US011684640B2

(12) United States Patent
Zitvogel et al.

(10) Patent No.: US 11,684,640 B2
(45) Date of Patent: Jun. 27, 2023

(54) MICROBIOTA COMPOSITION, AS A MARKER OF RESPONSIVENESS TO ANTI-PD1/PD-L1/PD-L2 ANTIBODIES AND USE OF MICROBIAL MODULATORS FOR IMPROVING THE EFFICACY OF AN ANTI-PD1/PD-L1/PD-L2 AB-BASED

(71) Applicants: INSTITUT GUSTAVE ROUSSY, Villejuif (FR); INSTITUT NATIONAL DE LA SANTE ET DE LA RECHERCHE MEDICALE-INSERM, Paris (FR); UNIVERSITE PARIS-SACLAY, Gif-sur-Yvette (FR); Institut national de recherche pour l'agriculture, l'alimentation et l'environnement (INRAE), Paris (FR)

(72) Inventors: Laurence Zitvogel, Paris (FR); Bertrand Routy, Paris (FR); Emmanuelle Le Chatelier, Magny les Hameaux (FR)

(73) Assignees: INSTITUT GUSTAVE ROUSSY, Villejuif (FR); INSTITUT NATIONAL DE LA SANTE ET DE LA RECHERCHE MEDICALE - INSERM, Paris (FR); UNIVERSITE PARIS-SACLAY, Gif-sur-Yvette (FR); Insitut national de recherche pour l'agriculture, l'alimentation et l'environnement (INRAE), Paris (FR)

( * ) Notice: Subject to any disclaimer, the term of this patent is extended or adjusted under 35 U.S.C. 154(b) by 97 days.

(21) Appl. No.: 16/472,778

(22) PCT Filed: Dec. 22, 2017

(86) PCT No.: PCT/EP2017/084552
§ 371 (c)(1),
(2) Date: Jun. 21, 2019

(87) PCT Pub. No.: WO2018/115519
PCT Pub. Date: Jun. 28, 2018

(65) Prior Publication Data
US 2021/0346438 A1 Nov. 11, 2021

(30) Foreign Application Priority Data

Dec. 22, 2016 (EP) ...................................... 16306779
Feb. 24, 2017 (EP) ...................................... 17305206

(51) Int. Cl.
| | | |
|---|---|---|
| A61K 35/744 | (2015.01) | |
| A61K 39/395 | (2006.01) | |
| C12Q 1/6886 | (2018.01) | |
| C12Q 1/689 | (2018.01) | |
| A61K 39/00 | (2006.01) | |

(52) U.S. Cl.
CPC ...... *A61K 35/744* (2013.01); *A61K 39/39558* (2013.01); *C12Q 1/689* (2013.01); *C12Q 1/6886* (2013.01); *A61K 2039/55594* (2013.01); *A61K 2039/585* (2013.01); *C12Q 2600/106* (2013.01); *C12Q 2600/118* (2013.01)

(58) Field of Classification Search
CPC ............ A61K 35/744; A61K 39/39558; A61K 2039/55594; A61K 2039/585; C12Q 1/6886; C12Q 1/689; C12Q 2600/106; C12Q 2600/118
See application file for complete search history.

(56) References Cited

FOREIGN PATENT DOCUMENTS

| | | |
|---|---|---|
| WO | 2015/075688 A1 | 5/2015 |
| WO | 2016/063263 A2 | 4/2016 |
| WO | 2016/086210 A1 | 6/2016 |
| WO | 2016/196605 A1 | 12/2016 |

OTHER PUBLICATIONS

Sivan et al. Commensal Bifidobacterium promotes antitumor immunity and facilitates anti-PD-L1 efficacy. Science, 2015, 350(6264), 1084-1089.
Vetizou et al. Anticancer immunotherapy by CTLA-4 blockade relies on the gut microbiota. Science, 2015, 350 (6264), 1079-1084.

*Primary Examiner* — Robert A Zeman
(74) *Attorney, Agent, or Firm* — Arrigo, Lee, Guttman & Mouta-Bellum LLP

(57) ABSTRACT

The invention relates to gut microbiota profiles associated with response or resistance to treatments with ICB, in particular with anti-PD1 or anti PD-L1 or anti-PD-L2 antibodies. In particular, the invention pertains to a theranostic method for identifying good responders, to whom an anti-PD1 or anti PD-L1 or anti-PD-L2 can be administered, while a pre-treatment based on FMT and/or immunogenic probiotics is recommended to bad responders exhibiting a dysbiosis. In particular, the present invention pertains to *Akkermansia muciniphila* as the main commensal species distinguishing responders from progressors and its use alone or with *E. hirae* for the treatment of antibiotics or gut repertoire insufficiency-associated dysbiosis.

4 Claims, 57 Drawing Sheets
Specification includes a Sequence Listing.

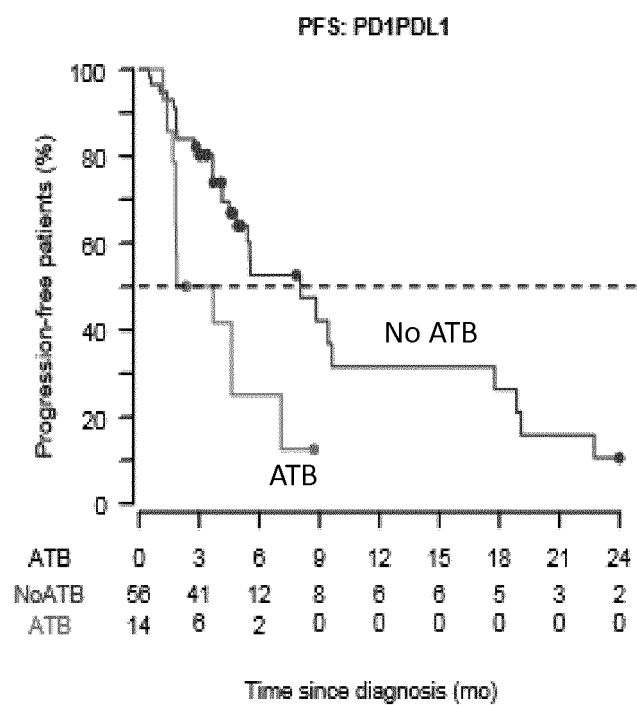
A
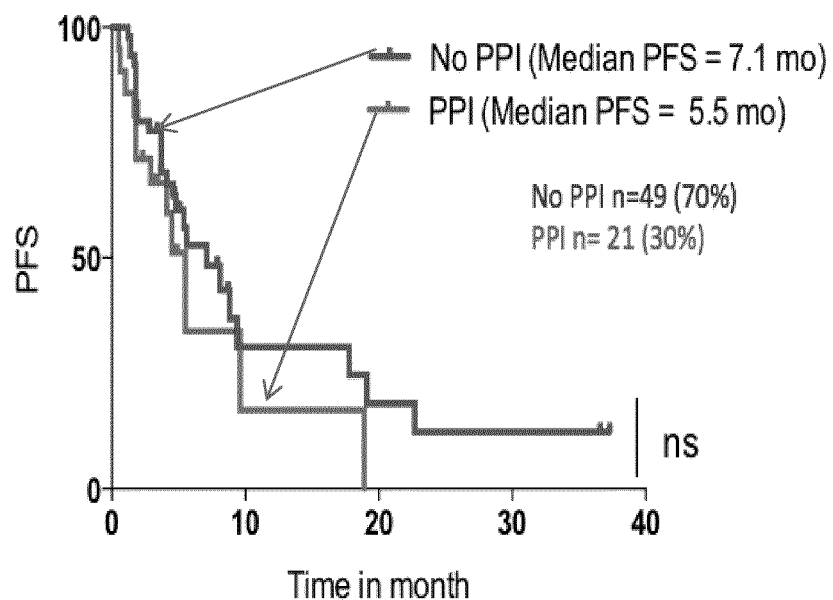
B
Figure 1

Figure 7

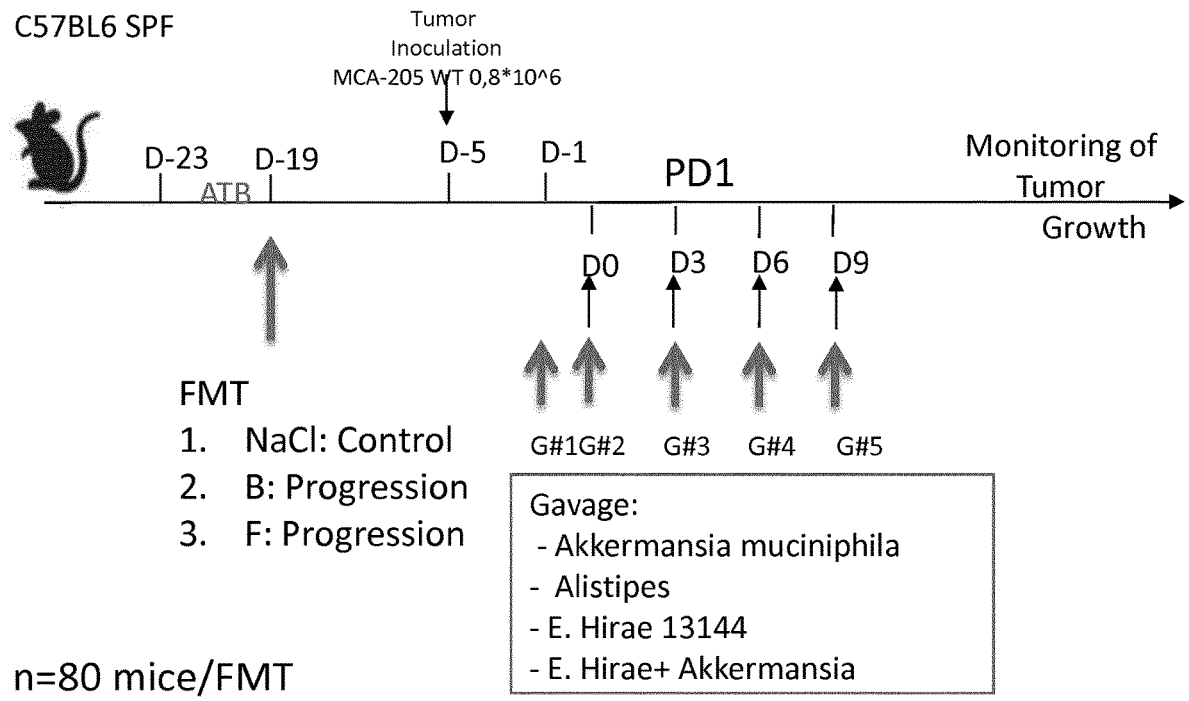
Figure 14
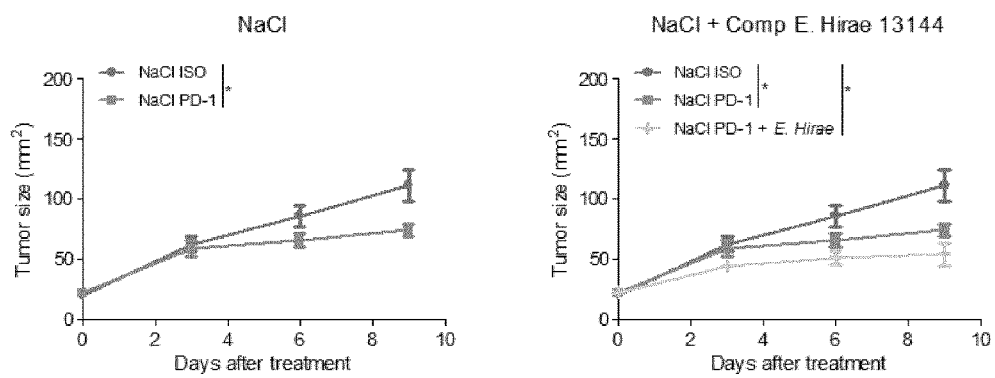
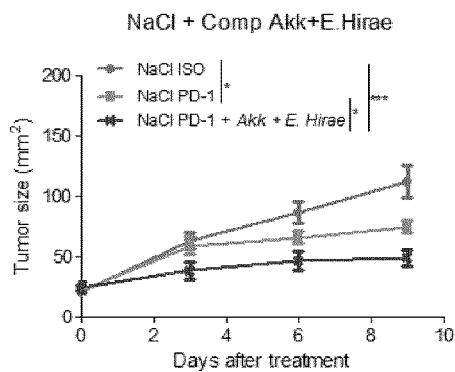
Figure 15

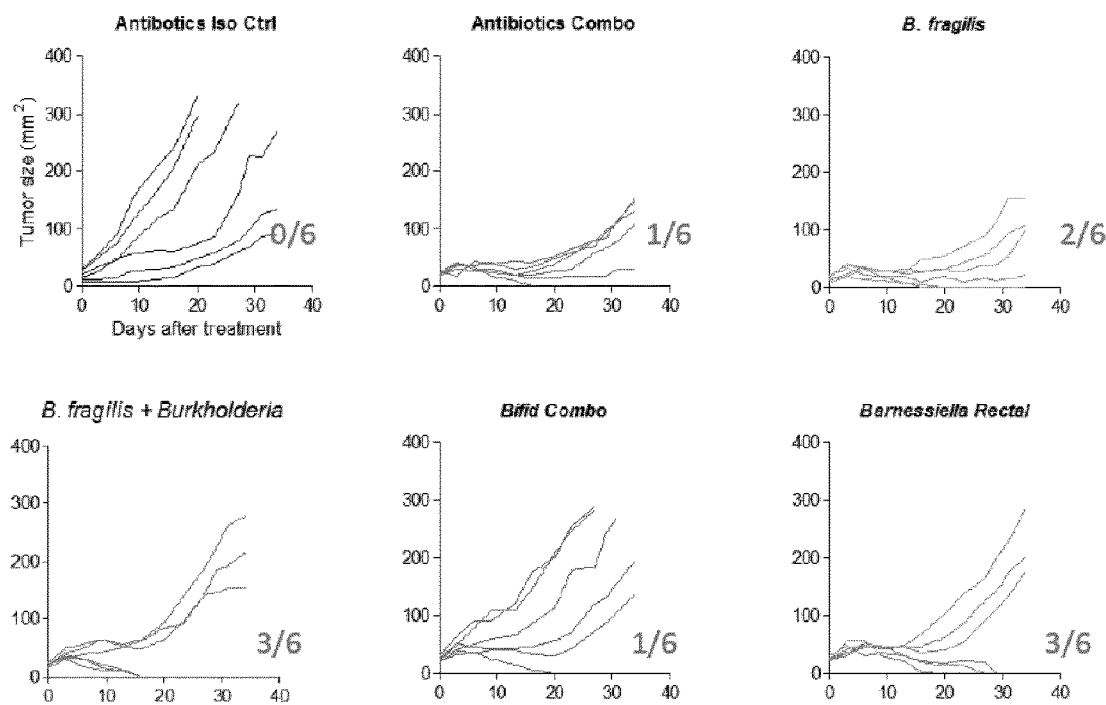
Figure 18
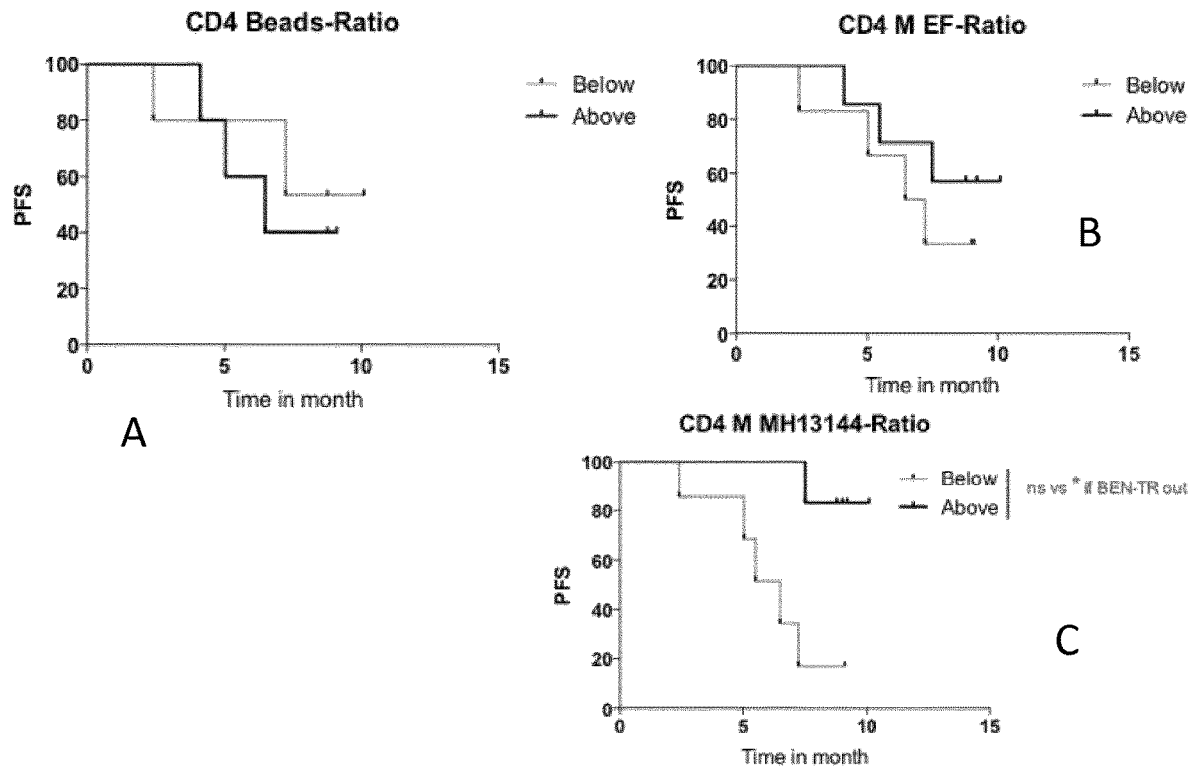
Figure 19 A-C

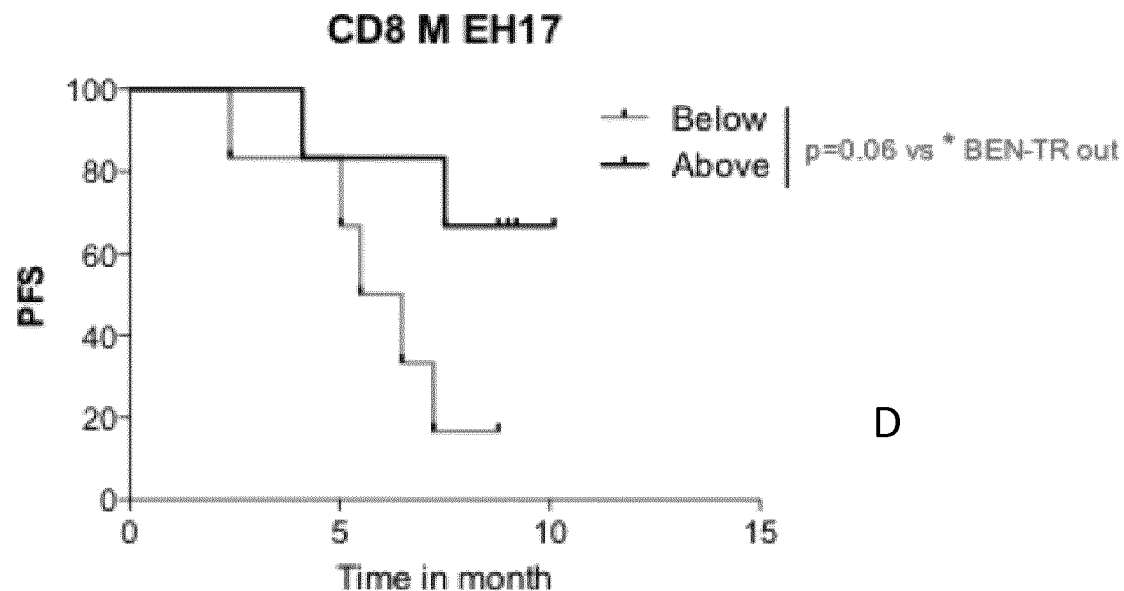
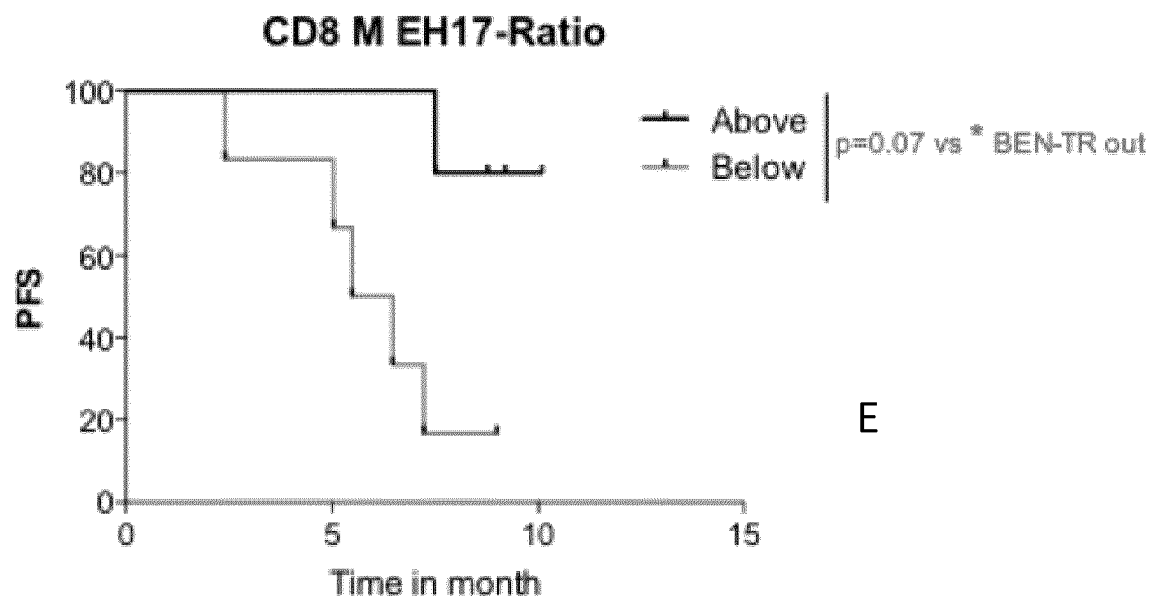
Figure 19 D-E

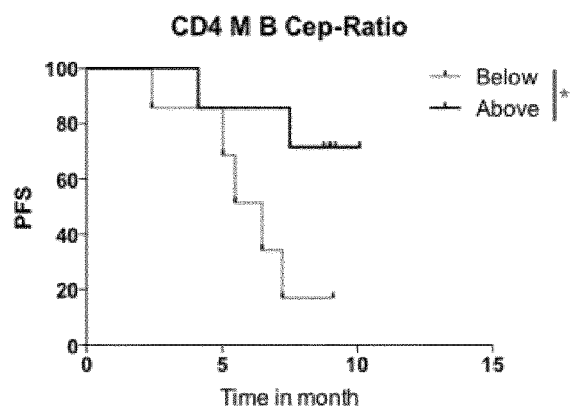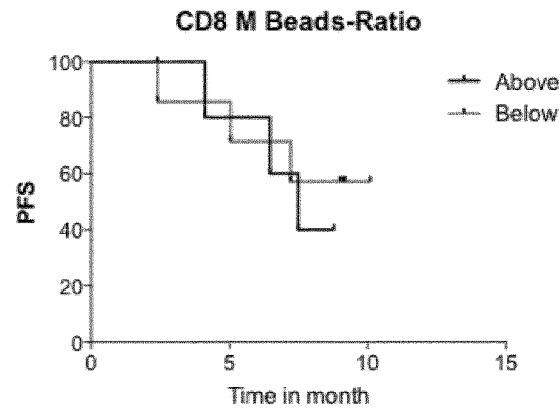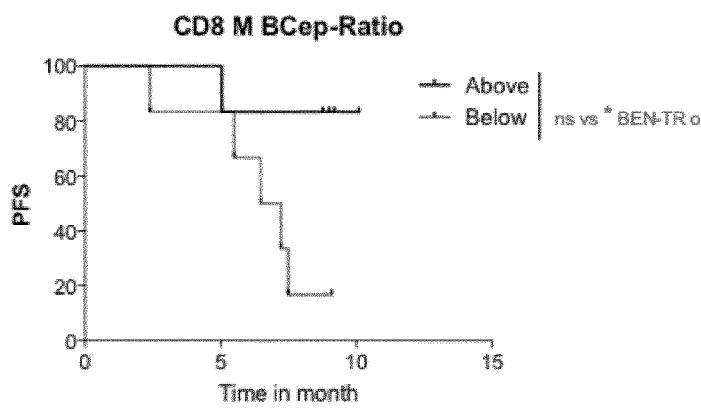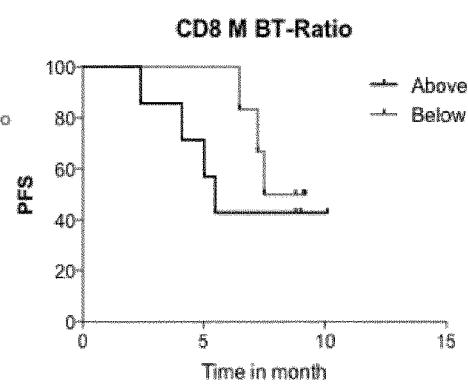
Figure 19 F-I

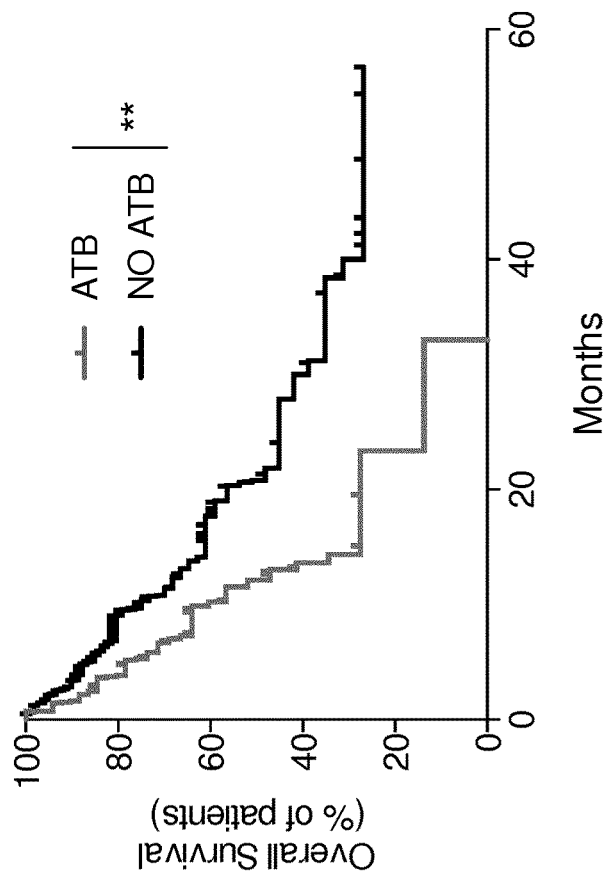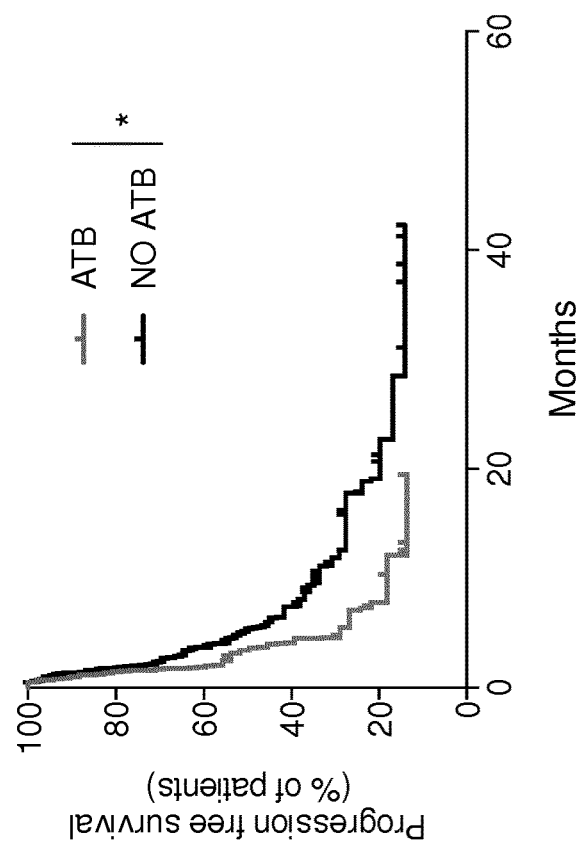
Figure 21

Figure 42A:
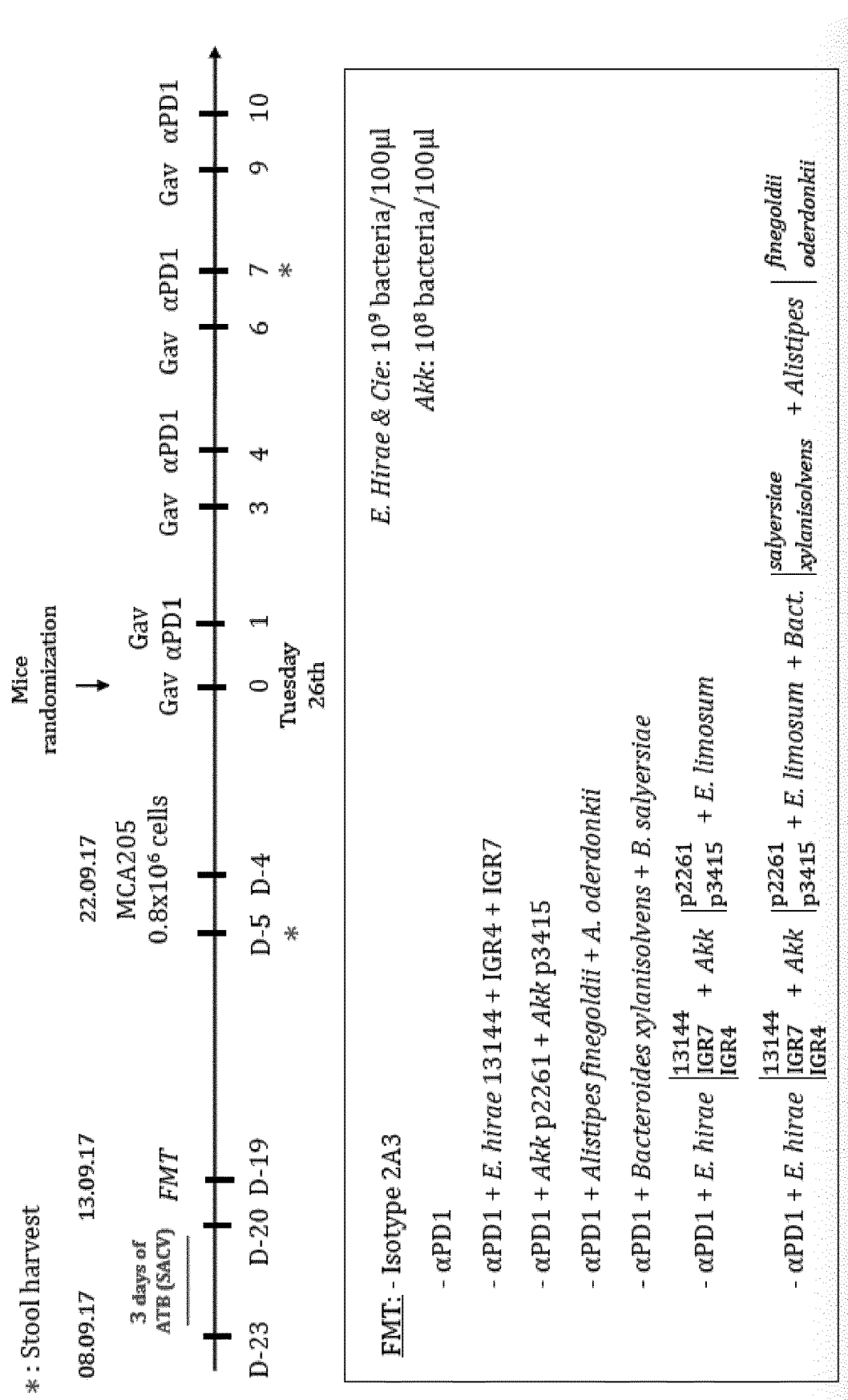

B.
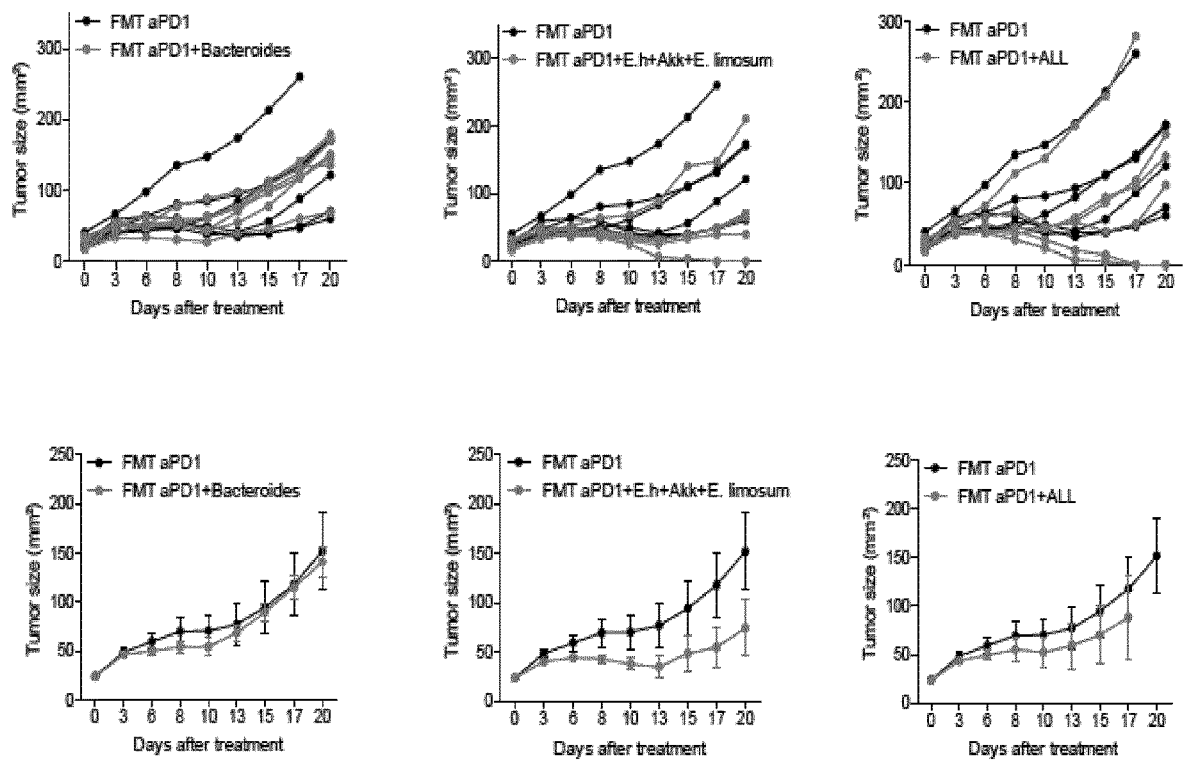
C.
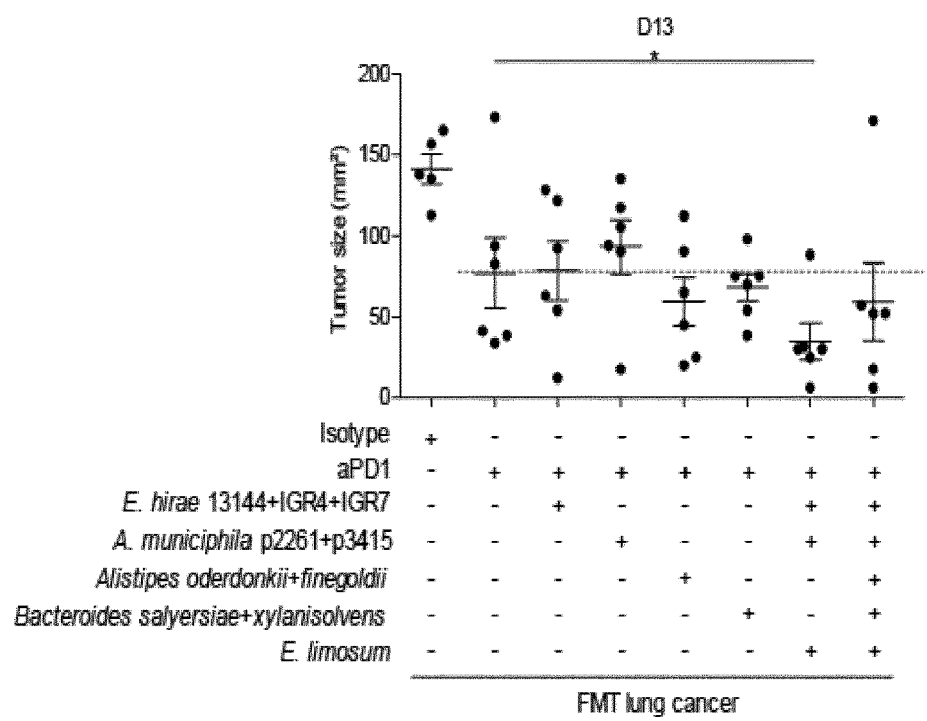
Figure 42B-C

R: compensation from responding patient

MICROBIOTA COMPOSITION, AS A MARKER OF RESPONSIVENESS TO ANTI-PD1/PD-L1/PD-L2 ANTIBODIES AND USE OF MICROBIAL MODULATORS FOR IMPROVING THE EFFICACY OF AN ANTI-PD1/PD-L1/PD-L2 AB-BASED

SEQUENCE LISTING

The instant application contains a Sequence Listing which has been filed electronically in ASCII format and is hereby incorporated by reference in its entirety. Said ASCII copy, created on May 18, 2021, is named 1018_007-US1_SL.txt and is 6,554,582 bytes in size.

FIELD OF THE INVENTION

The present invention relates to the field of anticancer treatment. In particular, the present invention concerns the role of the gut microbiota in the efficacy of cancer treatments and provides methods for determining if a patient is likely to benefit from a cancer treatment, more precisely, treatment comprising administration of an antibody directed against immune checkpoint blockers PD1, PD-L1 or PD-L2 alone or together with CTLA4. The present invention also provides probiotics to improve the efficacy of such a treatment in patients in need thereof.

BACKGROUND AND PRIOR ART

The gastrointestinal tract represents the largest compartment of the immune system. It is exposed to food, commensal antigens, and is the portal of entry for many pathogens. One hundred trillion organisms (mainly bacteria, phages but also archae, fungi and parasites) collectively referred to as the gut microbiota colonize the human intestine (Hugon et al., 2016). The intestinal microbiota comprises microbial populations that colonize the human gastrointestinal tract at increasing densities (from the top to bottom) and has been shown to play a crucial role in human health (Blaser, 2016; Gensollen et al., 2016). Indeed, the gut microbiota exerts a myriad of fundamental functions, such as the degradation of nutrients to provide energy source, the elimination of xenobiotics, the education of the immune system, the growth and terminal differentiation of epithelial cells, the intestinal peristalsis, and the production of antimicrobial peptides to eradicate pathogens and ensure colonization resistance (Goodrich et al., 2016; Rooks and Garrett, 2016).

Studies on human gut microbiome have revealed that healthy individuals harbor diverse microbial populations and that the composition of the intestinal microbiota differs from individual to individual, which can have implications in health and disease. The majority of bacterial taxa belong to the *Firmicutes* and *Bacteroidetes* phyla and bacteria belonging to the *Actinobacteria, Proteobacteria, Verrucomicrobia*, and *Fusobacteria* are also represented. Our knowledge of the genetic and functional diversity in gut microbes is far from being complete. Old bacterial identification methods consisting in qPCR or FISH analyses were neither comprehensive, specific nor sensitive enough. The burst of recent knowledge emerged from the targeted 16S rRNA gene analysis and far beyond by metagenomic shotgun sequencing, a costly method with heavy data mining (Nielsen et al., 2014) as it allows to identify all the microbial species present (with known or unknown reference genome present in the databases) and their coding capacities. Catalogs of reference genes in the human gut microbiome have been reported, gathering data from MetaHIT, Human Microbiome Project HMP and a large Chinese diabetes study, as well as >3400 sequenced prokaryotic genomes regarded as potentially of human gut origin. This nonredundant reference catalog of 9,879,896 genes is accessible for free through the internet (Integrated Reference Catalog of the Human Gut Microbiome) and the data are available on the GigaScience Database (Li et al., 2014). We may have reached saturated coverage of core gene content and functions. Of note, the number of genes present in more than 50% of the subjects remained below 300,000, pointing out the dominance of individual-specific genes. The individual-specific genes are enriched in the categories cell wall/membrane/envelope biogenesis and DNA replication, recombination and repair. The common genes are enriched in functions such as signal transduction mechanism, energy production, carbohydrate transport and metabolism, and amino acid transport and metabolism.

Perturbations of the symbiosis between the gut microbiome, the intestinal epithelium, and the host immune system are associated with various immunopathologies and chronic inflammation, including cancer. Hence, the composition of the intestinal microbiota has been associated with malnutrition, obesity, and chronic inflammatory disorders such as NASH and IBD (Pigneur and Sokol, 2016; Raoult, 2016). It has become evident that the intestinal microbiota not only mediates resistance to colonization by pathogens but also modulates immune function by promoting differentiation of different T-cell phenotypes, which may account for autoimmune or atopic disorders such as rheumatoid arthritis and asthma (Arrieta et al., 2015). Previous studies from Zitvogel's group have indicated that the intestinal microbiota can influence the immune response to systemic cancer chemotherapy and disruption of the intestinal microbiome was associated with resistance to cancer therapy (Viaud et al., 2013; WO 2015/075688). Pamer et al. also reported that graft-versus-host disease and graft-versus leukemia effects during allogeneic hematopoietic stem cell transplantation were associated with variegated composition of the intestinal microflora with causative links between both (Shono et al., 2016; Taur et al., 2015).

Lung cancer (LC) remains the most common cause of death from any cancer, estimated to be responsible for nearly 1.6 million deaths worldwide and around 30000 deaths in France each year (Fidler et al., 2016). This disease condemns the young, striking at a median age of 50-55 and standing among "unmet medical needs". In the past decade, progress in tumor biology, genomics technology, computational analysis and drug discovery has propelled advances in translational and clinical cancer research in LC. LC became the prototype for tailored targeted therapies, especially immunotherapies using Immune Checkpoint Blockers (ICB) such as monoclonal antibodies (mAb) directed against CTLA-4 and PD1/PD-L1 targeting T cell inhibitory receptors or ligands (Garon, 2015). Two mAb blocking PD1 receptors (Nivolumab and Pembrolizumab) and three mAb neutralizing PD1 ligands (PD-L1) (Atezolizumab, Durvalumab, and Avelumab) have been investigated in Phase I trials. One Phase II trial in 117 squamous non small cell LC (NSCLC) showed that Nivolumab lead to 15% objective response rates, with a median time to response of 3.3 months (Rizvi et al., 2015), while two seminal Phase III randomized trials, in cisplatinum-resistant squamous (SQ) and non-squamous (NSQ) NSCLC patients, also demonstrated a benefit in overall survival (OS) in the Nivolumab arm compared to Docetaxel in second line (for SQ: median OS=9.2 months versus 6 months, for NSQ: OS rate at 18 months=39% versus 23%). In March 2015, Nivolumab finally became the first checkpoint inhibitor approved in advanced SQ NSCLC who progressed during or after platinum-based chemotherapy. A first limit of those innovative and costly treatments is a relatively low and unpredictable efficacy. Only few parameters such as positive expression of PD-L1 on lung cancer cells (about 25% cases) as well as a high mutational load of LC appear to be linked with a high response rate to anti-PD1 mAb. Secondly, severe adverse events are usually observed (fatigue (4%), pneumonitis (3%) and diarrhea (3%)). Although co-blockade of both CTLA-4 and PD1 markedly augments objective response yields, these associations result in higher toxicities, especially immune-related adverse events (irAEs) at sites that are exposed to commensal microbiota, e.g the gut (Berman et al., 2010). IrAEs can be of grade III-IV in 20% cases, life threatening in nearly 5% cases, thereby causing premature interruption of the therapy (Champiat et al., 2016). Importantly, although characterized by low regulatory Treg numbers and specific genetic traits, to date irAEs cannot be effectively predicted nor prevented. However, patients develop antibodies to gut microbiome, suggesting that intestinal commensals or bacterial antigens may contribute to those irAEs.

Therefore, predicting primary resistance to ICB and uncoupling ICB efficacy from gut toxicity represents an unmet medical need challenging the future development of immune checkpoint blockers for the treatment of LC (or any other cancers such as renal cell cancers, head and neck tumors, bladder carcinoma, and all tumors amenable to anti-PD1/PD-L1 antibodies or combinations with chemotherapy).

Zitvogel et al. explored how cancer therapeutics (cytotoxicants and ICB) alter such a mutualist symbiosis. Three years ago, Zitvogel's group and others reported the crucial role of gut microbiota in eliciting innate and adaptive immune responses beneficial for the host in the context of effective therapies against cancer (such as cyclophosphamide, platinum salts) (Pitt et al., 2016; Viaud et al., 2013; WO 2015/075688; WO 2016/063263). By compromising intestinal integrity, chemotherapeutic agents enhance gut permeability, favoring the selective translocation of distinct immunogenic bacteria (namely *E. hirae*), inducing dramatic changes in the tumor microenvironment (myeloid cell oxidoreduction and accumulation of effector TH1 cells). Moreover, ICB and immunomodulators (anti-IL-10R, TLR9L) also affect the delicate symbiosis of the gut mucosa, favoring the emergence of distinct bacterial species favorably affecting the microenvironmental tone of the tumor. In fact, Zitvogel's group worked on the first-in-class immune checkpoint blocker, anti-CTLA-4 Ab/ipilimumab, showing the mandatory role of microbiota (*Bacteroidales* and *Burkholderiales*) in its antitumor immune and clinical effects and the prophylactic role of such commensals against subclinical colitis in mice (Vetizou et al., 2015; WO 2016/063263). In parallel, Gajewski's group demonstrated the role of *Bifidobacterium* in maturing intratumoral dendritic cells allowing the expansion of anti-cancer T cells in the tumor beds and their activation with anti-PD-L1 Ab (Sivan et al., 2015). In all these model systems, investigators show that ICB fail to mediate antitumor effects in germ free mice or after administration of broad-spectrum antibiotics in rodents reared in specific pathogen free conditions. Therefore, a better understanding of mucosal immunity and the immunological, epithelial, microbial cross-talk at portals of entry during ICB therapy of lung cancer may open up new avenues to explain the resistance of cancer patients to ICB or chemotherapy.

In the experimental data disclosed below, the inventors showed that antibiotics intake compromised the response of individuals diagnosed with advanced cancers to PD1/PD-L1 blockade and then, identified a typical cancer-associated microbial fingerprint of the intestinal content in cancers such as lung or renal cell carcinoma, called "dysbiosis" found associated with dismal prognosis. This prognosis can be improved by allogenic fecal microbial transplantation (FMT) of feces from healthy individuals, or by administration of probiotic compositions such as a composition of bacteria selected amongst *Enterococcus hirae, Akkermansia muciniphila, Alistipes*, as well as *Bifidobacterium adolescentis, Clostridiales* spp., *Roseburia, Blautia, Faecalibacterium, Ruminococcaceae, Christensenella minuta, Eubacterium limosum* and/or immunogenic bacteria selected amongst *Methanobrevibacter smithii, Barnesiella intestinihominis, Bacteroides fragilis, Collinsella intestinalis, Dielma fastidiosa, Flavonifractor plautii, Actinotignum schalii* and *Burkholderia cepacia*.

The inventors also identified gut microbiota profiles associated with response or resistance to treatments with ICB, in particular with anti-PD1 or anti-PD-L1 or anti-PD-L2 antibodies, as well as associated blood profiles. As a result, they propose a theranostic method for identifying good responders, to whom an anti-PD1 or anti-PD-L1 or anti-PD-L2 antibodies can be administered, while a pre-treatment based on FMT and/or probiotics is recommended to bad responders exhibiting a dysbiosis.

SUMMARY OF THE INVENTION

The invention pertains to probiotic compositions designed to improve the response to an anti-PD1/PD-L1/PD-L2 Ab-based therapy, for a patient in need thereof. A probiotic composition according to the invention comprises bacteria selected from the group consisting of one or several isolates of *Enterococcus hirae, Akkermansia muciniphila, Alistipes shahii*, other *Alistipes* species such as *Alistipes indistinctus* and mixtures thereof.

According to one embodiment, the composition comprises at least two, at least three, at least four or at least five bacterial species selected from the group consisting of *Firmicutes* species, *Clostridiales* species, *Alistipes* species, *Eubacterium* species, *Bacteroidales* species, *Methanobrevibacter smithii, Akkermansia muciniphila* and *Enterococcus hirae*. A particular composition which can be used, according to the invention, to induce immunostimulation in a cancer patient receiving an anti-PD1/PD-L1/PD-L2 Ab-based therapy, is a bacterial composition comprising *Enterococcus hirae* and/or *Akkermansia muciniphila* and/or *Alistipes*.

According to one embodiment, the composition comprises at least two, at least three, at least four or at least five bacterial species selected from the group consisting of *Enterococcus hirae, Akkermansia muciniphila, Alistipes indistinctus, Eubacterium* species (such as *Eubacterium limosum*), *Firmicutes* species (such as *Christensenella minuta, Dielma fastidiosa*), *Bacteroidesia* (such as *Bacteroides fragilis, Bacteroides salyersae, Barnesiella intestinihominis*), *Actinobacteria* (such as *Collinsella intestinalis, Collinsella tanakaei, Actinotignum schaalii*) and the archae *Methanobrevibacter smithii*.

A particular composition which can be used, according to the invention, to induce immunostimulation in a cancer patient receiving an anti-PD1/PD-L1/PD-L2 Ab-based therapy, is a bacterial composition comprising *Enterococcus hirae* and/or *Akkermansia muciniphila* and/or *Alistipes*.

According to another aspect, the present invention pertains to an in vitro theranostic method of determining if a cancer patient is likely to be a good responder to an anti-PD1/PD-L1/PD-L2 Ab-based therapy, comprising:
(i) assessing, in a feces sample from said patient, the relative abundance of at least 10 microorganism species selected from the microorganism species disclosed in Table 1 and Table 2;
(ii) for each microorganism, comparing the relative abundance measured in step (i) to a predetermined threshold,
wherein over-representation of microorganism species disclosed in Table 1 (below) and under-representation of microorganism species disclosed in Table 2 (below) are indicative that the patient is likely to be a good responder to the anti-PD1/PD-L1/PD-L2 Ab-based therapy.

Tools designed to easily perform the above method are also part of the present invention, such as a nucleic acid microarray comprising nucleic acid probes specific for each of the microorganism species to be detected in step (i) of the method, and such as a set of primers comprising primer pairs for amplifying sequences specific for each of the microorganism species to be detected in step (i) of said method.

The present invention also relates to an immunogenic composition comprising fragments of bacteria selected from the group consisting of *Firmicutes* species, *Clostridiales* species, *Alistipes* species, *Eubacterium* species, *Bacteroidales* species, *Methanobrevibacter smithii*, *Akkermansia muciniphila* and *Enterococcus hirae* and mixtures thereof, for use as an adjuvant to an anti-PD1/PD-L1/PD-L2 Ab-based therapy administered to a cancer patient.

According to another important aspect, the present invention pertains to the use of an allogeneic normal volunteer or responding patient derived-fecal microbial composition, for treating a cancer in combination with an anti-PD1/PD-L1 Ab-based therapy. Fecal microbial transplantation (FMT) with such a composition is particularly useful for improving the response rate to anti-PD1/PD-L1/PD-L2 antibodies of patients being identified as poor responders by the theranostic method of the invention.

Theranostic methods for determining whether an individual needs a bacterial composition with a bacterial composition and/or by FMT before receiving an anti-PD1/PD-L1 Ab-based therapy are also part of the invention.

The present invention also pertains to a method for ex vivo determining whether a cancer patient is likely to benefit from a treatment with an anti-PD1/PD-L1/PD-L2 Ab-based therapy, comprising assessing the presence of memory Th1 or Tc1 cells towards *Burkholderia cepacia*, *Akkermansia muciniphila*, *Enterococcus hirae* and/or *Bacteroides fragilis* in a blood sample from said patient, wherein the presence of memory Th1 or Tc1 cells towards *Burkholderia cepacia*, *Akkermansia muciniphila* and *Enterococcus hirae* indicates that the patient is likely to be a good responder to said treatment, and the presence of memory Th1 cells towards *Bacteroides fragilis* indicates that the patient is likely to be a poor responder.

LEGENDS TO THE FIGURES

FIG. 1: Kaplan Meier progression-free survival (PFS) curves in renal cell cancer patients. 70 metastatic renal cell carcinoma patients treated with nivolumab (ICB), according to antibiotic (ATB, upper panel) or proton pump inhibitor (PPI, bottom panel) cotreatment (both taken within one to two months prior to the first injection of ICB and up to 1 month post-initiation of PD1/PD-L1 blockade).

Figure 2:
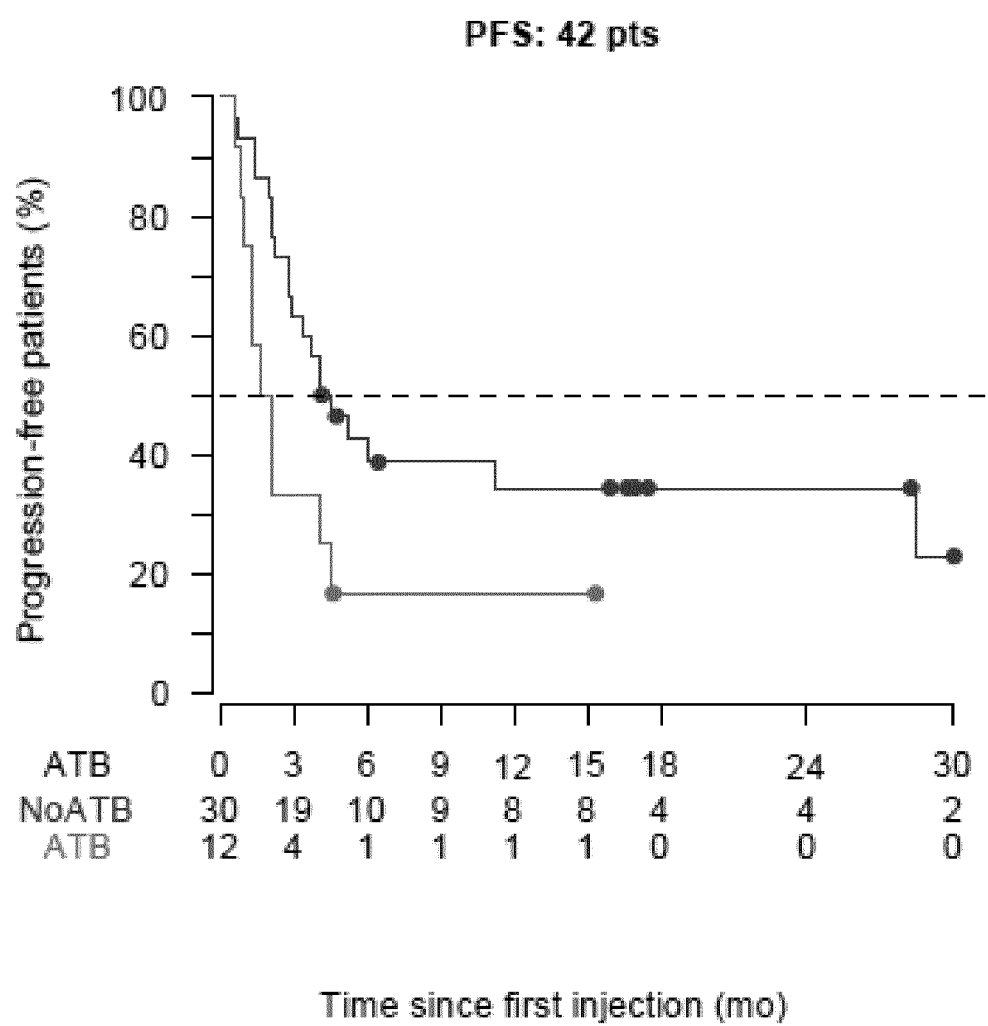

FIG. 2: Kaplan-Meier method to assess the PFS in patients in the ATB(+) group vs ATB (−) group in bladder cancer patients. 42 metastatic bladder urothelial cell carcinoma patients treated with anti-PD-L1 Ab (ICB) according to antibiotic (ATB) cotreatment (taken within one to two months prior to the first injection of ICB and up to 1 month post-initiation of PD-L1 blockade).

Figure 3:
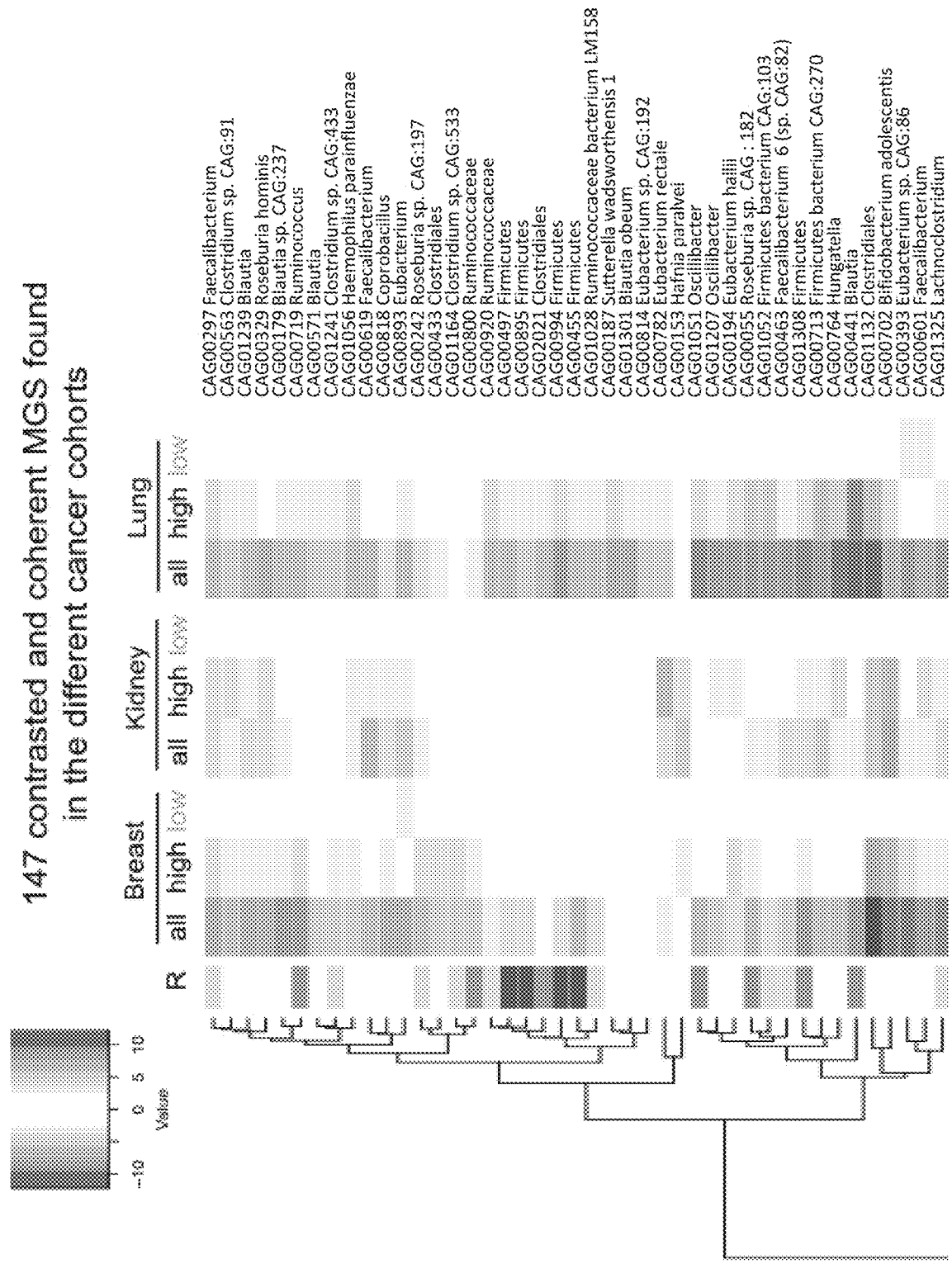
Figure 3:
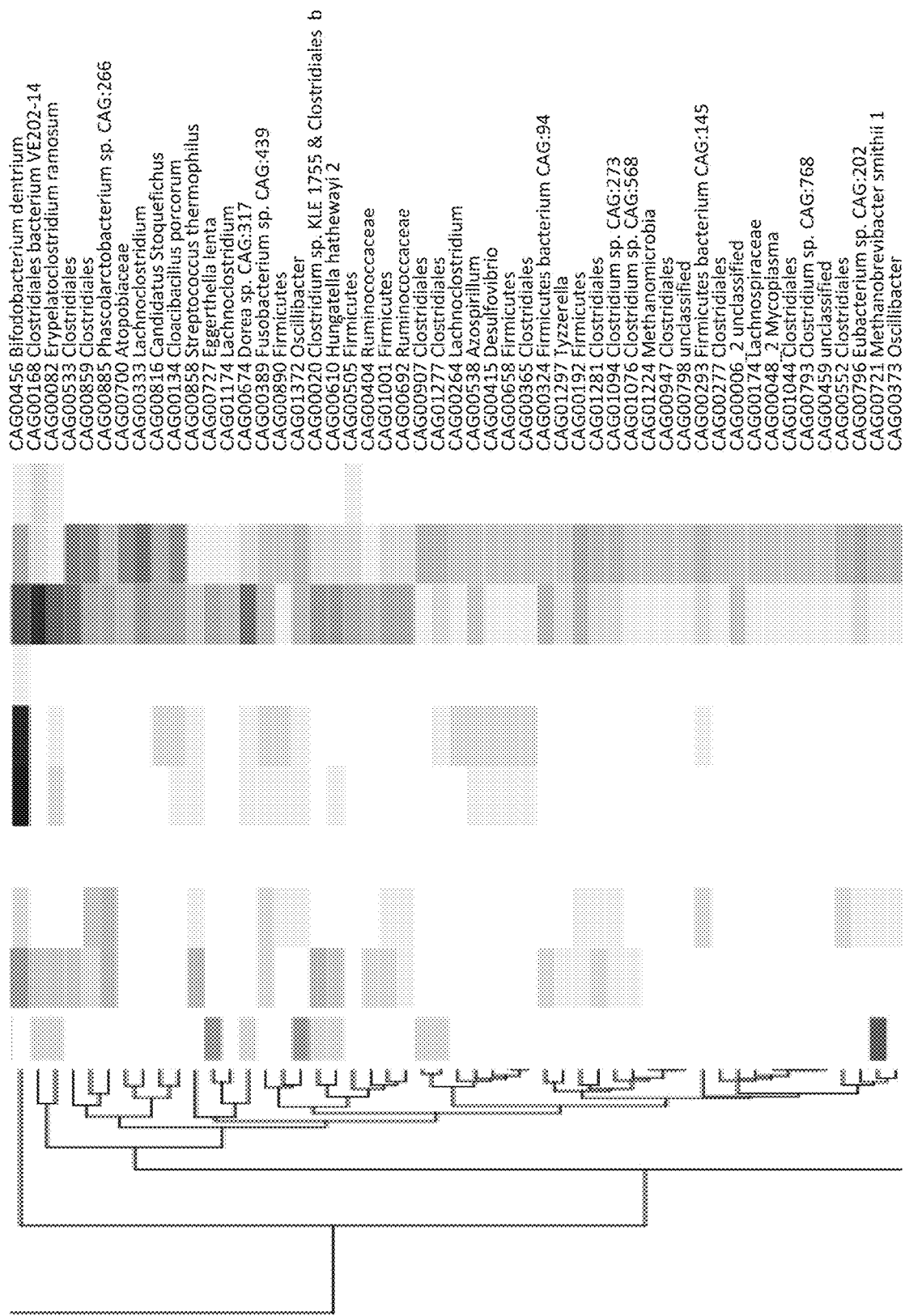
Figure 3:
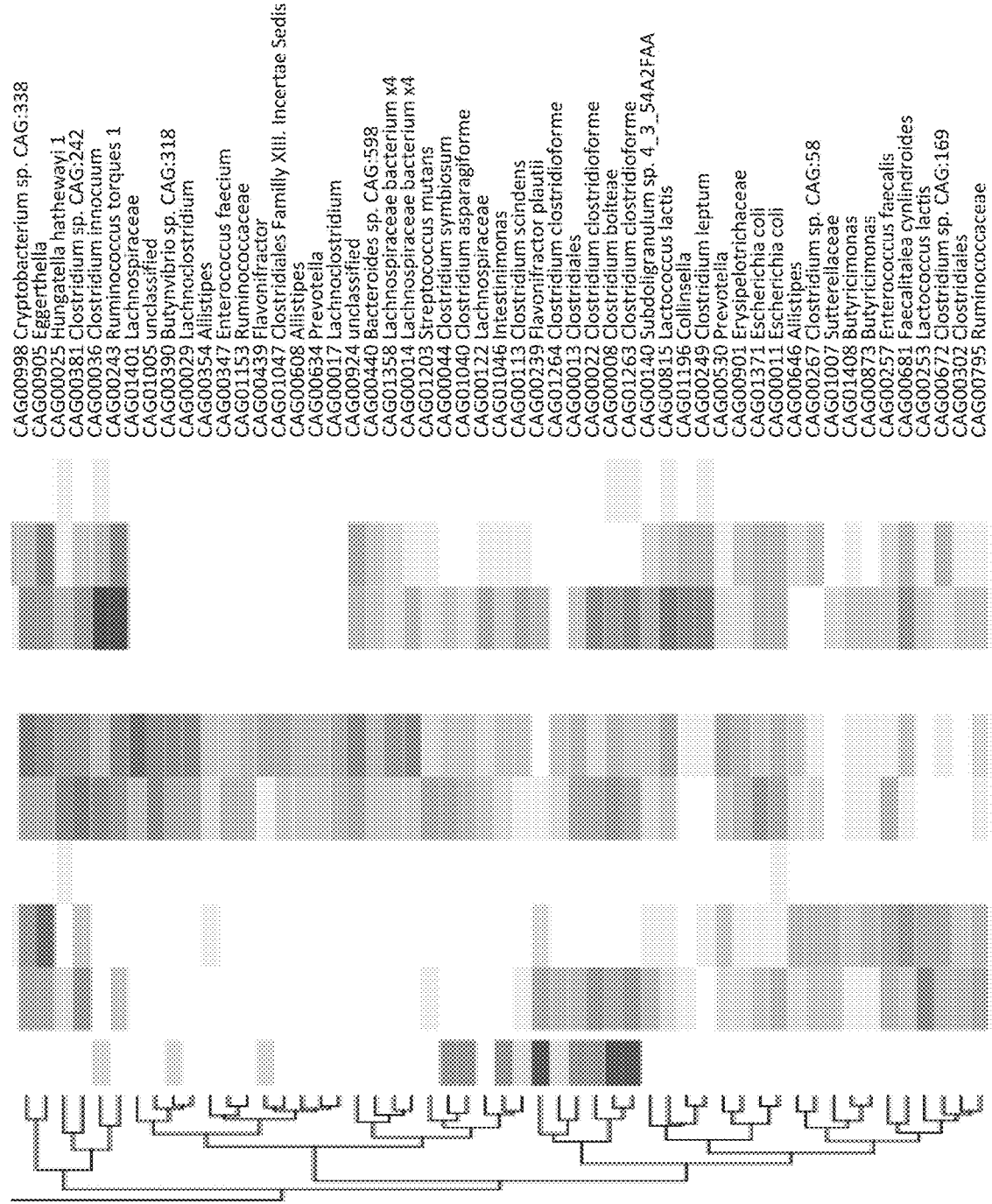

FIG. 3: Heatmap/hierarchical clustering of the 147 MGS contrasted in the cancer cohorts. Heatmap color code: Heatmap was performed after log 10 transformation of the p.value of the 147 MGS selected on the 3 cancer cohorts. To discreminate "cancer" species from "healthy" species, "healthy" values were reverse into positive values. Healthy species thus appear on the top and cancer species on the bottom. Row color code (column labeled R): colors indicates the High and Low richness MGS identified according to 387 control individuals, with no diagnosed cancer (spearman correlation |rho|>0.3, p.val <2e-05). A 3 color gradient code is used for |rho|>0.3, 0.4 and 0.5, dark colors indicating higher correlation. Cancer patients were diagnosed with either early breast, or metastatic lung or metastatic kidney cancer (3 cancer types).

Figure 4:
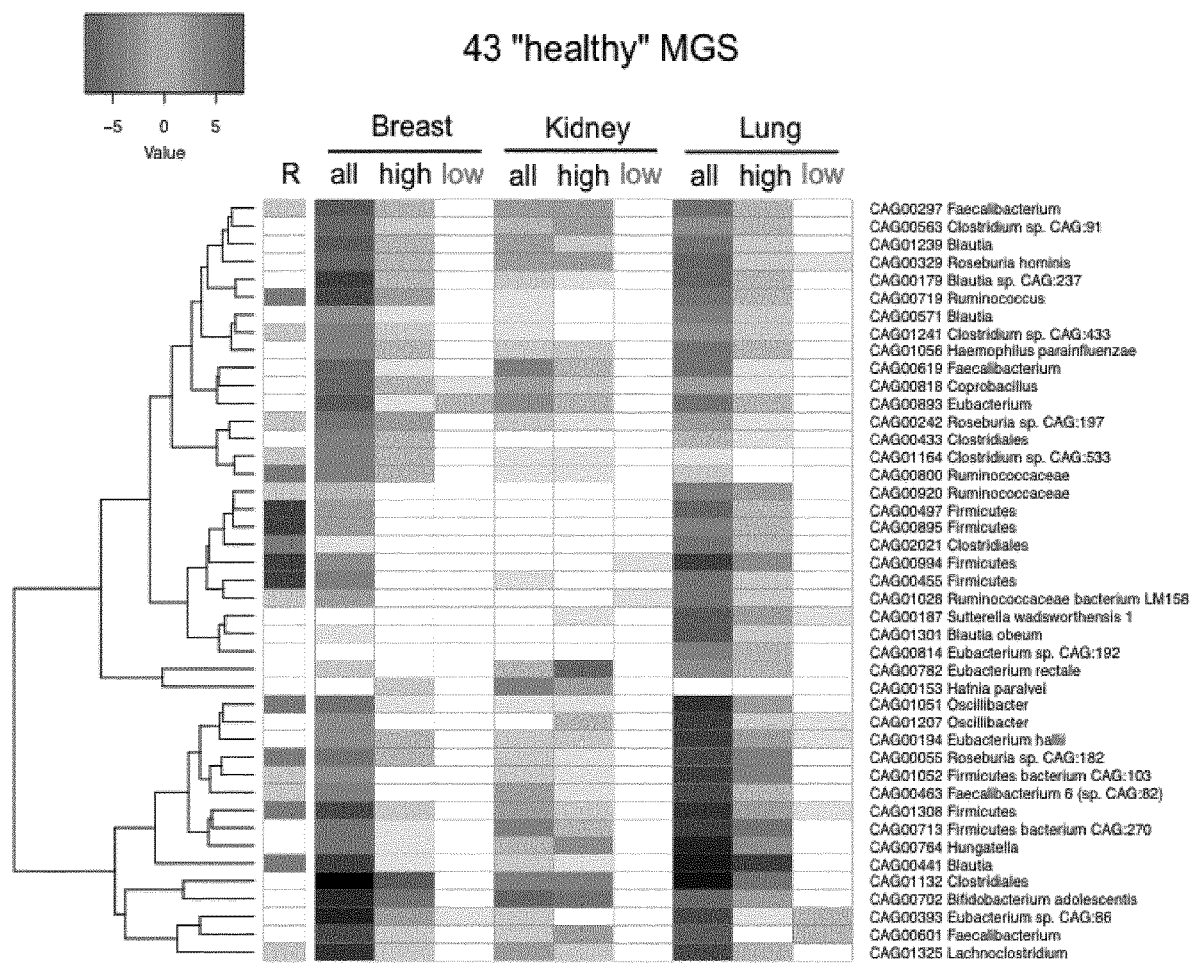

FIG. 4: Heatmap/hierarchical clustering of the 43 "healthy" species contrasted in the cancer cohorts. Extract from the heatmap shown in FIG. 3.

Figure 5:
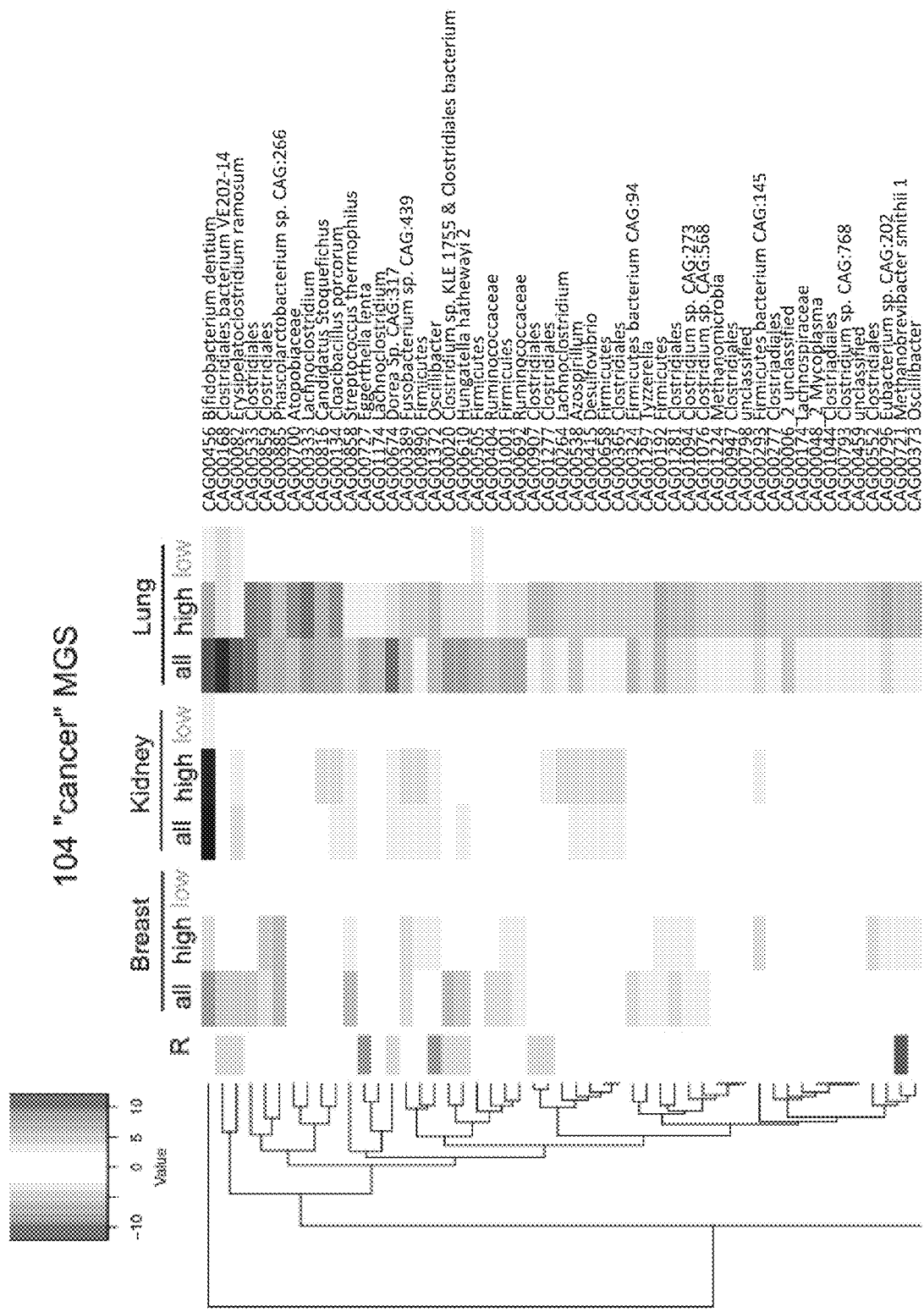
Figure 5:

FIG. 5: Heatmap/hierarchical clustering of the 104 "cancer" species contrasted in the cancer cohorts. Extract from the heatmap shown in FIG. 3.

Figure 6:
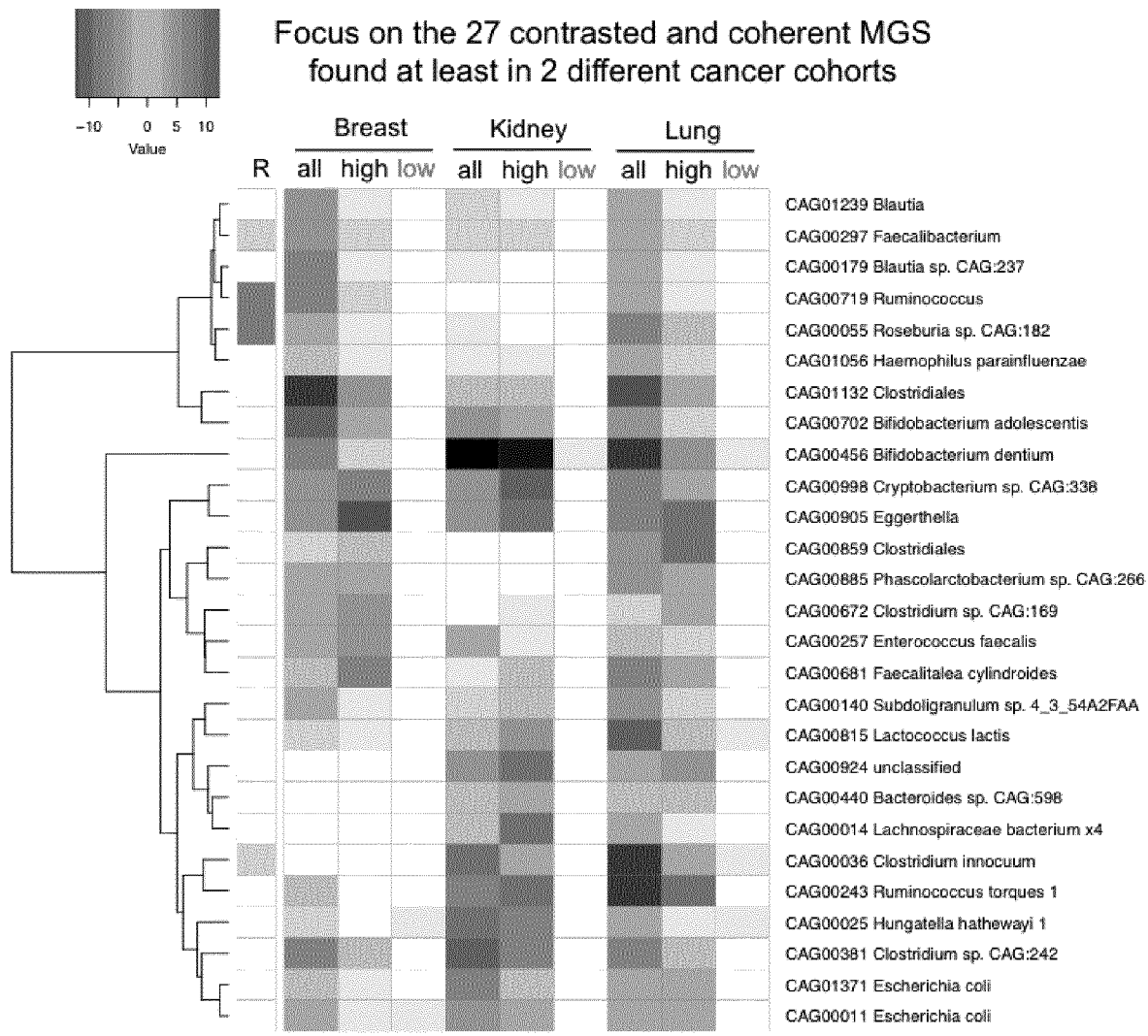

FIG. 6: Heatmap/hierarchical clustering of the 27 contrasted and coherent species at least in 2 different cancer cohorts (among the 3 cancer types).

Figure 7:
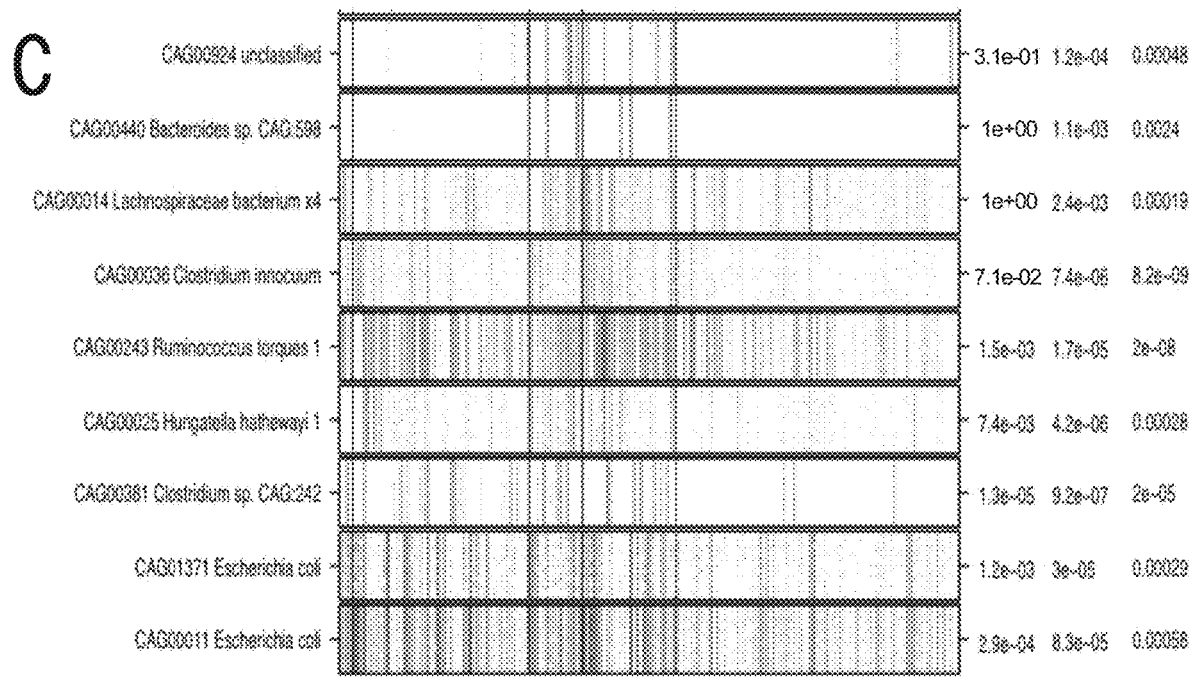

FIG. 7: Barcodes and p values of the MGS found contrasted between cancer patient cohorts (C) and healthy controls (H) (Gene counts (GC)*)

Figure 8:
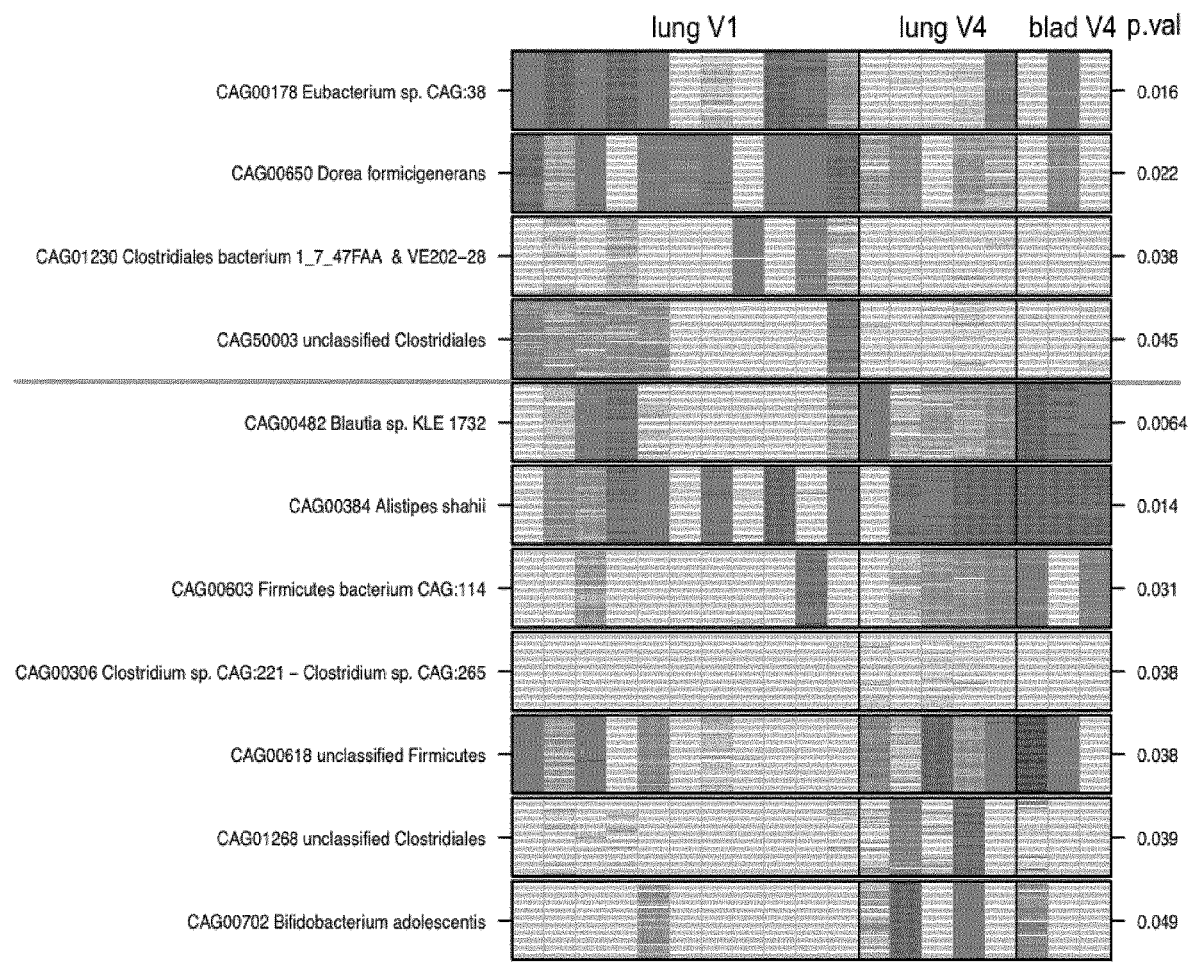

FIG. 8: Kinetics of MGS evolution during PD1 blockade. Barcodes of the MGS contrasted between lung cancer V1 (before commencement) and pooled lung+bladder V4 (at 6 months of therapy) patients during a therapy with anti-PD1/PDL1 Abs.

Figure 9:
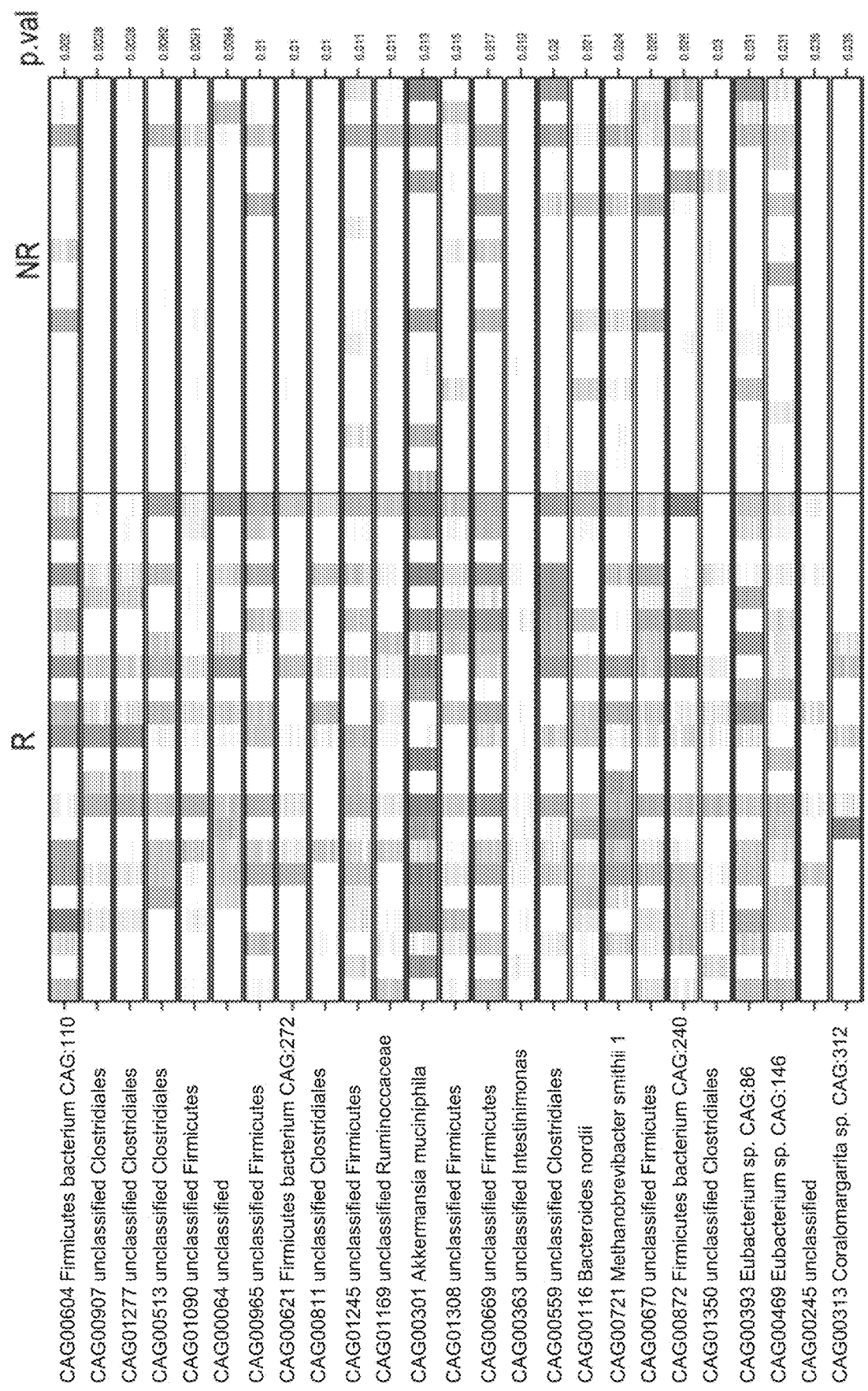
Figure 9:
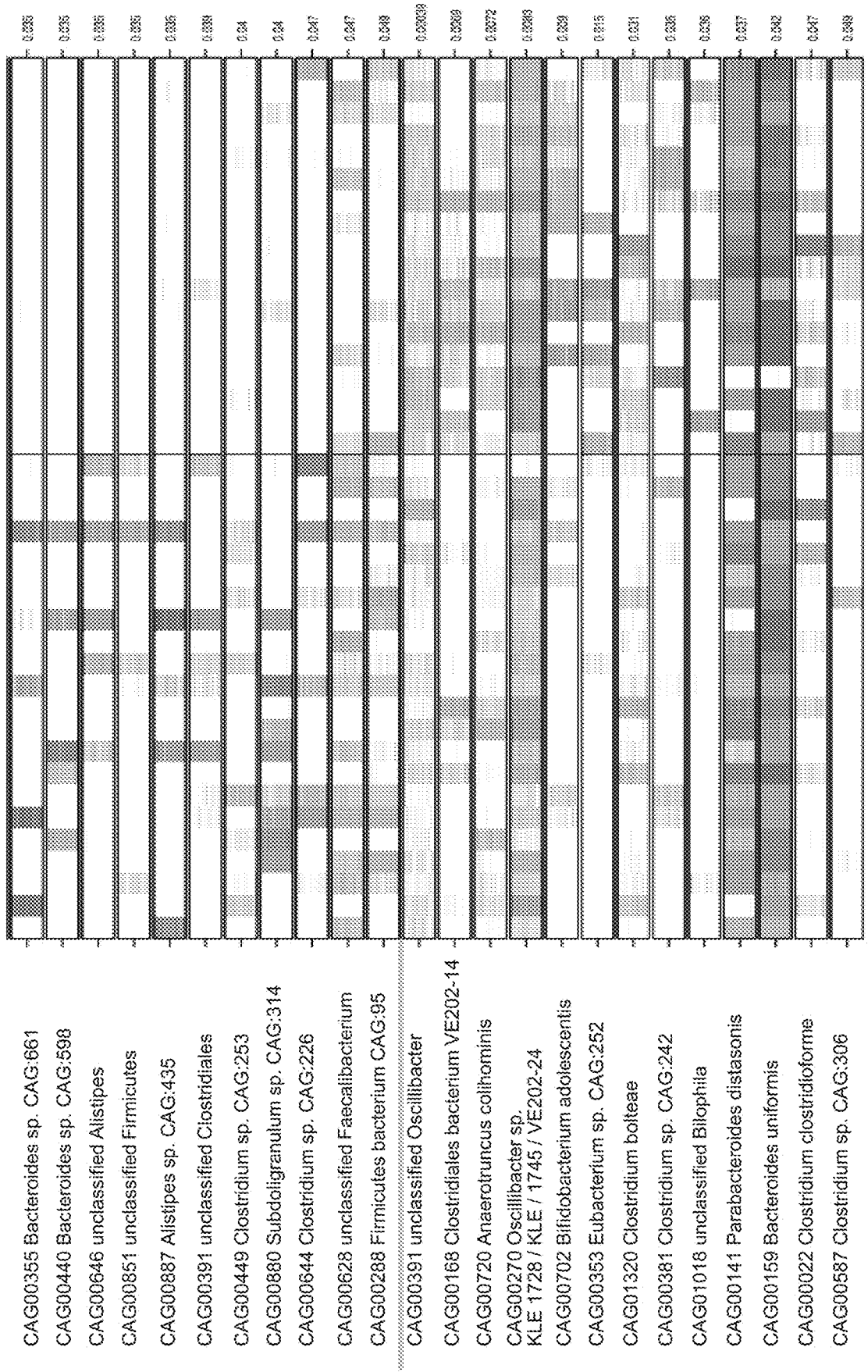

FIG. 9: Barcodes of the MGS contrasted between pooled lung+kidney R (responders)/NR (non responders) samples, regardless of antibiotics and at diagnosis (prior to therapy with anti-PD1 Abs)

Figure 10:
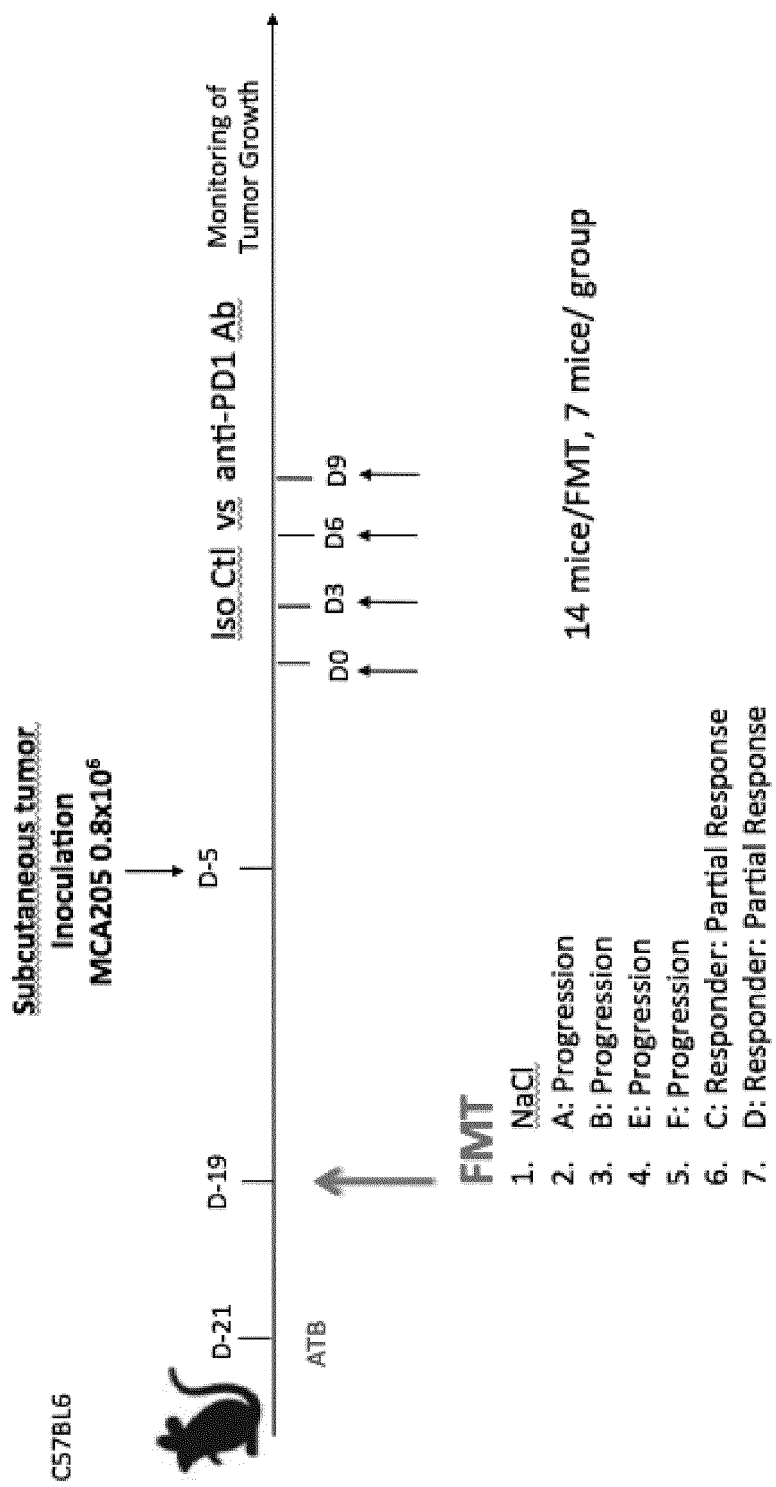

FIG. 10: Experimental setting of FMT transfer into ATB-treated tumor bearers (AVATAR mice) before PD1 blockade. FMT with lung cancer patients' feces was performed into ATB-treated mice bearing established MCA205 WT (2 experiments).

Figure 11:
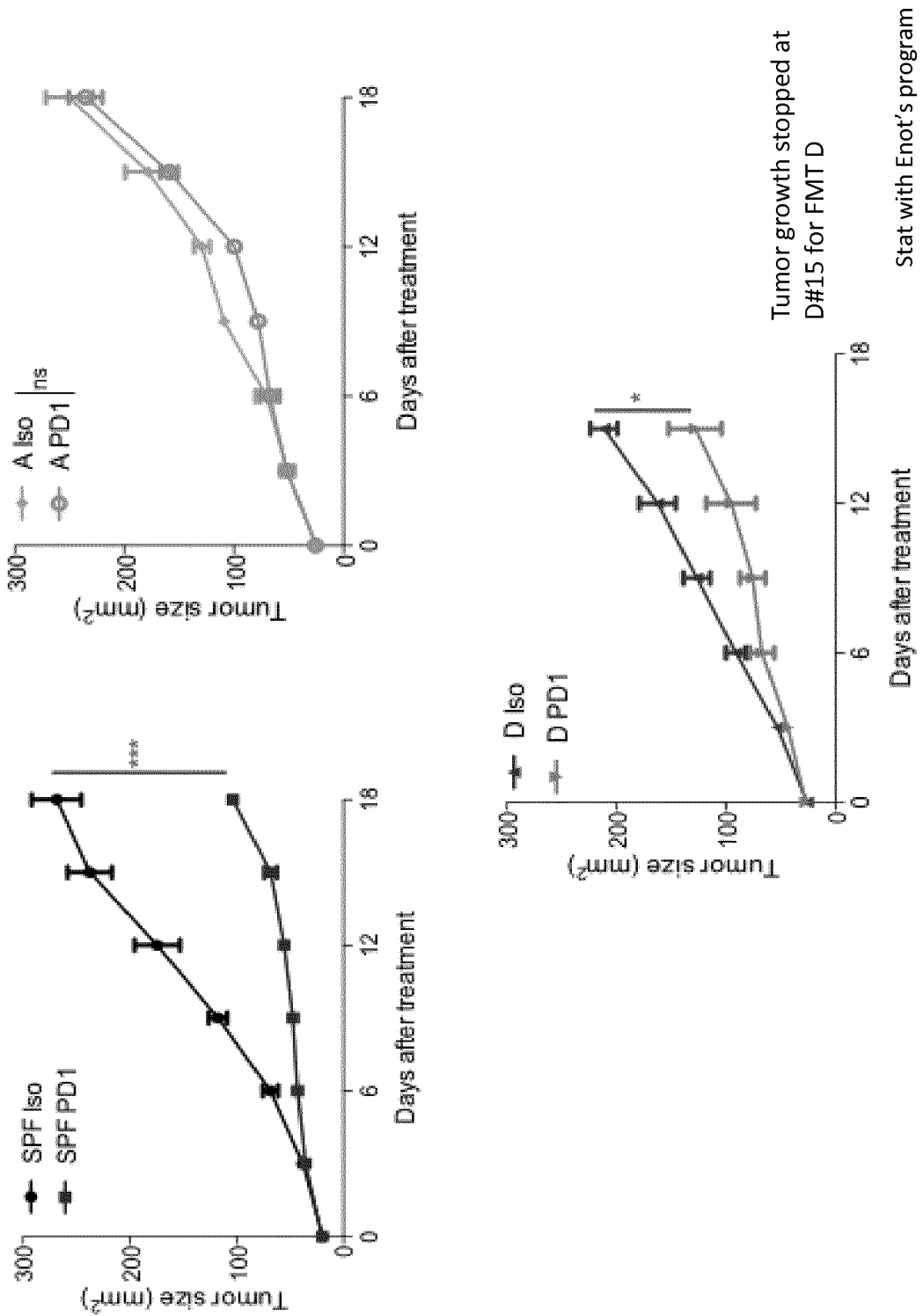

FIG. 11: Typical growth curve and kinetics of MCA205 inoculated in five SPF recipients or five ATB-treated mice that received FMT from a progressor (A) or from a responding (D) NSCLC patient.

Figure 12:
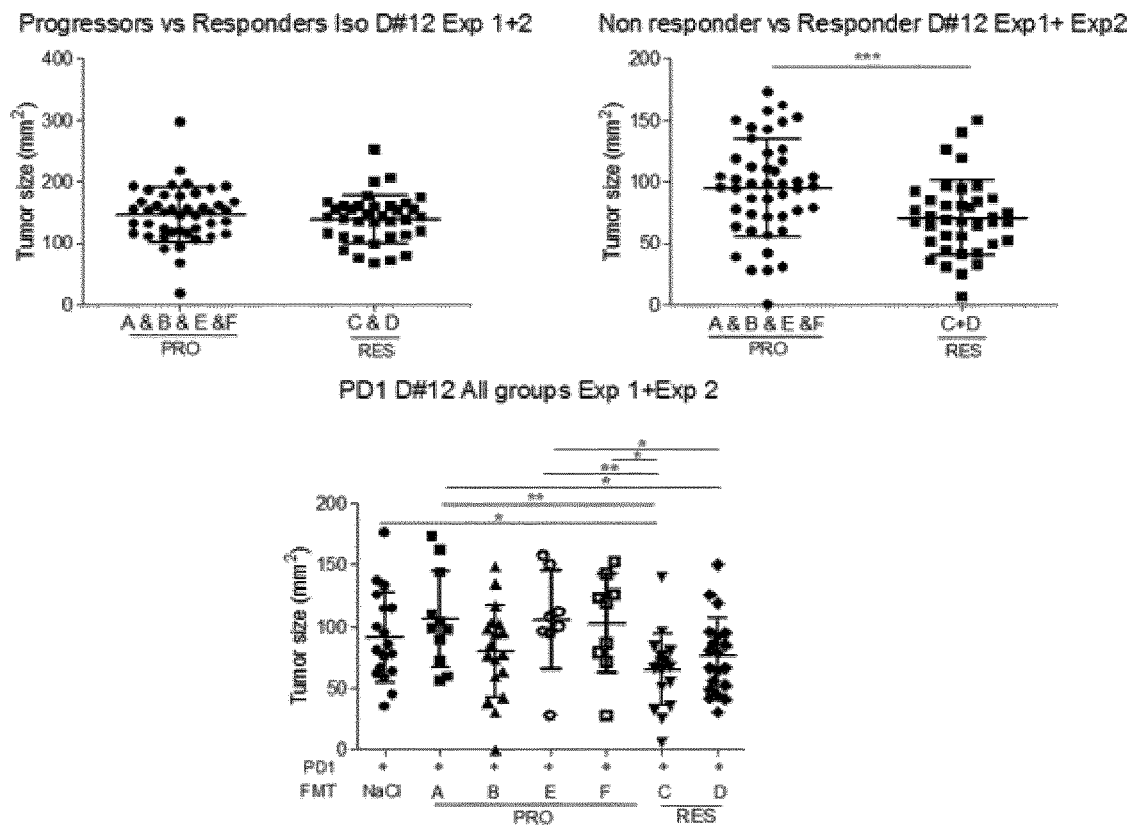

FIG. 12: Concatenated data of tumor sizes at sacrifice in several independent groups of mice receiving ATB followed by no FMT (NaCl), or FMT from four different progressors (A, B, E, F) and two different responders (C, D). Each dot represents one mouse tumor size at day 12 post-treatment start. Treatment consisted in ip administrations of anti-PD1 Abs.

Figure 13:
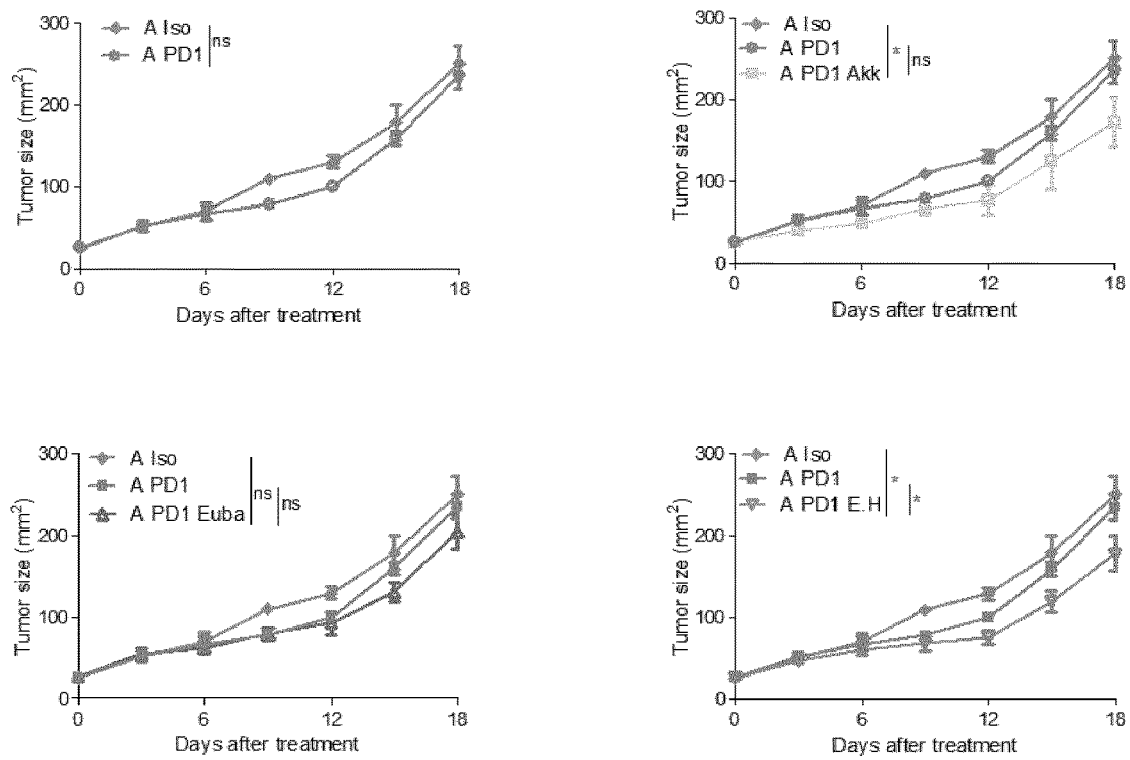

FIG. 13: Growth curves of MCA205 inoculated in GF mice that received FMT from a progressor (A) NSCLC patient followed by oral gavage of *Akkermansia municiphila* (Akk), *Enterococcus hirae* 13144 (EH) or *Eubacterium tenue* (Euba). Two gavages were performed with $10^9$ bacteria at the time of the first and second injection of anti-PD1

Abs. Three different bacteria were used, one for each group of mice (n=5 mice per group) in separated isolators.

FIG. 14: Experimental setting of bacterial compensation into ATB-treated tumor bearers (AVATAR mice) before and during PD1 blockade. Bacterial gavage was performed into ATB-treated mice bearing established MCA205 WT. Five gavages were performed with 109 bacteria prior to and at the time of the first, second, $3^{rd}$, $4^{th}$ injection of anti-PD1 Ab. Three different bacteria were used alone (*Akkermansia muciniphila*, *Alistipes* spp. and *Enterococcus hirae* 13144) or in a combination of *Akkermansia muciniphila*+*Enterococcus hirae* 13144 for each group of mice (n=5-6 mice per group) kept in separated isolators.

FIG. 15: Growth curves of MCA205 according to protocol of FIG. 14 that received oral gavage of *Akkermansia municiphila* (Akk) or *Akkermansia municiphila*+*Enterococcus hirae* 13144 (EH). Bacteria were administered by gavage in avatar mice that were spontaneously reconstituted with the mouse microflora after stopping ATB, according to the experimental setting shown in FIG. 14.

Figure 16:
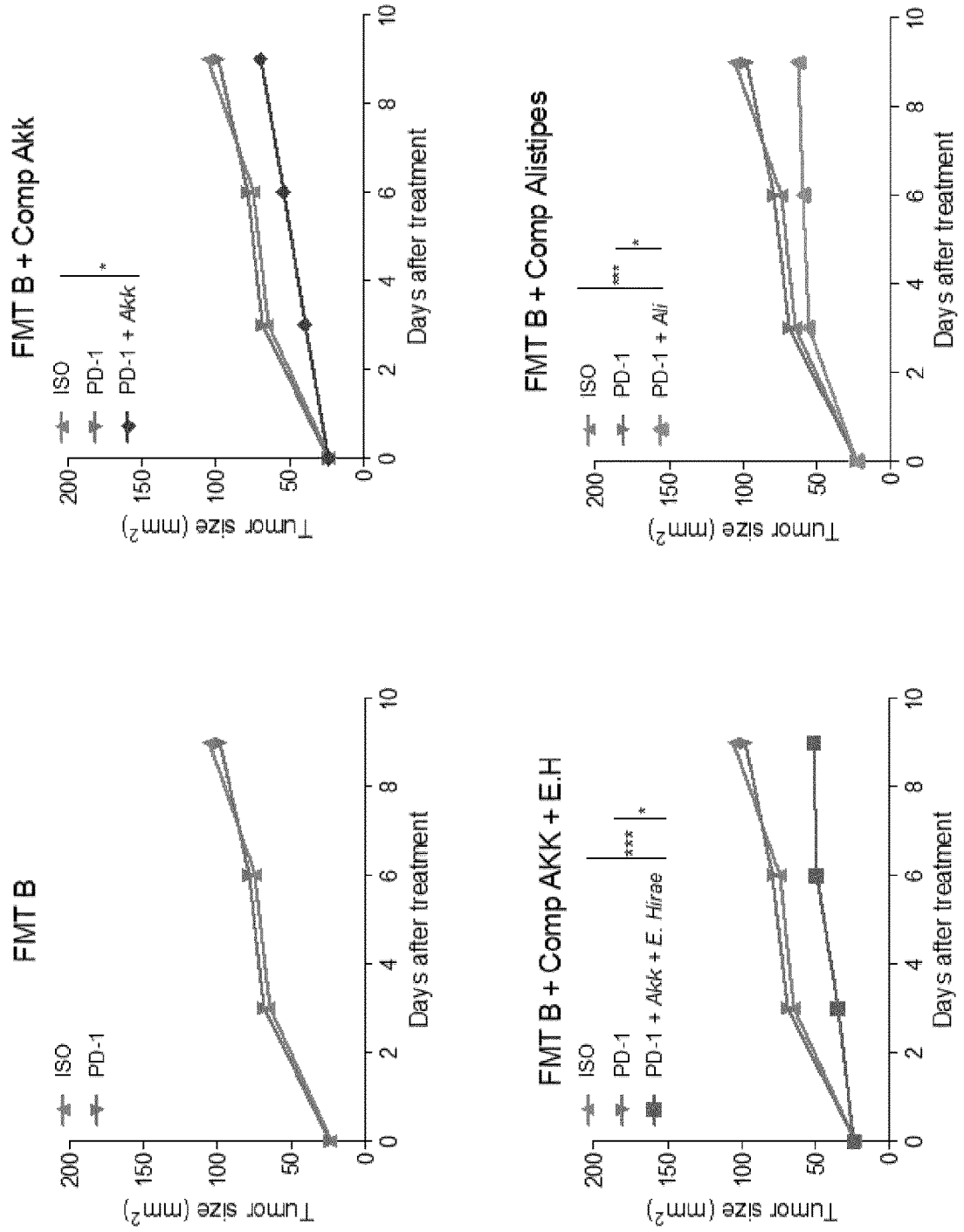

FIG. 16: Growth curves of MCA205 inoculated in GF mice that received FMT from a progressor (B) NSCLC patient followed by oral gavage of *Akkermansia municiphila* (Akk) or *Akkermansia municiphila*+*Enterococcus hirae* 13144 (EH) or *Alistipes* spp. (Ali). Bacteria were administered by gavage in avatar mice that received FMT from a progressor (B) NSCLC patient, according to the experimental setting shown in FIG. 14.

Figure 17:
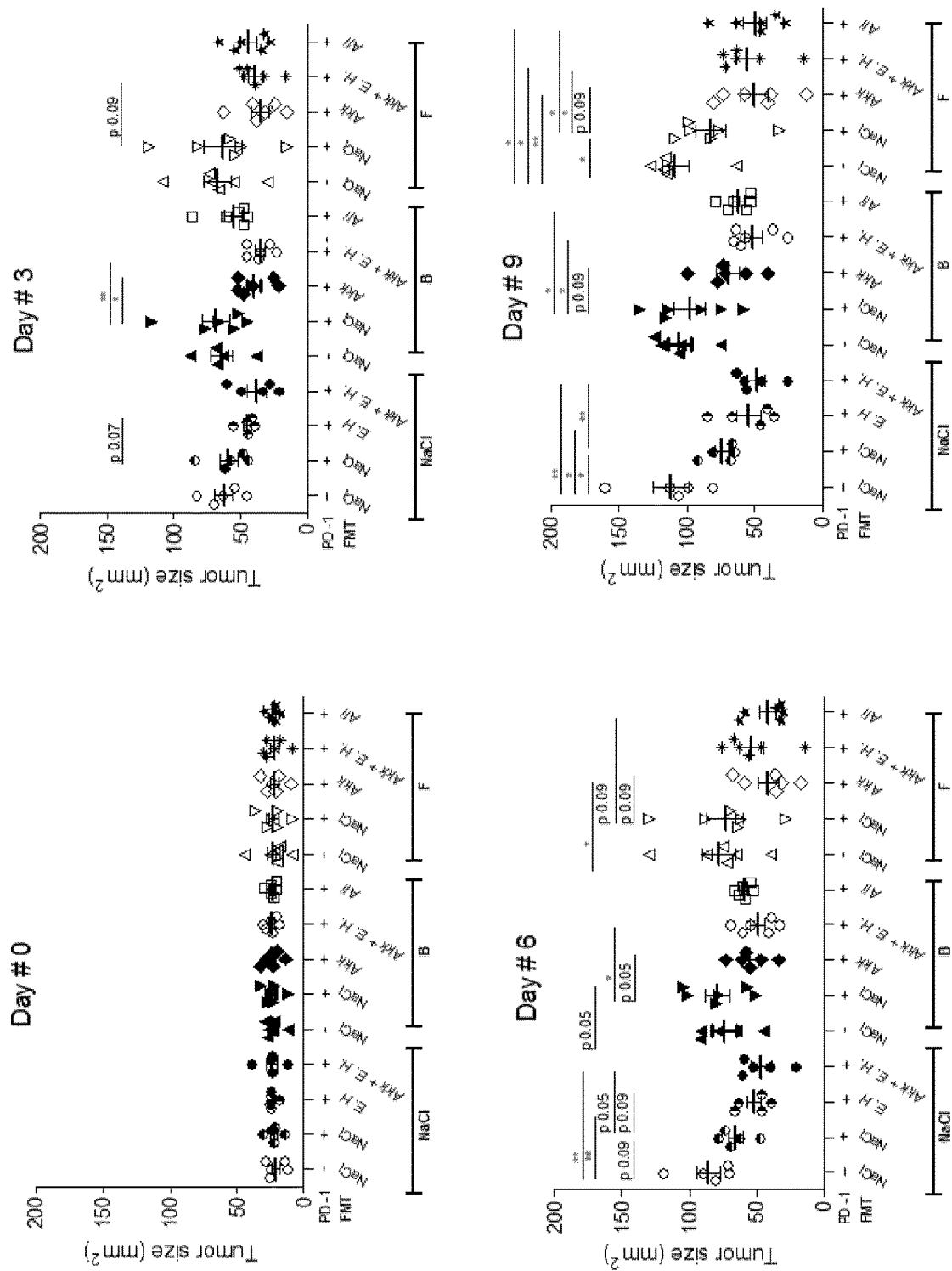

FIG. 17: Evolution of tumor sizes in several independent groups of ATB-treated mice that received FMT from two different progressors (B and F) NSCLC patient followed by oral gavage of *Akkermansia municiphila* (Akk), *Enterococcus hirae* 13144 (E.H.), *Alistipes* spp. (Ali) or *Akkermansia municiphila*+*Enterococcus hirae* 13144 (Akk+E.H). Bacteria were administered by gavage in avatar mice that received FMT from a progressor (B or F) NSCLC patient, according to the experimental setting shown in FIG. 14. Each dot represents one mouse tumor size at day 0, 3, 6 or 9 post-treatment start. Treatment consisted in ip administrations of anti-PD1 Abs.

FIG. 18: Compensating ATB-treated dysbiotic mice which do not respond to the combination of CTLA4+PD1 coblockade with "oncobax" (immunogenic commensals). C57BL/6 mice were inoculated with MCA205 sarcoma after a 14 day broad spectrum ATB administration. Then, at day 6 of MCA205 implantation, mice were treated with iv injections of anti-CTLA4 Ab (every other 3 days for 4 injections) as well as anti-PD1 Ab (6 injections every other 3 days for 6 injections). In independent groups isolated in different cages, mice received oral gavages with distinct oncobax, such as *Bifidobacterium breve* combined with *Bifidobacterium longum* or *Bacteroides fragilis* alone or combined to *Burkholderia cepacia*, or *Barnesiella intestinihominis* ("rectal" for rectal route of administration). Tumor growth kinetics were monitored in 6 mice/group, twice a week. The number of tumor free animals at sacrifice is indicated in parentheses.

FIG. 19: Memory Th1/Tr1 responses predict time to progression (TTP) under PD1 blockade in stage IV NSCLC. Tc1 or TH1 memory T cell responses to indicated commensals at diagnosis or during the first month of anti-PD1 Ab-based therapy in cancer patients segregated according to the mean value of IFNg production in the whole cohort for the calculation of TTP. Ratios between IFNg and IL-10 in memory CD4+ T cells or CD8+ T cells exposed to autologous monocytes incubated with distinct commensals in 14 advanced lung cancer patients is also shown. The Kaplan Meier curves separate the patients with high versus low ratios according to the median of the cohort.

Figure 20:
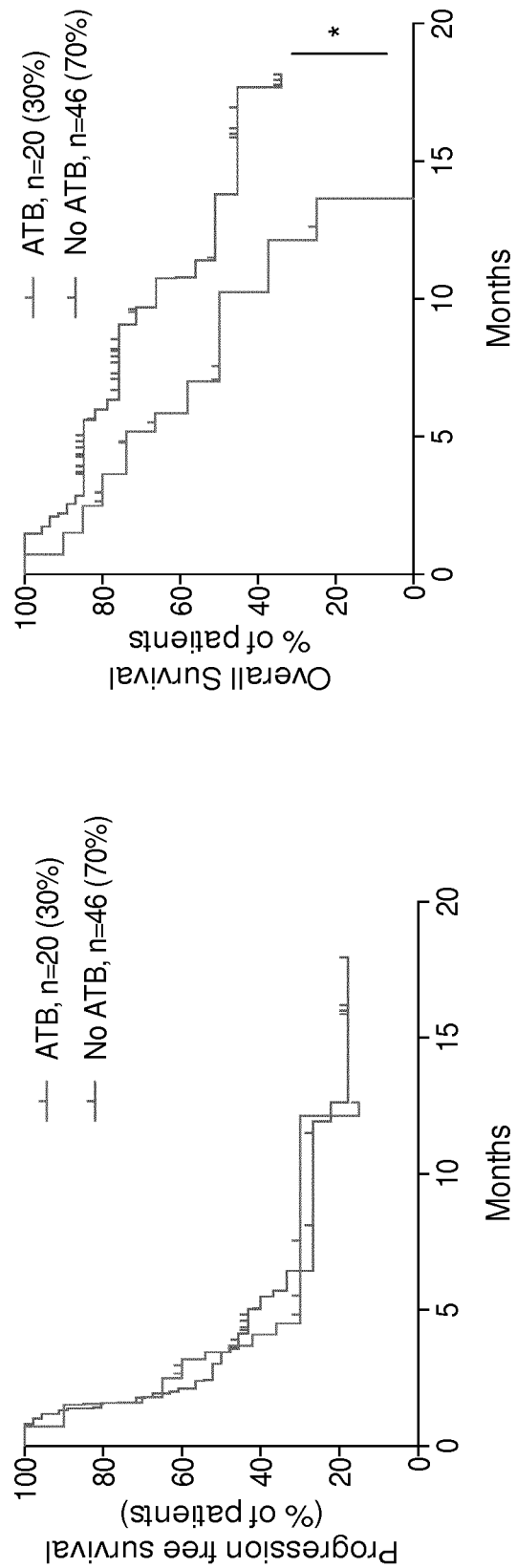

FIG. 20: Progression free survival (PFS) and overall survival (OS) of Non-Small Cell Lung Cancer patients who received ATB or not 2 months before their first injection of anti-PD1 Abs and up to month 1 after the $1^{st}$ one. The Kaplan Meier survival curves of NSCLC patients treated with Nivolumab in either ATB (+)/(−) are shown for progression free survival left panel and right panel: overall survival. Log-rank (Mantel-Cox). *p<0.05,  p<0.01,* p<0.001, ns=not significant.

FIG. 21: PFS and OS in all 3 advanced cancer types n=175 (NSCLC, mRCC, mUC) treated with PD1/PDL1 inhibitor. Progression free survival (left panel) and survival analysis (right panel) by Kaplan-Meier curves of pooled 3 cohorts of patients with advanced cancers. N=66 Non-small cell lung cancer, n=67 metastatic renal cell carcinoma, n=42 metastatic urothelial cancer all treated with PD1/PDL1 inhibitor on ATB (+) vs ATB (−). ATB(+)/(−) groups were defined as patients treated or not with ATB before (2 months period) or within the first month of ICB. *p<0.05,  p<0.01,* p<0.001, ns=not significant.

Figure 22:
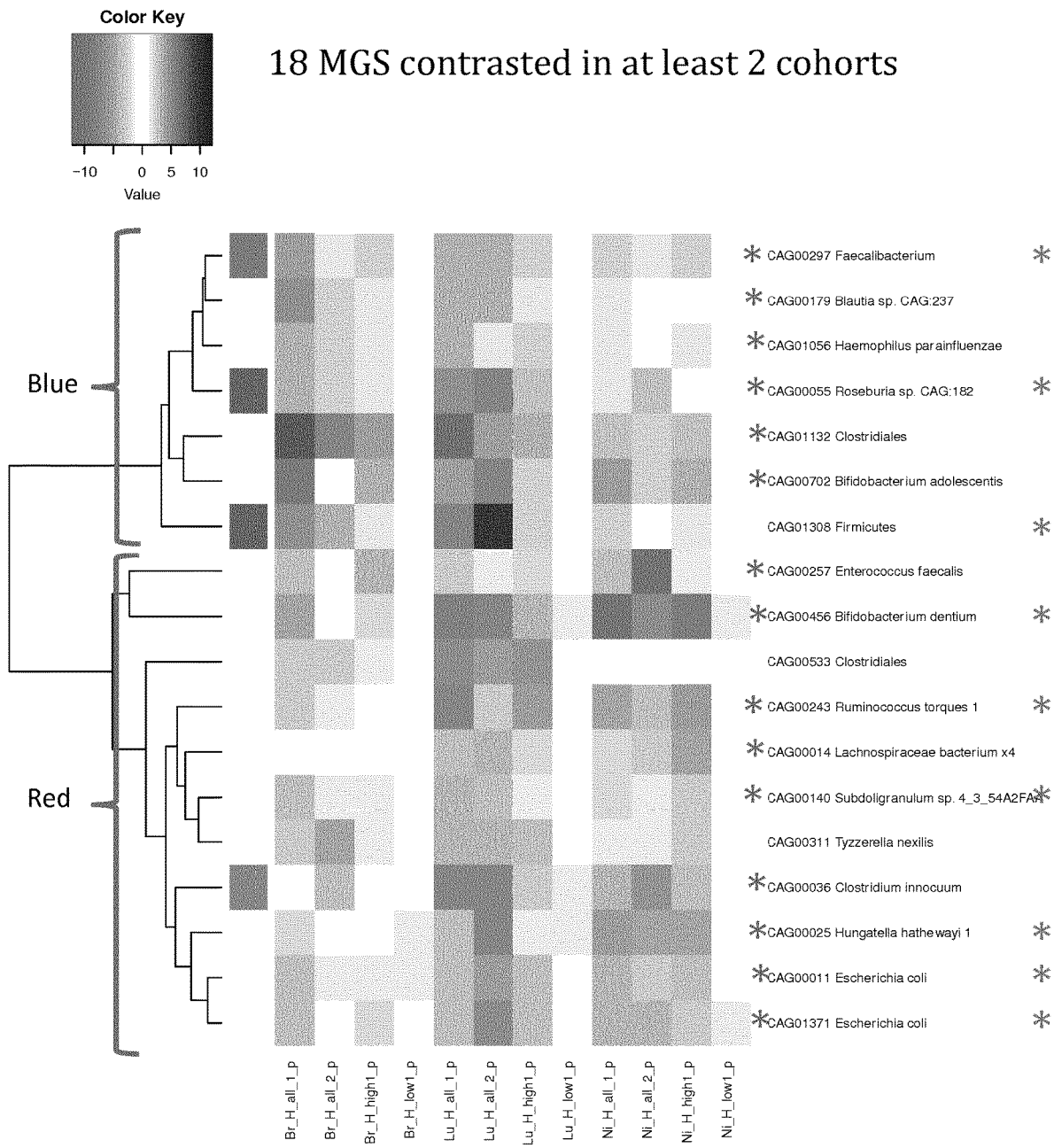

FIG. 22: Cancer-associated Gut fingerprint in metagenomics species (MGS): 18 contrasted MGS. Heat map of the non supervised hierarchical clustering of bacterial MGS common in two independent cohorts (1, 2) of cancer patients (Br: for breast cancer, Lu for lung cancers, Ni for kidney cancers), considering all patients (all) or high diversity subset (high) or low diversity subset (low). In blue, are those MGS overrepresented in healthy volunteers that are underrepresented in cancer patients while in red are those MGS overrepresented in cancer patients.

Figure 23:
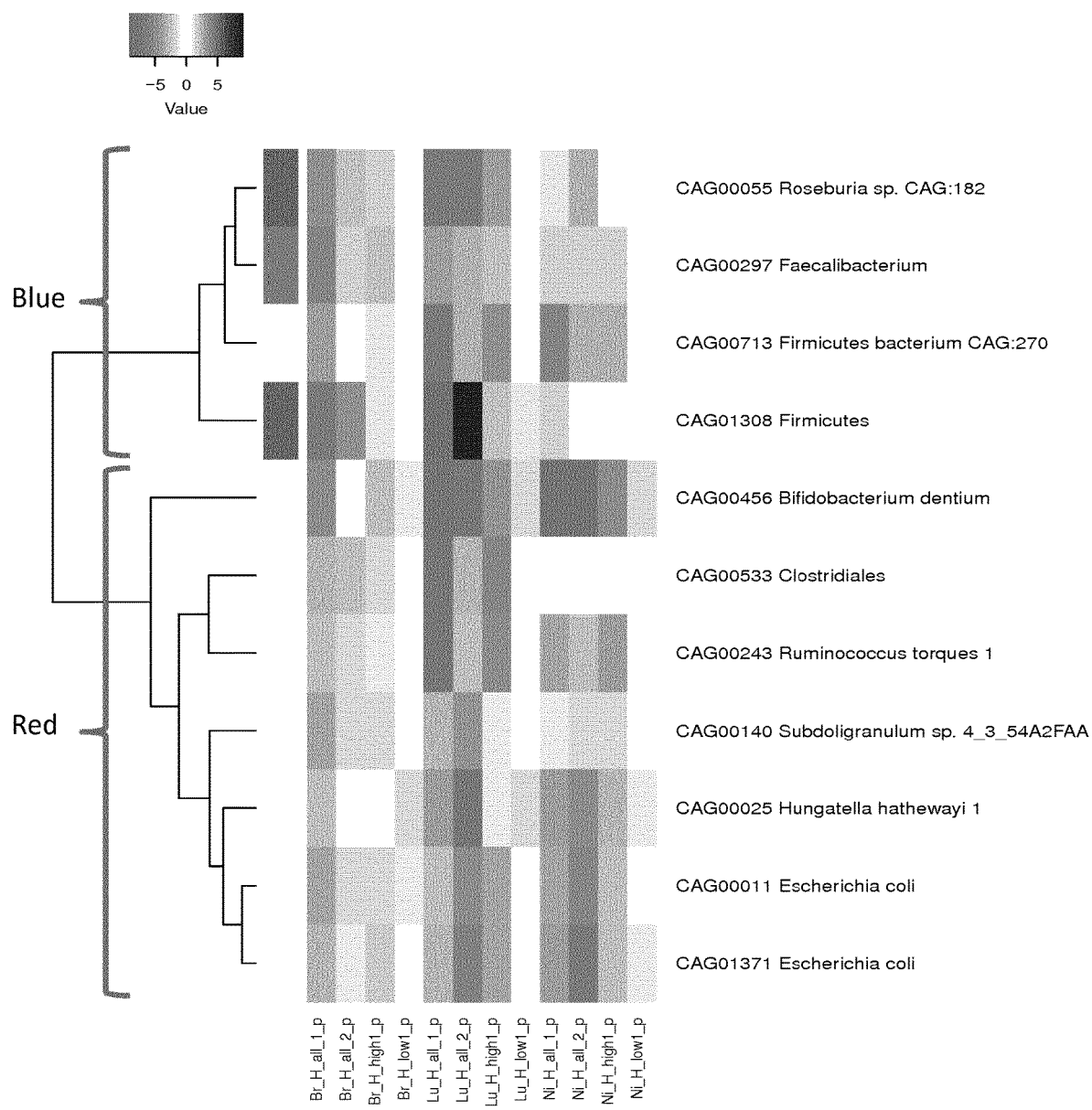

FIG. 23: Cancer-associated Gut fingerprint in MG: 11 contrasted MGS (no ATB). Same analysis as in FIG. 22 but eliminating cancer patients who took any antibiotics for at least 1 week, two months prior to feces collection.

Figure 24:
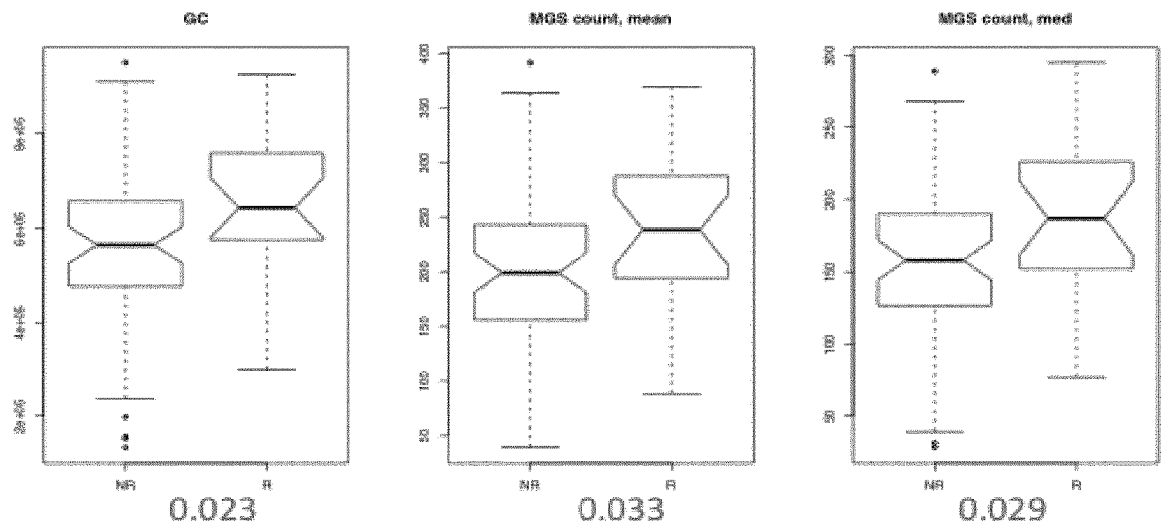

FIG. 24. Higher richness of gene counts and metagenomic species in stools at diagnosis in kidney or lung cancer patients predict better progression free survival at 6 months of continuous therapy with anti-PD1 Ab. Shot gun sequencing of fecal samples at diagnosis with representation of gene and MGS counts for all cancer patients according to clinical outcome (PFS at 6 months). Means±SEM of counts are depicted for patients experiencing PFS > or <6 months. Of note, gene or MGS richness did not predict PFS at 3 months.

Figure 25:
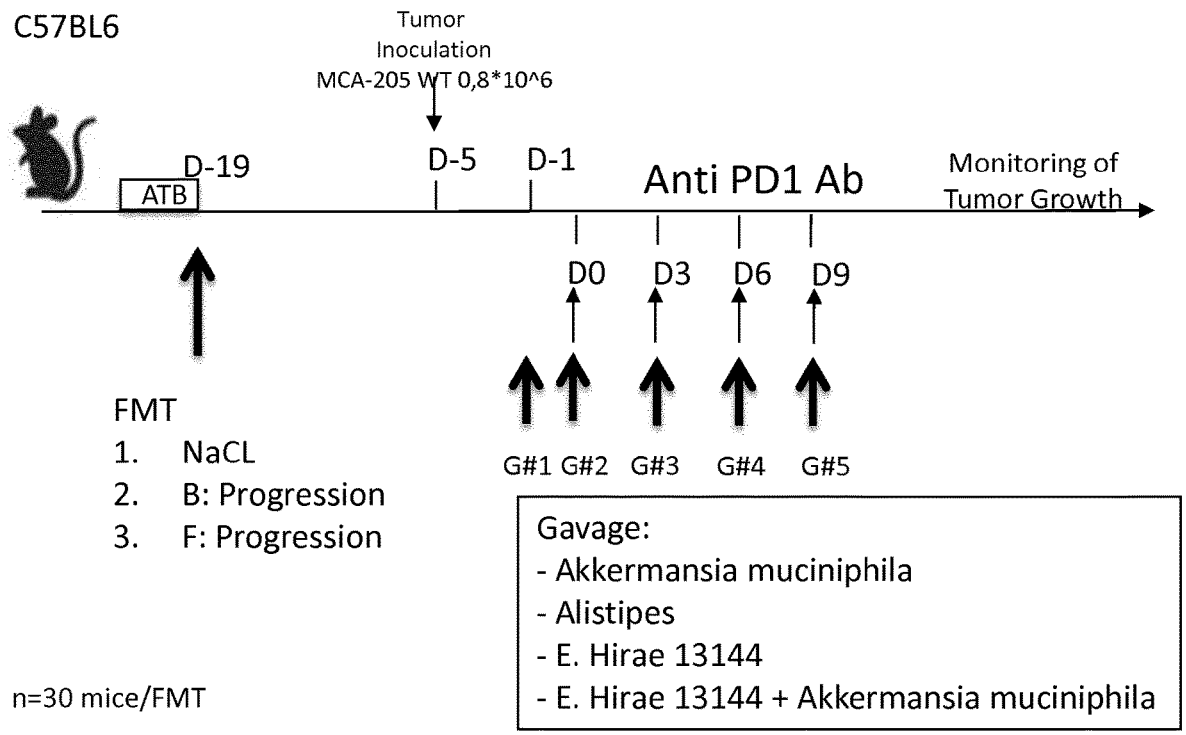

FIG. 25: Experimental setting of an FMT of 2 NSCLC progressors compensated by Oncobax in ATB-SPF recipients. Experimental design: Fecal microbial transplantation of two non-responders patients with NSCLC on anti-PD1 Abs in ATB treated mice. C57/BL6 SPF mice received 3 days of broad spectrum ATB: colistin, ampicillin, streptomycin. 12 hours after ATB discontinuation, FMT was performed with 200 µL of feces and 100 µL applied on the fur of each mouse (Patient feces were stored following the IHMS recommendations). Subsequently, 2 weeks later, MCA205 WT tumor were inculcated right flank and anti-PD1 Ab was started when tumor sizes reached 20-25 mm². Oncobax-Bacterial gavage (108 bacteria) was performed the day before the first intraperitoneal injection of anti-PD1 Ab and then at each anti-PD1 Ab injection.

Figure 26:
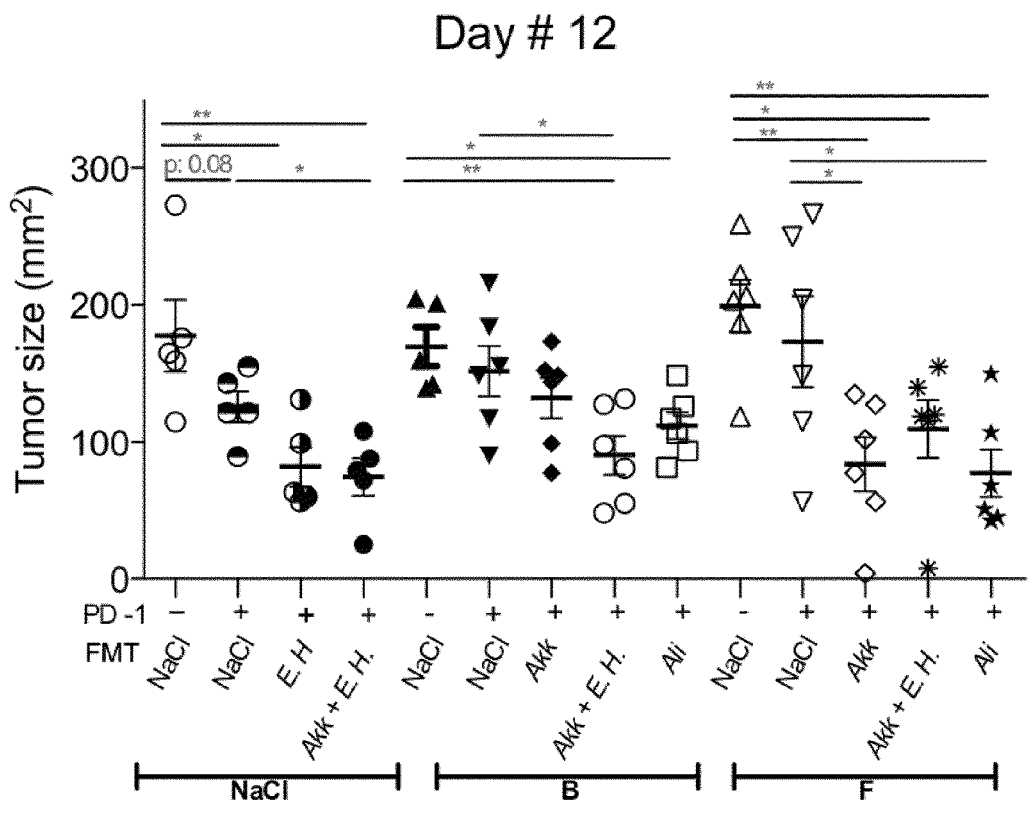

FIG. 26: Results of experiments described in FIG. 25. FMT of 2 NSCLC progressors compensated by Oncobax in ATB-SPF recipients: efficacy of Akk +/−*E. hirae* (oncobax). Tumor growth of MCA-205 WT in ATB treated mice following FMT with 2 non-responders NSCLC patients or NaCL control. Mice were treated with Iso control vs anti- PD1 Ab+different combination of Oncobax. T-test was performed. *p<0.05,  p<0.01,* p<0.001, ns=not significant.

Figure 27:
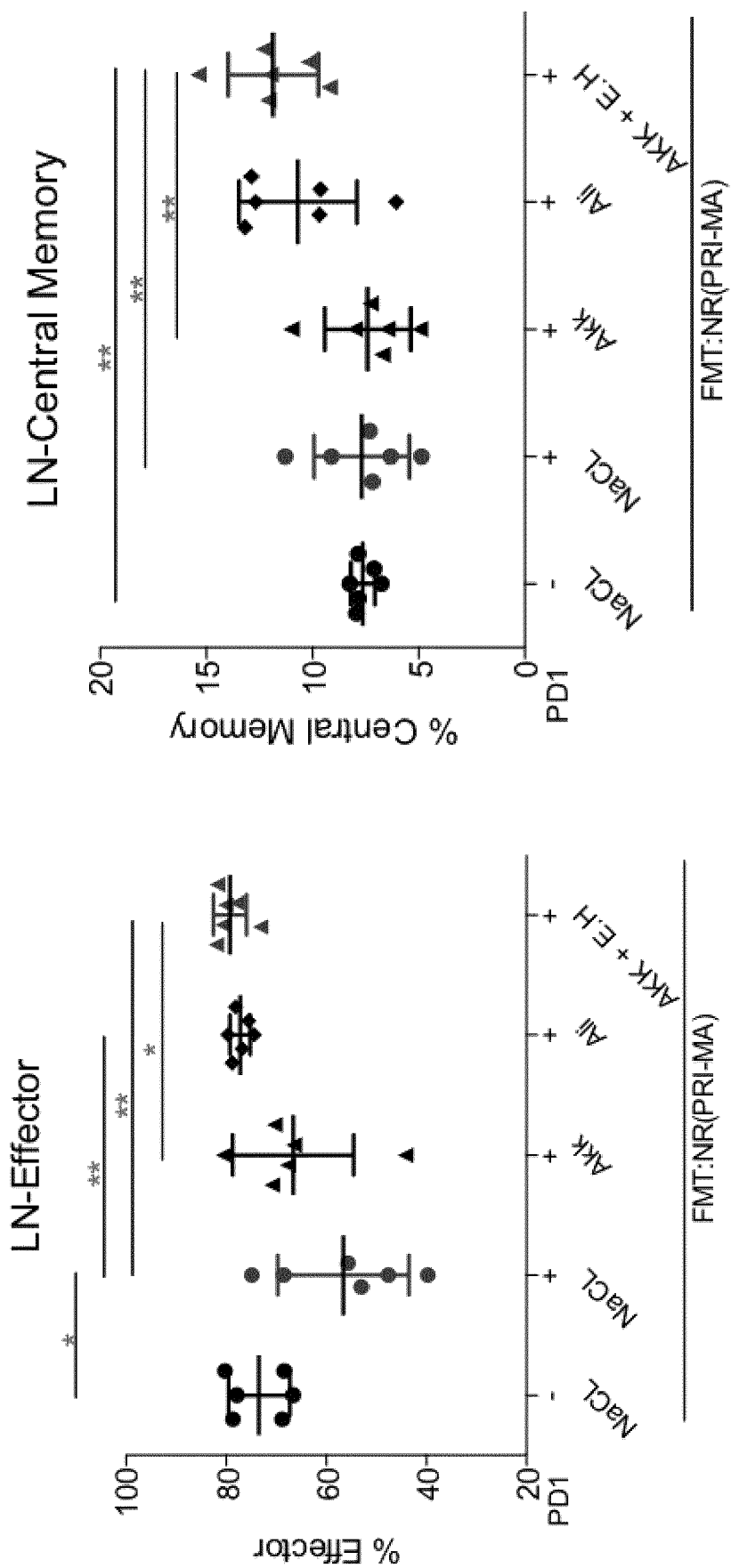

FIG. 27: Accumulation of effector and central memory CD8+ T cells with effective oncobax in tumor draining lymph nodes. Flow cytometry analyses of CD8+ effector (CD62-CD44+) and CD8+ central memory (CD62L+ CD44+) cells in draining lymph nodes of ATB treated post FMT using lung cancer feces (patient F) and treated with anti-PD1 Ab+different oncobax combinations.

Figure 28:
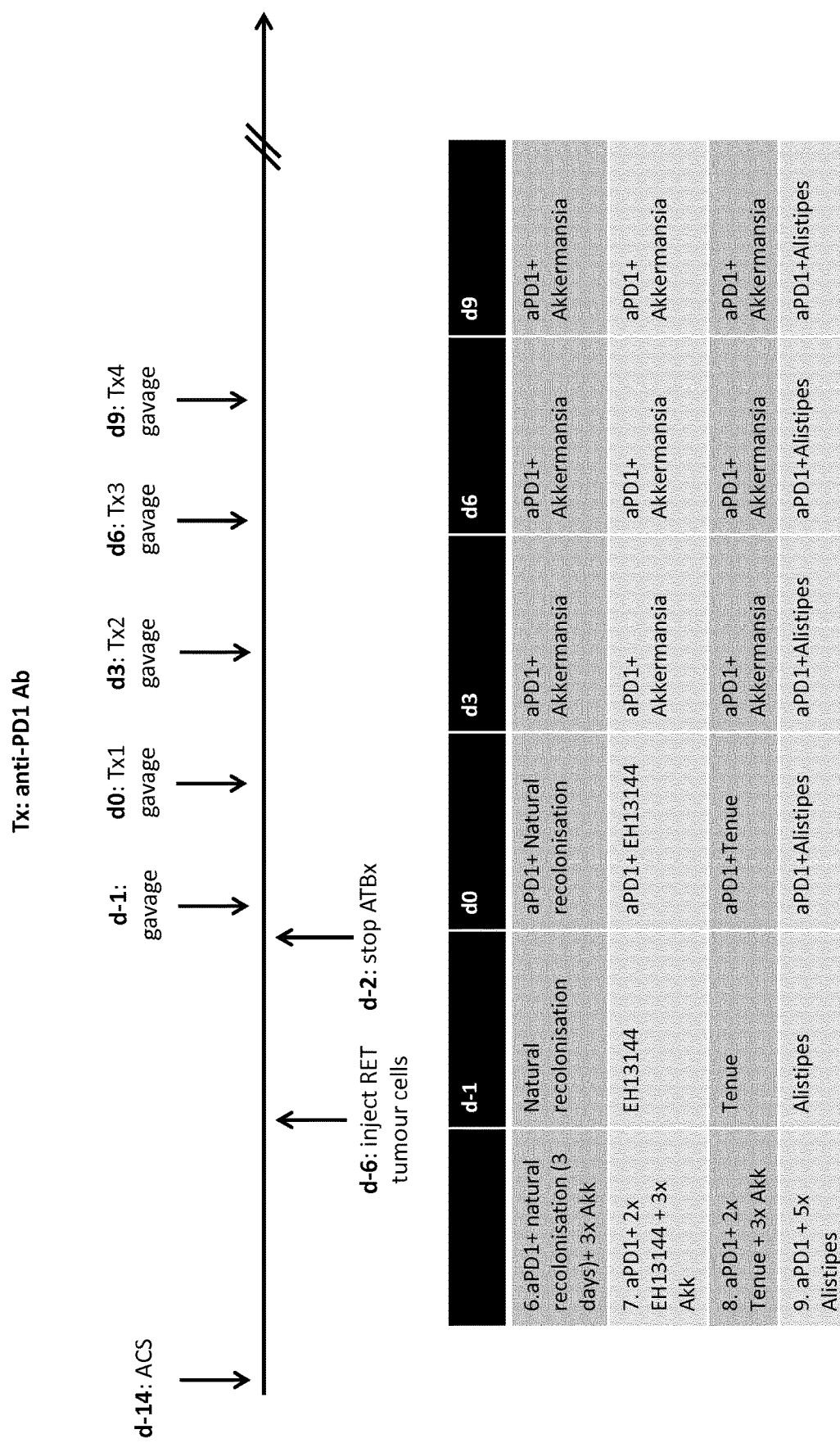

FIG. 28: Experimental setting in the RET melanoma tumor model in ATB-dysbiotic SPF recipients: compensation with various oncobax. RET melanoma tumors were injected in the left flank of ATB dysbiotic SPF C57/BL6 mice treated with Colistin, Streptomycin, and Ampicillin for two weeks. Then after ATB were discontinued, each group underwent bacterial gavage and mono-colonization with oncobax 108 bacteria or combination of two bacteria according to the detailed schedule. Each mouse received 4 intraperitoneal injections of either Iso Control or anti-PD1 Abs.

Figure 29:
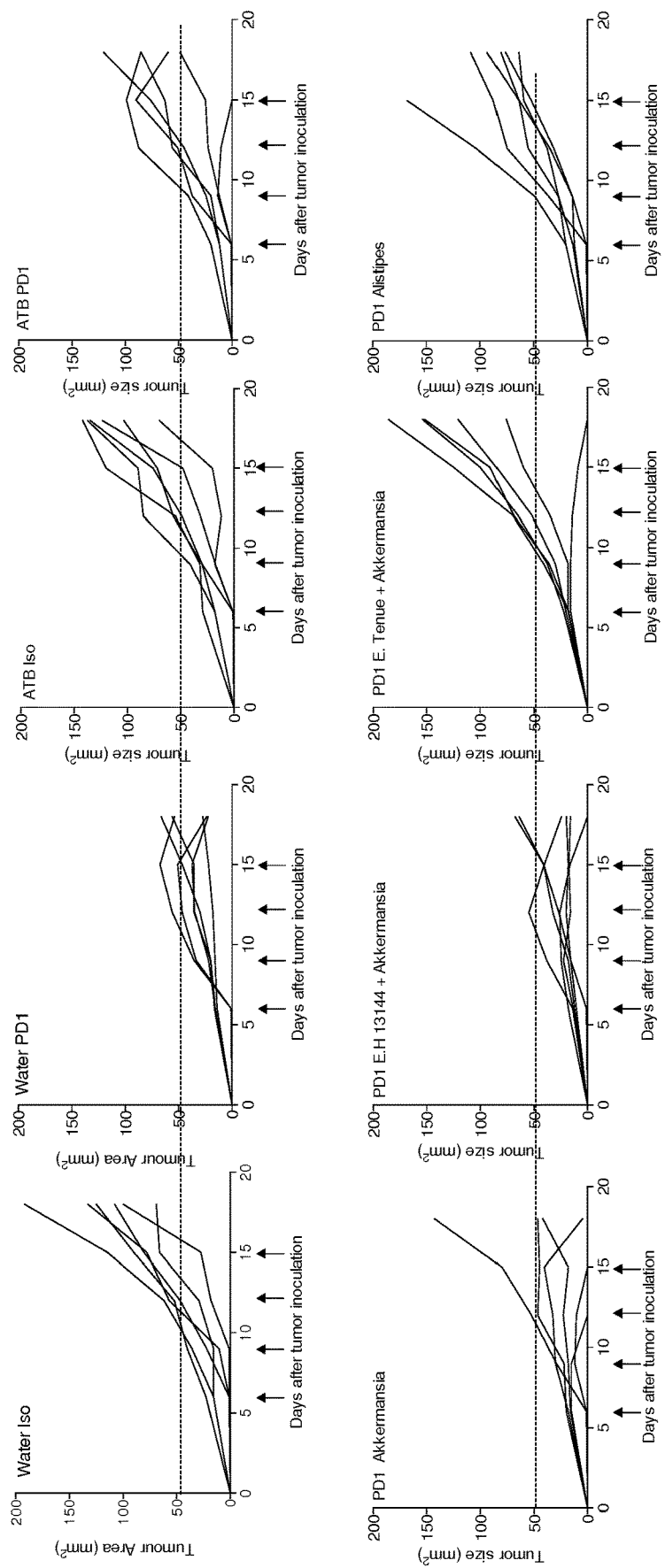

FIG. 29: Results from experimental setting described in FIG. 28. The combination of *Enterococcus hirae* (13144)+ *Akkermansia muciniphila* (Akk) is very efficient in the RET model. Tumor growth of RET in ATB dysbiotic SPF mice and treated according to experimental setting explained in FIG. 19. Each line represents one mouse. Two top left panels represent control mice that only received water. Top two panels on the right depict the tumor growth in mice that received ATB. The four panels at the bottom represent tumor growth of mice that underwent oncobax monocolonization after ATB with *Akkermansia muciniphila, Enterococcus hirae* 13144+*Akkermansia muciniphila, Eubacterium tenue*+*Akkermansia muciniphila, Alistipes indistinctus* respectively. One representative experiment out of two is shown.

Figure 30:
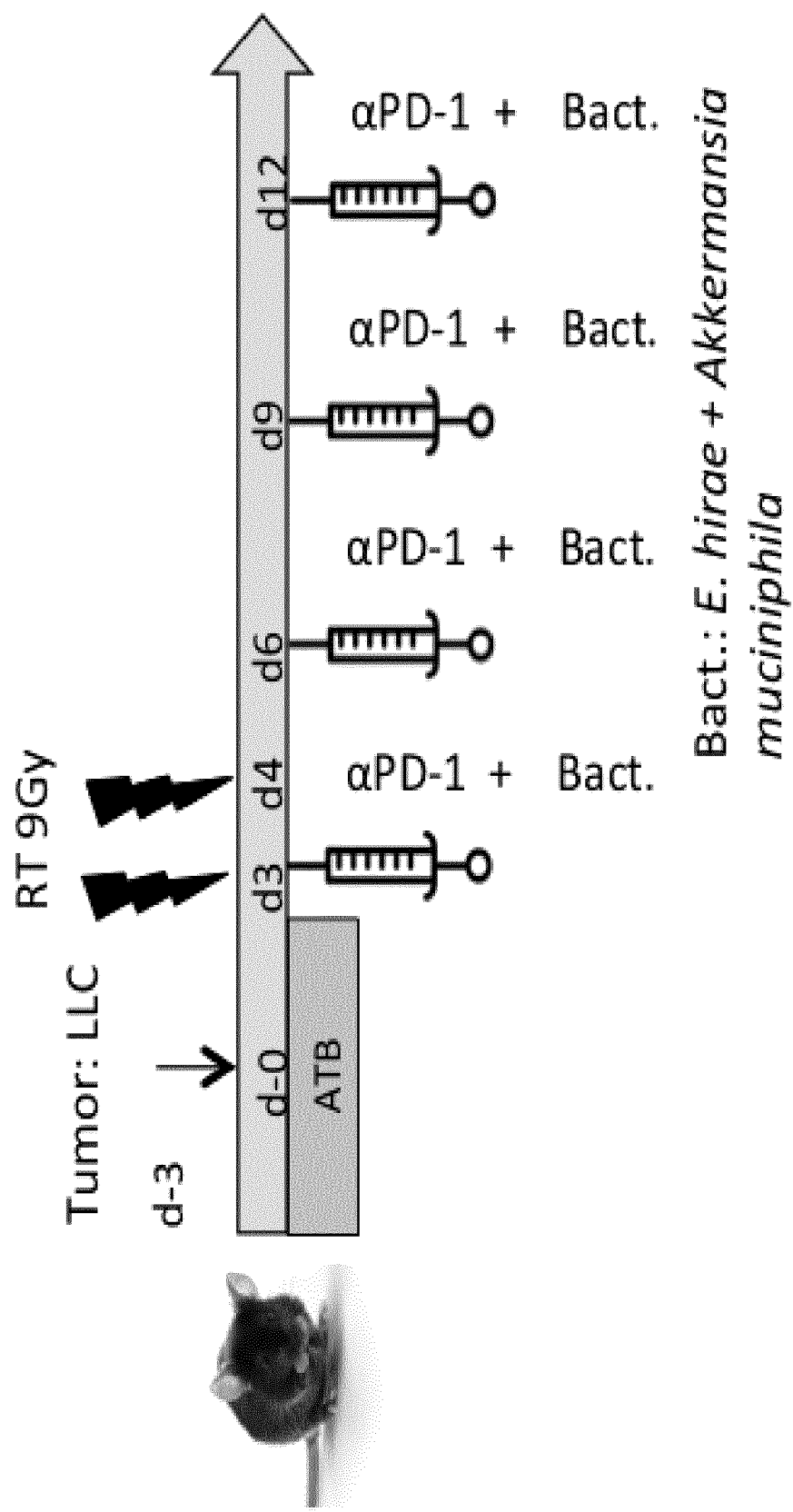

FIG. 30: Orthotopic LLC: efficacy of PD1 blockade+ radiotherapy combined with oncobax (1). Experimental settings for combined modalities Radiotherapy+PD1 in SPF mice. After, 3 days of ATB C57/BL6 mice were injected orhtotopically with Lewis Lung Cancer (LLC) cell line expressing luciferase that can be monitored using the IVIS spectrum in vivo imaging system after luciferine injection. On Day 3-4 they received 9Gy of radiotherapy targeting the thorax. Anti-PD1 Abs or Iso Control Abs were injected intraperitoneally according to the detailed schedule every 3 days. In the bacteria group: mice received orally *Enterococcus hirae* 13144+*Akkermansia muciniphila* at 108 on the same day as anti-PD1 Abs injection.

Figure 31:
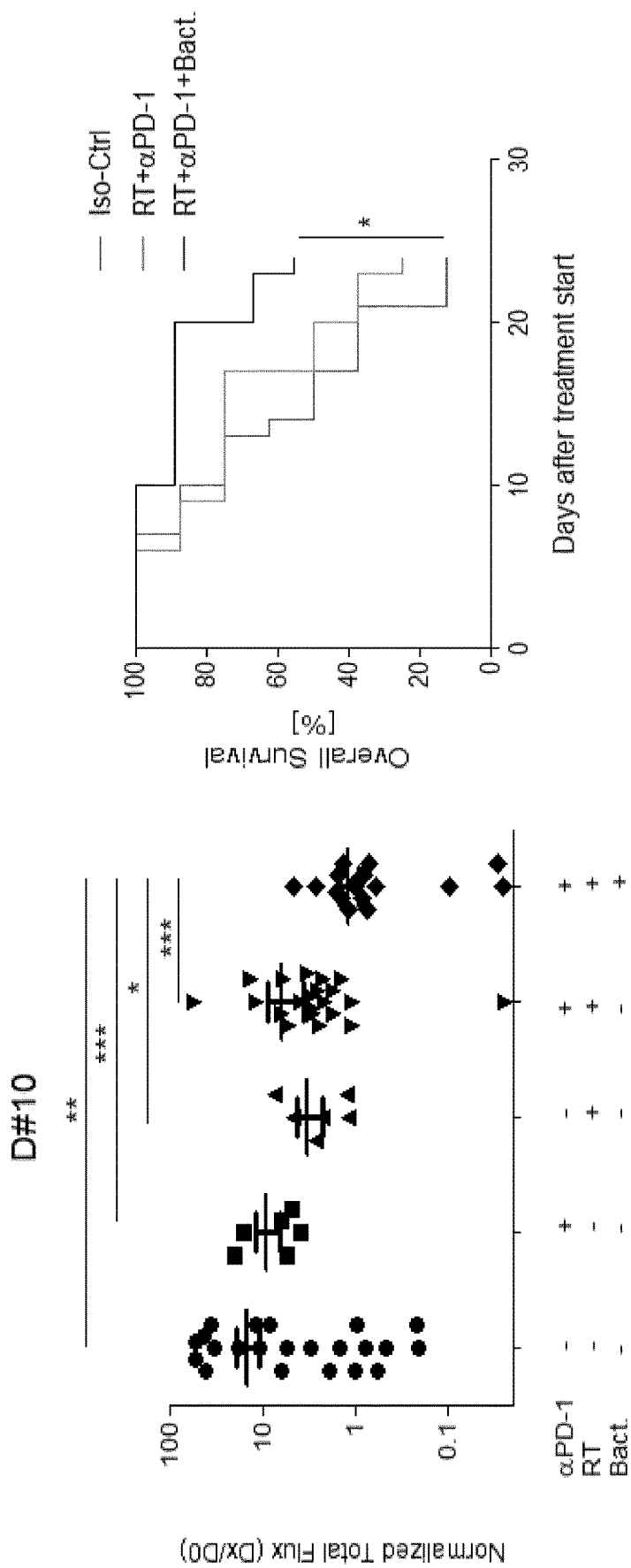

FIG. 31: Orthotopic LLC: efficacy of PD1 blockade+ radiotherapy combined with oncobax (2). Left panel represents the tumor growth measure using the IVIS spectrum in vivo imaging system. For each group normalized total flux is represented on day #10. Right panel: Survival analysis by Kaplan-Meier curves of all mice either in the Iso-Ctrl or Radiotherapy+PD1 or Radiotherapy+anti-PD1 Ab+Bacteria group. Log-rank (Mantel-Cox). *p<0.05,  p<0.01,* p<0.001, ns=not significant.

Figure 32:
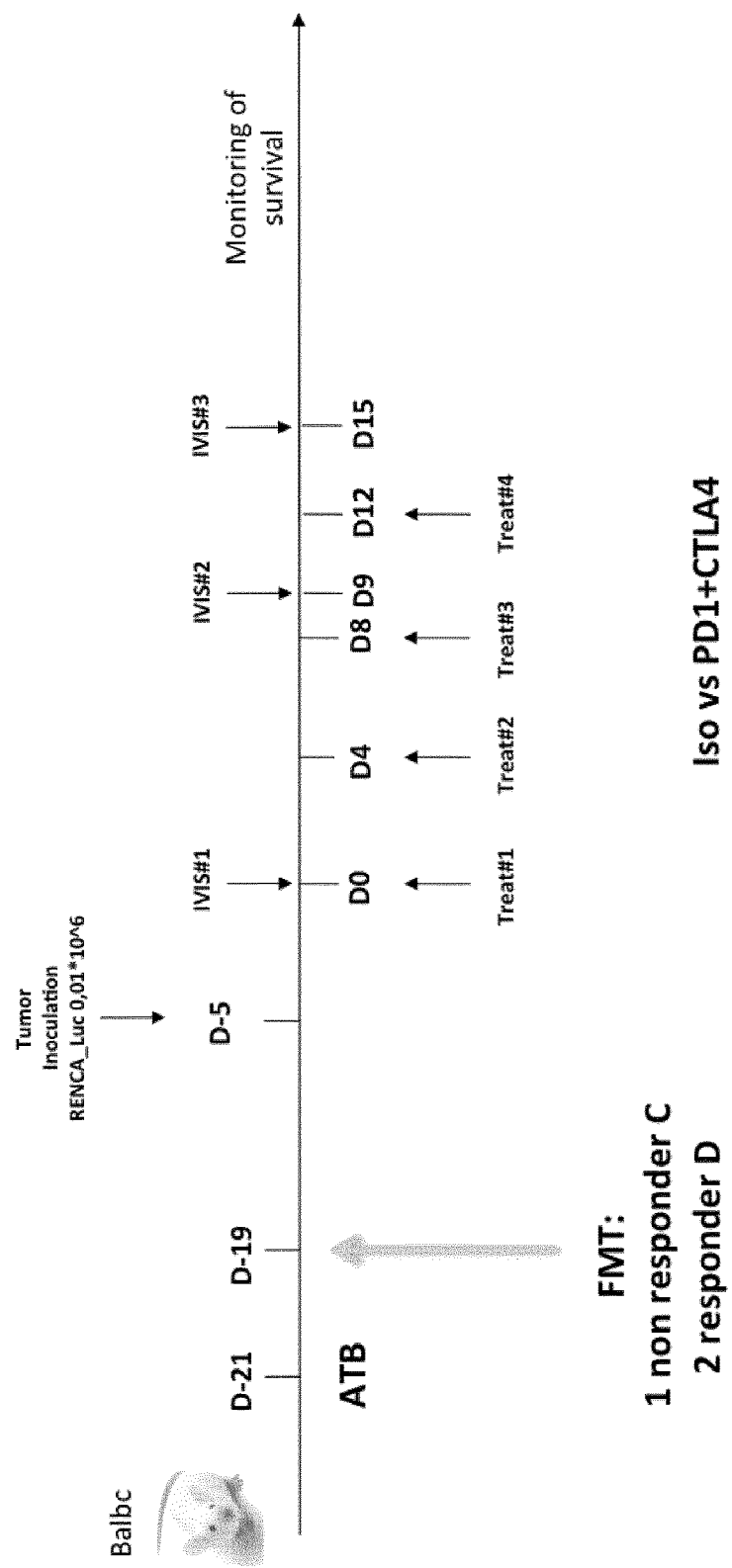

FIG. 32: Role of gut microbiome in the anticancer effects of anti-CTLA4+anti-PD1 Ab in a RENCA tumor model (1). Experimental setting of fecal microbial transplantation in Balb/c ATB-treated mice with feces from patients with metastatic renal cell carcinoma. After 3 days of ampicillin, colistin and streptomycin, Balb/c mice received FMT from 3 different patients with mRCC on Nivolumab. Two patients had no clinical benefit whereas the other one remained in partial response after 10 months. On day 14 post FMT, RENCA-luciferase tumors were injected orthotopically and mice received either Iso Control or PD1+CTLA4 in combination every 4 day according to the schedule. Table at the bottom shows metagenomic feces composition of the 3 donors for several bacteria.

Figure 33:
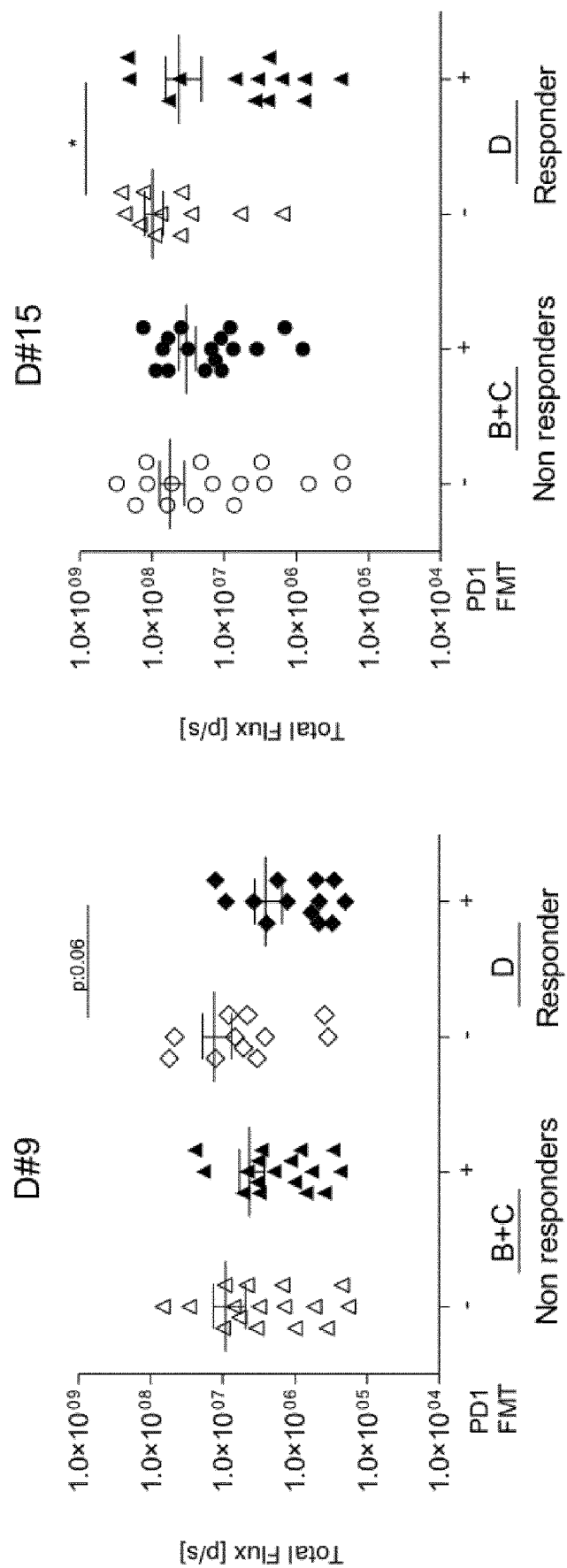

FIG. 33: Role of gut microbiome in the anticancer effects of anti-CTLA4+anti-PD1 Ab in a RENCA tumor model (2). Tumor size assessment of RENCA in Balb/c post FMT using IVIS® spectrum in vivo imaging system device. Total flux for each mouse is represented on Day 9-15. T-test was performed. *p<0.05,  p<0.01, * p<0.001, ns=not significant.

Figure 34:
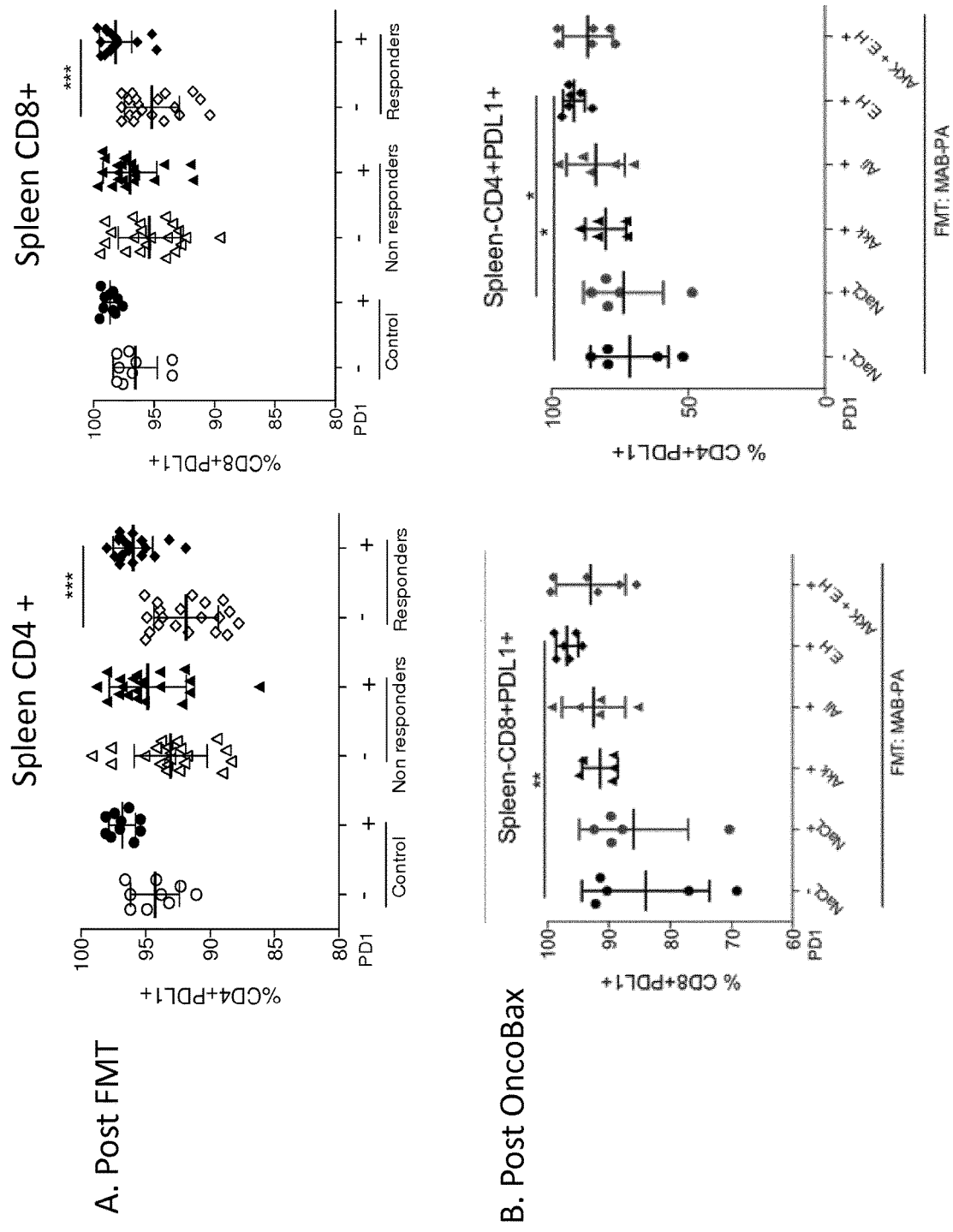

FIG. 34: PD-L1 upregulation on circulating T cells is a hallmark of a favorable MG composition of feces associated with clinical benefit to PD1 blockade. Flow cytometry analyses of splenic CD4+ and CD8+ T cell expression of PDL1 molecules on the cell surface. A. Post FMT of either responders or non responders in ATB-treated mice. Panel B Post FMT of a non responder followed by treatment with oncobax.

Figure 35:
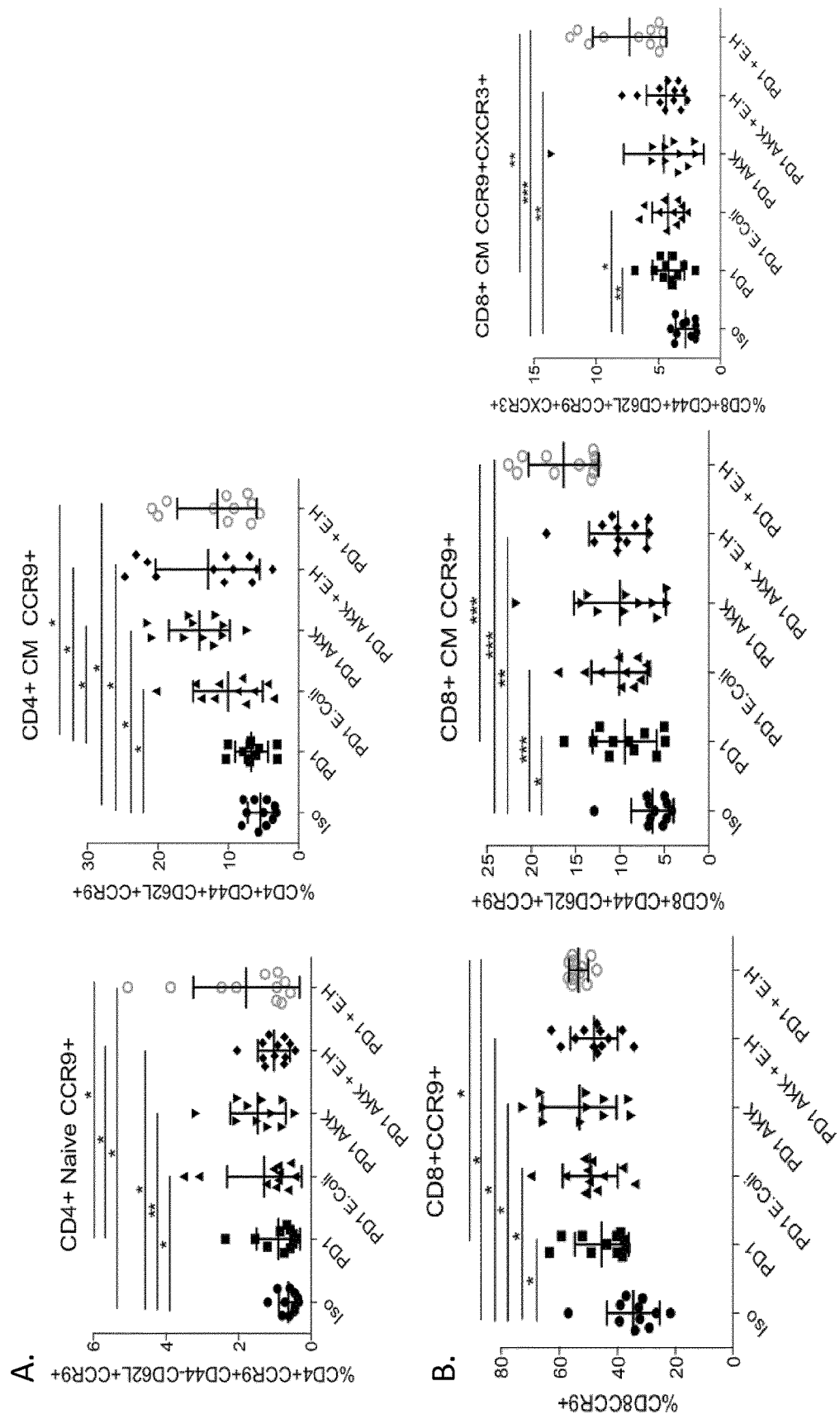

FIG. 35: Phenotypic changes post-oral gavage with oncobax in the mesenteric lymph nodes. Augmentation of CD4+ and CD8+ CCR9+CM (and naive to some extent) with *Enterococcus hirae* alone or combined with *Akkermansia muciniphila*. Flow cytometry analyses of mesenteric lymp nodes 48 hr post gavage with oncobax and treated with 1 injection of intraperitoneal anti-PD1 Ab. Panel A: CD4+ Naïve CCR9+ and CD4+ Central memory CCR9+. Panel B: CD8+CCR9+, CD8+ Central memory CCR9+, CD8+CM CCR9+CXCR3+. *Enterococcus hirae* markedly increase CD8+ TCM CCR9++ and CCR9+CXCR3+ while *Akkermansia muciniphila* augments mainly CD4+CCR9+ TCM.

Figure 36A:
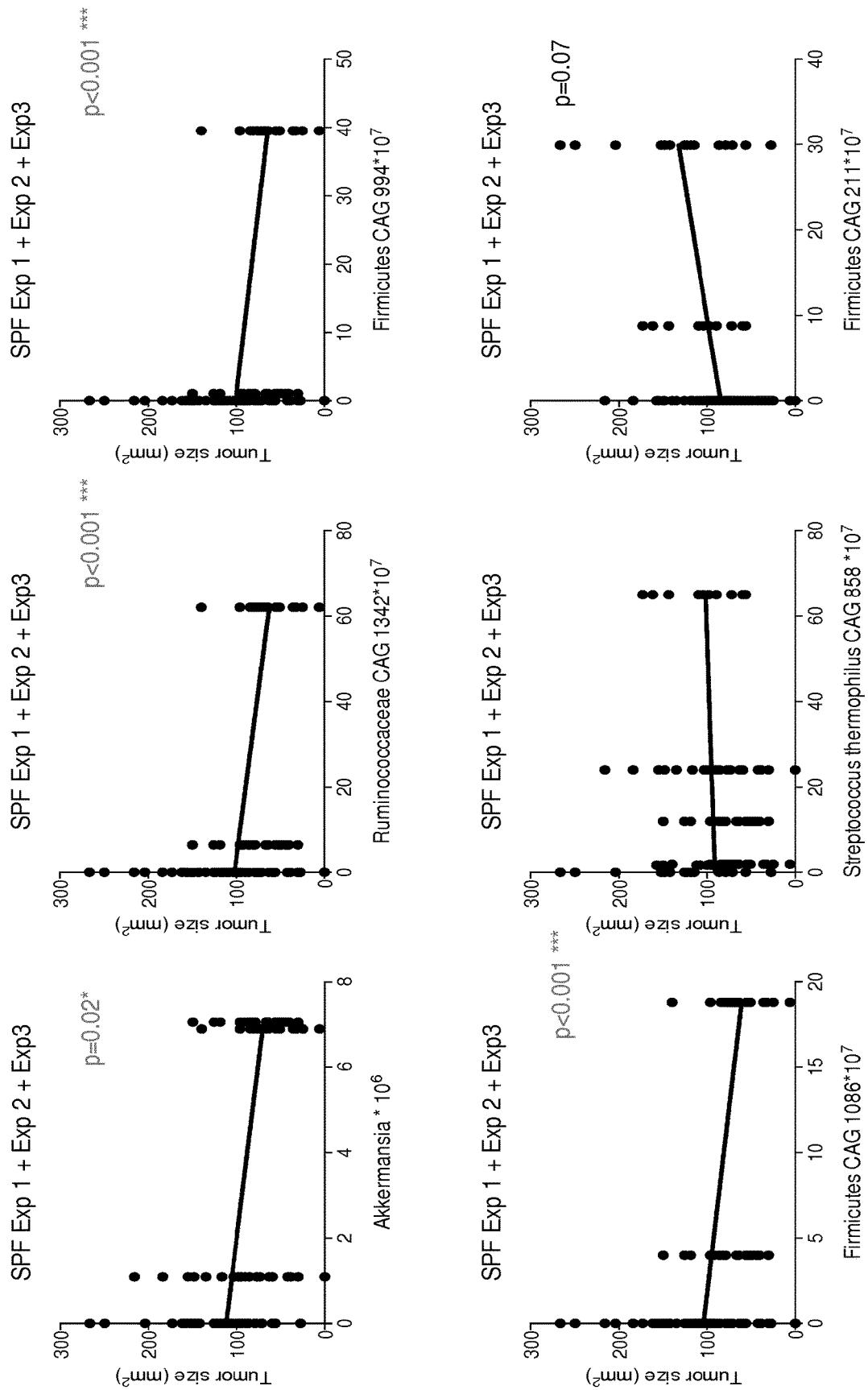
Figure 36B:
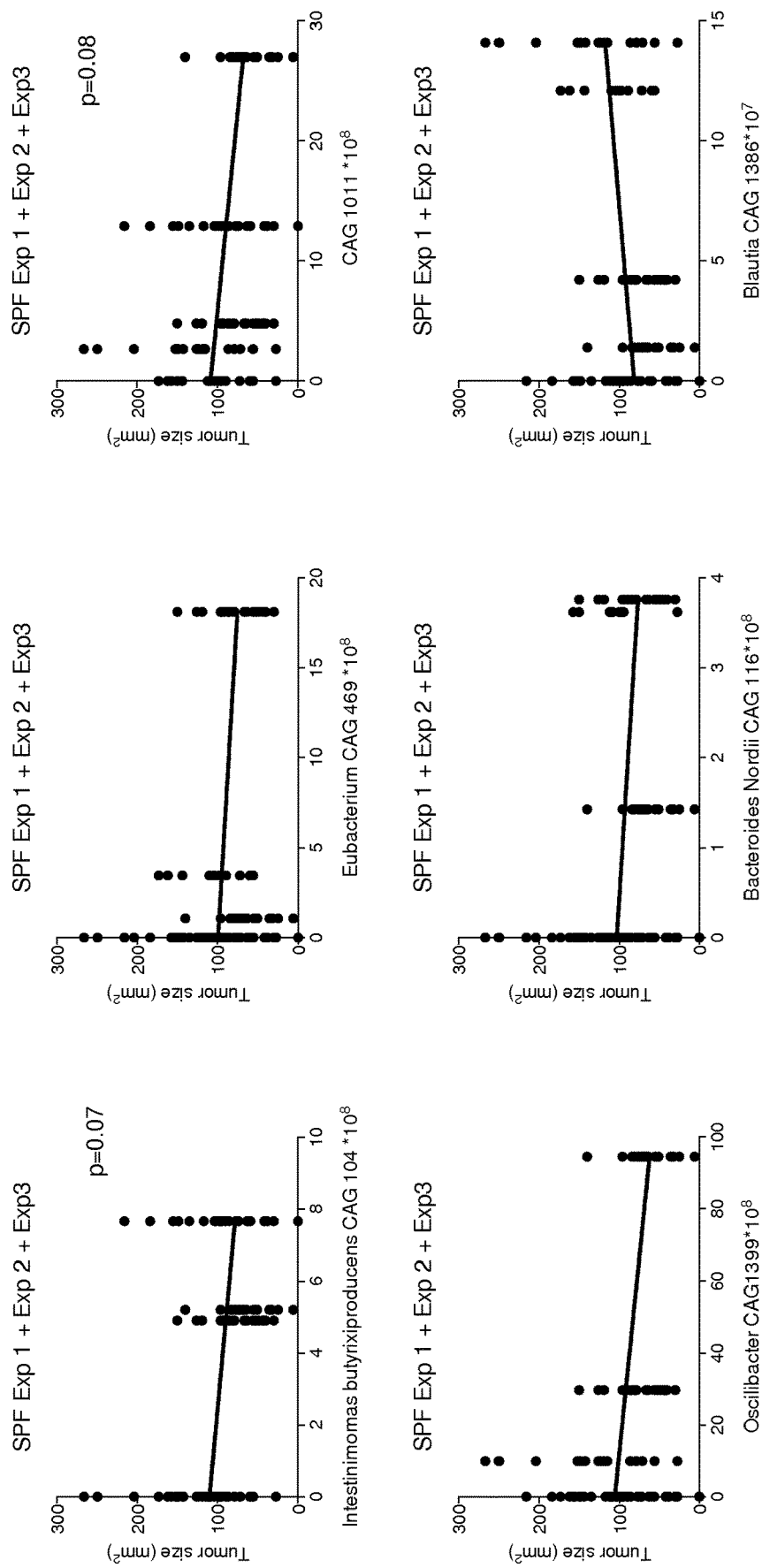

FIG. 36: Prediction of tumor size in Atb-treated mice post FMT using the metagenomic composition of the patients' feces. We performed FMT in ATB treated mice with feces from NSCLC (2 responders and 4 progressors) on Nivolumab (FIG. 12). Spearman correlation between individual mouse tumor size and the composition of the patient's feces for different bacteria present in the metagenomic signature either in the responder or non-responder section.

Figure 37:
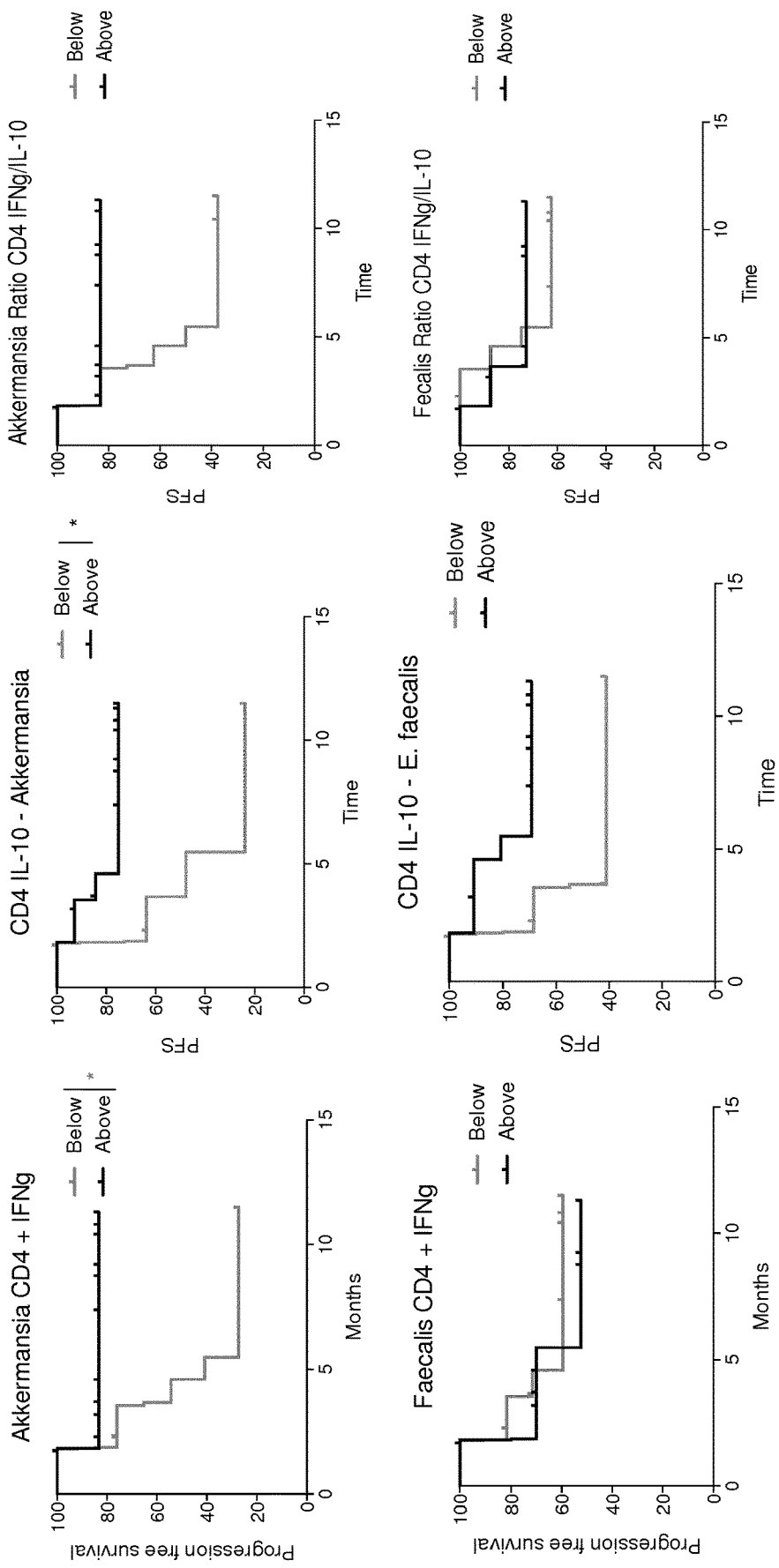

FIG. 37: CD4 stimulation with *Akkermansia muciniphila* vs *Enterococcus Faecalis*. Predictive value of CD4 IFN-g release determined by ELISA for each metastatic renal cell carcinoma patient during immunotherapy after various bacterial stimulations of monocytes/CD4+ T cell co-cultures. Similar results were obtained using CD8-IFNg (Tc1) in response to restimulation with *A. muciniphila*. The Kaplan Meier curves showing PFS for each subgroups (TH1: IFNg, TR1: L-10 or ratio IFNg/IL-10) patients above/below the median of cytokine production are represented for two bacteria. Memory TH1 and Tc1 immune responses against *A. muciniphila* predict TTP during PD1 blockade in both lung and kidney cancer patients (not shown). Log-rank *p<0.05, **p<0.01.

Figure 38:
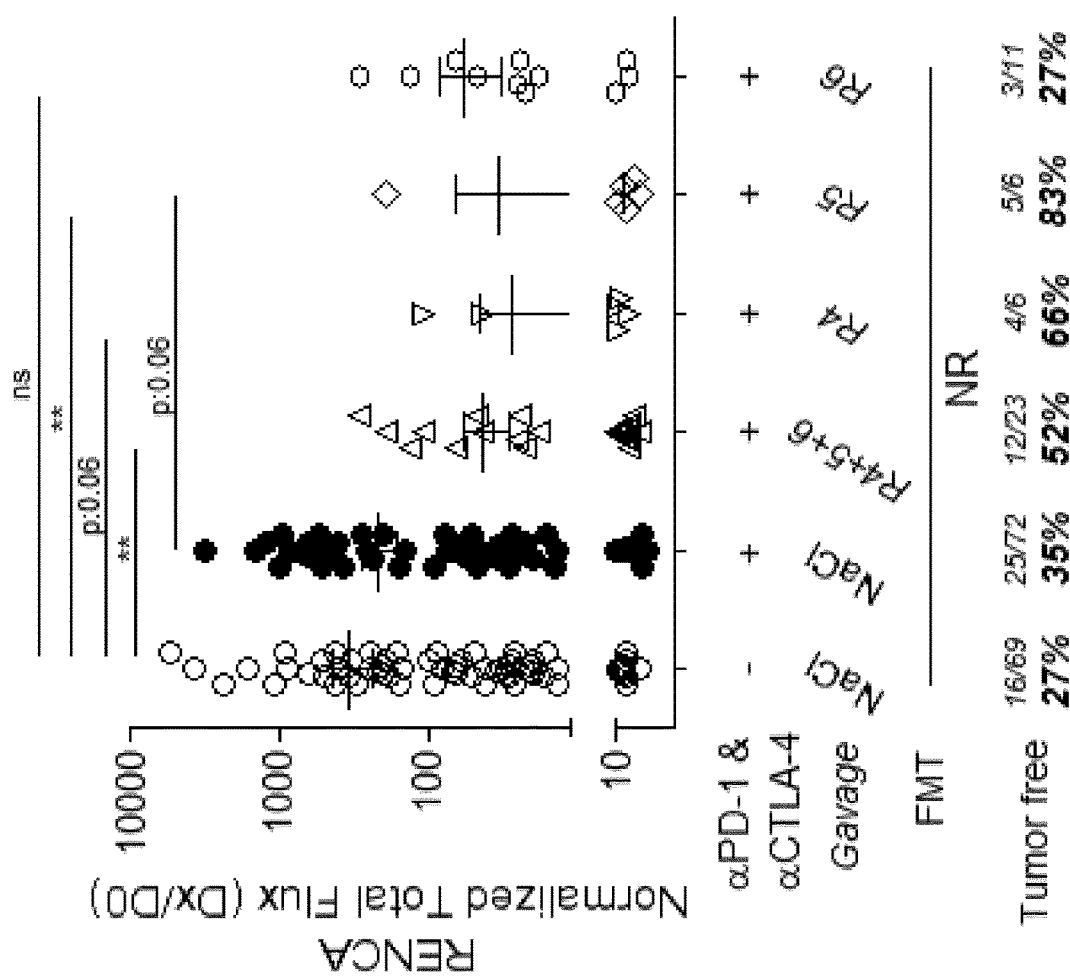

FIG. 38: Compensating a dysbiosis from a kidney cancer patient (RCC) with feces from a responding patient-derived stools for restoring the response to immune checkpoint inhibitors. BALB/c mice were treated with 3 days of broad spectrum antibiotics, followed by oral gavage with non responding patient-derived stools. Twenty days later, we inoculated in the kidney of BALB/c mice orthotopically the RENCA-luciferase tumor that we could follow with the reporter imaging system IVI. Eight days later, BALB/c mice received ip administration of anti-PD1 and anti-CTLA4 Ab every other 3 days for 5 injections. The day before each ip therapy with mAb, recipient tumor bearing mice received an oral gavage with feces ($10^{10}$ cfu) from one RCC patient who responded to anti-PD1 mAb-based therapy. Three distinct RCC responding patients (R4-R5-R6) stools were utilized. Tumor growth kinetics were followed. The graph depicts tumor sizes at sacrifice, showing individual data and also pooling the data from the 3 groups R4-R6. Anova statistical analyses:*p<0.05.

Figure 39A:
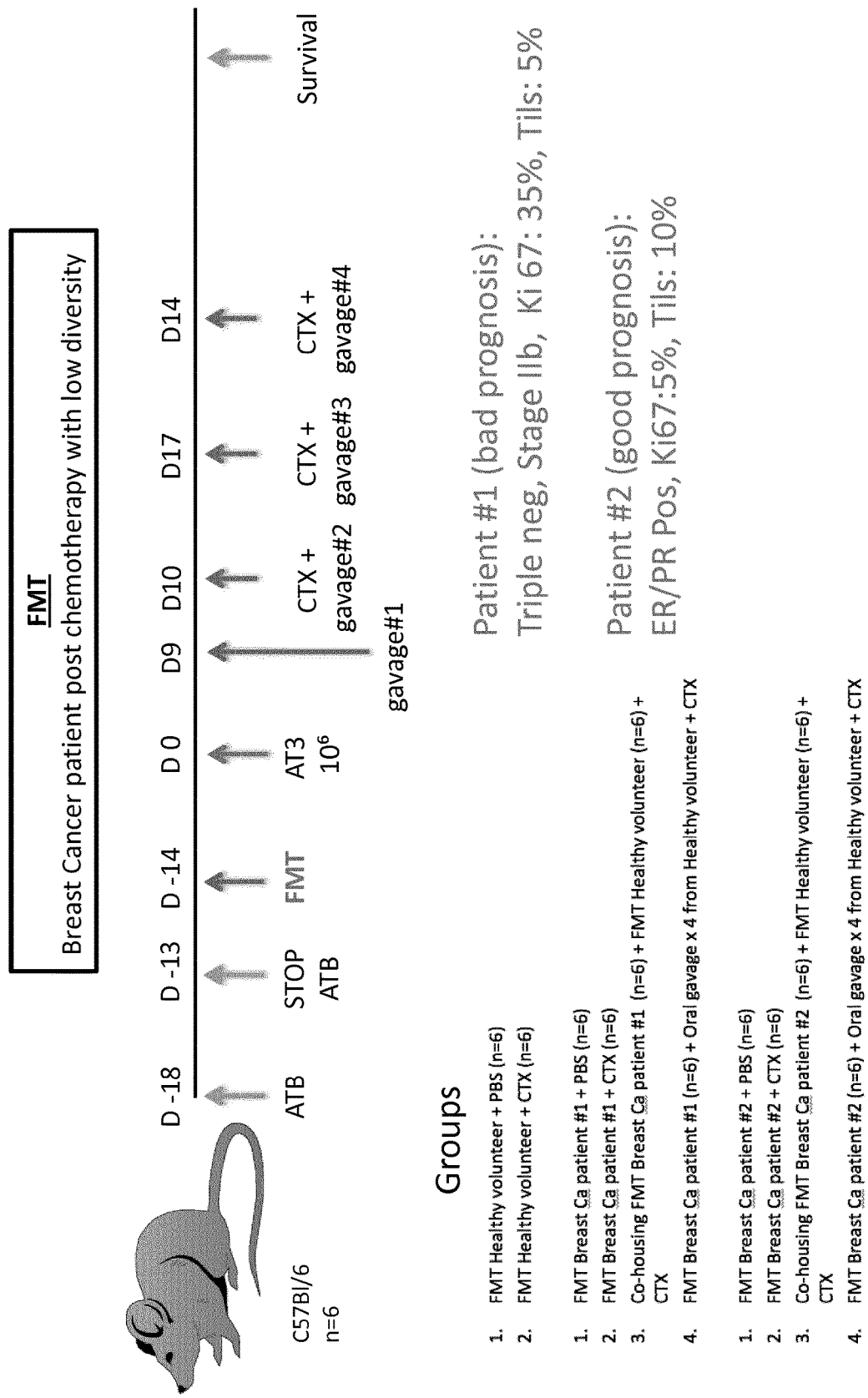
Figure 39B:
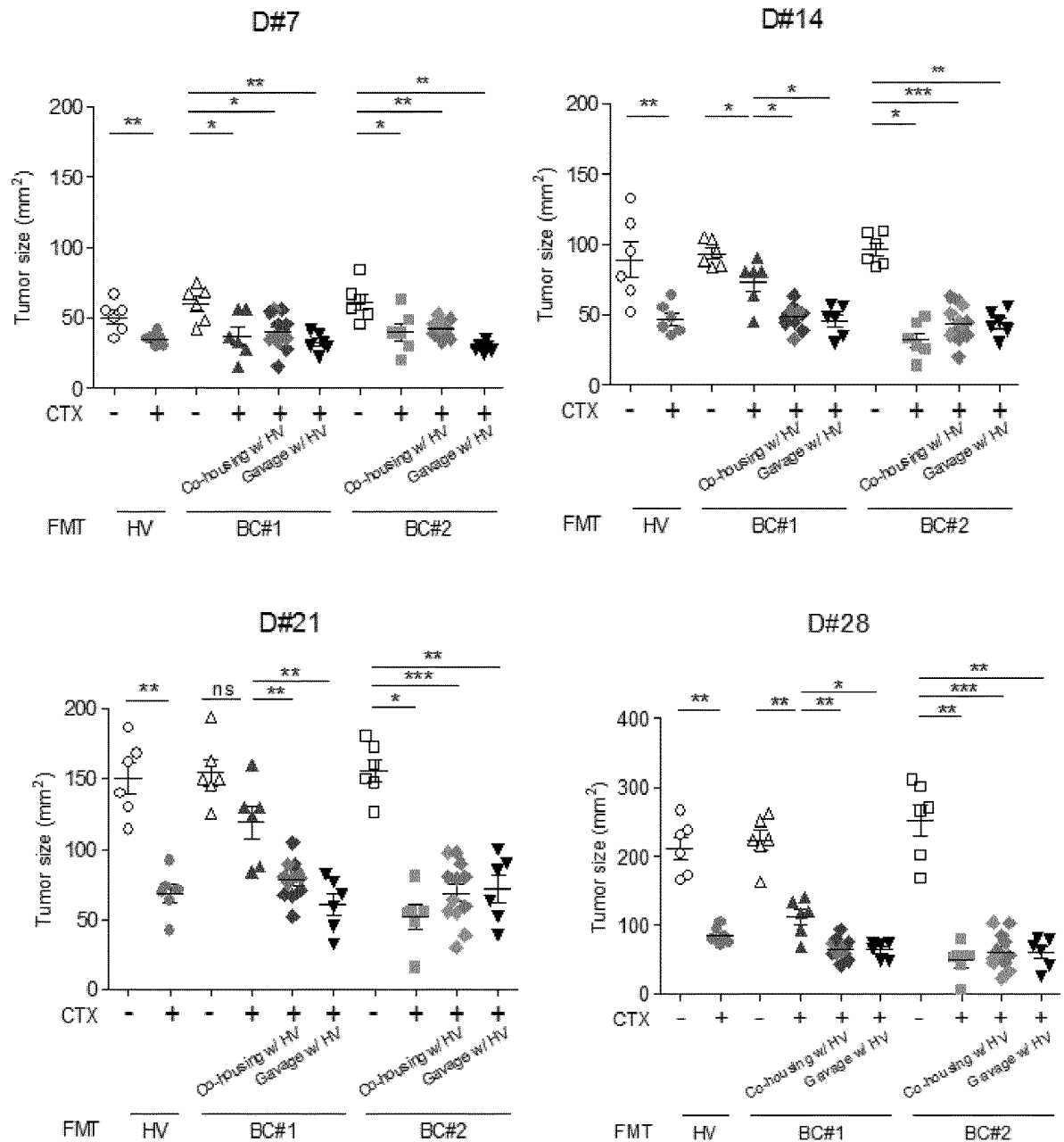

FIG. 39: Compensating a dysbiosis from a breast cancer patient (BC) with feces from a healthy volunteer (HV)-derived stools for restoring the response to metronomic cyclophosphamide (CTX). A. Experimental setting. C57BL/6 mice were treated with 3 days of broad spectrum antibiotics, followed by oral gavage (FMT) with two breast cancer patients (BC1 and BC2)-derived stools harvested post-chemotherapy when feces are dysbiostic with low diversity. BC1 is a triple negative BC with dismal prognosis while BC2 has a favorable prognosis. Twenty days later, we inoculated in the AT3 breast syngeneic mouse tumor sc. Ten days later, C57BL/6 mice received ip administration of metronomic CTX every week days for 3 injections. The day before each ip therapy with CTX the first time and then the same day, recipient tumor bearing mice received an oral gavage with feces ($10^{10}$ cfu) from one HV. Alternatively, mice (that were subjected to a FMT with HV or BC) were cohoused together for 3 weeks. B. Tumor growth kinetics were followed. The graph depicts tumor sizes over time and at sacrifice. Anova statistical analyses:*p<0.05; p<0.01; *p<0.001.

Figure 40A:
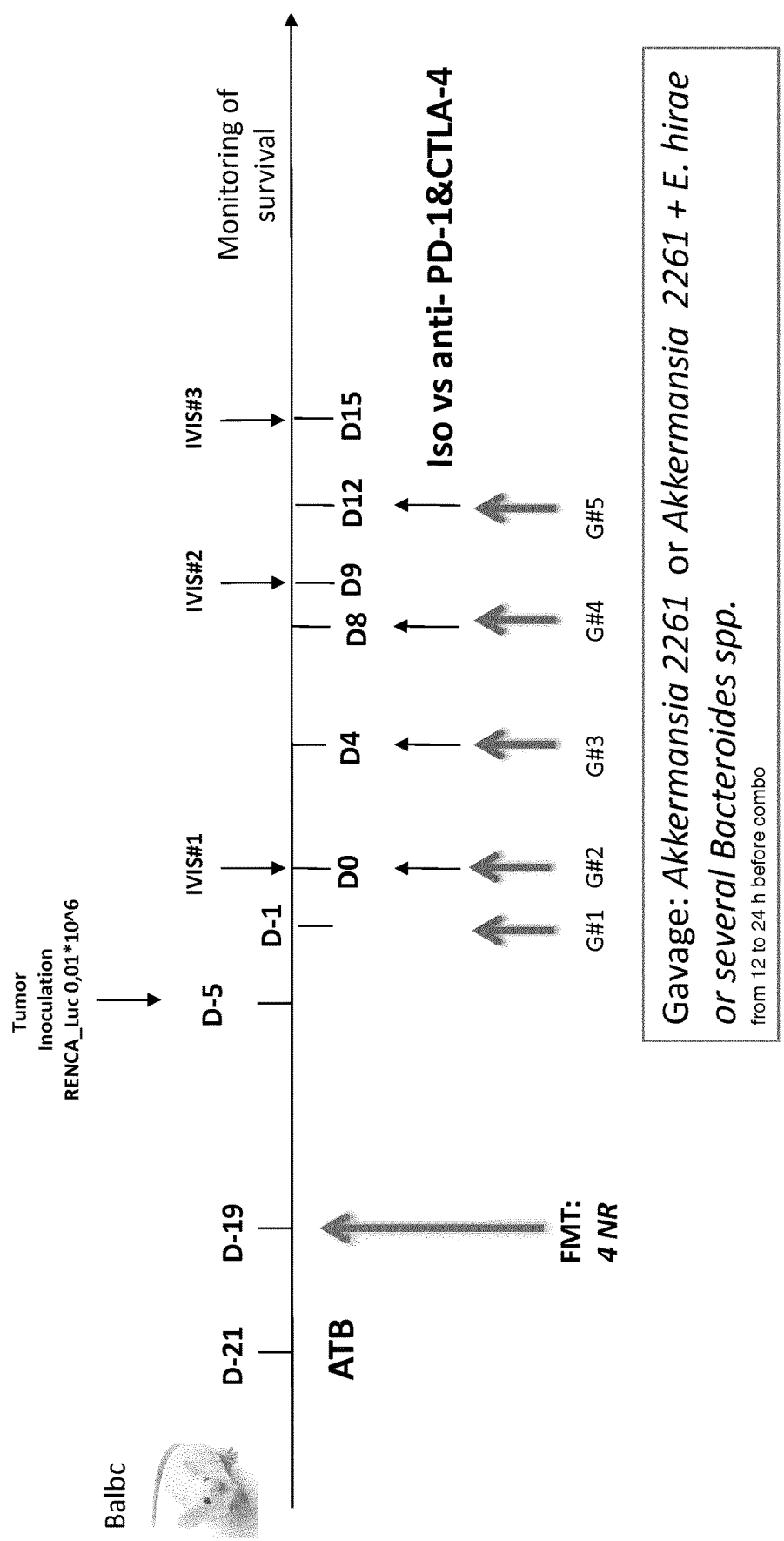
Figure 40B:
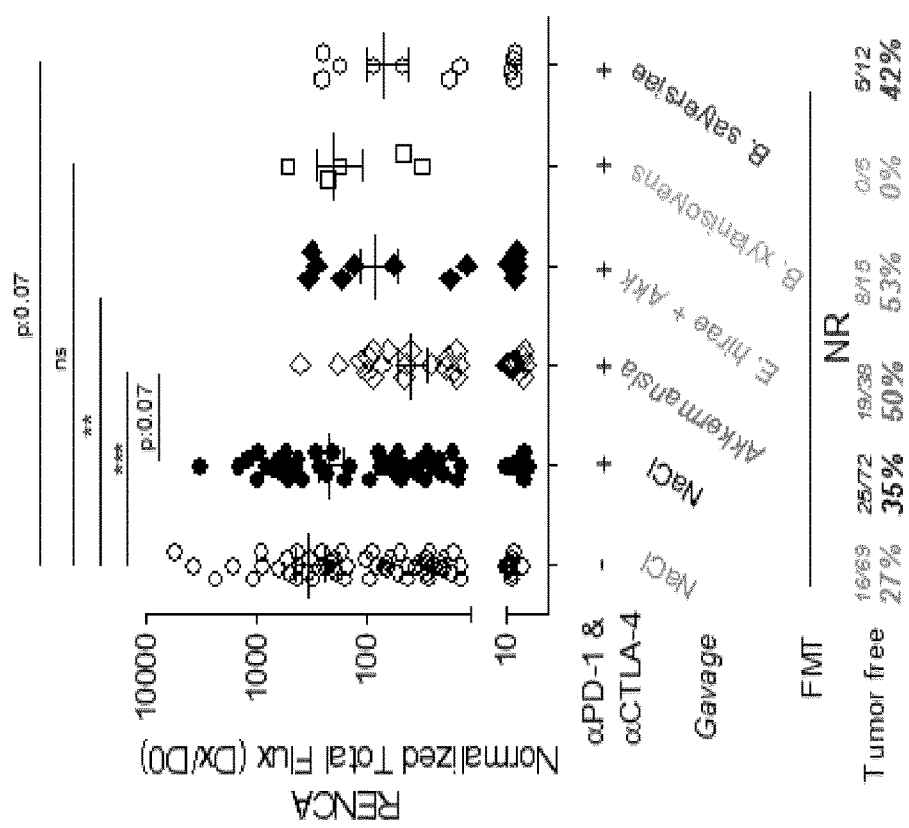

FIG. 40: Compensating a dysbiosis from a non responding kidney cancer patient (RCC) with defined strains for restoring the response to immune checkpoint inhibitors. A. BALB/c mice were treated with 3 days of broad spectrum antibiotics, followed by oral gavage with non responding patient-derived stools. Twenty days later, we inoculated in the kidney of BALB/c mice orthotopically the RENCA-luciferase tumor that we could follow with the reporter imaging system IVI. Eight days later, BALB/c mice received ip administration of anti-PD1 and anti-CTLA4 Ab every other 3 days for 5 injections. The day before each ip therapy with mAb, recipient tumor bearing mice received an oral gavage with $10^{10}$ cfu of various strains (listed in X axis). B. Tumor growth kinetics were followed. The graph depicts tumor sizes at sacrifice. The percentages of tumor free mice at sacrifice is indicated below. Anova statistical analyses: *p<0.05; p<0.01; *p<0.001.

Figure 41:
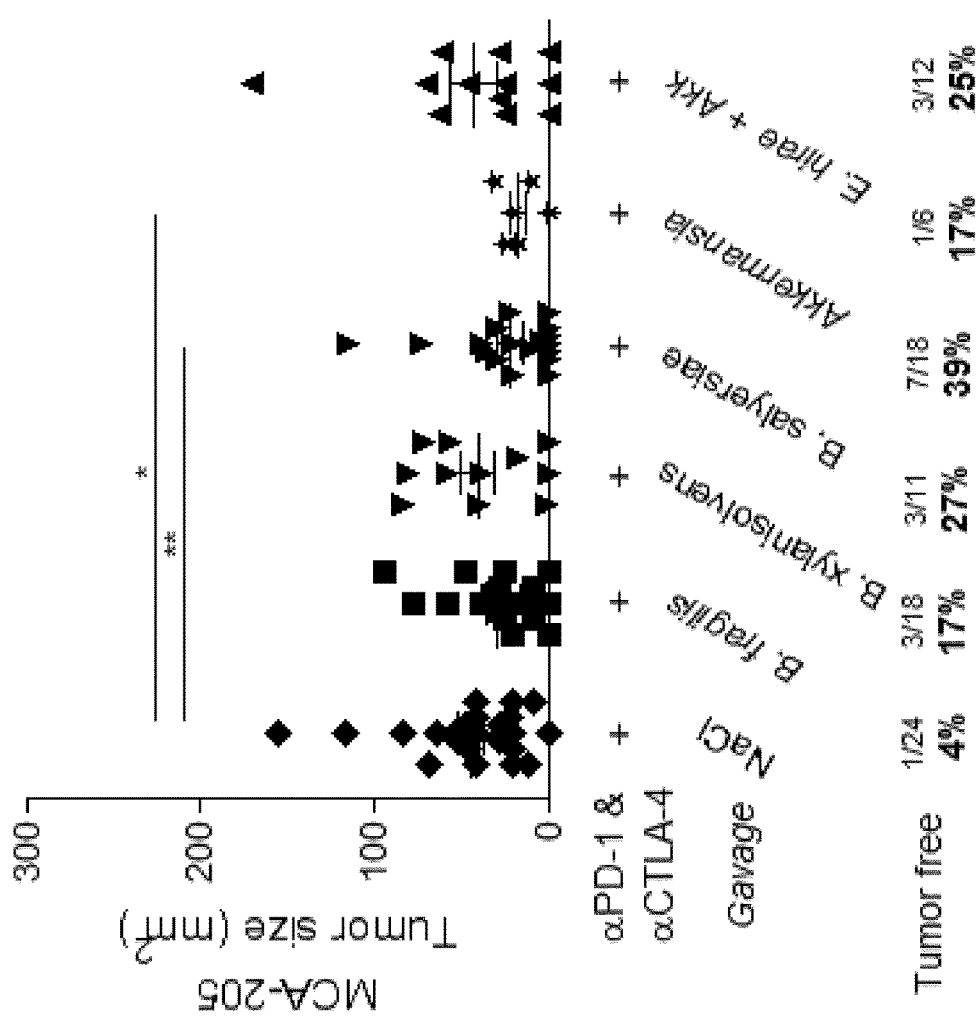

FIG. 41: Compensating a dysbiosis from a non responding kidney cancer patient (RCC) with *Bacteroides salyersae* for restoring the response to immune checkpoint inhibitors. C57BL/6 mice were treated with 3 days of broad spectrum antibiotics, followed by oral gavage with non responding RCC patient-derived stools. Twenty days later, we inoculated in the MCA205 sarcoma sc. Eight days later, C57BL/6 mice received ip administration of anti-PD1 Ab+anti CTLA4 Ab every other 3 days for 5 injections. The day before each ip therapy with mAb, recipient tumor bearing mice received an oral gavage with $10^{10}$ cfu of various strains (listed in X axis). Tumor growth kinetics were followed. The graph depicts tumor sizes at sacrifice. The percentages of tumor free mice at sacrifice is indicated below. Anova statistical analyses:*p<0.05.

FIG. 42: Compensating a dysbiosis from a lung NSCLC patient with a consortium of 6 bacteria strains for restoring the response to anti-PD1 mAb. A. C57BL/6 mice were treated with 3 days of broad spectrum antibiotics, followed by oral gavage with non responding NSCLC patient-derived stools. Twenty days later, we inoculated the MCA205 sarcoma sc. Eight days later, C57BL/6 mice received ip administration of anti-PD1 Ab every other 3 days for 5 injections. The day before each ip therapy with mAb, recipient tumor bearing mice received an oral gavage with $10^{10}$ cfu of various strains (listed in 6A). B. Tumor growth kinetics (means+/−SEM or each individual curve) were followed. The graph depicts the growth kinetics over time in the best groups (mouse by mouse in upper panels, means in lower panels). C. All tumor sizes for all groups recapitulated at day 13. Tumor Anova statistical analyses:*p<0.05.

Figure 43:
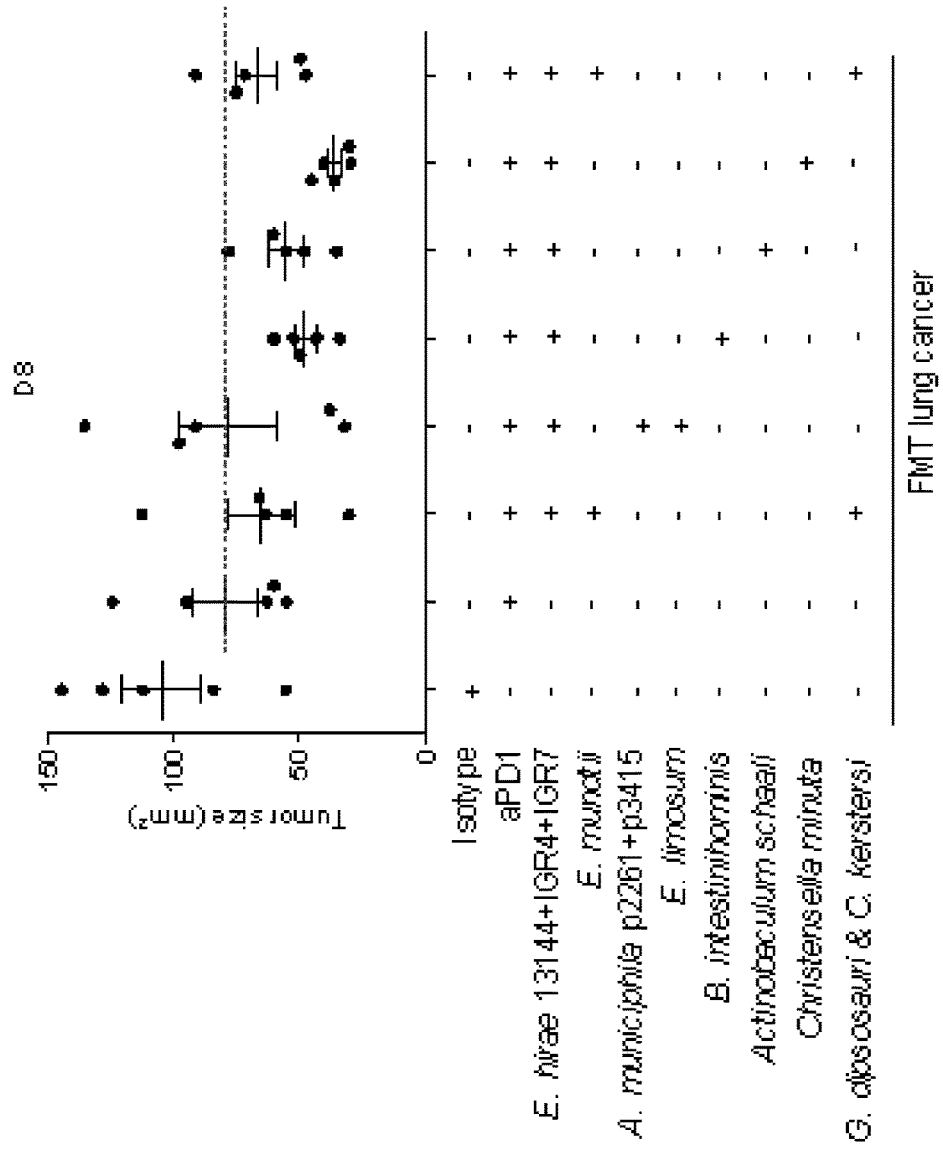

FIG. 43: Distinct consortia of bacteria are able to ameliorate anti-PD1 efficacy. C57BL/6 mice were treated with 3 days of broad spectrum antibiotics, followed by oral gavage (FMT) with lung cancer patients-derived stools. Fifteen days later, C57BL/6 mice were inoculated with MCA205 sarcoma mouse tumor sc. 4 days later, C57BL/6 mice received ip administration of anti-PD1 every 3 days for a total of 4 injections eventually orally gavaged with a consortium of bacteria composed of 109 cfu of various strains (listed in X axis). Tumor growth kinetics were followed. Tumor growth depicted at day 8 post gavage. Each dot represents one mouse tumor size. A representative experiment out of two yielding similar results is depicted.

Figure 44:
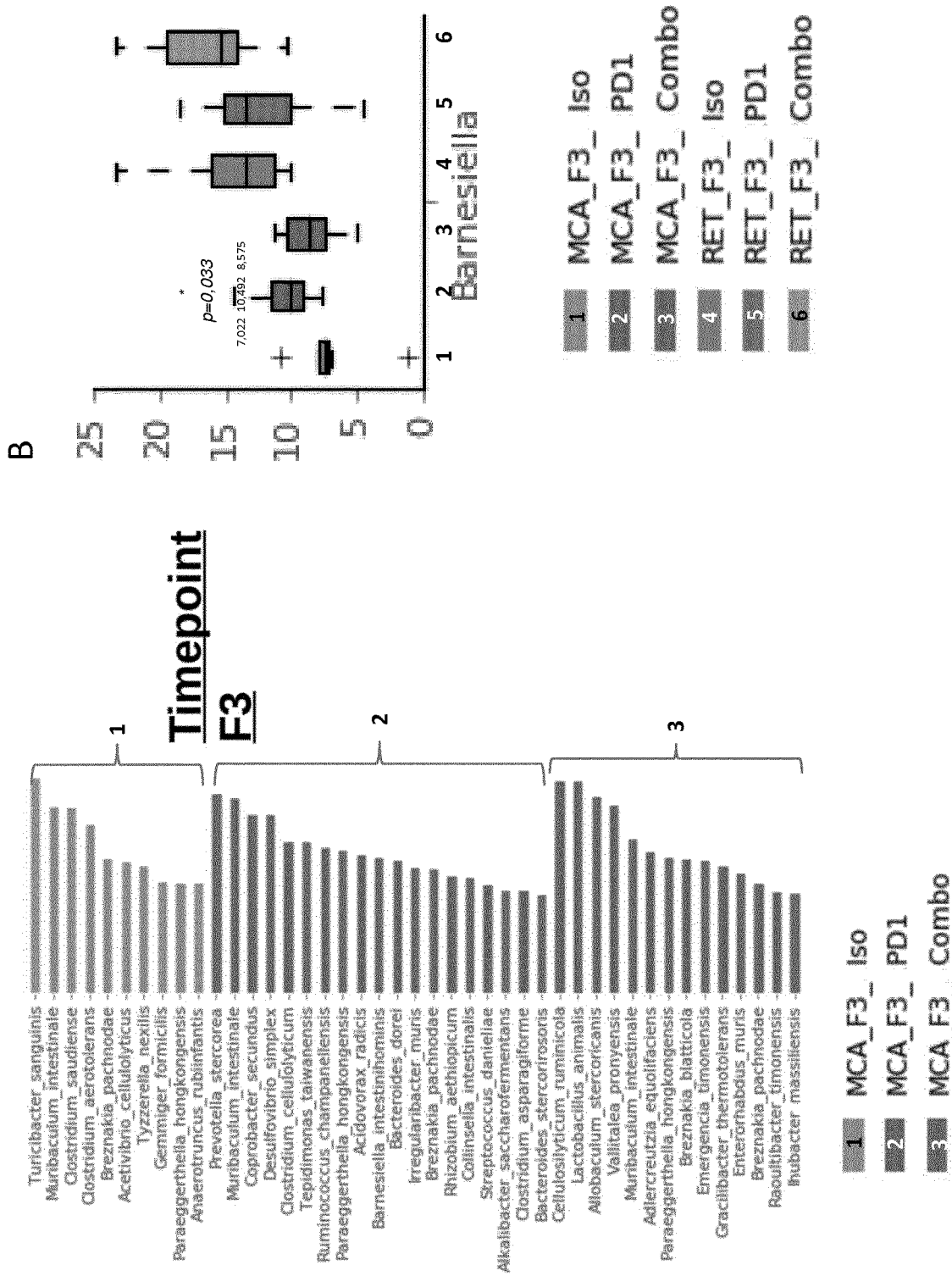

FIG. 44: *Barnesiella intestinihominis* is contained in the hallmark signature of therapy with anti-PD1 Abs (and response to this therapy). C57BL/6 mice were inoculated with MCA205 sarcoma mouse tumor sc. 6 days later, C57BL/6 mice received ip administration of anti-PD1 or anti-PD1/anti-CTLA4 Ab combination every 3 days for a total of 6 injections. Metagenomic analysis of stools after PD1 blockade or PD1+CTLA4 co-blockade to define specific gut fingerprints associated with each mAb therapy. Lefse (A) and boxplots (B) graphs after two injections of mAb-based immunotherapy (F3). Kruskal-Wallis analysis; p<0.05. MCA205 is a sarcoma while RET is a melanoma (not shown). *Barnesiella intestinihominis* is therefore selected post-PD1 blockade and associated with the clinical benefit.

Figure 45:
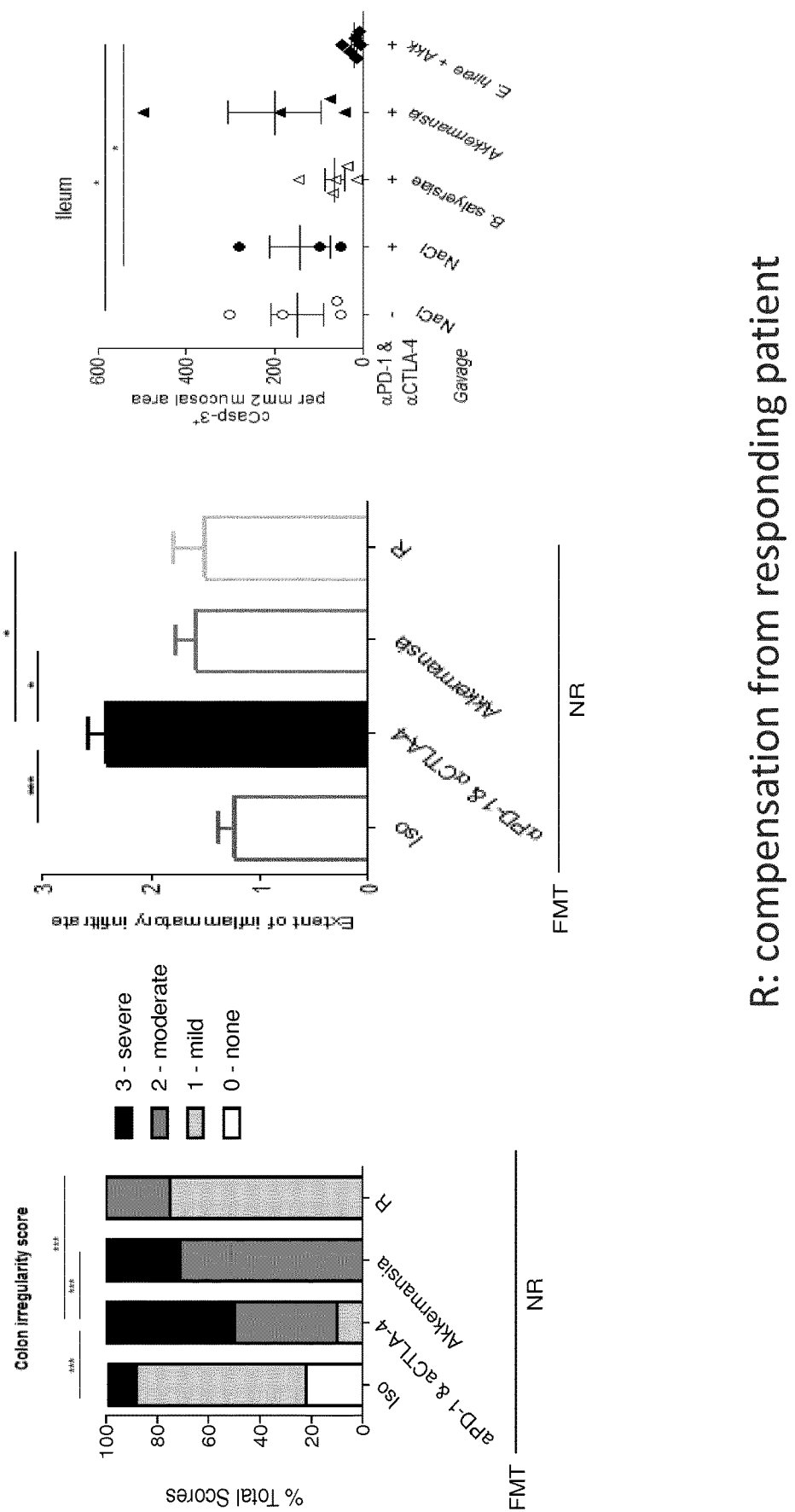

FIG. 45. Immunohistochemistry analyzing gut toxicity (crypts irregularities, loss of villosities, inflammatory patterns) in hematoxylin eosin or staining with anti-cleaved caspase3 Ab. Experimental settings described in FIG. 40-42. Transfer of feces from responders reduce toxicity obtained with feces from non responders. FMT compensated with oncobax reduces colitis scores.

Figure 46:
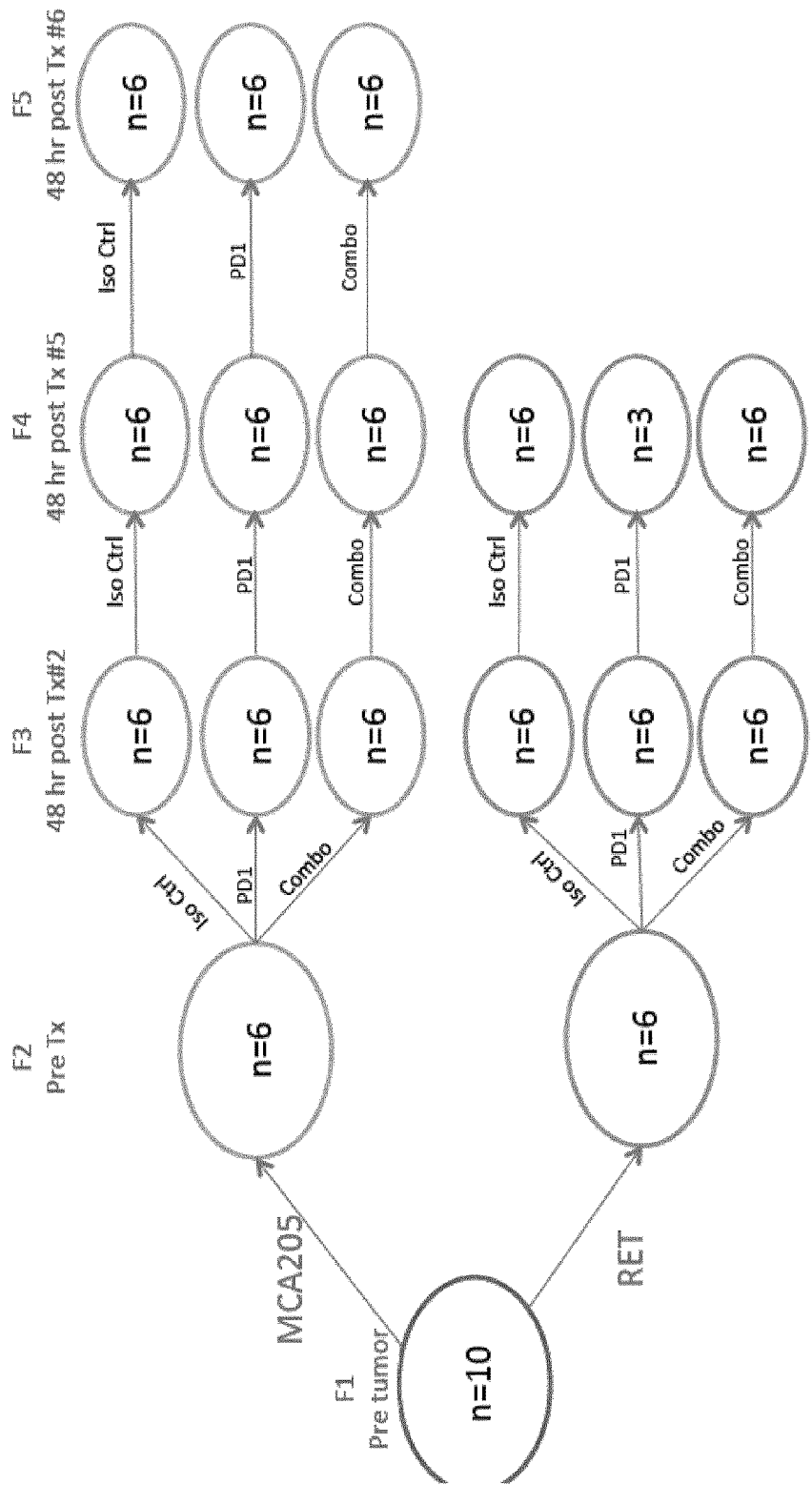

FIG. 46. Experimental setting and samples collection timing in two independent tumor mouse models. Timing of fecal samples collection from two different mouse tumor models. MCA-205-sarcoma or RET-melanoma were inoculated in SPF mice and subsequently treated with monotherapy anti-PD-1 mAb (n=6), combination anti-PD-1 mAb+anti-CTLA-4 mAb (n=6) or Iso Ctrl (n=6). F1: before tumor inoculation. F2: 5-7 days after tumor inoculation and before the first treatment. F3: 48 hr after the $2^{nd}$ injection. F4: 48 hr after the $5^{th}$ injection. F5: 48 hr after the $6^{th}$ injection.

Figure 47:
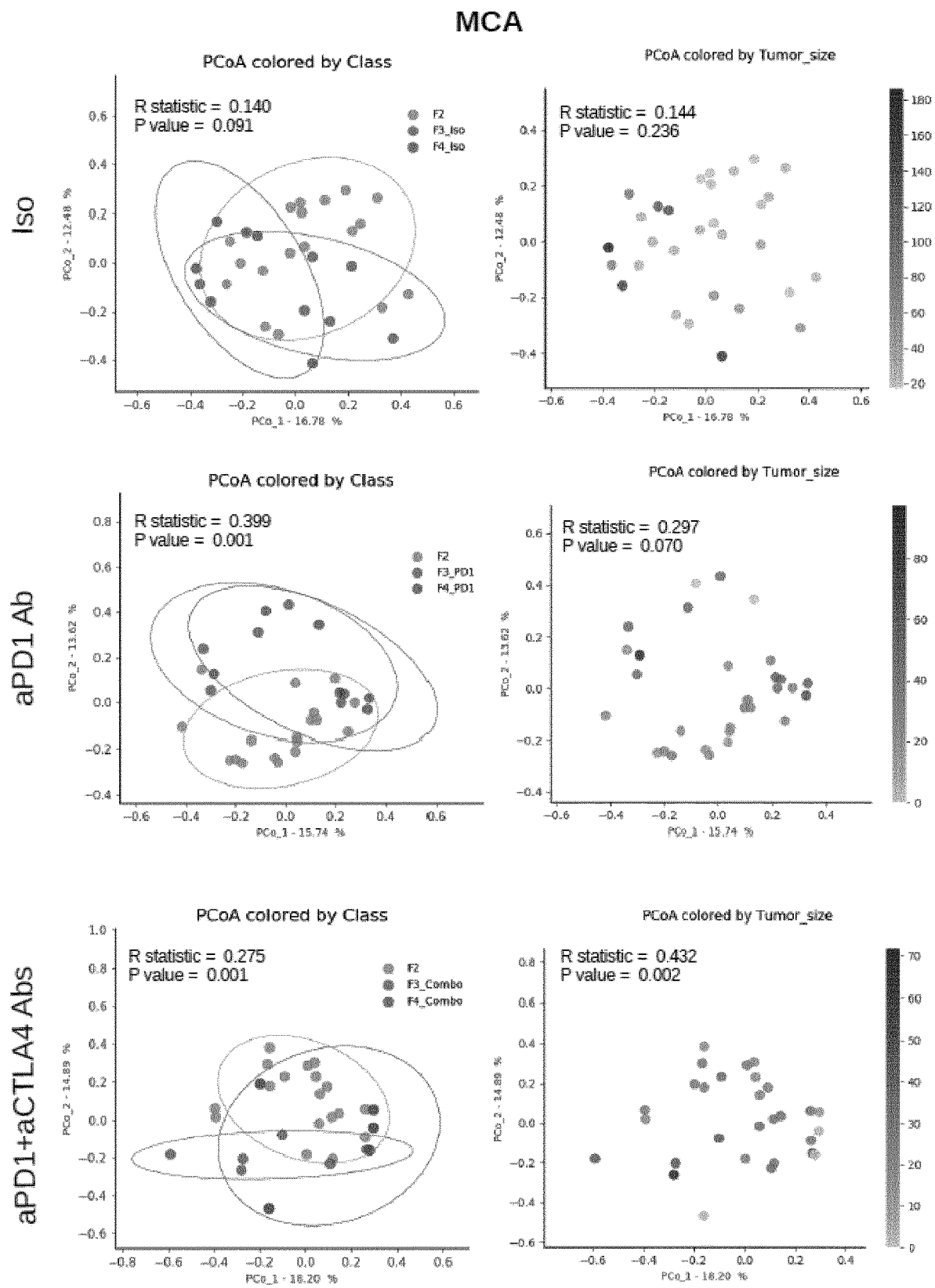

FIG. 47: Gut microbiota composition is influenced by anti-PD-1 monotherapy or in combination with anti-CTLA-4 mAb, and tumor size in MCA-205 mouse model. Left panels: Principle component analysis (PCA) graphs represent the beta-diversity of taxonomy derived from the 16 S rRNA sequencing of stools (exp setting FIG. 46), based on Bray-Curtis distance at different time points F2-F3-F4 for each group (IsoCtrl, PD-1, and combo: PD-1+anti-CTLA-4). Right panels: R statistic (from ANOSIM) evaluating the bacterial taxonomy diversity for each treatment group with the tumor size. An R value close to "1.0" suggests difference between groups (for a definite criterion), while an R value close to "0" suggests an even distribution of high and low ranks within and between groups. R values below "0" suggest that differences are greater within groups than between groups.

Figure 48:
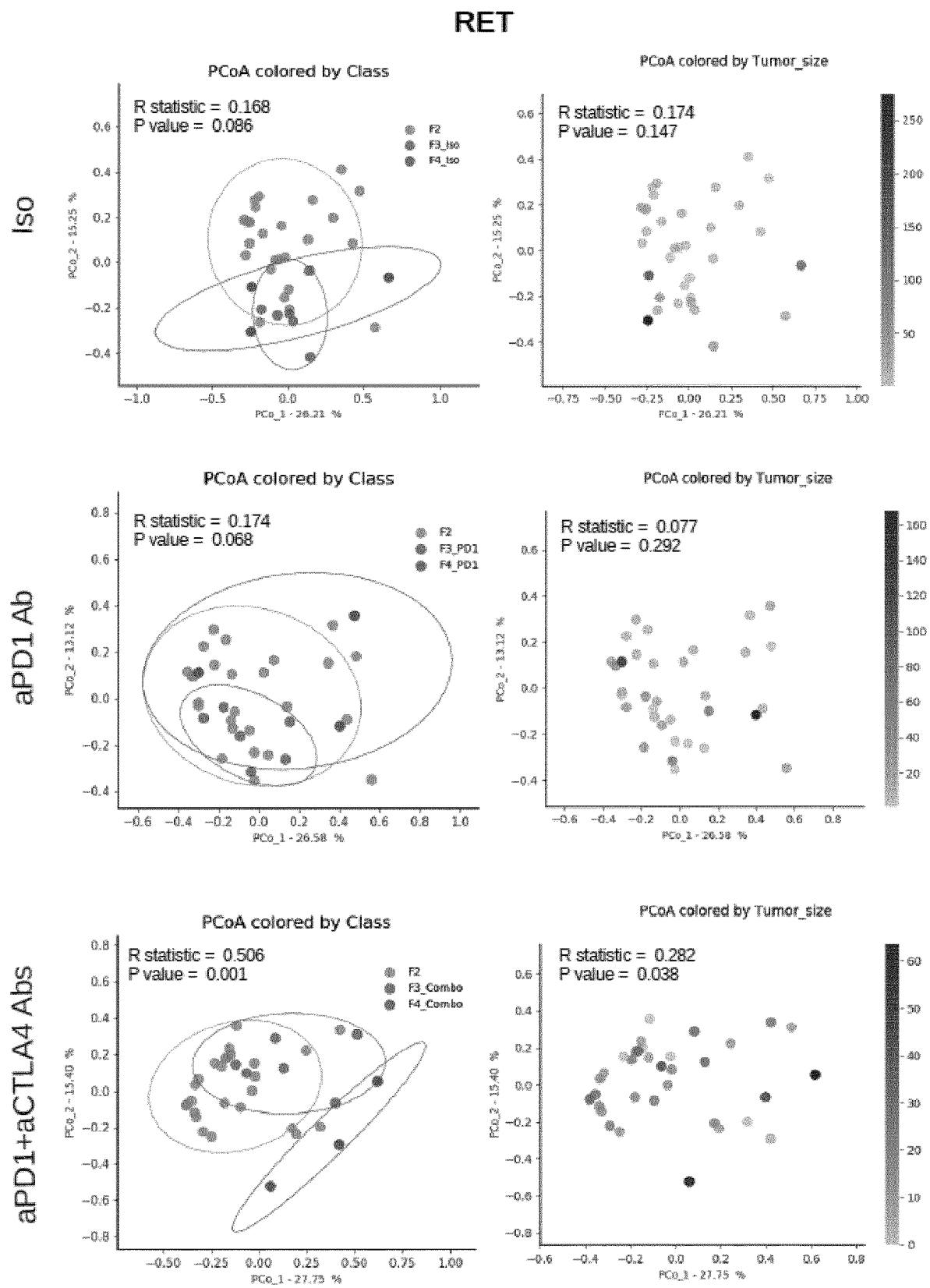

FIG. 48: Gut microbiota changes are influenced by the ICB combination (anti-PD-1+anti-CTLA-4 Abs) and correlate with tumor size in RET mouse model. Left panels: Principal component analysis representing the bacterial taxonomy-beta-diversity obtained in 16 S rRNA sequencing of stools (exp setting FIG. 46), based on Bray-Curtis distance at different time point F2-F3-F4 in each group (IsoCtrl, PD-1, and combo: anti-PD-1+anti-CTLA-4 Abs). Right panels: R statistic (from ANOSIM) evaluating the diversity for each treatment group with the tumor size. An R value close to "1.0" suggests difference between groups (for a definite criterion), while an R value close to "0" suggests an even distribution of high and low ranks within and between groups. R values below "0" suggest that differences are greater within groups than between groups.

Figure 49:
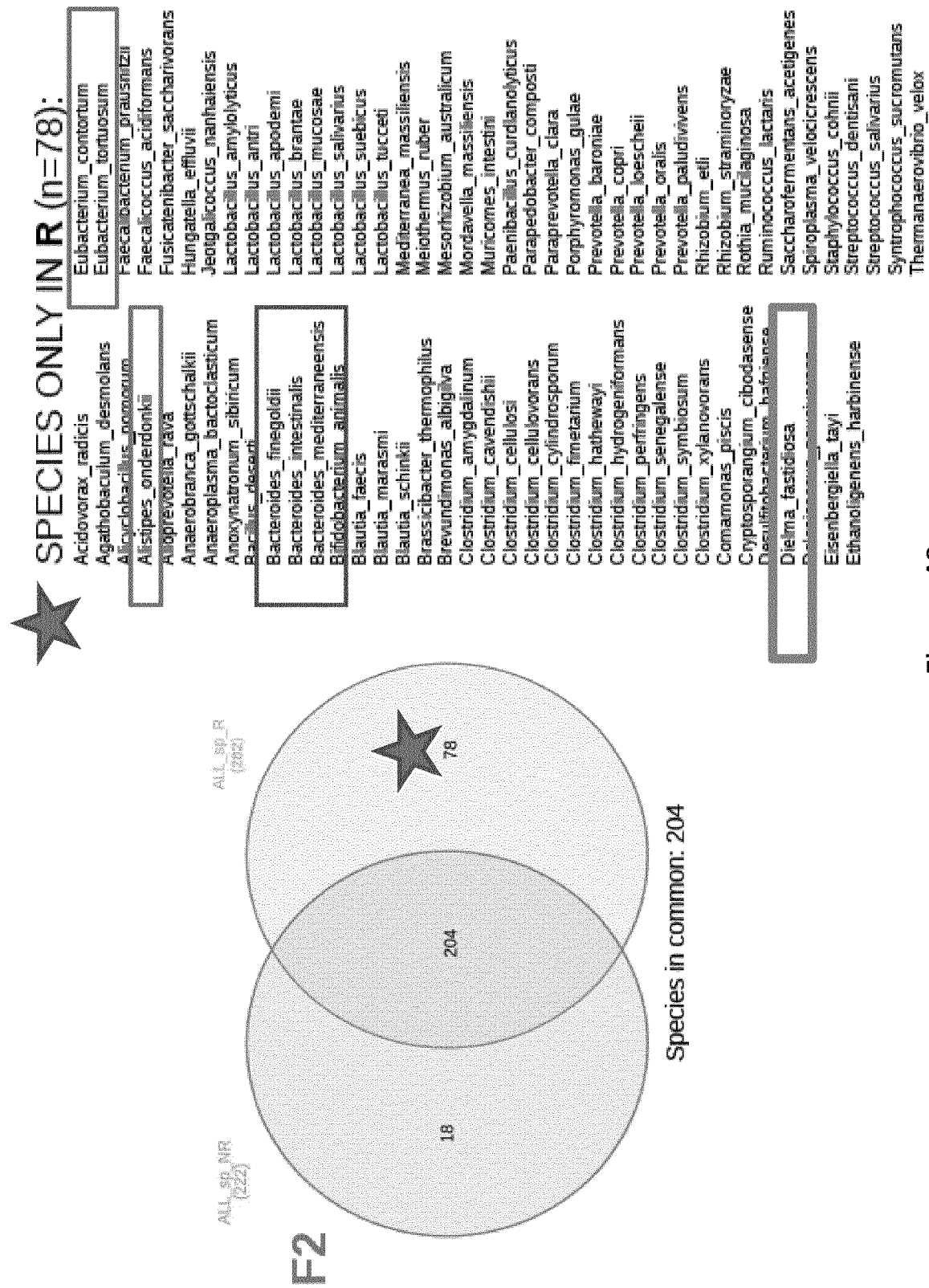

FIG. 49: Distinctive baseline microbiota composition and bacterial spp. predicting response or resistance to ICB in Exp setting FIG. 46. 16 S rRNA pyrosequencing analysis of baseline fecal composition (F2) of mice inoculated with either RET or MCA-205. Animals were segregated according to their tumor sizes upon killing in two groups responders (R) and non-responders (NR) regardless of their treatments (Iso Control, PD-1 or PD-1+Anti-CTLA-4). Among the responders, 78 bacteria were only found in this R group relative to the NR group.

Figure 50:
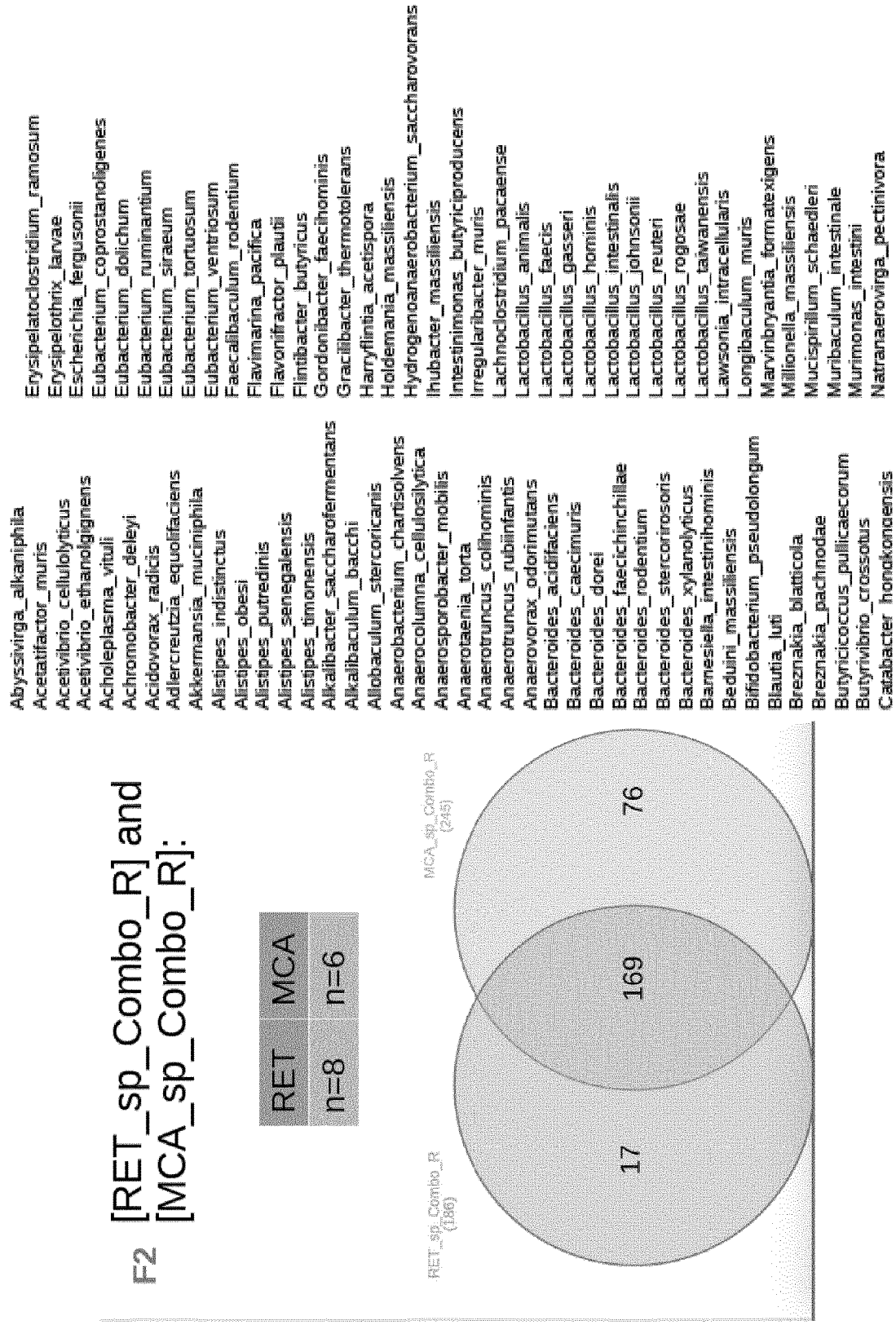

FIG. 50: Species associated with beneficial response in mice treated with the combination of immune checkpoint blockers (anti-PD-1+anti-CTLA-4 Abs). 16 S rRNA pyrosequencing analysis of gene amplicons in baseline fecal samples at F2 in mice inoculated with MCA-205 or RET. 169 bacteria species were common in responder mice treated with anti-PD-1+anti-CTLA-4 mAbs in both tumor models.

DETAILED DESCRIPTION OF THE PREFERRED EMBODIMENTS

In the present text, the following general definitions are used:

Gut Microbiota

The "gut microbiota" (formerly called gut flora or microflora) designates the population of microorganisms living in the intestine of any organism belonging to the animal kingdom (human, animal, insect, etc.). While each individual has a unique microbiota composition (60 to 80 bacterial species are shared by more than 50% of a sampled population on a total of 400-500 different bacterial species/individual), it always fulfils similar main physiological functions and has a direct impact on the individual's health:
- it contributes to the digestion of certain foods that the stomach and small intestine are not able to digest (mainly non-digestible fibers);
- it contributes to the production of some vitamins (B and K);
- it protects against aggressions from other microorganisms, maintaining the integrity of the intestinal mucosa;
- it plays an important role in the development of a proper immune system;
- a healthy, diverse and balanced gut microbiota is key to ensuring proper intestinal functioning.

Taking into account the major role gut microbiota plays in the normal functioning of the body and the different functions it accomplishes, it is nowadays considered as an "organ". However, it is an "acquired" organ, as babies are born sterile; that is, intestine colonisation starts right after birth and evolves afterwards.

The development of gut microbiota starts at birth. Sterile inside the uterus, the newborn's digestive tract is quickly colonized by microorganisms from the mother (vaginal, skin, breast, etc.), the environment in which the delivery takes place, the air, etc. From the third day, the composition of the intestinal microbiota is directly dependent on how the infant is fed: breastfed babies' gut microbiota, for example, is mainly dominated by *Bifidobacteria*, compared to babies nourished with infant formulas.

The composition of the gut microbiota evolves throughout the entire life, from birth to old age, and is the result of different environmental influences. Gut microbiota's balance can be affected during the ageing process and, consequently, the elderly have substantially different microbiota than younger adults.

While the general composition of the dominant intestinal microbiota is similar in most healthy people (4 main phyla, i.e., *Firmicutes, Bacteroidetes, Actinobacteria* and *Proteobacteria*), composition at a species level is highly personalised and largely determined by the individuals' genetic, environment and diet. The composition of gut microbiota may become accustomed to dietary components, either temporarily or permanently. Japanese people, for example, can digest seaweeds (part of their daily diet) thanks to specific enzymes that their microbiota has acquired from marine bacteria.

Dysbiosis

Although it can adapt to change and has a high resilience capacity, a loss of balance in gut microbiota composition may arise in some specific situations. This is called "dysbiosis", a disequilibrium between potentially "detrimental" and "beneficial" bacteria in the gut or any deviation to what is considered a "healthy" microbiota in terms of main bacterial groups composition and diversity. Dysbiosis may be linked to health problems such as functional bowel disorders, inflammatory bowel diseases, allergies, obesity and diabetes. It can also be the consequence of a treatment, such as a cytotoxic treatment or an antibiotic treatment. Here we will call "dysbiosis" any deviation of the gut composition observed in cancer patients compared to the gut composition from healthy individuals and "dysbiosis associated with lack of response to PD1/PD-L1 blockade" any under- or over-representation of distinct species described in Tables 1 and 2, respectively.

Antineoplastic Treatments

"Antineoplastic treatments" herein designate any treatment for cancer except surgery. They include chemotherapy, hormonal and biological therapies, and radiotherapy.

Biological Therapies

Anti-cancer "biological therapies" involve the use of living organisms, substances derived from living organisms, or laboratory-produced versions of such substances to treat cancer, by targeting either the cancer cells directly, or by stimulating the body's immune system to act against cancer cells ("immunotherapy"). Biological therapies include monoclonal antibodies (Mabs) (including those targeting cancer cell surface, e.g. rituximab and Alemtuzumab; anti-CTLA4 Mabs, such as Ipilimumab; targeting growth factors, e.g.: Bevacizumab, Cetuximab, Panitumumab and Trastuzumab; anti-PD1 Mabs, such as Nivolumab and Pembrolizumab; anti-Tim3 Mabs; anti-PD-L1 Mabs, such as Atezolizumab, Durvalumab, and Avelumab; anti-PD-L2 Mabs), agonistic antibodies (anti-ICOS Mabs, anti-OX40, anti-41 BB mAbs), immunoconjugates (e.g.: $^{90}$Y-ibritumomab tiuxetan, $^{131}$I-tositumomab, and ado-trastuzumab emtansine), cytokines (including interferons such as IFNα; interleukins such as IL-2, IL-11, G-CSF, GM-CSF), therapeutic vaccines (e.g.: Sipuleucel-T (Provenge®)), the bacterium *bacillus* Calmette-Guerin, cancer-killing viruses (oncolytic), gene therapy, and adoptive T-cell transfer.

Immune Checkpoint Blockers

In the present text, a "drug blocking an immune checkpoint", or "immune checkpoint blocker" or "immune checkpoint blockade drug" designates any drug, molecule or composition which blocks an immune checkpoint. In particular, it encompasses anti-CTLA-4 antibodies, anti-PD1 antibodies, anti-PD-L1 antibodies (such as Atezolizumab or Durvalumab) and anti-PD-L2 antibodies. More particularly, it can be an anti-PD1 monoclonal antibody such as Nivolumab or Pembrolizumab.

An "anti-PD1/PD-L1/PD-L2 Ab-based therapy" herein designates any drug that antagonizes PD1 or PD-L1 or PD-L2. Although the currently used drugs antagonizing PD1 or PD-L1 or PD-L2 are monoclonal antibodies, other molecules specifically binding to PD1, PD-L1 or PD-L2 could be used for the development of future ICB such as, for example, antibody fragments or specifically designed aptamers. Of course, the phrase "anti-PD1/PD-L1/PD-L2 Ab-based therapy" encompasses any therapy with active molecules that antagonize PD1 or PD-L1 or PD-L2.

Probiotics

"Probiotics" are micro-organisms that have claimed health benefits when consumed. Probiotics are commonly consumed as part of fermented foods with specially added active live cultures, such as in yogurt, soy yogurt, or as dietary supplements. Generally, probiotics help gut microbiota keep (or re-find) its balance, integrity and diversity. The effects of probiotics can be strain-dependent. Here we will use the phrase "anticancer probiotics" or the neologisms "oncobax" and "oncomicrobiotics" to designate any commensal composition that restores responsiveness to PD1/PD-L1 blockade or combination of anti-CTLA4+anti-PD1 or PD-L1 Ab. In the context of the present invention, a "probiotic composition" is thus not limited to food or food supplements, but it generally designates any bacterial composition comprising microorganisms which are beneficial to the patients. Such probiotic compositions can hence be medicaments or drugs.

Cancer, Treatment, Etc.

As used herein, "cancer" means all types of cancers. In particular, the cancers can be solid or non solid cancers. Non limitative examples of cancers are carcinomas or adenocarcinomas such as breast, prostate, ovary, lung, pancreas or colon cancer, sarcomas, lymphomas, melanomas, leukemias, germ cell cancers and blastomas.

The immune system plays a dual role against cancer: it prevents tumor cell outgrowth and also sculpts the immunogenicity of the tumor cells. Drugs blocking an immune checkpoint can hence be used to treat virtually any type of cancer. Thus, the methods according to the invention are potentially useful for patients having a cancer selected amongst adrenal cortical cancer, anal cancer, bile duct cancer (e.g. periphilar cancer, distal bile duct cancer, intrahepatic bile duct cancer), bladder cancer, bone cancers (e.g. osteoblastoma, osteochrondroma, hemangioma, chondro- myxoid fibroma, osteosarcoma, chondrosarcoma, fibrosarcoma, malignant fibrous histiocytoma, giant cell tumor of the bone, chordoma, lymphoma, multiple myeloma), brain and central nervous system cancers (e.g. meningioma, astocytoma, oligodendrogliomas, ependymoma, gliomas, medulloblastoma, ganglioglioma, Schwannoma, germinoma, craniopharyngioma), breast cancer (e.g. ductal carcinoma in situ, infiltrating ductal carcinoma, infiltrating lobular carcinoma, lobular carcinoma in situ, gynecomastia), Castleman disease (e.g. giant lymph node hyperplasia, angiofollicular lymph node hyperplasia), cervical cancer, colorectal cancer, endometrial cancers (e.g. endometrial adenocarcinoma, adenocanthoma, papillary serous adenocarcinoma, clear cell), esophagus cancer, gallbladder cancer (mucinous adenocarcinoma, small cell carcinoma), gastrointestinal carcinoid tumors (e.g. choriocarcinoma, chorioadenoma destruens), Hodgkin's disease, non-Hodgkin's lymphoma, Kaposi's sarcoma, kidney cancer (e.g. renal cell cancer), laryngeal and hypopharyngeal cancer, liver cancers (e.g. hemangioma, hepatic-adenoma, focal nodular hyperplasia, hepatocellular carcinoma), lung cancers (e.g. small cell lung cancer, non-small cell lung cancer), mesothelioma, plasmacytoma, nasal cavity and paranasal sinus cancer (e.g. esthesioneuroblastoma, midline granuloma), nasopharyngeal cancer, neuroblastoma, oral cavity and oropharyngeal cancer, ovarian cancer, pancreatic cancer, penile cancer, pituitary cancer, prostate cancer, retinoblastoma, rhabdomyosarcoma (e.g. embryonal rhabdomyosarcoma, alveolar rhabdomyosarcoma, pleomorphic rhabdomyosarcoma), salivary gland cancer, skin cancer (e.g. melanoma, nonmelanoma skin cancer), stomach cancer, testicular cancers (e.g. seminoma, nonseminoma germ cell cancer), thymus cancer, thyroid cancers (e.g. follicular carcinoma, anaplastic carcinoma, poorly differentiated carcinoma, medullary thyroid carcinoma, thyroid lymphoma), vaginal cancer, vulvar cancer, and uterine cancer (e.g. uterine leiomyosarcoma). More particularly, the method according to the invention can be used for predicting and optimizing a patient's response to a medicament targeting an immune checkpoint, wherein the patient has a cancer selected from the group consisting of metastatic melanoma, non-small cell lung carcinoma (NSCLC), small cell lung cancer (SCLC), mesothelioma, bladder cancer, renal cell carcinoma, head and neck cancers, oesophageal and gastric cancers, rectal cancers, hepatocarcinoma, sarcoma, Wilm's tumor, Hodgkin lymphoma, ALK-neuroblastoma, (hormone refractory) prostate cancers and GIST.

Other definitions will be specified below, when necessary.

According to a first aspect, the present invention pertains to an in vitro theranostic method of determining if a cancer patient is likely to be a good responder to an anti-PD1/PD-L1/PD-L2 Ab-based therapy, comprising:

(i) assessing, in a feces sample from said patient, the relative abundance of at least 10 microorganism species selected from the microorganism species disclosed in Table 1 and Table 2, (ii) for each microorganism, comparing the relative abundance measured in step (i) to a predetermined threshold, wherein over-representation of microorganism species disclosed in Table 1 and under-representation of microorganism species disclosed in Table 2 are indicative that the patient is likely to be a good responder to the anti-PD1/PD-L1/PD-L2 Ab-based therapy.

TABLE 1

Bacterial species over-represented in cancer patients likely to be good responders to anti-PD1 or PD-L1 or anti-PD-L2 antibodies and under-represented in cancer patients likely to be resistant to anti-PD1 or PD-L1 or anti-PD-L2 antibodies, as well as corresponding referenced species (for already identified species) and sequences comprised therein. The information concerning the corresponding reference species can be found on the NCBI website.

| Bacterial species | Number of co-variant genes | Corresponding referenced species | Annotation | Sequences (SEQ ID Nos) |
|---|---|---|---|---|
| CAG00064 | 3310 | | unclassified | 1-25 |
| CAG00245 | 2277 | | unclassified | 51-75 |
| CAG00453 | 1942 | | NA | 1751-1775 |
| CAG00060 | 3391 | | NA | 1201-1225 |
| CAG01227 | 815 | | NA | 2776-2800 |
| CAG00774 | 1519 | Firmicutes | Firmicutes | 2076-2100 |
| CAG00604 | 1714 | Firmicutes bacterium CAG: 110 | Firmicutes | 401-425 |
| CAG01090 | 1026 | | Firmicutes | 776-800 |
| CAG00965 | 1210 | | Firmicutes | 751-775 |
| CAG00621 | 1695 | Firmicutes bacterium CAG: 272 | Firmicutes | 426-450 |
| CAG01245 | 780 | | Firmicutes | 826-850 |
| CAG01308 | 666 | | Firmicutes | 851-875 |
| CAG00669 | 1649 | | Firmicutes | 526-550 |
| CAG00670 | 1648 | | Firmicutes | 551-575 |
| CAG00872 | 1359 | Firmicutes bacterium CAG: 240 | Firmicutes | 651-675 |
| CAG00851 | 1422 | | Firmicutes | 626-650 |
| CAG00288 | 2189 | Firmicutes bacterium CAG: 95 | Firmicutes | 76-100 |
| CAG1173 | 907 | Firmicutes bacterium CAG: 321 | Firmicutes | 2626-2650 |
| CAG01223 | 819 | Firmicutes bacterium CAG: 114 | Firmicutes | 2751-2775 |
| CAG00076 | 3098 | Firmicutes bacterium CAG: 424 | Firmicutes | 1251-1275 |
| CAG00966 | 1209 | Firmicutes bacterium CAG: 552 | Firmicutes | 2351-2375 |
| CAG1086 | 1037 | Firmicutes bacterium CAG: 124 | Firmicutes | 2526-2550 |
| CAG0730 | 1576 | *Dialister succinatiphilus* | Firmicutes, Veillonellaceae | 2026-2050 |
| CAG00901 | 1313 | Unclassified Erysipelotrichaeae | Erysipelotrichaeae | 2251-2275 |
| CAG00363 | 2056 | *Intestinimonas butyriciproducens* | *Intestinimonas butyriciproducens* (closely related to *Flavonifractor plautii*) | 176-200 |
| CAG00391 | 2019 | | Clostridiales | 201-225 |
| CAG00449 | 1945 | *Clostridium* sp. CAG: 253 | Clostridiales | 276-300 |
| CAG00513 | 1853 | | Clostridiales | 326-350 |
| CAG00559 | 1776 | | Clostridiales | 376-400 |
| CAG00644 | 1670 | *Clostridium* sp. CAG: 226 | Clostridiales | 476-500 |
| CAG00811 | 1469 | | Clostridiales | 601-625 |
| CAG00907 | 1299 | | Clostridiales | 726-750 |
| CAG01350 | 597 | | Clostridiales | 876-900 |
| CAG00382 | 2033 | | Clostridiales | 1676-1700 |
| CAG1075 | 1052 | | Clostridiales | 2501-2525 |
| CAG00821 | 1461 | Clostridiales bacterium VE202 | | 2126-2150 |
| CAG119 | 2762 | *Clostridium* | Clostridiales | 1326-1350 |
| CAG1158 | 938 | Unclassified Clostridiales | Clostridiales | 2601-2625 |
| CAG1011 | 1140 | Uncultured Dore asp. | Clostridiales | 2426-2450 |
| CAG00108 | 2820 | *Clostridium paraputrificum* | Clostridiales | 1276-1300 |
| | 3314 | *Coprococcus* spp. ART 55/1 And *Coprococcus* sp. CAG: 131 | Clostridiales, Lachnospiraceae | |

TABLE 1-continued

Bacterial species over-represented in cancer patients likely to be good responders to anti-PD1 or PD-L1 or anti-PD-L2 antibodies and under-represented in cancer patients likely to be resistant to anti-PD1 or PD-L1 or anti-PD-L2 antibodies, as well as corresponding referenced species (for already identified species) and sequences comprised therein. The information concerning the corresponding reference species can be found on the NCBI website.

| Bacterial species | Number of co-variant genes | Corresponding referenced species | Annotation | Sequences (SEQ ID Nos) |
|---|---|---|---|---|
| CAG00871 | 1162 | Lachnospiraceae | Lachnospiraceae | 2226-2250 |
| CAG1146 | 956 | Oscillibacter sp. CAG: 155 | Clostridiales, Oscillospiricaeae | 2576-2600 |
| CAG00006_3 | 785 | Oscillibacter | Clostridiales, Oscillospiricaeae | 1126-1150 |
| CAG01047 | 1087 | Clostridium Incertae Sedis | Clostridiales Family XIII | 2476-2500 |
| CAG00134 | 2690 | Cloacibacillus porcorum | | 1351-1375 |
| CAG01169 | 912 | | Ruminococcaceae | 801-825 |
| CAG00210 | 2389 | Ruminococcus bicirculans | Ruminococcaceae | 1426-1450 |
| CAG00949 | 1224 | Ruminococcaceae bacterium D16 | Ruminococcaceae | 2326-2350 |
| CAG00558 | 1777 | Ruminococcus lactaris | Ruminococcaceae | 351-375 |
| CAG01262 | 750 | Ruminococcus torques 2 | Ruminococcaceae | 2826-2850 |
| CAG00250 | 2262 | Ruminococcus sp. CAG: 353 | Ruminococcaceae | 1476-1500 |
| CAG00854 | 2572 | Ruminococcaceae | Ruminococcaceae | 2176-2200 |
| CAG00880 | 1352 | Subdoligranulum sp. CAG: 314 | Subdoligranulum sp. | 676-700 |
| CAG00628 | 1686 | | Faecalibacterium | 451-475 |
| CAG001046 | 1089 | Intestinimonas butyriciproducens | Intestinimonas butyriciproducens (closely related to Flavonifractor plautii) | 2451-2475 |
| CAG00555 | 1782 | Flavonifractor plautii | | 1926-1950 |
| CAG00469 | 1928 | Eubacterium sp. CAG: 146 | Eubacterium | 301-325 |
| CAG00786 | 1484 | Eubacterium sp. CAG: 202 | Eubacterium | |
| | | Eubacterium sp. 3_1_31 | Erysipelotrichaceae bacterium 5_2_54FAA | |
| CAG00393 | 2011 | | Eubacterium | 226-250 |
| CAG00116 | 2783 | Bacteroides nordii | Bacteroidales | 26-50 |
| CAG00355 | 2067 | Bacteroides sp. CAG: 661 | Bacteroidales | 151-175 |
| CAG00440 | 1952 | Bacteroides sp. CAG: 598 | Bacteroidales | 251-275 |
| CAG0049 | 3561 | Bacteroides cacae | Bacteroidales | |
| CAG00646 | 1668 | | Alistipes | 501-525 |
| CAG00887 | 1332 | Alistipes sp. CAG: 435 | Alistipes sp. | 701-725 |
| CAG00827 | 1455 | Alistipes sp. CAG: 514 | Alistipes sp. | 2151-2175 |
| CAG00354 | 2067 | Candidatus alistipes marseilloanorexicus | Alistipes | 1626-1650 |
| CAG1244 | 783 | Parabacteroides merdae | Bacteroidales | 2801-2825 |
| CAG00062 | 3614 | Bacteroides salyersiae | Bacteroidales | 1226-1250 |
| CAG00521 | 1835 | Prevotella sp. CAG: 1058 | Bacteroidales | 1851-1875 |
| CAG00942 | 1237 | Prevotella disiens | Bacteroidales | 2301-2325 |
| CAG00301 | 3187 | Akkermansia muciniphila CAG: 154 | Akkermansia muciniphila | 101-125 |
| CAG00313 | 2139 | Coraliomargarita sp. CAG: 312 | Coraliomargarita sp. | 126-150 |
| CAG00721 | 1830 | Methanobrevibacter smithii ATCC 35061 | Methanobrevibacter smithii | 576-600 |
| CAG00302 | 2161 | Rhodospirillales | Alphaproteobacteria | 1551-1575 |
| CAG00475 | 1917 | Eggerthellaceae | Actinobacteria | 1776-1800 |

TABLE 2

Bacterial species under-represented in cancer patients likely to be good responders to anti-PD1 or PD-L1 or anti-PD-L2 antibodies and over-represented in cancer patients likely to be resistant to anti-PD1 or PD-L1 or anti-PD-L2 antibodies, as well as corresponding referenced species (for already identified species) and sequences comprised therein. The information concerning the corresponding reference species can be found on the NCBI website.

| Bacterial species | Number of co-variant genes | Corresponding referenced species | Annotation | Sequences (SEQ ID Nos) |
|---|---|---|---|---|
| CAG00931 | 1257 | | *Oscillibacter* | 901-925 |
| CAG00270 | 2225 | | *Oscillibacter* | 926-950 |
| CAG00702 | 1609 | *Bifidobacterium adolescentis* L2-32 | *Bifidobacterium adolescentis* | 951-975 |
| CAG00549 | 1788 | *Bifidobacterium longum* | Bifidobacteria | 1901-1925 |
| CAG00720 | 1590 | *Anaerotruncus colihominis* DSM 17241 | *Anaerotruncus colihominis* | 976-1000 |
| CAG00381 | 2033 | *Clostridium* sp. CAG: 242 | *Clostridium* sp. | 1001-1025 |
| CAG00365 | 2055 | *Clostridium* sp: CAG306 | *Clostridium* sp. | 1651-1675 |
| CAG01118 | 994 | Unclassified Clostridiales | *Clostridium* sp. | 2551-2575 |
| CAG00048_1 | 1403 | | Clostridiales | 1151-1175 |
| CAG00981 | 1189 | Erysipelotrichaceae | Erysipelotrichaeae | 2376-2400 |
| CAG00211 | 2389 | Firmicutes bacterium CAG: 227 | Firmicutes | 1451-1475 |
| CAG00168 | 2534 | Clostridiales bacterium VE202-14 | Clostridiales | 1026-1050 |
| CAG00353 | 2341 | *Eubacterium* sp. CAG: 252 | *Eubacterium* sp. | 1051-1075 |
| CAG01018 | 1135 | *Bilophila wadsworthia* | unclassified *Bilophila* | 1076-1100 |
| CAG00052 | 3522 | *Parabacteroides goldsteinii* | | 1176-1200 |
| CAG00141 | 2649 | *Parabacteroides distasonis* | Bacteroidales | 1376-1400 |
| CAG00492 | 2012 | *Faecalibacterium* | Firmicutes | 1826-1850 |
| CAG00259 | 2248 | Unclassified firmicutes | Firmicutes | 1501-1525 |
| CAG1214 | 832 | *Blautia* | Firmicutes | 2701-2725 |
| CAG00175 | 2509 | *Bacteroides clarus* | Bacteroidales | 1401-1425 |
| CAG00858 | 1400 | *Streptococcus thermophilus* | | 2201-2225 |

According to a particular embodiment of the above method, the relative abundance of at least 10 microorganism species selected from the microorganism species disclosed in Table 1a and Table 2a is assessed in step (i).

TABLE 1a subgroup of bacterial species over-represented in cancer patients likely to be good responders to anti-PD1 or PD-L1 or anti-PD-L2 antibodies and under-represented in cancer patients likely to be resistant to anti-PD1 or PD-L1 or anti-PD-L2 antibodies, as well as corresponding referenced species (for already identified species) and sequences comprised therein. The information concerning the corresponding reference species can be found on the NCBI website.

| Bacterial species | Number of co-variant genes | Corresponding referenced species | Annotation | Sequences (SEQ ID Nos) |
|---|---|---|---|---|
| CAG00064 | 3310 | | unclassified | 1-25 |
| CAG00245 | 2277 | | unclassified | 51-75 |
| CAG00604 | 1714 | Firmicutes bacterium CAG: 110 | Firmicutes | 401-425 |
| CAG01090 | 1026 | | Firmicutes | 776-800 |
| CAG00965 | 1210 | | Firmicutes | 751-775 |
| CAG00621 | 1695 | Firmicutes bacterium CAG: 272 | Firmicutes | 426-450 |
| CAG01245 | 780 | | Firmicutes | 826-850 |
| CAG01308 | 666 | | Firmicutes | 851-875 |
| CAG00669 | 1649 | | Firmicutes | 526-550 |
| CAG00670 | 1648 | | Firmicutes | 551-575 |
| CAG00872 | 1359 | Firmicutes bacterium CAG: 240 | Firmicutes | 651-675 |
| CAG00851 | 1422 | | Firmicutes | 626-650 |
| CAG00288 | 2189 | Firmicutes bacterium CAG: 95 | Firmicutes | 76-100 |
| CAG00363 | 2056 | | Clostridiales | 176-200 |
| CAG00391 | 2019 | | Clostridiales | 201-225 |
| CAG00449 | 1945 | *Clostridium* sp. CAG: 253 | Clostridiales | 276-300 |
| CAG00513 | 1853 | | Clostridiales | 326-350 |
| CAG00559 | 1776 | | Clostridiales | 376-400 |
| CAG00644 | 1670 | *Clostridium* sp. CAG: 226 | Clostridiales | 476-500 |
| CAG00811 | 1469 | | Clostridiales | 601-625 |
| CAG00907 | 1299 | | Clostridiales | 726-750 |

TABLE 1a-continued subgroup of bacterial species over-represented in cancer patients likely to be good responders to anti-PD1 or PD-L1 or anti-PD-L2 antibodies and under-represented in cancer patients likely to be resistant to anti-PD1 or PD-L1 or anti-PD-L2 antibodies, as well as corresponding referenced species (for already identified species) and sequences comprised therein. The information concerning the corresponding reference species can be found on the NCBI website.

| Bacterial species | Number of co-variant genes | Corresponding referenced species | Annotation | Sequences (SEQ ID Nos) |
|---|---|---|---|---|
| CAG01350 | 597 | | Clostridiales | 876-900 |
| CAG01169 | 912 | | Ruminococcaceae | 801-825 |
| CAG00880 | 1352 | Subdoligranulum sp. CAG: 314 | Subdoligranulum sp. | 676-700 |
| CAG00628 | 1686 | | Faecalibacterium | 451-475 |
| CAG00558 | 1777 | Ruminococcus lactaris | Ruminococcaceae | 351-375 |
| CAG00469 | 1928 | | Eubacterium | 301-325 |
| CAG00393 | 2011 | | Eubacterium | 226-250 |
| CAG00116 | 2783 | | Bacteroides nordii | 26-50 |
| CAG00355 | 2067 | Bacteroides sp. CAG: 661 | Bacteroides sp. | 151-175 |
| CAG00440 | 1952 | Bacteroides sp. CAG: 598 | Bacteroides sp. | 251-275 |
| CAG00646 | 1668 | | Alistipes | 501-525 |
| CAG00887 | 1332 | Alistipes sp. CAG: 435 | Alistipes sp. | 701-725 |
| CAG00301 | 3187 | Akkermansia muciniphila CAG: 154 | Akkermansia muciniphila | 101-125 |
| CAG00313 | 2139 | Coraliomargarita sp. CAG: 312 | Coraliomargarita sp. | 126-150 |
| CAG00721 | 1830 | Methanobrevibacter smithii ATCC 35061 | Methanobrevibacter smithii | 576-600 |

TABLE 2a subgroup of bacterial species under-represented in cancer patients likely to be good responders to anti-PD1 or PD-L1 or anti-PD-L2 antibodies and over-represented in cancer patients likely to be resistant to anti-PD1 or PD-L1 or anti-PD-L2 antibodies, as well as corresponding referenced species (for already identified species) and sequences comprised therein. The information concerning the corresponding reference species can be found on the NCBI website.

| Bacterial species | Number of co-variant genes | Corresponding referenced species | Annotation | Sequences (SEQ ID Nos) |
|---|---|---|---|---|
| CAG00931 | 1257 | | Oscillibacter | 901-925 |
| CAG00270 | 2225 | | Oscillibacter | 926-950 |
| CAG00702 | 1609 | Bifidobacterium adolescentis L2-32 | Bifidobacterium adolescentis | 951-975 |
| CAG00720 | 1590 | Anaerotruncus colihominis DSM 17241 | Anaerotruncus colihominis | 976-1000 |
| CAG00381 | 2033 | Clostridium sp. CAG: 242 | Clostridium sp. | 1001-1025 |
| CAG00168 | 2534 | Clostridiales bacterium VE202-14 | Clostridiales | 1026-1050 |
| CAG00353 | 2341 | Eubacterium sp. CAG: 252 | Eubacterium sp. | 1051-1075 |
| CAG01018 | 1135 | Bilophila wadsworthia | unclassified Bilophila | 1076-1100 |

According to another particular embodiment of the above method, the relative abundance of at least 7, 8, 9 or 10 microorganism species selected from the microorganism species disclosed in Table 1b and Table 2b is assessed in step (i).

TABLE 1b subgroup of species from Table 1

| Bacterial species | Number of co-variant genes | Corresponding referenced species | Annotation | Sequences (SEQ ID Nos) |
|---|---|---|---|---|
| CAG00064 | 3310 | | unclassified | 1-25 |
| CAG01245 | 780 | | Firmicutes | 826-850 |
| CAG01308 | 666 | | Firmicutes | 851-875 |

TABLE 1b-continued subgroup of species from Table 1

| Bacterial species | Number of co-variant genes | Corresponding referenced species | Annotation | Sequences (SEQ ID Nos) |
|---|---|---|---|---|
| CAG00391 | 2019 | | Clostridiales | 201-225 |
| CAG00559 | 1776 | | Clostridiales | 376-400 |
| CAG01169 | 912 | | Ruminococcaceae | 801-825 |
| CAG00210 | 2389 | Ruminococcus bicirculans | Ruminococcaceae | 1426-1450 |
| CAG00949 | 1224 | Ruminococcaceae bacterium D16 | Ruminococcaceae | 2326-2350 |
| CAG00558 | 1777 | Ruminococcus lactaris | Ruminococcaceae | 351-375 |
| CAG01262 | 750 | Ruminococcus torques 2 | Ruminococcaceae | 2826-2850 |
| CAG00250 | 2262 | Ruminococcus sp. CAG: 353 | Ruminococcaceae | 1476-1500 |
| CAG00854 | 2572 | Ruminococcaceae | Ruminococcaceae | 2176-2200 |
| CAG00363 | 2056 | Intestinimonas butyriciproducens | Intestinimonas butyriciproducens (closely related to Flavonifractor plautii) | 176-200 |
| CAG001046 | 1089 | Intestinimonas butyriciproducens | Intestinimonas butyriciproducens (closely related to Flavonifractor plautii) | 2451-2475 |
| CAG00469 | 1928 | Eubacterium sp. CAG: 146 | Eubacterium | 301-325 |
| CAG00646 | 1668 | | Alistipes | 501-525 |
| CAG00887 | 1332 | Alistipes sp. CAG: 435 | Alistipes sp. | 701-725 |
| CAG00827 | 1455 | Alistipes sp. CAG: 514 | Alistipes sp. | 2151-2175 |
| CAG00301 | 3187 | Akkermansia muciniphila CAG: 154 | Akkermansia muciniphila | 101-125 |

TABLE 2b subgroup of species from Table 2

| Bacterial species | Number of co-variant genes | Corresponding referenced species | Annotation | Sequences (SEQ ID Nos) |
|---|---|---|---|---|
| CAG00702 | 1609 | Bifidobacterium adolescentis L2-32 | Bifidobacterium adolescentis | 951-975 |
| CAG00549 | 1788 | Bifidobacterium longum | Bifidobacteria | 1901-1925 |
| CAG00981 | 1189 | Erysipelotrichaceae | Erysipelotrichaeae | 2376-2400 |
| CAG01018 | 1135 | Bilophila wadsworthia | unclassified Bilophila | 1076-1100 |
| CAG00052 | 3522 | Parabacteroides goldsteinii | | 1176-1200 |
| CAG00141 | 2649 | Parabacteroides distasonis | Bacteroidales | 1376-1400 |

In what precedes, "over-representation" means, for each microorganism species, that this species is present in the sample with a relative abundance that is superior to the predetermined threshold. Of course, "under-representation" means that the species is present in the sample with a relative abundance that is inferior to the predetermined threshold.

Examples of thresholds that can be used as "predetermined thresholds" in the frame of the invention are disclosed in the experimental part below. Of course, the skilled artisan can adapt or refine these thresholds, depending on the technique used to measure the relative abundance of the microorganisms (for example, quantitative PCR, hybridization on a microarray or pyrosequencing), the specific anti-PD1/PD-L1/PD-L2 antibody, the specific pathology of the patient, the patient's food habits and other possible factors. More generally, the threshold to be considered when performing the above method is predetermined by measuring the relative abundance of the recited microorganisms in a representative cohort of individuals treated by an immune checkpoint blockade therapy, and whose response to this treatment is known.

According to one embodiment, the threshold is calculated to obtain the best predictability for the response (sensitivity and specificity). For example, the threshold is calculated to maximize the Youden index.

According to a particular embodiment of this method, the threshold used for each of the species is the detection limit of a sensitive detection method, (such as MGS analysis). In such a case, what is assessed is not the "relative abundance" of the species but merely its presence (corresponding to the "over-representation") or absence (corresponding to the "under-representation"). This also applies to the description which follows of further methods according to the invention, where "relative abundance" can be read as "presence or absence", "presence" can be read as "over-representation" and absence can be read as "under-representation".

According to the present invention, a "bacterial species" is a group of bacterial genes from the gut microbiome (i.e., the gene repertoire of the gut microbiota), which abundance level varies in the same proportion among different individual samples. In other words, a bacterial species according to the invention is a cluster of bacterial gene sequences which abundance levels in samples from distinct subjects are statistically linked rather than being randomly distributed.

Most current approaches for analyzing metagenomic data rely on comparisons to reference genomes, but the human gut microbiota diversity extends beyond what is currently covered by reference databases. In the results disclosed herein, the inventors used a method based on binning co-abundant genes across a series of metagenomic samples, that enables comprehensive discovery of new microorganisms without the need for reference sequences. In what follows, most of the species identified as likely to play a role in the patients' response to therapies based on antibodies against PD1, PD-L1 or PD-L2 are newly-identified species, not yet referenced in public databases. For each of the identified species (both newly-identified and species very close to already referenced species), the present application discloses a set of 25 bacterial genes which are non-redundant sequences and can be used, alone or in combination, as tracer genes to assess the presence and relative abundance to the corresponding species. Of course, once the species are identified, either by the set of non-redundant genes disclosed herein, or later on, by their further identification and/or inclusion into a data base, the skilled in the art can assess their relative abundance by any appropriate means, such as, for example, by measuring the copy number of another non-redundant gene that co-varies with the 25 sequences disclosed in the present application. Hence, the present invention is not limited to the use of the disclosed sequences to measure the relative abundance of the corresponding species.

As shown in Tables 1 and 2, some of the species which have been identified as playing an important part in the response to an anti-PD1/PD-L1/PD-L2 blockade are very close to species that are already referenced and accessible, for example, in the NCBI database. The "corresponding referenced species" indicated in Tables 1 and 2 are, for each species, the closer identified organism (strain of a given species). For each of the indicated references, the mean percentages of alignment and identity between the genes of the CAG identified by the inventors and the referenced genome are above 93% (alignment) and 98% (identity).

According to a particular embodiment of the above method, under-representation of microorganism species disclosed in Table 1 and over-representation of microorganism species disclosed in Table 2 are indicative that the patient is likely to be resistant to the anti-PD1/PD-L1/PD-L2 Ab-based therapy. In such a case, the patient can be proposed an alternative therapy, or a pre-treatment with a probiotic composition as disclosed below, to modify its microbiota and improve his/her chances of responding to the treatment.

While the relative abundance of a minimum of 10 species selected in Tables 1 and 2 are measured when performing the method of the invention, the method can be performed by measuring a higher number of species (for example 11, 12, 13, 14, 15, 16, 17, 18, 19, 20, 25, 30, 35, 40 species or more). In a particular embodiment of the above methods, the measured species are chosen to optimize the relevance of the profile. For example, the relative abundances of at least 5 *Firmicutes* species, three *Clostridiales* species, one *Alistipes* species, one *Eubacterium* species, one *Bacteroidales* species and *Methanobrevibacter smithii* are measured in step (i). According to this embodiment, the relative abundance of *Akkermansia muciniphila* can measured in step (i) in place of or in addition to the relative abundance of *Methanobrevibacter smithii*.

According to another particular embodiment, the relative abundances of *Anaerotruncus colihominis* and at least one *Oscillibacter* species are also measured in step (i).

The above method can advantageously be used for any patient suffering from a cancer amenable to PD1 or PD-L1 or PD-L2 blockade. Of course, some cancers that are currently not treated with such treatments can become new applications of anti-PD1/PD-L1/PD-L2 antibodies, and patients suffering from such cancers will then benefit from the present invention. It is to be noted that the present invention is also particularly useful in the frame of clinical trials aimed at determining the efficiency of PD1 or PD-L1 or PD-L2 blockade in new indications, and/or with new molecules. According to a particular embodiment, the invention is performed to assess the responsive/resistant status of a patient who has a cancer selected from the group consisting of lung cancer (such as squamous cell lung cancer but also adenocarcinoma non small cell or small cell lung cancer), renal cell cancer, head and neck tumor, bladder carcinoma, liver cancer, mesothelioma, Merkel-cell carcinoma, esophageal cancer, stomach cancer, triple negative breast cancer, melanoma and thymoma.

The method of the invention is particularly useful for assessing the responsive/resistant status of a patient who has a locally advanced or metastatic cancer, or an operable cancer in a neoadjuvant setting, i.e., in the present case, a tumor that could be surgically excised after PD1 or PD-L1 or PD-L2 blockade, for example to reduce the amount of cycles post-surgery in those patients doomed to fail therapy or to compensate them with anticancer probiotics to continue therapy.

As disclosed in the experimental part below, the method of the invention is useful for patients for whom the anti-PD1/PD-L1/PD-L2 Ab-based therapy is the second or third line therapy. According to another embodiment, the method is performed to assess the responder or resistant status of a patient before administering an anti-PD1/PD-L1/PD-L2 Ab-based therapy to said patient as first line therapy, or for assessing the responder or resistant status of a patient who already received an anti-PD1/PD-L1/PD-L2 Ab-based therapy as first line therapy.

The above method can advantageously be used when the anti-PD1/PD-L1/PD-L2 Ab-based therapy is administered alone, but also when the anti-PD1/PD-L1/PD-L2 Ab-based therapy is administered in combination with anti-CTLA4 Ab or IDO inhibitors or any other immunomodulator.

As already mentioned, the above method can be used before the beginning of a treatment with an anti-PD1/PD-L1/PD-L2 antibody, to avoid administration of such a treatment to a poor responder and/or convert this poor responder into good responder by appropriate pre-treatments, but it can also be used for assessing the responder/resistant status of a patient who already received an anti-PD1/PD-L1/PD-L2 antibody. In such a case, if the patient is identified as being resistant, the treatment can be stopped, or combined to another treatment likely to increase the patient's response. Such treatments are disclosed below.

When performing the above methods, the relative abundance of each microorganism can be assessed by measuring the number of copies of at least one, 2, 5, 10, 15, 20 or at least 25 nucleic acid sequence(s) specific for said microorganism in the sample. Any appropriate technique known by the skilled artisan can be used to measure the number of copies of the recited sequences, such as PCR-based techniques (Q-PCR, QRT-PCR etc.), hybridization (for example using a nucleic microarray), sequencing (for example by NGS) and any other appropriate method known to the person of skills in the art. Of course, any nucleic acid sequence specific for a given microorganism can be chosen to measure the relative abundance of said microorganism. By way of example, the number of copies of any sequence recited in Table 1 and Table 2 can be measured, it being understood that any sequence that co-varies with the disclosed sequences specific for a given species can also be used to measure the relative abundance of said species. The relative abundance of species very close to (or identical to) bacteria that have already been referenced in databases can be assessed by measuring the copy number of any sequence specific for the corresponding referenced species identified in Tables 1 and 2.

In a first particular embodiment, the number of copies of sequences specific for species listed in Tables 1 and 2 is assessed by PCR-based techniques. The PCR technique used can quantitatively measure starting amounts of DNA, cDNA, or RNA. Examples of PCR-based techniques according to the invention include techniques such as, but not limited to, quantitative PCR (Q-PCR), reverse-transcriptase polymerase chain reaction (RT-PCR), quantitative reverse-transcriptase PCR (QRT-PCR), rolling circle amplification (RCA) or digital PCR. These techniques are well known and easily available and do not need a precise description. In a particular embodiment, the determination of the copy number of the bacterial genes of the invention is performed by quantitative PCR.

The PCR-based techniques are performed with amplification primers designed to be specific for the sequences which are measured. The present invention hence also pertains to a set of primers suitable for performing the above method, i.e., a set of primers comprising primer pairs for amplifying sequences specific for each of the microorganism species to be detected in step (i) of said method (i.e., at least 10 species selected amongst those recited in Tables 1 and 2). Such a set of primers comprises a minimum of 20 primers, but it can comprise more primers, for example 30, 40, 50, 60, 70, 80, 100, 200, 300, 500, 1000, 2000 or more primers. According to a particular embodiment, the set of primers comprises at least one primer pair specifically amplifying part of a sequence selected amongst SEQ ID Nos: 1-1125. Of course, primer sets according to the invention can advantageously comprise 2, 3, 4, 5, 10, 20, 30, 40, 50, 60, 70, 80, 100, 200, 300, 500, 1000 or more pairs of primers each specifically amplifying part of a sequence selected amongst SEQ ID Nos: 1-1125.

In another particular embodiment, the relative abundance of the selected species is assessed in step (i) by the use of a nucleic microarray. A "nucleic microarray" consists of different nucleic acid probes that are attached to a solid support, which can be a microchip, a glass slide or a microsphere-sized bead. Probes can be nucleic acids such as cDNAs ("cDNA microarray") or oligonucleotides ("oligonucleotide microarray"), and the oligonucleotides may be about 25 to about 60 base pairs or less in length. To determine the copy number of a target nucleic acid sample, this sample is labelled and contacted with the microarray in hybridization conditions so that complexes form between probe sequences attached to the microarray surface and target nucleic acids that are complementary thereto. The presence of labelled hybridized complexes is then detected. Many variants of the microarray hybridization technology are available to the skilled artisan.

A nucleic acid microarray designed to perform the method according to the invention is hence also part of the present invention. Such a nucleic acid microarray comprises nucleic acid probes specific for each of the microorganism species to be detected in step (i) of said method (i.e., at least 10 species selected amongst those recited in Tables 1 and 2). In a specific embodiment, the nucleic acid microarray is an oligonucleotide microarray comprising at least one oligonucleotide specific for at least one sequence selected from SEQ ID NOs: 1-1125. For example, the said microarray comprises at least 45 oligonucleotides, each oligonucleotide being specific for one sequence of a distinct species recited in tables 1 and 2. The microarray of the invention can of course comprise 1125 oligonucleotides specific for each of the sequences of SEQ ID NOs: 1-1125. The microarray according to the invention may further comprise at least one oligonucleotide for detecting at least one gene of at least one control bacterial species. A convenient bacterial species may be e.g. a bacterial species the abundance of which does not vary between individuals having a cancer and healthy individuals. Preferably, the oligonucleotides are about 50 bases in length. Suitable microarray oligonucleotides specific for any gene of SEQ ID NOs: 1-1125 may be designed, based on the genomic sequence of each gene, using any method of microarray oligonucleotide design known in the art. In particular, any available software developed for the design of microarray oligonucleotides may be used, such as, for instance, the OligoArray software, the GoArrays software, the Array Designer software, the Primer3 software, or the Promide software, all known by the skilled in the art.

According to yet another embodiment, determining the number of copies of at least one bacterial gene in a sample obtained from the subject is performed using sequencing. Optionally, DNA is fragmented, for example by restriction nuclease prior to sequencing. Sequencing is done using any technique known in the state of the art, including sequencing by ligation, pyrosequencing, sequencing-by-synthesis, single-molecule sequencing or next-generation sequencing. Sequencing also includes PCR-Based techniques, such as for example quantitative PCR or emulsion PCR. A number of platforms are available for performing next-generation sequencing (NGS, also called "massive parallel DNA sequencing"), such as, but not limited to the Illumina Genome Analyzer platform, the Roche 454 platform, the ABI SOLiD platform, the Helicos single molecule sequencing platform, real-time sequencing using single polymerase molecules (Eid et al., 2009), Ion Torrent sequencing (WO 2010/008480) and nanopore sequencing (Clarke et al., 2009).

When the skilled person relies on sequencing methods to measure the number of copies of specific genes, bioinformatics tool are necessary to treat the collected information. Indeed, using sequencing, a searched nucleic acid sequence is identified in the global sequencing data by comparison with reference sequences. Hence, alignments are performed (between the sequenced data and the reference sequences) and the skilled artisan choses a threshold of percentage of identity above which a sequence is considered as identical to a reference sequence. For example, in an embodiment, the nucleic acid sequences of the relevant bacterial species are identified in the global sequencing data by comparison with the nucleic acid sequences comprised in the species recited indicated in Tables 1 and 2. This comparison is advantageously based on the level of sequence identity with the sequences SEQ ID NOs: 1 to 1125, or with other nucleic acid sequences comprised in the species or "corresponding referenced species" identified in Tables 1 and 2. Thus, a nucleic acid sequence exhibiting at least 90%, at least 95%, at least 96%, at least 97%, at least 98%, at least 99%, or 100% identity with a nucleic acid sequence amongst SEQ ID NOs: 1 to 1125 is identified as a sequence comprised in one of the bacterial species identified as playing a role in the response or resistance to an anti-PD1/PD-L1/PD-L2 antibody.

The term "sequence identity" herein refers to the identity between two nucleic acids sequences. To determine the percentage of identity of two amino acids sequences, the sequences are aligned for optimal comparison. In this comparison the sequences can be the same length or can be different in length. Several alignments algorithms and softwares (such as, for example, the BLAST software) are available and can be used to assess the percentage of identity between two sequences over a window of comparison, and the skilled artisan is free to use any appropriate algorithm and method to assess the percentage of identity between sequenced data and reference sequences.

Another aspect of the present invention is a probiotic composition.

According to one embodiment, the composition comprises bacteria selected from the group consisting of *Enterococcus hirae, Akkermansia muciniphila, Alistipes shahii*, other *Alistipes* species and mixtures thereof.

According to one embodiment, the composition is used for treating a cancer, in combination with an anti-PD1/PD-L1/PD-L2 Ab-based therapy. The basis for this therapeutical use is that such a composition induces immunostimulation in a cancer patient. The combined administration of a composition according to the invention and an anti-PD1/PD-L1/PD-L2 Ab-based therapy leads to synergistic effects, so that patients who were or would have been non-responders or poor responders to the anti-PD1/PD-L1/PD-L2 Ab-based therapy become responders. Interestingly, as illustrated in FIG. 45 and Example 23 below, the compositions according to the invention also prevent some adverse effects of the anti-PD1/PD-L1/PD-L2 Ab-based therapy.

According to one embodiment, the probiotic composition according to the invention comprises bacteria selected from the group consisting of one or several isolates of *Enterococcus hirae, Akkermansia muciniphila, Alistipes indistinctus*, other *Alistipes* species and mixtures thereof. Another composition comprises at least five bacterial species selected from the group consisting of *Enterococcus hirae, Akkermansia muciniphila, Alistipes indistinctus, Eubacterium* species (such as *Eubacterium. limosum*), *Firmicutes* species (such as *Christensenella minuta, Dielma fastidiosa, Flavonifractor plautii*), *Bacteroidia* (such as *Bacteroides fragilis, Bacteroides salyersae, Barnesiella intestinihominis*), *Actinobacteria* (such as *Collinsella intestinalis, Collinsella Tanakaei, Actinotignum schaalii*) and the archae *Methanobrevibacter smithii*. A particular composition which can be used, according to the invention, to induce immunostimulation in a cancer patient receiving an anti-PD1/PD-L1/PD-L2 Ab-based therapy, is a bacterial composition comprising *Enterococcus hirae* and/or *Akkermansia muciniphila* and/or *Alistipes* and/or *Christensenella minuta*.

In the present text, the compositions of the invention which comprise bacteria that can be advantageously administered to cancer patients are indifferently designated as "probiotic compositions", "bacterial compositions", "oncobax compositions" or merely "compositions" when the context makes clear that these compositions comprise bacteria.

According to a particular embodiment, the composition according to the invention comprises at least two bacterial species selected from the group consisting of *Firmicutes* species, *Clostridiales* species, *Alistipes* species, *Eubacterium* species, *Bacteroidales* species, *Methanobrevibacter smithii, Akkermansia muciniphila* and *Enterococcus hirae*, for example at least two bacterial species selected from the group consisting of *Enterococcus hirae, Akkermansia muciniphila, Alistipes* species, *Eubacterium* species, *Ruminococcaceae, Clostridiales* species, *Bacteroidales* species, *Actinobacteria, Coriobacteriales* species and *Methanobrevibacter smithii*. Non-limitative examples of *Enterococcus hirae* strains which can be used in the probiotic compositions according to the invention are the strains 13144, deposited on Nov. 7, 2013 at the Collection Nationale de Cultures de Microorganismes (CNCM), under the number 1-4815, IGR7 deposited on Aug. 31, 2017 at the CNCM under the number I-5224, IGR4 deposited on Nov. 27, 2017 at the CNCM under the number CNCM I-5260 and IGR11 deposited on Nov. 27, 2017 at the CNCM under the number CNCM I-5261. Mixtures of two, three or more *E. hirae* strains (amongst those listed above and others) can also be used in the frame of the present invention.

According to one embodiment, the composition according to the invention comprises at least one or several isolates of *Enterococcus hirae, Akkermansia muciniphila, Alistipes indistinctus*, other *Alistipes* species and mixtures thereof. Another composition comprises at least five bacterial species selected from the group consisting of *Enterococcus hirae, Akkermansia muciniphila, Alistipes* indistinctus, *Eubacterium* species (such as *Eubacterium. limosum*), *Firmicutes* species (such as *Christensenella minuta, Dielma fastidiosa, Flavonifractor plautii*), *Bacteroidia* (such as *Bacteroides fragilis, Bacteroides salyersae, Barnesiella intestinihominis*), *Actinobacteria* (such as *Collinsella intestinalis, Collinsella Tanakaei, Actinotignum schaalii*) and the archae *Methanobrevibacter smithii*. A particular composition which can be used, according to the invention, to induce immunostimulation in a cancer patient receiving an anti-PD1/PD-L1/PD-L2 Ab-based therapy, is a bacterial composition comprising at best two bacteria of *Enterococcus hirae* and/or *Akkermansia muciniphila* and/or *Alistipes* and/or *Christensenella minuta*.

According to one embodiment, the composition further comprises bacteria selected from the group consisting of *Bifidobacterium adolescentis, Clostridiales* spp., *Roseburia, Blautia, Faecalibacterium, Ruminococcaceae, Flavonifractor plautii* and *Burkholderia cepacia*.

According to a preferred embodiment of the probiotic composition of the invention, said composition comprises *Enterococcus hirae* and *Akkermansia muciniphila*.

According to a preferred embodiment of the probiotic composition of the invention, said composition comprises *Alistipes shahii* or other *Alistipes* spp. with or without *Enterococcus hirae* and *Akkermansia muciniphila*.

Such a composition can advantageously further comprise *Burkholderia cepacia* and/or *Bacteroides fragilis* and/or *Actinotignum schaalii* and/or *Alistipes indistinctus* and/or *Alistipes onderdonkii*.

According to a particular embodiment, the composition of the invention comprises:

*Clostridiales* bacteria of the species *Christensenella minuta*; and/or

*Erisipelotrichia* (*Dielma fastidiosa, Erysipelatoclostridium ramosum*); and/or

*Alistipes* bacteria of species selected from the group consisting of *Alistipes shahii, Alistipes indistinctus, Alistipes onderdonkii* and *Alistipes finegoldii*; and/or

*Eubacterium* bacteria of the species *Eubacterium limosum*; and/or

*Bacteroidales* bacteria of species selected from the group consisting of *Bacteroides fragilis, Bacteroides salyersiae* and *Barnesiella intestinihominis*, especially *Bacteroides salyersiae* and/or *Barnesiella intestinihominis*; and/or

*Actinobacteria* of the species *Actinotignum schaalii*; and/or

*Coriobacteriales* bacteria of the species *Collinsella intestinalis* and/or *Collinsella tanakaei*; and/or

*Firmicutes* such as *Flavonifractor plautii*; and/or

Archae bacteria of the species *Methanobrevibacter smithii*.

Several bacterial consortia which proved particularly efficient for compensating dysbiosis and restoring a response to an anti-PD1/PD-L1/PD-L2 Ab-based therapy are illustrated in the examples below (see at least FIGS. 42 and 43). The present invention thus pertains to compositions comprising specific bacterium consortia.

According to a particular embodiment of the present invention, the composition comprises:
(i) *Enterococcus hirae* selected from the group consisting of strain 13144 (CNCM I-4815), strain IGR7 (CNCM I-5224), strain IGR4 (CNCM I-5260), strain IGR11 (CNCM I-5261) and mixtures thereof; and
(ii) *Akkermansia muciniphila*, for example bacteria of the strains p2261 and/or p3415, both deposited at the Collection de souches de l'Unité des Rickettsies (CSUR); and
(iii) *Eubacterium limosum*.

According to another particular embodiment of the present invention, the composition comprises:
(i) *Enterococcus hirae* selected from the group consisting of strain 13144 (CNCM I-4815), strain IGR7 (CNCM I-5224), strain IGR4 (CNCM I-5260), strain IGR11 (CNCM I-5261) and mixtures thereof; and
(ii) *Barnesiella intestinihominis*.

According to yet another particular embodiment of the present invention, the composition comprises:
(i) *Enterococcus hirae* selected from the group consisting of strain 13144 (CNCM I-4815), strain IGR7 (CNCM I-5224), strain IGR4 (CNCM I-5260), strain IGR11 (CNCM I-5261) and mixtures thereof; and
(ii) *Christensenella minuta*.

According to a further particular embodiment of the present invention, the composition comprises:
(i) *Enterococcus hirae* selected from the group consisting of strain 13144 (CNCM I-4815), strain IGR7 (CNCM I-5224), strain IGR4 (CNCM I-5260), strain IGR11 (CNCM I-5261) and mixtures thereof; and
(ii) *Actinotignum schaalii*.

According to the invention, a composition as above-described is advantageously used as a medicament for compensating dysbiosis in a cancer patient. In particular, the composition can be used as an adjuvant to an anti-PD1/PD-L1/PD-L2 Ab-based treatment administered to a cancer patient.

The compositions of the invention are also efficacious as medicaments for decreasing or preventing gut toxicity of an anti-PD1/PD-L1/PD-L2 Ab-based therapy and/or an anti-CTLA-4 Ab-based therapy, for example crypts irregularities, loss of villosities and inflammatory patterns frequently associated with treatments by immune checkpoint blockers.

The above probiotic compositions can advantageously be formulated for oral administration and administered either as food supplements or as functional food. The skilled artisan knows a variety of formulas which can encompass living or killed microorganisms and which can present as food supplements (e.g., pills, tablets and the like) or as functional food such as drinks, fermented yoghurts, etc. The compositions according to the present invention can also be formulated as medicaments, in capsules, pills, liquid solution, for example as encapsulated lyophilized bacteria etc.

As already mentioned, the above probiotic composition according to the invention can advantageously be administered to a patient in need thereof in combination with an anti-PD1/PD-L1/PD-L2 Ab-based therapy. In such a combination, the probiotic bacterial composition advantageously induces immunostimulation.

As used herein, the term "in combination" refers to the use of more than one agent (e.g., a probiotic composition strain and an anti-PD1/PD-L1/PD-L2 antibody). The use of the term "in combination" does not restrict the order in which therapies are administered to the patient, although it is preferable to administer the probiotic strain prior to or simultaneously with the antineoplastic treatment. For example, the probiotic strain can be administered prior to the anti-PD1/PD-L1/PD-L2 antibody (e. g., 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks before), either punctually or several times (for example, each day) before the anti-PD1/PD-L1/PD-L2 Ab-based treatment is administered. A method for treating a cancer patient, comprising administering a composition as above-described, for example a probiotic bacterial composition comprising at least two bacterial species selected from the group consisting of *Firmicutes* species, *Clostridiales* species, *Alistipes* species, *Eubacterium* species, *Bacteroidales* species, *Methanobrevibacter smithii*, *Akkermansia muciniphila* and *Enterococcus hirae*, prior to administering a drug blocking PD1, PD-L1 or PD-L2 to said patient, is hence also part of the present invention.

The above probiotic composition is particularly useful in the context of anti-PD1 alone or combined with anti-CTLA4 coblockade.

According to a particular aspect, the present invention pertains to a probiotic composition comprising bacteria selected from the group consisting of *Enterococcus hirae*, *Akkermansia muciniphila*, *Alistipes* spp. and mixtures thereof, for use for treating a cancer, in combination with an anti-PD1/PD-L1/PD-L2 Ab-based therapy, wherein the probiotic bacterial composition induces immunostimulation in a cancer patient.

The probiotic compositions according to the invention are particularly useful as adjuvant therapy for treating a cancer patient who has been identified as likely to be resistant to an anti-PD1/PD-L1/PD-L2 Ab-based treatment.

According to a particular embodiment, the probiotic composition of the invention is administered to the patient before and during the anti-PD1/PD-L1/PD-L2 Ab-based therapy, for example every 3 days during the whole anti-PD1/PD-L1/PD-L2 Ab-based therapy, or at least the day before and the day after each intravenous administration of the anti-PD1/PD-L1/PD-L2 antibody (which is typically given twice a month during 1.5 year).

According to another particular embodiment, the patient receives a treatment that will kill or remove at least part of the bacteria present in his/her intestines, before administration of a probiotic composition of the invention. Such a treatment aims at favoring the niching of the "favorable" bacteria present in the probiotic composition. Non-limitative examples of such pre-treatments are administration of polyethylene glycol and/or short duration (typically one to three days) broad spectrum antibiotics (e.g. ampicilline or cephalosporines). A method for treating a cancer patient, comprising administering (i) polyethylene glycol and/or short duration broad spectrum antibiotics, then (ii) a probiotic bacterial composition as above-described, and (iii) a drug blocking PD1, PD-L1 or PD-L2 to said patient, is hence also part of the present invention.

According to another aspect, the compositions according to the invention are used as an immunostimulating therapy for preventing a cancer relapse. A method of preventing cancer relapse in an individual who has been treated for a cancer, for example with a drug blocking PD1, PD-L1 or PD-L2, wherein a composition as above-described is administered to the individual as an immunostimulating treatment, is hence also part of the present invention.

The present invention also pertains to a theranostic method for determining if an individual in need an anti-PD1/PD-L1/PD-L2 Ab-based therapy, whether this individual needs a bacterial compensation before administration of this therapy. Indeed, anti-PD1/PD-L1/PD-L2 Ab-based are heavy, both in terms of possible side effects and in terms of financial cost, and everything should be done to ensure that the treatment will be beneficial to the patient.

The present invention thus pertains to a theranostic method for determining if a cancer patient needs a bacterial compensation before administration of an anti-PD1/PD-L1/PD-L2 Ab-based therapy comprising assessing, in a feces sample from said patient, the presence or absence of *Akkermansia muciniphila*, wherein if *Akkermansia muciniphila* is absent from said feces sample, the patient needs a bacterial compensation with a bacterial composition or a fecal microbial composition as above-described.

Another theranostic method of the invention, for determining if a cancer patient needs a bacterial compensation before administration of an anti-PD1/PD-L1/PD-L2 Ab-based therapy, comprises assessing, in a feces sample from said patient, the presence or absence of *Enterococcus hirae*, wherein if *Enterococcus hirae* is absent from said feces sample, the patient needs a bacterial compensation with a bacterial composition or a fecal microbial composition as above-described.

Another theranostic method of the invention, for determining if a cancer patient needs a bacterial compensation before administration of an anti-PD1/PD-L1/PD-L2 Ab-based therapy, comprises assessing, in a feces sample from said patient, the presence or absence of *Ruminococcus* sp. CAG:353, *Ruminococcus* bacterium LM158, *Ruminococcus torques* 2 and *Ruminococcaceae* bacterium D16, wherein if none of *Ruminococcus* sp. CAG:353, *Ruminococcus* bacterium LM158, *Ruminococcus torques* 2 and *Ruminococcaceae* bacterium D16 is present in said feces sample, the patient needs a bacterial compensation with a bacterial composition or a fecal microbial composition as above-described.

Another theranostic method of the invention, for determining if a cancer patient needs a bacterial compensation before administration of an anti-PD1/PD-L1/PD-L2 Ab-based therapy, comprises assessing, in a feces sample from said patient, the presence or absence of *Alistipes* sp. CAG: 435, *Alistipes* sp. CAG:514, *Alistipes indistinctus* CAG328 and *Alistipes* sp. CAG/268, wherein if none of *Alistipes* sp. CAG:435, *Alistipes* sp. CAG:514, *Alistipes indistinctus* CAG328 and *Alistipes* sp. CAG/268 is present in said feces sample, the patient needs a bacterial compensation with a bacterial composition or a fecal microbial composition as above-described.

Another theranostic method of the invention, for determining if a cancer patient needs a bacterial compensation before administration of an anti-PD1/PD-L1/PD-L2 Ab-based therapy, comprises assessing, in a feces sample from said patient, the presence or absence of *Bacteroides xylanosolvens* CAG945, *Bacteroides ovatus* CAG1165, *Prevotella* CAG:255, CAG163, *Ruminococcus bromii* CAG611, *Roseburia intestinalis* CAG291 and *Eubacterium* CAG:38, CAG 629, wherein if *Bacteroides xylanosolvens* CAG945, *Bacteroides uniformis* CAG159, *Bacteroides ovatus* CAG1165, *Prevotella* CAG:255, CAG163, *Ruminococcus bromii* CAG611, *Roseburia intestinalis* CAG291 or *Eubacterium* CAG:38, CAG 629 are present in said feces sample, the patient needs a bacterial compensation with a bacterial composition or a fecal microbial composition as above-described.

Another theranostic method of the invention, for determining if a cancer patient needs a bacterial compensation before administration of an anti-PD1/PD-L1/PD-L2 Ab-based therapy, comprises assessing, in a feces sample from said patient, the presence or absence of short chain fatty acid producing *Clostridiaceae* selected from the group consisting of *Firmicutes bacterium, Eubacterium, Blautia* and *Roseburia*, wherein the absence of *Firmicutes bacterium, Eubacterium, Blautia* and *Roseburia* from said feces sample indicates that the patient needs a bacterial compensation with *Enterococcus hirae* and/or *Akkermansia muciniphila* or with another bacterial composition as above-described, or with a fecal microbial composition as above-described.

Another theranostic method of the invention, for determining if a cancer patient needs a bacterial compensation before administration of an anti-PD1/PD-L1/PD-L2 Ab-based therapy, comprises assessing, in a feces sample from said patient, the presence or absence of *Dielma fastidiosa*, wherein the absence of *Dielma fastidiosa* from said feces sample indicates that the patient needs a bacterial compensation with *Enterococcus hirae* and/or *Akkermansia muciniphila* or with another bacterial composition as above-described, or with a fecal microbial composition as above-described.

According to another of its aspects, illustrated in the experimental part below, the present invention pertains to an in vitro method for assessing whether a cancer patient has a dysbiosis associated with cancer, comprising assessing, in a feces sample from said patient, the presence of at least 10, 11, 12, 13, 14, 15, 16, 17, 18 or 19 microorganism species selected from the group consisting of *Faecalibacterium* CAG297, *Blautia* CAG179, *Roseburia* CAG55, *Haemophila parainfluenzae* CAG1056, *Clostridiales* CAG1132, *Bifidobacterium adolescentis, Firmicutes* CAG1308, *Firmicutes bacterium* CAG713, *Bifidobacterium dentium, Enterococcus faecalis, Subdoligranulum* CAG140, *Lachnospiricaeae bacterium* CAG14, *Clostridium innocuum* CAG36, *Ruminococcus torques* 1, *Hungatella hathewayi* 1 CAG25, *E. coli* CAG 11, *E. coli* CAG 371, *Clostridiales* CAG533 and *Tyzzerella nexilis* CAG311, wherein:
  the presence of microorganism species selected from the group consisting of *Bifidobacterium dentium, Enterococcus faecalis, Subdoligranulum* CAG140, *Lachnospiricaeae bacterium* CAG14, *Clostridium innocuum* CAG36, *Ruminococcus torques* 1, *Hungatella hathewayi* 1 CAG25, *E. coli* CAG 11, *E. coli* CAG 371, *Clostridiales* CAG533 and *Tyzzerella nexilis* CAG311 and
  the absence of microorganism species selected from the group consisting of *Faecalibacterium* CAG297, *Blautia* CAG179, *Roseburia* CAG55, *Haemophila parainfluenzae* CAG1056, *Clostridiales* CAG1132, *Bifidobacterium adolescentis, Firmicutes* CAG1308 and *Firmicutes bacterium* CAG713 are indicative that the patient has a dysbiosis associated with cancer.

The present invention also pertains to an in vitro method for predicting relapse in a patient who is treated or who has been treated for a cancer, comprising assessing, in feces samples from said patient obtained at different time-points, the presence of at least 5, 6, 7, 8, 9, 10, 11, 12, 13, 14, 15, 16, 17, 18 or 19 microorganism species selected from the group consisting of *Faecalibacterium* CAG297, *Blautia* CAG179, *Roseburia* CAG55, *Haemophila parainfluenzae* CAG1056, *Clostridiales* CAG1132, *Bifidobacterium adolescentis*, *Firmicutes* CAG1308, *Firmicutes bacterium* CAG713, *Bifidobacterium dentium*, *Enterococcus faecalis*, *Subdoligranulum* CAG140, *Lachnospiricaeae bacterium* CAG14, *Clostridium innocuum* CAG36, *Ruminococcus torques* 1, *Hungatella hathewayi* 1 CAG25, *E. coli* CAG 11, *E. coli* CAG 371, *Clostridiales* CAG533 and *Tyzzerella nexilis* CAG311, wherein:

- an increase of microorganism species selected from the group consisting of *Bifidobacterium dentium*, *Enterococcus faecalis*, *Subdoligranulum* CAG140, *Lachnospiricaeae bacterium* CAG14, *Clostridium innocuum* CAG36, *Ruminococcus torques* 1, *Hungatella hathewayi* 1 CAG25, *E. coli* CAG 11, *E. coli* CAG 371, *Clostridiales* CAG533 and *Tyzzerella nexilis* CAG311 and
- a decrease of microorganism species selected from the group consisting of *Faecalibacterium* CAG297, *Blautia* CAG179, *Roseburia* CAG55, *Haemophila parainfluenzae* CAG1056, *Clostridiales* CAG1132, *Bifidobacterium adolescentis*, *Firmicutes* CAG1308 and *Firmicutes bacterium* CAG713 are indicative that the patient is likely to relapse.

The present invention also pertains to methods for ex vivo determining whether a cancer patient is likely to benefit from a treatment with an anti-PD1/PD-L1/PD-L2 Ab-based therapy, based on the analysis of memory T cells of said patient. According to one of these methods, the presence of memory Th1 or Tc1 cells towards *Burkholderia cepacia*, *Enterococcus hirae* and/or *Bacteroides fragilis* in a blood sample from said patient is assessed, wherein the presence of memory Th1 or Tc1 cells towards *Burkholderia cepacia* and *Enterococcus hirae* indicates that the patient is likely to be a good responder to said treatment, and the presence of memory Th1 cells towards *Bacteroides fragilis* indicates that the patient is likely to be a poor responder.

Another method according to the invention for ex vivo determining whether a cancer patient is likely to benefit from a treatment with an anti-PD1/PD-L1/PD-L2 Ab-based therapy, illustrated in the experimental part below, comprises assessing the presence of memory Th1 or Tr1 cells towards *Akkermansia muciniphila* in a blood sample from said patient, wherein the presence of memory CD4+ Th1 or CD8+ Tc1 (IFNg producing) or CD4+ Tr1 cells (IL-10 producing) towards *Akkermansia muciniphila* indicates that the patient is likely to be a good responder to said treatment, and the presence of only memory Tr1 cells towards *Akkermansia muciniphila* indicates that the patient is likely to be a poor responder.

The present invention also provides means to follow-up the response of a patient treated with an anti-PD1/PD-L1/PD-L2 Ab-based therapy. The present invention thus pertains to a method for assessing if a cancer patient who is treated with an anti-PD1/PD-L1/PD-L2 Ab-based therapy is a good responder to said treatment, comprising the following steps:

(i) assessing, in a feces sample from said patient obtained at the beginning of the treatment, the presence or the relative abundance of at least 3, 4, 5, 6, 7, 8, 9 or 10 microorganism species selected from the group consisting of *Bacteroides xylanosolvens* CAG945, *Bacteroides uniformis* CAG159, *Bacteroides ovatus* CAG1165, *Prevotella* CAG:255, CAG163, *Ruminococcus bromii* CAG611, *Roseburia intestinalis* CAG291, *Eubacterium* CAG:38, CAG 629, *Ruminococcaceae* CAG1003, *Flavonifractor plautii* CAG 439 and *Firmicutes bacterium* CAG: 124, CAG 629, (ii) assessing, in a feces sample from said patient obtained after three or four administrations of the anti-PD1/PD-L1/PD-L2 Ab, the presence or the relative abundance of the same species as in step (i), wherein:

a decrease or complete loss of *Bacteroides xylanosolvens* CAG945, *Bacteroides uniformis* CAG159, *Bacteroides ovatus* CAG1165, *Prevotella* CAG:255, CAG163, *Ruminococcus bromii* CAG611, *Roseburia intestinalis* CAG291 and *Eubacterium* CAG:38, CAG 629 and/or in increase or gain of *Ruminococcaceae* CAG1003, *Flavonifractor plautii* CAG 439 and *Firmicutes bacterium* CAG: 124, CAG 629 indicate that the patient is a good responder to the treatment.

In the probiotic compositions according to the invention, the probiotic bacteria are preferentially alive. However, compositions comprising dead bacteria, such as autoclaved, pasteurized, irradiated or fragmented bacteria, are also part of the present invention, as well as compositions only comprising certain bacterial antigens. Indeed, it has been shown that isolated bacterial components can exert the same effects as live bacteria, or even enhanced effects (Plovier et al., 2016). In the above compositions, live bacteria can hence be replaced by suitable bacterial products for triggering innate or acquired immune responses that favor the elimination of tumor cells from the organism.

According to another aspect, the present invention thus pertains to an immunogenic composition comprising fragments of bacteria selected from the group consisting of *Firmicutes* species, *Clostridiales* species, *Alistipes* species, *Eubacterium* species, *Bacteroidales* species, *Methanobrevibacter smithii*, *Akkermansia muciniphila* and *Enterococcus hirae* and mixtures thereof, for use as an adjuvant to an anti-PD1/PD-L1/PD-L2 Ab-based therapy administered to a cancer patient. According to a preferred embodiment, the immunogenic composition comprises fragments of *Enterococcus hirae* (its TLR2 or a NOD2 agonists for instance), for example fragments of the strain CNCM I-4815, together with fragments of *Akkermansia muciniphila*. An immunogenic composition as above-described can further comprise fragments of *Bacteroides fragilis* and/or *Burkholderia cepacia*.

In what precedes, the term "fragment" may refer to cellular components, metabolites, secreted molecules and compounds resulting from the metabolism of the recited bacteria. Fragments may be obtained, for example, by recovering the supernatant of a culture of one or several bacterial species or by extracting cell components or cell fractions, metabolites or secreted compounds from such a culture. The term "fragment" may also refer to a degradation product. A fragment may correspond to a component in the isolated form or to any mixture of one or more components derived from the considered bacterial species. Non-limitative examples of bacterial components that can advantageously be ingredients of the immunogenic compositions as above-described include Amuc_1100, a specific protein isolated from the outer membrane of *Akkermansia muciniphila* (Plovier et al., supra), capsular polysaccharides A (PSA), which are required by *B. fragilis* to occupy a mucosal niche in the colon, zwitterionic polysaccharide (ZPS) repeated motifs from *Bacteroides* species (for example from *B. fragilis*) and lysine-aspartic acid (KD) peptides with >15 repetitive units.

The immunogenic compositions according to the invention are preferably formulated for intradermal, subcutaneous, intravenous or intramuscular or oral administration. They can advantageously be administered before, at the same time and/or after administration of an anti-PD1/PD-L1/PD-L2 Ab-based therapy, in order to induce an immune response which will have an adjuvant effect to the treatment.

According to another aspect of the present invention, an individual in need of a treatment with an anti-PD1/PD-L1/PD-L2 Ab-based therapy is treated by fecal microbiota transplantation (FMT), using to this aim fecal microbiota from healthy individual(s), and/or fecal microbiota from one or several individual(s) treated with an anti-PD1/PD-L1/PD-L2 Ab-based therapy and who proved to respond to this therapy, and/or fecal microbiota from one or several individual(s) exhibiting a gut microbiota profile that identifies him/her/them as likely to respond to the envisioned treatment or from a responding patient. The theranostic method of the present invention can of course be used to select appropriate donors. This can be done for any patient, but of course such an FMT is particularly useful for an individual who has been identified as likely to be a poor responder to a treatment with said anti-PD1/PD-L1/PD-L2 Ab-based therapy.

The present invention hence also pertains to a fecal microbial composition, for use for treating a cancer, in combination with an anti-PD1/PD-L1/PD-L2 Ab-based therapy. As mentioned above, the fecal microbial composition is preferably obtained (directly or indirectly) from a stool sample from (a) healthy individual(s) or (a) responder(s) to a treatment with an anti-PD1/PD-L1/PD-L2 Ab-based therapy, or at least from an individual exhibiting a gut microbiota profile that identifies him/her as likely to respond to the envisioned treatment. The fact that the fecal microbial composition can be obtained indirectly from a healthy individual's stool sample means that banks of fecal microbial material may be created, with possible mixes of stool samples, and possible creation of "standard healthy fecal microbial compositions", possibly adapted to certain conditions requiring FMT (a fecal microbial composition for treating a *Clostridium* infection may be different from a fecal microbial composition for use in a cancer context) and/or to other characteristics of patients (age, ethnic origin, food regimen etc.). Several ways of conditioning fecal microbial material and conducting FMT have been described and are currently developed, and the skilled artisan is free to choose appropriate techniques for preparing the fecal microbial composition according to the invention, which can be freshly-prepared liquid, freeze-dried material or any other conditioning.

According to a particular embodiment, the fecal microbial composition of the invention comprises at least 10 bacterial species selected from the group consisting of at *Firmicutes* species, *Clostridiales* species, *Alistipes* species, *Eubacterium* species, *Bacteroidales* species, *Methanobrevibacter smithii, Akkermansia muciniphila* and *Enterococcus hirae* and, more preferably, at least 5 different *Firmicutes* species, 3 different *Clostridiales* species, one *Alistipes* species, one *Eubacterium* species, one *Bacteroidales* species, *Methanobrevibacter smithii, Akkermansia muciniphila* and *Enterococcus hirae*.

In a particular embodiment, the composition allows the niching of at least 10 bacterial species selected from the group consisting of at *Firmicutes* species, *Clostridiales* species, *Alistipes* species, *Eubacterium* species, *Bacteroidales* species, *Methanobrevibacter smithii, Akkermansia muciniphila* and *Enterococcus hirae* upon transplant into a germ-free animal used as a MCA205 sarcoma bearing animal model to validate the composition and its antitumor efficacy.

According to another embodiment, the fecal microbiota composition allows the expansion of at least 10 bacterial species selected from the group consisting of at *Firmicutes* species, *Clostridiales* species, *Alistipes* species, *Eubacterium* species, *Bacteroidales* species, *Methanobrevibacter smithii, Akkermansia muciniphila* and *Enterococcus hirae* upon transplant into a germ-free tumor-bearing host after treatment of said host with an anti-PD1/PD-L1/PD-L2 antibody. In what precedes, the host can be a cancer patient having received a pre-treatment for eliminating germs from his/her intestines, such as those described above, but it can also be an animal used as a preclinical model suitable for screening the fecal microbial material to select appropriate fecal microbiota compositions.

According to another embodiment, the fecal microbiota composition has been enriched with a bacterial composition as above-described.

A fecal microbial composition of the invention is advantageously used for allogeneic healthy fecal microbial transplantation in a cancer patient who has been identified as likely to be resistant to the anti-PD1/PD-L1/PD-L2 Ab-based therapy by the theranostic method described above.

FMT with a composition of the invention is preferably performed before the beginning of the treatment, for example a few days before, but it can also be performed in the course of said treatment.

As described in the experimental part below (Example 8), the inventors also showed that a Th1 or Tc1 response towards certain bacteria is indicative that a patient treated with an anti-PD1 antibody is a good responder to the treatment. Indeed, patients who developed a Th1 or Tc1 immune response towards *Enterococcus hirae* or *Akkermansia muciniphila* or *Burkholderia cepacia* after the 2-4 administrations of anti-PD1 Abs have a long term benefit to PD1 blockade a memory, contrary to those who developed a Th1 or Tc1 immune response towards *Bacteroides fragilis*. Accordingly, the present invention also pertains to a method for ex vivo determining whether a cancer patient is likely to benefit from a treatment with an anti-PD1/PD-L1/PD-L2 Ab-based therapy, comprising assessing the presence of memory Th1 or Tc1 cells towards *Enterococcus hirae* and/or *Burkholderia cepacia* and/or *Bacteroides fragilis* in a blood sample from said patient, wherein the presence of such memory Th1 or Tc1 cells indicates that the patient is likely to be a good responder to said treatment, and the presence of memory Th1 or Tc1 cells towards *Bacteroides fragilis* indicates that the patient is likely to be a poor responder.

This method can be performed with a blood sample obtained before the beginning of any treatment with an anti-PD1/PD-L1/PD-L2 Ab-based drug. However, the sensitivity of the test may be insufficient to provide any clear result. This is not a problem anymore after one or two administrations of said drug, which is another moment when this method can be performed.

One particularly advantageous aspect of this method is that it can be performed using a blood sample. The Th1 or Tc1 response of the patient can be assessed at different times during the treatment and lead to a decision to stop the treatment or to adjuvant it with FMT or administration of a probiotic or immunogenic composition as above described if the patient is or becomes a poor responder. Of course, this method can be done for patients having any kind of cancers, including lung cancer, renal cell cancer, head and neck tumor, bladder carcinoma, liver cancer, mesothelioma, Merkel-cell carcinoma, esophageal cancer, stomach cancer, melanoma and thymoma. The results of this method are particularly relevant for patients having an advanced non-small cell lung cancer.

Other characteristics of the invention will also become apparent in the course of the description which follows of the biological assays which have been performed in the framework of the invention and which provide it with the required experimental support, without limiting its scope.

EXAMPLES

Materials and Methods

In the absence of any indications to the contrary, Examples 1 to 8 were performed using the following materials and methods. Additional materials and methods are described in the examples, when necessary.

Dataset 127 samples were sequenced, corresponding to 3 distinct cohorts designed to test Nivolumab in three different cancers with several timepoints: before (V1) or with ongoing treatment (V2-V4).

54 samples from 28 patients with lung cancer
16 samples/patients with kidney cancer (Nivoren cohort)
4 samples/patients with bladder cancer Patients bearing either a lung or a kidney or a bladder cancer (first tables 3-5) were all advanced or non operable or metastatic patients enrolled in a PD1 or PD-L1 Ab-based monotherapy after progression with conventional treatments in second or third line. They were enrolled at Gustave Roussy in the context of the EMA approval of the drug and according to ethical guidelines allowing harvesting of stools at different time points of PD1 blockade to analyze the MG composition. The endpoint of this ancillary study was to establish correlates between feces composition (at species and genes levels) and clinical response to PD1 blockade (response rates and progression-free survival (PFS)).

TABLE 3

Patient characteristics in the lung cancer cohort (batch 1)

| Characteristics-Lung cancer | n = 28 |
|---|---|
| Median age - yr | 65 (48-76) |
| Sex - no. (%) | |
| Male | 16 (57) |
| Female | 12 (43) |
| Histology - no. (%) | |
| Adenocarcinoma | 21 (75) |
| Squamous cell carcinoma | 3 (11) |
| Other | 4 (14) |
| Clinical Stage - no. (%) | |
| II | 1 (4) |
| IV | 27 (96) |
| Metastasis - no. (%) | |
| Brain | 14 (50) |
| Liver | 7 (25) |
| Bone | 10 (36) |
| Mutations - no. (%) | |
| EGFR | 3 (11) |
| ALK | 1 (4) |
| KRAS | 7 (25) |

TABLE 3-continued

Patient characteristics in the lung cancer cohort (batch 1)

| Characteristics-Lung cancer | n = 28 |
|---|---|
| Clinical response - no. (%) | |
| Complete response | 0 (0) |
| Partial response | 4 (14) |
| Stable disease | 5 (18) |
| Progression | 19 (68) |
| Survival outcome - no. (%) | |
| Dead | 8 (29) |
| Alive | 20 (71) |

TABLE 4

Patient characteristics in the renal cell cancer cohort (batch 1)

| Characteristics-Renal cell cancer | n = 16 |
|---|---|
| Median age - yr | 60 (46-77) |
| Sex - no. (%) | |
| Male | 13 (81) |
| Female | 3 (19) |
| Histology - no. (%) | |
| Clear cell renal cell carcinoma | 15 (94) |
| Non-clear cell renal cell carcinoma | 1 (6) |
| Fuhrmann score - no. (%) | |
| II | 5 (31) |
| III | 5 (31) |
| IV | 1 (6) |
| N/A | 5 (31) |
| Clinical Stage - no. (%) | |
| IV | 16 (100) |
| Median tumor burden | 82 (30-197) |
| IMDC risk group - no. (%) | |
| Favorable | 3 (19) |
| Intermediate | 8 (50) |
| Poor | 5 (31) |
| Karnofsky performance status - no. (%) | |
| ≤70 | 6 (38) |
| ≤80 | 5 (31) |
| ≤90 | 5 (31) |
| Clinical response - no. (%) | |
| Complete response | 0 (0) |
| Partial response | 3 (19) |
| Stable disease | 7 (44) |
| Progression | 6 (38) |

TABLE 5

Patient characteristics in the bladder cancer cohort (batch 1)

| Characteristics-Bladder cancer | n = 4 |
|---|---|
| Median age - yr | 52 (49-62) |
| Sex - no. (%) | |
| Male | 3 (75) |
| Female | 1 (25) |
| Histology - no. (%) | |
| Transitional | 1 (25) |
| Urothelial carcinoma | 3 (75) |

TABLE 5-continued

Patient characteristics in the bladder cancer cohort (batch 1)

| Characteristics-Bladder cancer | n = 4 |
|---|---|
| Clinical Stage - no. (%) | |
| IV | 4 (100) |
| Median tumor burden | 42 (32-68) |
| Karnofsky performance status - no. (%) | |
| ≤70 | 0 |
| ≤80 | 1 (25) |
| ≤90 | 3 (75) |
| Clinical response - no. (%) | |
| Complete response | 2 (50) |
| Partial response | 0 |
| Stable disease | 1 (25) |
| Progression | 1 (25) |
| Survival outcome - no. (%) | |
| Dead | 1 (25) |
| Alive | 3 (75) |

In other larger retrospective analyses (featuring below, tables 6 and 8) of the same trials encompassing at least >60 patients, in which feces were not collected, we analyzed the impact of antibiotics use on clinical outcome.

Analysis Pipeline and Methodology

Gut microbiota analysis was performed using the quantitative metagenomics pipeline developed at MetaGenoPolis (MGP). This approach allows the analysis of the microbiota at the gene and species levels.

Total DNA has been extracted from the 127 stool samples (SAMBO platform) and subjected to shotgun sequencing using Ion Proton sequencer to reach >20 million short DNA sequence reads (MetaQuant platform). High quality reads were selected and cleaned to eliminate possible contaminants as human reads. The HQ clean reads were then mapped (shared procedure) and counted using the MetaHIT hs_9.9M genes catalogue (Li et al., 2014) using the METEOR Studio in house pipeline using a two steps procedure: first using uniquely mapping reads, then attributing shared reads (mapping different genes from the catalogue) according to their mapping ratio using unique reads. Mapping was performed using a >95% identity threshold to account gene variability and the no redundant nature of the catalogue.

After a downsizing step (to correct for the different sequencing depth) and normalization (RPKM), a gene frequency profile matrix was obtained which is used as the starting point to perform the analysis using MetaOMineR, a suite of R packages developed at MGP, dedicated to the analysis of large quantitative metagenomics datasets.

MGS

The hs_9.9M gene catalogue has been clustered into 1438 MGS (MetaGenomic Species, groups of >500 genes that covary in abundance among hundreds samples and thus belong to the same microbial species). The taxonomical annotation of the MGS was performed using the homology of its genes with previously sequenced organisms (using blastN against nt and wgs databanks).

MGS signal among samples was calculated as the mean signal of 50 marker genes.

A MGS frequency profile matrix was constructed using the MGS signals and after normalization (sum of the MGS frequency of a sample=1).

MGS barcode: MGS occurrence and abundance within samples is visualized using "barcodes", heatmap of a frequency abundance table of 50 marker genes with samples in columns and genes in rows. A heat color code is used (white for 0, lightblue <blue <green <yellow <orange <red for increasing abundance, each color change corresponding to a 4-fold abundance change). In these barcodes, MGS appear as vertical lines (co-abundant genes in the sample) colored according to gene abundance.

Richness

The richness of the samples can be evaluated at the gene or MGS level.

GC: gene count, number of genes seen in a sample.

MGS count: number of MGS seen in a sample

Similarity

Similarity between samples was evaluated at the gene and MGS levels using spearman correlation.

Microbiota Analysis

Microbiota analysis was performed at the MGS level.

First, we analysed the microbiota of the different cohorts of cancer patients compared to that of healthy "controls".

Second, exploratory microbiota analyses were performed according to several hot questions.

Contrasted or correlated MGS were searched according to sample classes or clinical parameters using Wilcoxon test or Spearman correlation and the MGS mean signal, and selected according to p-value.

Statistical Analysis

Determination of bacterial cut-off: Two-sided p-values were calculated from the Wilcoxon rank-sum test. Biomarker effectiveness was determined from the area under the receiver operating characteristic curve (AUC) that describes the relationship between the sensitivity and the complement of the specificity for each possible value taken by the biomarker as a discrimination threshold. Optimal cut-off corresponds to the most effective biomarker discrimination threshold. It corresponds to the value that maximises the Youden index as defined as the sum of the sensitivity and specificity for each possible value of the biomarker. 95% confidence intervals for the AUC and the optimal cut-off were determined by bootstrapping (B=1999).

Example 1: The Efficacy of PD1 Blockade is Significantly Decreased by Oral Antibiotics in Renal Cell Carcinoma and Urothelial Cancer Patients First, a cohort of 70 metastatic RCC patients enrolled in the phase II NIVOREN protocol in second or third line therapy with anti-PD1 or anti-PD-L1 Ab were retrospectively analyzed for the effects of oral administration antibiotics (ATB, at least 7 days of β-lactamines) or proton pump inhibitors (PPI) taken 60 to 30 days prior to enrollment in NIVOREN. 14 and 21 patients out of 70 received β-lactamines and PPI respectively. In univariate analysis of all clinical parameters associated with accelerated time to progression (PFS), Karnofsky performance status (KPS) and ATB uptake were the two significant variables retained in the model, predicting shorter PFS. In multivariate Cox regression analysis, ATB (and to a lesser extent PPI) administration remained significant factors associated with reduced benefit from PD1 blockade (reduced PFS, $p<0.01$ and $p<0.03$ respectively) (FIG. 1, Tables 6, 7).

TABLE 6

Patient characteristics in the mRCC cohort

| Characteristics-Renal cell cancer | n = 70 |
|---|---|
| Age-yr-no. (%) | |
| <60 | 32 (46) |
| ≥60 | 38 (54) |
| Sex-no. (%) | |
| Male | 48 (69) |
| Female | 22 (32) |
| Nephrectomy-no. (%) | |
| Yes | 63 (90) |
| No | 7 (10) |
| Tumour Histology-no. (%) | |
| Clear cell | 68 (97) |
| Non-clear cell | 2 (3) |
| Fuhrmann Grade-no. (%) | |
| I | 4 (8) |
| II | 14 (29) |
| III | 22 (46) |
| IV | 8 (17) |
| N/A | 22 |
| Median Tumor Burden-median (range) | 84 (48-271) |
| Karnofsky performance status-no. (%) | |
| ≤70 | 10 (14) |
| ≤80 | 23 (33) |
| ≤90 | 37 (53) |
| IMDC Risk Group-no. (%) | |
| Good | 15 (21) |
| Intermediate | 41 (59) |
| Poor | 14 (20) |
| ATB-no. (%) | |
| No | 56 (80) |
| Yes | 14 (20) |

Secondly, a similar analysis was performed in patients with urothelial carcinoma (UC) treated with PD-L1 inhibitors (anti-PD-L1 Ab). We conducted a retrospective study of UC patients treated at Gustave Roussy with PD-L1 inhibitors and available data on ATB. ATB (+)/(−) group were defined as patients treated or not with ATB (2 months before the first injection and thereafter up to 1 month). Progression-Free survival (PFS), Response Rate (RR) and Overall Survival (OS) were compared between ATB (+) and ATB (−). Statistical analyses were performed using the Kaplan-Meier method and Cox regression adjusted for risk factors. 42 patients were included in this study, 12 patients (29%) received ATB (beta-lactamases and fluoroquinolones most frequently). ATB (+) group had decrease PFS when compared to ATB (−) group (1.8 vs. 4.3 months, p<0.04). This statistical association was maintained after multivariate analysis adjusted for age, gender, Karnofsky Performance Status, hemoglobin and presence of liver metastases. In ATB (+) group compared to ATB (−) group, the RR was lower (4 pts (33%) vs 21 pts (70%)) (p<0.03). After a median follow-up of 15 months, there was a negative trend on the OS driven by ATB, but the median OS was still unreached in the ATB(−) group. (Table 8, 8a and FIG. 2).

TABLE 8

Patients' characteristics in the urothelial cancer cohort.

| Characteristics - Bladder cancer | n = 42 |
|---|---|
| Age-yr no. (%) | |
| <65 | 21 (50) |
| ≥65 | 21 (50) |
| Sex-no. (%) | |
| Male | 30 (71) |
| Female | 12 (29) |

TABLE 7

Multivariate analysis of clinical parameters affecting progression free survival in 70 RCC from NIVOREN protocol.

| | | | Univariate | | Multivariate | |
|---|---|---|---|---|---|---|
| Parameter | Levels | Group | HR [95% CI] | LRT | HR [95% CI].adj | LRT.adj |
| ATB | NoATB | 56/29 | 1 | 7.34, p < 0.0067 | 1 | 6.07, p < 0.0138 |
| | ATB | 14/11 | 2.89 [1.4; 5.99], p < 0.0067 | | 2.89 [1.25; 6.66], p < 0.0138 | |
| AgeDiagCl | (25, 60] | 32/18 | 1 | 0.24, p < 0.6271 | 1 | 0.20, p < 0.6535 |
| | (60, 85] | 38/22 | 0.86 [0.46; 1.6], p < 0.6271 | | 0.85 [0.41; 1.77], p < 0.6535 | |
| Gender | F | 22/15 | 1 | 0, p < 0.9663 | 1 | 0.00, p < 0.9661 |
| | M | 48/25 | 1.01 [0.53; 1.93], p < 0.9663 | | 1.02 [0.49; 2.12], p < 0.9661 | |
| KPSBis | 70 | 10/8 | 1 | 8.99, p < 0.0111 | 1 | 7.64, p < 0.0219 |
| | 80 | 23/11 | 0.27 [0.1; 0.68], p < 0.0071 | | 0.20 [0.06; 0.63], p < 0.0059 | |
| | 90 | 37/21 | 0.25 [0.11; 0.59], p < 0.0032 | | 0.21 [0.06; 0.73], p < 0.0191 | |
| IMDC | Poor | 14/10 | 1 | 1.85, p < 0.3961 | 1 | 0.65, p < 0.7219 |
| | Inter | 41/22 | 0.59 [0.28; 1.26], p < 0.1778 | | 1.53 [0.47; 4.97], p < 0.4612 | |
| | Good | 15/8 | 0.73 [0.29; 1.88], p < 0.5105 | | 1.75 [0.41; 7.51], p < 0.4386 | |
| TBCl | Lo | 23/10 | 1 | 4.64, p < 0.0981 | 1 | 1.11, p < 0.5738 |
| | Mi | 22/11 | 1.04 [0.44; 2.47], p < 0.9237 | | 1.09 [0.42; 2.82], p < 0.8483 | |
| | Hi | 25/19 | 2.03 [0.94; 4.38], p < 0.0612 | | 1.58 [0.62; 4.04], p < 0.3284 | |
| PPI | NoPPI | 48/27 | 1 | 2.12, p < 0.1454 | 1 | 4.24, p < 0.0396 |
| | PPI | 22/13 | 1.66 [0.85; 3.27], p < 0.1454 | | 2.20 [1.04; 4.66], p < 0.0396 | |

ATB: uptake of antibiotics. KPS: Karnofsky performance status. IMDC: International metastatic renal cell carcinoma database consortium-prognosis index, TBCl: Tumor burden classification (lo: low, Mi: Middle, Hi-High) PPI: uptake of a proton pump inhibitor.

TABLE 8-continued

Patients' characteristics in the urothelial cancer cohort.

| Characteristics - Bladder cancer | n = 42 |
|---|---|
| Histology-no. (%) | |
| Urothelial carcinoma | 42 (100) |
| Median Tumor Burden-median (range) | 54 (15-157) |
| Karnofsky performance status-no. (%) | |
| ≤70 | 2 (5) |
| ≤80 | 14 (33) |
| ≤90 | 26 (62) |
| Hemoglobin-no. (%) | |
| >10 mg/dL | 32 (76) |
| <10 mg/dL | 10 (24) |
| Liver metastasis-no. (%) | |
| No | 26 (62) |
| Yes | 16 (38) |
| ATB-no. (%) | |
| No | 30 (71) |
| Yes | 12 (29) |

TABLE 8a

Multivariate analysis of known clinical risk factors to determine the influence of ATB on PFS in 42 patients with urothelial cancer.

| | Multivariate p-value |
|---|---|
| ATB | 0.026* |
| KPS | 0.046* |
| Hb | 0.565 |
| Liver Met | 0.765 |
| Sex | 0.138 |

ATB: uptake of antibiotics.
KPS: Karnofsky performance status.
Hb: hemoglobin

In conclusion, these findings indicate that ATB hamper the clinical benefit expected from anti-PD1 or anti-PD-L1 Abs, suggesting that an intact intestinal microbiota might be required for the bioactivity of nivolumab or atezolizumab. This data prompted us to investigate potential deviations of the gut microbiome in cancer patients (versus normal individuals) and their consequences on prognosis and responses to chemotherapy or ICB.

Additional data regarding the impact of ATB uptake on the bioactivity and clinical effects of anti-PD1 or anti-PD-L1 Abs are disclosed in Example 9 below (FIG. 20-21).

Example 2: Cancer Affects the Richness of the Intestinal Microbiota

The quality control of the reads was satisfactory and indicated an homogeneity among all cancer patients. Interestingly, a contamination with human reads was observed in cancer patients that progressed post-nivolumab (not shown), suggesting that intestinal apoptosis might precede or be concomitant to dissemination of tumor cells. Similar richness (GC and MGS count) was observed whatever the cohort or the outcome (not shown).

Comparisons of cancer patients with "healthy controls" (selected among the samples sequenced using Ion Torrent with >=13M mapped reads onto the hs_9.9M gene catalogue: 85 samples) revealed that there was only a tendency for lower richness in cancer patients compared with healthy controls both in gene or MGS level (not shown).

Despite the lack of significance of richness contrast between cancer and healthy (H) controls, a deep loss of richness appears in ~ half of cancer patients when performing a gene (but not MGS) based-hierarchical clustering. Indeed, 54% (68/127) cancer (C) samples and 9% (8/85) healthy (H) samples belong to the "low" group (chi.test p.value=1.4 e-10), suggesting that genes relevant for functions outside species taxonomy are separating cancer bearers from healthy individuals (not shown).

Example 3: Phenotypic Traits of the Cancer-Associated Microbiota Compared with Healthy Microbiota: 19 Markers Associated with Cancer Dysbiosis We aim to identify microbiota contrast between the different Cancer (C) patients' cohorts and Healthy (H) cohorts. For each patient, the first sample (at diagnosis prior to therapy) was chosen for the analysis.

For this example, an additional cohort was added, comprising 53 breast cancer patients (Table 9).

TABLE 9

| Characteristics-Breast cancer | n = 53 |
|---|---|
| Median age-yr | 50 (35-74) |
| Histology -no. (%) | |
| Ductal carcinoma | 43 (81) |
| Lobular carcinoma | 6 (11) |
| Other | 4 (8) |
| Ellis-Elston | |
| 1 | 2 (52) |
| 2 | 22 (42) |
| 3 | 28 (53) |
| N/A | 1 (2) |
| Clinical Stage T-no. (%) | |
| 1 | 22 (42) |
| 2 | 22 (42) |
| 3 | 8 (15) |
| N/A | 1 (2) |
| Clinical Stage N-no. (%) | |
| 0 | 30 (57) |
| 1 | 16 (30) |
| 2 | 3 (6) |
| 3 | 4 (8) |
| Clinical Stage-no. (%) | |
| I | 16 (30) |
| II A | 20 (38) |
| II B | 5 (9) |
| III A | 8 (15) |
| III C | 4 (8) |
| Hormonal receptor-no. (%) | |
| Luminal Non Her2 | 26 (49) |
| Luminal Her 2 | 13 (25) |
| Non luminal Her2 | 4 (8) |
| Triple Negative | 10 (19) |

Samples:

Patients with Cancer: 101

Breast: 53 patients

Kidney: 16 patients

Lung: 28 patients

Bladder: 4 patients

Healthy controls: 85 individuals.

Microbiota:

The following strategy was used to identify contrasted MGS between cancer patients and healthy controls:
- based on the 2 clusters obtained using correlation of the samples according to their gene content, the whole cohort was separated in "high" and "low" richness samples
  - Breast: 28 "high" and 25 "low"
  - Kidney: 11 "high" and 5 "low"
  - Lung: 14 "high" and 14 "low"
  - Healthy: 77 "high" and 8 "low"
- for each cancer cohort, MGS contrast with the whole healthy cohort was searched using:
  - all the individuals
  - the "high" richness samples
  - the "low" richness samples
- contrasted MGS were selected if they met the following criteria:
  - being both significantly contrasted for all samples and high richness samples (p.val <0.05)
  - same status in both analysis
  - significance s 0.001 for at least one of the tests Using this strategy, the following contrasted MGS were found:
- Breast: 90 contrasted MGS using both p.val <0.05 and 40 MGS using best p.val <0.001
- Kidney: 157 contrasted MGS using both p.val <0.05 and 42 MGS using best p.val <0.001
- Lung: 160 contrasted MGS using both p.val <0.05 and 100 MGS using best p.val <0.001

147 MGS were found significantly contrasted (p<0.001) in at least one of the former analyses, some of them being common as judged by the heatmaps/hierarchical clusterings presented in FIGS. 3 to 5. Despite the lack of significance in richness loss upon cancer, a great correlation was observed between bacterial species enriched in Healthy controls & High richness species vs Cancer species & Low richness species.

29% of the contrasted MGS appear to be high or low richness MGS with a very strong association between richness MGS and phenotype: high richness MGS/healthy subjects vs low richness MGS/cancer cohorts. Among the "healthy MGS" are found many potential short-chain fatty acids (SCFA) producing bacteria (as *Faecalibacterium, Roseburia, Blautia*, species) (FIG. 4).

27 MGS were found contrasted in at least 2 cancer cohorts (FIGS. 6-7).

In conclusion, a typical cancer-associated microbial fingerprint of intestinal content would be based on the 19 markers defined as follows:

Over-representation of *Bifidobacterium dentium, Cryptobacterium* sp. CAG:338, unclassified *Eggerthella, Phascolarctobacterium* sp. CAG:266, *Clostridium* sp. CAG:169, *Enterococcus faecalis, Faecalitalea cylindroides, Suddoligranulum* sp. 4_3_54A2FAA, *Ruminococcus torques, Hungatella hathewayi, Clostridium* sp. CAG:242, *Escherichia coli* CAG00011; CAG00815 *Lactococcus lactis*.

TABLE 10

| CAG | Corresponding referenced species | Number of co-variant genes | Threshold maximizing the Youden index |
| --- | --- | --- | --- |
| CAG00456 | *Bifidobacterium dentium* | 1968 | 2.082182e−05 [2.082182e−05; 5.039616e−05] |
| CAG00998 | *Cryptobacterium* sp. CAG: 338 | 1546 | 7.378485e−05 [7.378485e−05; 0.0004056758] |
| CAG00905 | unclassified *Eggerthella* | 1302 | 4.286171e−05 [4.286171e−05; 0.0001209414] |
| CAG00885 | *Phascolarctobacterium* sp. CAG: 266 | 1336 | 9.264798e−05 [9.264798e−05; 0.005263659] |
| CAG00672 | *Clostridium* sp. CAG: 169 | 1645 | 0.0001620558 [0.0001620558; 0.000452764] |
| CAG00257 | *Enterococcus faecalis* | 2253 | 0.0001263241 [0.0001263241; 0.0001986582] |
| CAG00681 | *Faecalitalea cylindroides* | 1635 | 5.495815e−05 [3.013049e−05; 0.0002242631] |
| CAG00140 | *Subdoligranulum* sp. 4_3_54A2FAA | 2650 | 0.001252674 [0.000247579; 0.001681001] |
| CAG00243 | *Ruminococcus torques* | 2625 | 0.0004426992 [0.0002992785; 0.001181286] |
| CAG00025 | *Hungatella hathewayi* | 4407 | 3.731168e−05 [9.958701e−06; 5.823888e−05] |
| CAG00381 | *Clostridium* sp. CAG: 242 | 2033 | 5.09195e−05 [5.09195e−05; 9.205743e−05] |
| CAG00011 | *Escherichia coli* | 5523 | 0.0003582595 [7.379654e−05; 0.001757729] |
| CAG00815 | *Lactococcus lactis* | 1464 | 4.785713e−05 [4.785713e−05; 0.0001031883] |

Under-representation of *Bifidobacterium adolescentis*, unclassified *Clostridiales, Roseburia* sp. CAG:182, unclassified *Blautia, Blautia* sp. CAG:237, unclassified *Faecalibacterium*

TABLE 11

| CAG | Corresponding referenced species | Number of co-variant genes | Threshold maximizing the Youden index |
|---|---|---|---|
| CAG00702 | *Bifidobacterium adolescentis* | 1609 | 0.002773964 [0.0006811621; 0.003241451] |
| CAG01132 | unclassified Clostridiales | 976 | 0.0005991194 [0.0002469458; 0.0007978176] |
| CAG00055 | *Roseburia* sp. CAG: 182 | 3490 | 5.27458e-05 [5.27458e-05; 0.0002543267] |
| CAG01239 | unclassified *Blautia* | 796 | 8.193166e-05 [5.975853e-05; 0.0001334845] |
| CAG00179 | *Blautia* sp. CAG: 237 | 2495 | 2.026261 e-05 [1.20318e-05; 2.713887e-05] |
| CAG00297 | unclassified *Faecalibacterium* | 2174 | 0.0001188712 [0.0001188712; 0.0009145373] |

This observation of a typical cancer-associated microbial fingerprint of intestinal content led the inventors to propose allogeneic fecal microbial transplantation of healthy individual feces to cancer patients in need thereof and/or administration of a composition aimed at favoring the patient's response to an antineoplastic treatment, such as (i) a composition admixing *Bifidobacterium adolescentis*, unclassified *Clostridiales, Roseburia* sp. CAG:182, unclassified *Blautia, Blautia* sp. CAG:237, unclassified *Faecalibacterium*, or (ii) a probiotic composition of immunogenic bacteria such as *Enterococcus hirae* or *Akkermansia muciniphila* or *Alistipes* shahii or other *Alistipes* spp. or *Barnesiella intestinihominis* or *Bacteroides fragilis* and *Burkholderia cepacia*.

Additional data regarding the cancer-associated microbial fingerprint of intestinal content are disclosed in Example 10 below (FIG. 22-23).

Example 4: Gut Fingerprints Predicting Clinical Benefit with Antibodies Blocking the Anti-PD1/PD-L1-PD-L2 Axis First, we examined the microbiome profile before the first administration of anti-PD1 Ab (V1) and compared it with that observed after 6 months (6 months of bimonthly injections, V4). All V4 were responders (since these therapeutic administrations were stopped at 3 months in non-responders). We pooled bladder and lung cancer bearing patients for this analysis since results were quite similar in lung cancers taken separately.

Samples:

lung: 16 samples; 11 V1/5 V4 bladder; 3 more responders V4 samples

Results

There were significant shifts in the microbiome composition over the course of the treatment in responders to PD1 blockade who tend to manifest the following profile (FIG. 8):

Over-representation of *Blautia* sp. KLE 1732, *Alistipes shahii, Firmicutes bacterium* CAG:114, *Clostridium* sp. CAG:265, unclassified *Firmicutes* (CAG00618), unclassified *Clostridiales, Bifidobacterium adolescentis*

Under-representation of unclassified *Clostridiales, Clostridiales bacterium* 1_7_47FAA, *Dorea formicigenerans, Eubacterium* sp. CAG:38.

TABLE 12

| CAG | Corresponding referenced species | Number of co-variant genes | Threshold maximizing the Youden index |
|---|---|---|---|
| Over-representation | | | |
| CAG00482 | *Blautia* sp. KLE 1732 | 1904 | 0.000170535 [0.000170535; 0.00329442] |
| CAG00384 | *Alistipes shahii* | 2666 | 0.005322663 [0.005322663; 0.007488159] |
| CAG00603 | Firmicutes bacterium CAG: 114 | 1715 | 0.0001692879 [0.0001692879; 0.001029164] |
| CAG00306 | *Clostridium* sp. CAG: 221 - *Clostridium* sp. CAG: 265 | 2154 | 2.168856e-05 [2.168856e-05; 5.477953e-05] |
| CAG00618 | unclassified Firmicutes | 1699 | 0.0001257995 [0.0001257995; 0.01956294] |
| CAG01268 | unclassified Clostridiales | 742 | 9.118905e-05 [9.118905e-05; 0.0004603249] |
| CAG00702 | *Bifidobacterium adolescentis* | 1609 | 0.0002381096 [0.0002381096; 0.003149554] |

TABLE 12-continued

| CAG | Corresponding referenced species | Number of co-variant genes | Threshold maximizing the Youden index |
|---|---|---|---|
| | Under-representation | | |
| CAG50003 | unclassified Clostridiales | 699 | 0.0006258979 [0.0006258979; 0.0006736022] |
| CAG01230 | Clostridiales bacterium 1_7_47FAA & VE202-28 | 814 | 5.596526e−05 [5.596526e−05; 0.0002626544] |
| CAG00650 | Dorea formicigenerans | 1667 | 0.001599624 [0.0003350047; 0.002411789] |
| CAG00178 | Eubacterium sp. CAG: 38 | 2496 | 0.002371692 [7.063138e−05; 0.003622146] |

Secondly, we aimed at predicting the clinical benefit to anti-PD1 Ab (nivolumab) by analyzing the specimen before onset of PD1 blockade, by identifying microbiota contrast between Responders/Non Responders at time 0 (sample V1, before treatment). As no clear difference could be detected between paired V1 and V2 lung samples (not shown), we used V2 samples when V1 samples were not available to increase cohort size.

Samples:

Lung: 6 R (3 V1 and 3 V2)/19 NR (8 V1 and 11 V2),

NB: excluded from contrasts 3 R (1 V3 and 2 V4)

1 R was only followed for 2.4 months

Kidney: 9 R V1/6 NR V1

Richness

No significant richness difference between responders and non responders was observed but a tendency of lower richness in lung NR (not shown).

We pooled lung+kidney patients as such:

Since outcome was evaluated after ~3 months in kidney patients, the pooled analysis was performed using R+NR >3 months: 13 lung+9 kidney patients/NR<3 months: 12 lung+6 kidney We found 36 MGS more abundant in Responders, 11 MGS more abundant in Progressors (FIG. 9).

In conclusion a microbial fingerprint of intestinal content prone to respond to PD1 blockade, is the following profile, based on approximately 45 markers, enriched in *Firmicutes, Clostridiales, Alistipes* and *Eubacterium* as well as interesting species such as *Methanobrevibacter smithii*, and *Akkermansia muciniphila*, but poor in *Oscillibacter* and defined precisely as such:

Over-representation of unclassified species:

CAG00064

CAG00245

*Firmicutes* species:

CAG00604, 1714

CAG01090, 1026

CAG00965, 1210

CAG00621, 1695

CAG01245, 780

CAG01308, 606

CAG00669, 1649

CAG00670, 1648

CAG00872, 1359

CAG00851, 1422

CAG00288, 2189

*Clostridiales* species:

CAG00363, 2056

CAG00391, 2019

CAG00449, 1945

CAG00513, 1853

CAG00559, 1776

CAG00644, 1670

CAG00811

CAG00907, 1299

CAG01350

*Ruminococcaceae* species:

unclassified *Ruminococcaceae*, CAG01169, 912

*Subdoligranulum* sp. CAG:314, CAG00880, 1352 unclassified *Faecalibacterium*, CAG00628, 1686

*Ruminococcus lactaris* CAG00558, 1777

*Eubacterium* species:

CAG00469, 1928

CAG00393, 2011

*Bacteroidales* species

*Bacteroides nordii*, CAG00116, 2783

*Bacteroides* sp. CAG:661, CAG00355, 2067

*Bacteroides* sp. CAG:598, CAG00440, 1952 unclassified *Alistipes*, CAG00646, 1668

*Alistipes* sp. CAG:435, CAG00887, 1332

*Verrucomicrobia* species

*Akkermansia muciniphila*, CAG00301, 3187

*Coraliomargarita* sp. CAG:312, CAG00313, 2139

*Archaea* species

*Methanobrevibacter smithii* CAG00721, 1830

Under-Representation of:

*Oscillibacter* (CAG00931, 1257, and CAG00270, 2225)

*Bifidobacterium adolescentis* (CAG00702, 1609)

*Anaerotruncus colihominis* (CAG00720, 1590)

*Clostridium* sp. CAG:242, CAG00381, 2033

*Clostridiales bacterium* VE202-14, CAG00168, 2534

*Eubacterium* sp. CAG:252, CAG00353, 2341 unclassified *Bilophila*, CAG01018, 1135

TABLE 13

| CAG | Corresponding referenced species | Number of co-variant genes | Threshold maximizing the Youden index |
|---|---|---|---|
| | Unclassified species | | |
| CAG00064 | unclassified species | 3310 | 0.0003947016 [7.891756e−05; 0.001301043] |
| CAG00245 | unclassified species | 2277 | 0.0001214906 [0; 0.006284153] |
| | Firmicutes species | | |
| CAG00604 | Firmicutes bacterium CAG: 110 | 1714 | 7.147811e−05 [7.147811e−05; 0.006567028] |
| CAG01090 | unclassified Firmicutes | 1026 | 0.0003618442 [2.265689e−05; 0.002130399] |
| CAG00965 | Firmicutes | 1210 | 3.247673e−05 [3.247673e−05; 0.003148149] |
| CAG00621 | Firmicutes bacterium CAG: 272 | 1695 | 0.000151022 [0.000151022; 0.00308653] |
| CAG01245 | Firmicutes | 780 | 0.0002287271 [0; 0.002195563] |
| CAG01308 | unclassified Firmicutes | 666 | 4.033813e−05 [4.033813e−05; 0.0006620213] |
| CAG00669 | Firmicutes | 1649 | 0.0001890876 [0.0001890876; 0.0107959] |
| CAG00670 | unclassified Firmicutes | 1648 | 0.0002932635 [0.0001187004; 0.003081848] |
| CAG00872 | Firmicutes bacterium CAG: 240 | 1359 | 0.0008436382 [5.18632e−05; 0.005900856] |
| CAG00851 | unclassified Firmicutes | 1422 | 0.0003027565 [0; 0.004660334] |
| CAG00288 | Firmicutes bacterium CAG: 95 | 2189 | 0.001213057 [6.712724e−05; 0.001438314] |
| | Clostridiales species | | |
| CAG00363 | unclassified Clostridiales | 2056 | 5.290508e−05 [0; 9.015663e−05] |
| CAG00391 | unclassified Clostridiales | 2019 | 0.001109153 [0; 0.01542335] |
| CAG00449 | Clostridium sp. CAG: 253 | 1945 | 8.256957e−05 [8.256957e−05; 0.000333628] |
| CAG00513 | unclassified Clostridiales | 1853 | 0.0007258855 [0.0007258855; 0.003000979] |
| CAG00559 | unclassified Clostridiales | 1776 | 0.0008511848 [0.00028557; 0.008890015] |
| CAG00644 | Clostridium sp. CAG: 226 | 1670 | 0.0001241694 [0.0001241694; 0.04165556] |
| CAG00811 | unclassified Clostridiales | 1469 | 3.800777e−05 [0; 0.0008164238] |
| CAG00907 | unclassified Clostridiales | 1299 | 0.002714397 [0; 0.008836334] |
| CAG01350 | unclassified Clostridiales | 597 | 0.0002351261 [0; 0.00110505] |
| | Ruminococcaceae species | | |
| CAG01169 | unclassified Ruminococcaceae | 912 | 6.304785e−05 [6.304785e−05; 0.0007941971] |
| CAG00880 | Subdoligranulum sp. CAG: 314 | 1352 | 0.006182719 [0; 0.0202024] |
| CAG00628 | unclassified Faecalibacterium | 1686 | 0.0009421326 [0.0003118048; 0.001708944] |
| CAG00558 | Ruminococcus lactaris | 1777 | 0.006544936 [2.066638e−05; 0.008354078] |
| | Eubacterium species | | |
| CAG00469 | Eubacterium sp. CAG: 146 | 1928 | 4.815212e−05 [1.161598e−05; 0.00016962] |
| CAG00393 | Eubacterium sp. CAG: 86 | 2011 | 0.0006926536 [4.554846e−05; 0.001057236] |
| | Bacteroidales species | | |
| CAG00116 | Bacteroides nordii | 2783 | 1.220512e−05 [1.220512e−05; 0.001216345] |
| CAG00355 | Bacteroides sp. CAG: 661 | 2067 | 0.0001412803 [0.0001412803; 0.08686365] |
| CAG00440 | Bacteroides sp. CAG: 598 | 1952 | 0.004614811 [0; 0.01166431] |

TABLE 13-continued

| CAG | Corresponding referenced species | Number of co-variant genes | Threshold maximizing the Youden index |
|---|---|---|---|
| CAG00646 | *Alistipes* | 1668 | 0.001840316 [0; 0.01288615] |
| CAG00887 | *Alistipes* sp. CAG: 435 | 1332 | 0.017485 [0; 0.09121542] |
| | Verrumicrobia species | | |
| CAG00301 | *Akkermansia muciniphila* | 3187 | 0.01598361 [0.0002493237; 0.01987093] |
| CAG00313 | *Coraliomargarita* sp. CAG: 312 | 2139 | 0.02535175 [0; 0.02535175] |
| | Archaea species | | |
| CAG00721 | *Methanobrevibacter smithii* | 1830 | 0.006472178 [0; 0.008177933] |
| | Under-representation | | |
| CAG00931 | *Oscillibacter* | 1257 | 0.0003035762 [0.0001338014; 0.0005623075] |
| CAG00270 | *Oscillibacter* sp. KLE 1728/KLE 1745/VE202-24 | 2225 | 0.001063076 [0.0008154304; 0.005943308] |
| CAG00702 | *Bifidobacterium adolescentis* | 1609 | 0.0003875448 [0.0003420176; 0.00213834] |
| CAG00720 | *Anaerotruncus colihominis* | 1590 | 0.0003752534 [1.467377e−05; 0.0004653186] |
| CAG00381 | *Clostridium* sp. CAG: 242 | 2033 | 7.505283e−05 [2.96228e−05; 0.003922126] |
| CAG00168 | Clostridiales bacterium VE202-14 | 2534 | 6.323201e−05 [6.323201e−05; 0.0005837004] |
| CAG00353 | *Eubacterium* sp. CAG: 252 | 2341 | 0.0001766626 [0.0001766626; 0.002312927] |
| CAG01018 | unclassified *Bilophila* | 1135 | 0.0002772262 [0.0002772262; 0.004455528] |

Example 5: Fecal Microbial Transplantation of Human Feces from Lung (NSCLC) Cancer Patients Confer Sensitivity or Resistance to PD1 Blockade in Germ Free Tumor Bearing Mice We selected four stage IV NSCLC patients (A, B, E, F) who failed to respond to 4 months of nivolumab as well as two stage IV NSCLC patients who exhibited partial response to nivolumab to transfer their stools into ATB-treated recipient animals. In parallel, control specific pathogen free (SPF) mice were given ip administrations of nivolumab and responded by decreased tumor outgrowth as expected (experimental setting described in FIG. 10). However, ATB-treated animals transferred with progressors-derived feces failed to respond while ATB-treated littermates transferred with responders-derived stools did (FIG. 11-12).

Prior to perform FMT, the mice received 3 days of ATB. Then the FMT was performed using feces from different NSCLC patients treated with anti-PD1 Ab. Subsequently, MCA205 WT tumor was inoculated and the mice received four injections of anti-PD1 or isotype control Abs.

There was no difference in tumor size in the Isotype groups from mice that underwent FMT from either responders or not. However, significant smaller final tumor sizes in mice treated with anti-PD1 Abs were observed in animals that received FMT from Responders (RES) compared to that which Progressed (PRO).

This experiment was duplicated in germ free animals as recipients instead of ATB-treated C57BL/6 mice, yielding similar results.

Example 6: Compensatory Anticancer Probiotics Also Called "Oncomicrobiotics" or "Oncobax" (Such as *Akkermansia muciniphila* or *Enterococcus hirae* or *Alistipes* or Combinations)

To establish the proof-of-concept that oral feeding with immunogenic bacteria that are absent in non-responders patients can be beneficial, we performed FMT in avatar model (described in FIG. 10-11-12) followed by bacterial compensation. We could have access to the metagenomic data of Patient A, B (both experiencing Progression) whose feces had a low level of *Akkermansia municiphila* CAG00301: 0 and 0,00344667 respectively (cut-off 0,01598361). *Bacteroides nordii* CAG00116 values were also below the cut-off of 1,22 E-05 (0 & 0 respectively).

Based on the experience presented in FIG. 10-12, we performed FMT of feces from patient A (clinically non responder, metagenomic profile: low *Akkermansia*) in GF mice. Then, 2 gavages were performed with 109 bacteria at the time of the first and second injection of anti-PD1 Abs. Three different bacteria were used, one for each group of mice (n=5 mice per group) in separated isolators.

The oral gavage of *Akkermansia municiphila* (Akk) or *Enterococcus hirae* 13144 (EH) significantly decreased the final tumor size of avatar mice that received FMT from a patient A who progressed. On the other hand, *Eubacterium tenue* did not modify the tumor size post FMT (FIG. 13).

This experiment was repeated with FMT of feces from other patients (patients B and F), with the same and other bacteria and with a higher number of probiotic administrations.

We could have access to the metagenomic data of Patients B and F (both experiencing progression), whose feces had a low level of *Akkermansia municiphila* CAG00301 and *Alis-* tipes spp. Then, 5 gavages were performed with $10^9$ bacteria prior to and at the time of the first, second, $3^{rd}$, $4^{th}$ injection of anti-PD1 Ab. Three different bacteria were used alone (*Akkermansia muciniphila, Alistipes* spp. and *Enterococcus hirae* 13144), as well as the combination of Akk+EH 13144 for each group of mice (n=5-6 mice per group) kept in separated isolators (FIG. 14).

The best responding group was the one with oral gavage of *Akkermansia municiphila+Enterococcus hirae* 13144, which significantly decreased the final tumor size of avatar mice that were either spontaneously reconstituted with the mouse microflora (after stopping ATB, FIG. 15) or that received FMT from patient B (FIG. 16) or F. FIG. 17 shows the results for all mice in this experiment, in which the combination of Akk+EH was more effective than each commensal alone.

Example 7: The Efficacy of PD1 and CTLA4 Coblockade Depends on Gut Microbiota and in Dysbiotic Mice, the Compromised Tumoricidal Activity of the Combination can be Restored by the Combination of *B. fragilis* and *B. cepacia* or *Barnesiella intestinihominis*

C57BL/6 mice were inoculated with MCA205 sarcoma after a 14 day broad spectrum ATB administration. Then, at day 6 of MCA205 implantation, mice were treated with iv injections of anti-CTLA4 Ab (every other 3 days for 4 injections) as well as anti-PD1 Ab (6 injections every other 3 days for 6 injections). In independent groups isolated in different cages, mice received oral gavages with distinct "oncobax", such as *Bifidobacterium breve* combined with *Bifidobacterium longum* or *Bacteroides fragilis* alone or combined to *Burkholderia cepacia* or *Barnesiella intestinihominis*. Tumor growth kinetics were monitored in 6 mice/group, twice a week.

The best result in two independent experiments was obtained with the combination of *Bacteroides fragilis*+ *Burkholderia cepacia* or *Barnesiella intestinihominis*. The percentages of tumor free mice which rejected the tumor was 3/6 (50%) in this group (FIG. 18).

Conclusive Remarks to Examples 1-7

We aimed at better defining the intestinal microbiome of cancer patients at very different stages of their disease: breast cancer at diagnosis, cis-platinum resistant bladder cancers responding at 6 months post-PD1 blockade, second or third line metastatic kidney cancer resistant to tyrosine kinase inhibitors and mTOR inhibitors, cis-platinum-resistant advanced lung cancers. None, except one patient, had taken antibiotics in the last month before feces collection.

Despite this broad heterogeneity of disease histology and stage, we found very homogenous sequenced samples according to reads number and high mapping %.

Similar richness of the cancer samples (GC and MGS count) was found, whatever the cohort or the outcome.

According to gene and MGS count, cancer patients tend to have a lower richness but the difference was not significant. However, hierarchical clustering of the samples gave 2 big clusters driven by microbiota richness, the high richness samples encompassing most (90%) of the healthy samples and only half of the cancer samples, which suggests a richness deficiency in half of the cancer associated microbiomes.

Microbial species associated to cancer were contrasted to that of healthy subjects. 138 MGS were found significantly contrasted in at least one cancer cohort, 40% of them appearing to be high or low richness MGS with a very strong association between richness MGS and phenotype: high richness MGS/healthy subjects vs low richness MGS/cancer cohorts. We thus stratified all samples according to gene richness clusters and focused on MGS significantly contrasted using both the full cohort and the high richness samples. 147 MGS were found significantly contrasted in at least one cancer cohort and 27 were contrasted in at least 2 different cohorts. 30% of the contrasted MGS still appear to be high or low richness MGS but the richness/phenotype association is less clear. Among the "healthy MGS", many potential SCFA producing bacteria (as *Faecalibacterium* and *Roseburia* species) are found as well as *Bifidobacterium adolescentis* that appears to be highly depleted in cancer patients.

In particular, we propose a typical cancer-associated microbial fingerprint of intestinal content based on 19 markers defined as follows:

Over-representation of *Bifidobacterium dentium, Cryptobacterium* sp. CAG:338, unclassified *Eggerthella, Phascolarctobacterium* sp. CAG:266, *Clostridium* sp. CAG:169, *Enterococcus faecalis, Faecalitalea cylindroides, Suddoligranulum* sp. 4_3_54A2FAA, *Ruminococcus torques, Hungatella hathewayi, Clostridium* sp. CAG:242, *Escherichia coli, Lactococcus lactis*.

Under-representation of *Bifidobacterium adolescentis*, unclassified *Clostridiales, Roseburia* sp. CAG:182, unclassified *Blautia, Blautia* sp. CAG:237, unclassified *Faecalibacterium*

Accordingly, lung and bladder cancer patients maintained at least 6 months on prolonged PD1 blockade (and responding to this therapy) manifested a microbial shift, resembling that of healthy volunteers, with decreased abundance of *Clostridium leptum* (considering lung patients only) and enrichment of *Bifidobacterium adolescentis* (highly enriched in healthy controls vs all cancer cohorts).

A microbial fingerprint of intestinal content associated with responses to PD1 blockade is based on 16 MGS, enriched in *Firmicutes, Clostridiales, Ruminococcaceae, Alistipes* and *Eubacterium* as well as interesting species such as *Methanobrevibacter smithii* and *Akkermansia muciniphila*, but poor in *Oscillibacter*. *Akkermansia muciniphila* has been found in anorexia, as well as in metformin-treated individuals, ameliorating diabetes and insulinodependence. This *Verrucomicrobiaceae*-belonging *Akkermansia muciniphila* was also overrepresented in cancer patients responding to PD1 blockade and converted non responding avatar mice into responders in our FMT experiments. Interestingly, an *enterococcus* of high immunogenicity (*Enterococcus hirae*) in the context of cyclophosphamide was also very efficient in converting progressors into responders in avatar mice. Moreover, culturomics analyses revealed higher numbers of detectable colonies of *Enterococcus hirae* in stools at diagnosis in NSCLC patients proned to respond compared to stools of patients doomed to fail therapy with anti-PD1/PDL1 Abs.

In summary, cancer patients display a dysbiotic fecal microbial composition, with low gene diversity, low representation of "health associated MGS" such as SCFA-making bacteria which reduce their immune tone and their propensity and likelihood to respond to immunomodulation such as PD1 blockade. They could benefit from allogeneic fecal microbial transplantation of healthy individual feces or appropriate probiotic compositions, such as a composition admixing *Bifidobacterium adolescentis*, unclassified *Clostridiales, Roseburia* sp. CAG:182, unclassified *Blautia*,

*Blautia* sp. CAG:237, and unclassified *Faecalibacterium*, or a probiotic composition of immunogenic bacteria such as *Enterococcus hirae* or *Akkermansia muciniphila* or *Barnesiella intestinihominis* or *Bacteroides fragilis* and *Burkholderia cepacia*.

Example 8: Stage IV NSCLC Patients Who Develop a TH1 Immune Response Towards *Enterococcus hirae* or *Burkholderia cepacia* or Best *Akkermansia muciniphila* after the 2-4 First Administrations of Anti-PD1 Abs have a Long Term Benefit to PD1 Blockade Fourteen NSCLC patients (Table 14 below) treated with anti-PD1 Abs (Nivolumab) were followed up for their memory TH1 and TC1 or Tr1 immune responses against a variety of different commensals as described in Vetizou et al. Science 2015, after the $1^{st}$ or $2^{nd}$ or third injection.

TABLE 14

| Patient ID | Outcome | PFS in month |
| --- | --- | --- |
| 1-DAM-GU | Dead | 7.495069034 |
| 5-DAN-TH | PRO | 5.489809336 |
| 6-MOU-GI | PRO | 6.47600263 |
| 11-FAY-JU | Partial response | 8.777120316 |
| 13-MAI-CH | Partial response | 8.777120316 |
| 15-BRU-JA | Stable disease | 9.204470743 |
| 16-ALL-JE | Stable disease | 10.09204471 |
| 19-MAT-HE | PRO | 7.232084155 |
| 20-BEN-TR | PRO | 4.109138725 |
| 22-RIF-JE | PRO | 5.029585799 |
| 23-VIA-JM | Partial response | 9.105851414 |
| 26-BEN-KA | Stable disease | 2.399737015 |
| 27-SET-JA | Stable disease | 9.007232084 |
| 29-MAB-PA | PRO | 2.399737015 |

Briefly, autologous monocytes were incubated with live bacteria at a 1:10 ratio, then bacteria were inactivated by appropriate ATB prior to addition of autologous CD4+ or CD8+ T cells (sorted from patients' blood using magnetic beads). The 48 hr supernatants of these cocultures were tested in ELISA for the concentration of IFNγ or IL-10. The median of IFNγ or IL-10 production or their ratio for each bug in the whole cohort was used to segregate the patients and calculate the time to progression during PD1 blockade. The memory TH1/Tr1 CD4+ T cell responses directed toward *Enterococcus hirae* 13144 (MH13144) was associated with long term time to progression (TTP) in these 14 patients treated with anti-PD1 Ab, while those directed toward *Enterococcus faecalis* (EF) or TCR cross linking (beads) failed to predict TTP (FIG. 19 A, B, C).

To confirm the relevance of the immunogenicity of *Enterococcus hirae* in this cohort of NSCLC patients for the response to PD1 blockade, we also exemplified that CD8+ Tc1 immune response to the other isolates of *Enterococcus hirae* (EH17/13344) are also critical to predict TTP (FIG. 19 D-E). High Tc1 immune responses to *Enterococcus hirae* are a favourable immunodynamic parameter predicting TTP under anti-PD1 Ab-based therapy. In FIG. 37, we also demonstrate that CD4+ TH1 (FIG. 37) and CD8+ Tc1 immune responses (Routy et al Science 2017) to the *Verrucomicrobiaceae A. muciniphila* are also critical to predict TTP.

Among 8 other commensals, only TH1 responses to *Burkholderia cepacia* (B) were also relevant to predict TTP in this cohort of patients, high TH1 or TH1/Tr1 ratios being associated with prolonged TTP (FIGS. 19 F and 19H).

Example 9: The Efficacy of PD1 Blockade is Significantly Decreased by Oral Antibiotics in Non Small Lung Cancer Patients We have extended the deleterious role of antibiotics (ATB) for the response to PD1 blockade to non small cell lung cancer patients. 66 NSCLC patients (characteristics detailed in Table 15) in second or third line therapy enrolled in a treatment using anti-PD1 Ab (ICB) were followed up for 18 months. Twenty patients received antibiotics (detailed in Table 16), either up to 2 months before the start of ICB (V1) or during the first month post-1st inoculation of ICB (V2). ATB (+) group: V1 (before the 1st injection of ICB)+V2 (within the $1^{st}$ month of ICB).

TABLE 15

Baseline characteristics of 66 patients with NSCLC treated with Nivolumab as 2nd-3rd line treatment. ATB(+)/(−) groups were defined as patients treated or not with ATB before (2 months period) or within the first month of Nivolumb. Beside the mutational status, no significant difference in clinical characteristics between ATB (+) and ATB (−) group. ATB (+) group: V1 (before the 1st injection of ICB) + V2 (within the 1st month of ICB).

| CHARACTERISTICS - LUNG CANCER | | ATB (+) GROUP (N = 20) | ATB (−) GROUP (N = 46) | P - VALUE | TOTAL (N = 66) |
| --- | --- | --- | --- | --- | --- |
| AGE-YR | MEDIAN | 63 | 62 | <0.308 | 63 |
| | RANGE | 46-77 | 32-77 | | 33-77 |
| AGE-YR- NO. (%) | <65 | 11 (55) | 26 (57) | <0.901 | 37 (56) |
| | ≥65 | 9 (45) | 20 (43) | | 29 (44) |
| GENDER- NO. (%) | MALE | 8 (40) | 33 (72) | <0.015 | 41 (62) |
| | FEMALE | 12 (60) | 13 (28) | | 25 (38) |
| SMOKING STATUS- NO. (%) | CURRENT | 7 (35) | 13 (28) | <0.570 | 20 (30) |
| | FORMER | 12 (60) | 28 (61) | | 40 (61) |
| | NEVER | 2 (5) | 7 (15) | | 6 (9) |
| ECOG PS- NO. (%) | 0-1 | 12 (60) | 14 (70) | <0.860 | 40 (60) |
| | ≥2 | 3 (15) | 5 (11) | | 11 (17) |
| | NOT REPORTED | 5 (25) | 9 (19) | | 15 (23) |
| HISTOLOGY-NO. (%) | SQUAMOUS | 5 (25) | 4 (9) | <0.475 | 13 (20) |
| | NON-SQUAMOUS | 15 (75) | 42 (91) | | 53 (80) |
| MUTATION STATUS- NO. (%) | EGFR POSITIVE | 1 (5) | 1 (2) | * | 5 (7) |
| | KRAS POSITIVE | 4 (10) | 7 (15) | | 13 (20) |
| | ALK POSITIVE | 2 (5) | 0 (0) | | 2 (3) |

TABLE 15-continued

Baseline characteristics of 66 patients with NSCLC treated with Nivolumab as 2nd-3rd line treatment. ATB(+)/(−) groups were defined as patients treated or not with ATB before (2 months period) or within the first month of Nivolumb. Beside the mutational status, no significant difference in clinical characteristics between ATB (+) and ATB (−) group. ATB (+) group: V1 (before the 1st injection of ICB) + V2 (within the 1st month of ICB).

| CHARACTERISTICS - LUNG CANCER | | ATB (+) GROUP (N = 20) | ATB (−) GROUP (N = 46) | P - VALUE | TOTAL (N = 66) |
|---|---|---|---|---|---|
| BRAIN METASTASIS - NO. (%) | | 5 (25) | 7 (15) | <0.723 | 13 (20) |
| NUMBER OF PRIOR SYSTEMIC REGIMENS - NO. (%) | ≥2 | 14 (70) | 16 (35) | <0.596 | 30 (45) |
| LIST OF ATBS - NO. (%) | MACROLIDES | 2 (10) | — | | 2 (3) |
| | BETA LACTAMASES | 9 (45) | — | | 9 (14) |
| | FLUOROQUINOLONES | 4 (20) | — | | 4 (6) |
| | SULFONAMIDES | 2 (10) | — | | 2 (3) |
| | TETRACYCLINE | 2 (10) | — | | 2 (3) |
| | NOT REPORTED | 1 (5) | — | | 1 (1) |

* Not calculated due to small numbers

TABLE 16

ATB specificities. V2 patient charts were reviewed and V2 ATB were prescribed for urinary tract infection, cough or fever (based on CTCAE v4). None was in ICU or actively dying from sepsis.

| LIST OF ATBS | ATB (+) GROUP (N = 20) | ATB (V2) GROUP (N = 7) |
|---|---|---|
| MACROLIDES | 2 | 1 |
| BETA LACTAMASES | 9 | 4 |
| FLUOROQUINOLONES | 4 | 2 |
| SULFONAMIDES | 2 | — |
| TETRACYCLINE | 2 | — |
| NOT REPORTED | 1 | — |

The Kaplan Meier survival curves are shown for progression free survival (no significant difference between the groups treated or not with ATB, FIG. 20 left panel) or overall survival (significant difference, FIG. 20, right panel). The Cox regression multivariate analyses show that ATB administration remains an independent predictor of resistance to ICB in NSCLC patients (Table 17).

TABLE 17

Multivariate analysis for overall survival in NSCLC. Multivariate analysis to determine hazard ratio calculated adjusting for known prognostic risk factors: ATB, Age, Gender, Histology (Non-squamous vs squamous), Smoking History (non-smoker vs smoker), Number of prior therapies, Number of metastatic sites, ECOG scale of performance status (0 = fully active, 1 = restricted in physically strenuous activity, 2 = confined to bed or chair < 50%, 3 = confined to bed or chair > 50%, 4 = completely disable).

| | | | Multivariate (1) | |
|---|---|---|---|---|
| Parameter | Levels | N/Nevent | HR [95% CI], adj (n = 66) | LRT, adj (n = 66) |
| Antibiotics | NoATB | 46/17 | 1 | 6.10, p < 0.0136 |
| | ATB | 20/11 | 3.15 [1.28; 7.80], p < 0.0136 | |
| Age at diagnostic | <65 | 37/18 | | 2.76, p < 0.0967 |
| | >=65 | 29/10 | 0.51 [0.22; 1.18], p < 0.0967 | |
| Gender | F | 25/12 | | 0.00, p < 0.9985 |
| | M | 41/16 | 1.00 [0.35; 2.85], p < 0.9985 | |
| Histology | NonSq | 53/20 | | 10.58, p < 0.0011 |
| | Squamous | 13/8 | 5.80 [2.00; 16.81], p < 0.0011 | |
| Smoking | NonS | 9/6 | | 3.31, p < 0.0691 |
| | Smoker | 57/22 | 0.31 [0.09; 1.09], p < 0.0691 | |
| Num. prior therapies (2) | 0-2 | 50/21 | | 0.28, p < 0.5944 |
| | 3-5 | 16/7 | 1.27 [0.52; 3.11], p < 0.5944 | |
| Num. met. site (3) | 0-2 | 50/21 | | 1.31, p < 0.2529 |
| | 3-4 | 16/7 | 1.81 [0.65; 5.04], p < 0.2529 | |
| ECOG (2) | 0-1 | 55/22 | | 3.59, p < 0.0580 |
| | 2 | 11/6 | 2.78 [0.99; 7.79], p < 0.0580 | |

*p < 0.05,
** p < 0.01,
*** p < 0.001,
ns = not significant.

We gathered the cancer patients suffering from lung cancer (N=66, cohort described in Table 15), bladder cancer (N=42, cohort described in Table 5) and kidney cancer (N=67, described in Table 18 below). In this total of N=175 patients amenable to an ICB-based therapy in $2^{nd}$ or $3^{rd}$ line therapy, we showed that ATB induce resistance to PD-1 blockade (PFS and OS, FIG. 21).

TABLE 18

Update on patient baseline characteristics with mRCC treated with PD1 included in the analysis on the influence of ATB in PFS and OS.

| CHARACTERISTICS - RENAL CELL CARCINOMA | | ATB (+) GROUP (N = 20) | ATB (−) GROUP (N = 47) | P-VALUE | TOTAL (N = 67) |
|---|---|---|---|---|---|
| AGE-YR | MEDIAN | 60 | 61 | <0.322 | 61 |
|  | RANGE | 40-83 | 30-82 |  | 30-83 |
| GENDER-NO. (%) | MALE | 11 (55) | 34 (72) | <0.170 | 45 (67) |
|  | FEMALE | 9 (45) | 13 (28) |  | 22 (33) |
| HISTOLOGY-NO. (%) | CLEAR CELL | 17 (85) | 44 (94) | <0.877 | 61 (91) |
|  | NON-CLEAR CELL | 3 (15) | 3 (6) |  | 6 (9) |
| FUHRMAN GRADE-NO. (%) | I-II | 9 (45) | 9 (19) | <0.055 | 18 (27) |
|  | III-IV | 7 (35) | 22 (47) |  | 29 (43) |
|  | NOT REPORTED | 4 (20) | 16 (34) |  | 20 (30) |
| TUMOR BURDEN-MM | <100 | 11 (55) | 36 (77) | <0.077 | 47 (70) |
|  | ≥100 | 9 (45) | 11 (23) |  | 20 (30) |
| KPS-NO. (%) | ≤70 | 4 (20) | 6 (13) | <0.890 | 10 (15) |
|  | ≤80 | 7 (35) | 15 (32) |  | 22 (33) |
|  | ≤90 | 9 (45) | 26 (55) |  | 35 (52) |
| IMDC RISK GROUP-NO. (%) | GOOD | 5 (25) | 9 (19) | <0.697 | 14 (21) |
|  | INTERMEDIATE | 12 (60) | 27 (58) |  | 39 (58) |
|  | POOR | 3 (15) | 11 (23) |  | 14 (21) |
| NUMBER OF PRIOR LINES-NO. (%) | ≥2 | 18 (90) | 20 (42) | <0.001 | 38 (57) |
| CONCOMITANT DRUGS-NO. (%) | CORTICOSTEROIDS | 4 (20) | 1 (5) | * | 5 (7) |
|  | PROTON PUMP INHIBITORS | 6 (30) | 14 (70) |  | 20 (30) |
| ANTIBIOTICS | BETA-LACTAMASE | 12 (60) |  |  |  |
|  | FLUROQUINOLONE | 2 (10) |  |  |  |
|  | TETRACYCLINE | 1 (5) |  |  |  |
|  | AMINOGLYCOSIDES | 1 (5) |  |  |  |
|  | NITROFURANTOIN | 1 (5) |  |  |  |
|  | N/A | 3 (15) |  |  |  |

Example 10: Gut Fingerprint Associated with Cancer (with or without ATB)

Materials

292 Healthy Controls

Cancer Patients:

Breast cancer: batch 1 described in Table 9 and batch 2 described in Table 19.

Lung cancer: batch 1 described in Table 3 and batch 2 described in Table 20.

Kidney cancer: batch 1 described in Table 4 and batch 2 described in Table 21.

30 samples come from patients treated using antibiotics (AB).

3: Augmentin (beta-lactamine+penicilline),

1: Ofloxacine (fluoroquinolone)

1: Ceftriaxone (beta-lactamine)

25: NA

With only partial information from the AB prescribed, the AB samples were treated as a whole.

2 analyses were performed:

all samples paired samples+/−AB (12 Lung+5 Kidney paired samples)

AB treated samples have a tendency of lower richness (not significant).

TABLE 19

Breast cancer patient characteristics included in the second batch.

| CHARACTERISTICS-BREAST CANCER | N = 30 |
|---|---|
| MEDIAN AGE-YR | 60 (38-75) |
| HISTOLOGY -NO. (%) |  |
| DUCTAL CARCINOMA | 29 (97) |
| LOBULAR CARCINOMA | 1 (3) |
| ELLIS-ELSTON |  |
| 1 | 5 (17) |
| 2 | 11 (37) |
| 3 | 13 (43) |
| N/A | 1 (3) |
| CLINICAL STAGE T-NO. (%) |  |
| 1 | 13 (43) |
| 2 | 10 (33) |
| 3 | 7 (21) |
| CLINICAL STAGE N-NO. (%) |  |
| 0 | 17 ( ) |
| 1 | 10 ( ) |
| 2 | 2 (7) |
| 3 | 1 (3) |
| CLINICAL STAGE-NO-(%) |  |
| 1 | 14 (47) |
| 2 | 10 (33) |
| 3 | 6 (20) |

TABLE 19-continued

Breast cancer patient characteristics included in the second batch.

| CHARACTERISTICS-BREAST CANCER | N = 30 |
|---|---|
| HORMONAL RECEPTOR-NO. (%) | |
| LUMINAL NON HER2 | 11 (37) |
| LUMINAL HER2 | 5 (17) |
| NON LUMINAL HER2 | 5 (17) |
| TRIPLE NEGATIVE | 9 (30) |

TABLE 20

Lung cancer patient characteristics included in batch 2.

| CHARACTERISTICS -NSCLC | | TOTAL (N = 38) |
|---|---|---|
| AGE-YR | MEDIAN | 62 |
| | RANGE | 32-77 |
| GENDER- NO. (%) | MALE | 21 (55) |
| | FEMALE | 17 (45) |
| HISTOLOGY- | SQUAMOUS | 10 (26) |
| NO. (%) | NON-SQUAMOUS | 28 (74) |
| ECOG-NO. (%) | 0-1 | 30 (79) |
| | ≥2 | 8 (21) |
| MUTATION - | EGFR POSITIVE | 3 (7) |
| NO. (%) | KRAS POSITIVE | 2 (5) |
| | ALK POSITIVE | 1 (2) |
| SMOKING - NO. (%) | CURRENT | 12 (32) |
| | FORMER | 24 (63) |
| | NEVER | 2 (5) |

TABLE 21

Metastatic renal cell carcinoma patient characteristics included in batch 2.

| CHARACTERISTICS -mRCC | | TOTAL (N = 25) |
|---|---|---|
| AGE-YR | MEDIAN | 63 |
| | MEDIAN | 50-75 |
| GENDER- NO. (%) | MALE | 20 (80) |
| | FEMALE | 5 (20) |
| HISTOLOGY- | CLEAR CELL | 25 (100) |
| NO. (%) | NON - CLEAR CELL | — |
| ECOG - NO. (%) | 0-1 | 23 (92) |
| | ≥2 | — |
| | NA | 2 (3) |
| IMDC - NO. (%) | GOOD | 8 (32) |
| | INTERMEDIATE | 13 (52) |
| | POOR | 2 (8) |
| | NA | 2 (8) |

Results

Eighteen metagenomic species (MGS) were found contrasted with the 2 batches in at least 2 cancer cohorts. Of these, fifteen were in the list of the 27 species initially identified (FIGS. 6 and 7).

Eleven metagenomic species are maintained if we take out the ATB-treated patients.

We hence propose a gut fingerprint of cancer patients validated in 2 batches with or without (*) ATB, which comprises 19 MGS.

8 MGS Underexpressed in Cancer Versus Healthy Volunteers:
*Faecalibacterium* CAG297 *
*Blautia* CAG179
*Roseburia* CAG55 *
*Haemophila parainfluenzae* CAG1056
*Clostridiales* CAG1132
*Bifidobacterium adolescentis* (CAG702)
*Firmicutes* CAG1308 *
*Firmicutes bacterium* CAG713 *

11 MGS Overexpressed in Cancer Versus HV:
*Bifidobacterium dentium* (CAG456) *
*Enterococcus faecalis* (CAG257)
*Subdoligranulum* CAG140 *
*Lachnospiricaeae bacterium* CAG14
*Clostridium innocuum* CAG36
*Ruminococcus torques* 1 (CAG243) *
*Hungatella hathewayi* 1 CAG25 *
2 *E. coli* (CAG 11*et 371*)
*Clostridiales* CAG533 *
*Tyzzerella nexilis* CAG311

18 of them are contrasted in 2 (out of 3) cancer cohorts at least (FIG. 22, data not shown).

If one considers only those patients who did not take antibiotics (no ATB), there are only 11 MGS contrasted in at least 2 (out of 3) cancer cohorts (FIG. 23).

The direct effects of ATB on the cancer cohorts are apparent upon MGS analysis: 9 MGS are enriched post-ATB, while 6 are eliminated. ATB tend to enrich in deleterious bacteria blunting the efficacy of PD1 blockade or other immunogenic chemotherapy such as *Bacteroides uniformis, Bacteroides cellulosilyticus, Coprobacter fastidiosus, Lachnospiraceae bacterium*. Moreover, ATB tend to deplete the host flora from important protective anticancer bacteria such as *Roseburia* CAG100, *Blautia* CAG01214, *Eubacterium* CAG38 and CAG115.

Example 11: Gut Fingerprint Predicting Clinical Benefit with Antibodies Blocking the Anti-PD1/PD-L1-PD-L2 Axis The same experiments as disclosed in Example 4 above were conducted on a pool of patients suffering from kidney or lung cancer (N=100 patients).

The results confirm the favorable role of several species, such as:

1. Signature at diagnosis: favorable and dominant role of *Akkermansia muciniphila, Ruminococcaceae* (CAG 210 *bicirculans*, CAG854, *torques* 2 CAG1262, 250, *bacterium* D16 CAG949)

2. Signature at diagnosis: favorable role of *Intestinimonas butyriciproducens, Oscillibacter, Collinsella* spp. (tanakaei and intestinihominis) (data not shown+table 27)

3. Signature at diagnosis: deleterious roles of *Bifidobacteria adolescentis, longum*, as well as *Parabacteroides distasonis* and *goldsteinii, Bilophila wadsworthia, Erysipelotricaceae, Bacteroides uniformis*.

Example 12: Gut Fingerprint Associated with Response to PD1 Blockade in Lung Cancers (with or without ATB)

A gut fingerprint specific for end stage lung carcinoma associated with responses or resistance to anti-PD1 Ab was identified for time to progression at 3 months.

TABLE 22 bacterial species over-represented in lung cancer patients likely to be good
responders at 3 months to anti-PD1 or PD-L1 or anti-PD-L2 antibodies and under-
represented in lung cancer patients likely to be resistant at 3 months to anti-
PD1 or PD-L1 or anti-PD-L2 antibodies, as well as corresponding referenced species
(for already identified species) and sequences comprised therein.

| Bacterial species | Number of co-variant genes | Corresponding referenced species | Annotation | Sequences (SEQ ID Nos) |
|---|---|---|---|---|
| CAG00363 | 2056 | *Intestinimonas butyriciproducens* | *Intestinimonas butyriciproducens* (closely related to *Flavonifractor plautii*) | 176-200 |
| CAG00134 | 2690 | *Cloacibacillus porcorum* | | 1351-1375 |
| CAG00278 | 2203 | *Roseburia* sp. CAG: 380 | | 1526-1550 |
| CAG00469 | 1928 | *Eubacterium* sp. CAG: 146 *Eubacterium* sp. 3_1_31 | *Eubacterium* Erysipelotrichaceae bacterium 5_2_54FAA | 301-325 |
| CAG00676 | 1643 | Firmicutes bacterium CAG: 176 | Firmicutes | 1976-2000 |
| CAG01188 | 880 | Firmicutes bacterium CAG: 321 | | 2651-2675 |
| CAG01090 | 1026 | Firmicutes bacterium CAG: 110 | Firmicutes | 776-800 |
| CAG0994 | 1171 | Firmicutes bacterium CAG: 124 | Firmicutes | 2401-2425 |
| CAG1205 | 855 | *Phascolarctobacterium succintulens* | | 2676-2700 |
| CAG1220 | 823 | *Phascolarctobacterium succintulens* | | 2726-2750 |
| CAG1399 | 524 | *Oscillibacter* sp. CAG: 155 | Clostridiales, Oscillospiricaeae | 2901-2925 |
| CAG1086 | 1037 | Firmicutes bacterium CAG: 124 | Firmicutes | 2526-2550 |
| CAG01245 | 780 | Firmicutes | Firmicutes | 826-850 |
| CAG1011 | 1140 | Uncultured Dore asp. | Clostridiales | 2426-2450 |
| CAG00064 | 3310 | | NA | 1-25 |
| | 3561 | *Bacteroides caccae* | Bacteroidales | |
| CAG00112 | 3092 | *Blautia* sp CAG: 52 | | 1301-1325 |
| CAG1386 | 546 | *Blautia* sp. KLE 1732 | | 2876-2900 |
| CAG00453 | 1942 | | NA | 1751-1775 |
| CAG00674 | 1643 | Dore asp. CAG: 317 | | 1951-1975 |
| CAG00328 | 2113 | *Alistipes indistinctus* | *Alistipes* | 1601-1625 |
| CAG00646 | 1668 | *Alistipes* sp. CAG: 268 | *Alistipes* | 501-525 |
| CAG00301 | 3187 | *Akkermansia muciniphila* CAG: 154 | *Akkermansia muciniphila* | 101-125 |
| CAG00731 | 1576 | Proteobacteria bacterium CAG: 139 | *Parasutterella* | 2051-2075 |
| CAG0903 | 2783 | *Desulfovibrio piger* | | 2276-2300 |
| CAG00250 | 2262 | *Ruminococcus* sp. CAG: 353 | Ruminococcaceae | 1476-1500 |
| CAG001342 | 613 | *Ruminococcus bacterium* LM158 | Ruminococcaceae | 2851-2875 |
| CAG01262 | 750 | *Ruminococcus torques* 2 | Ruminococcaceae | 2826-2850 |

TABLE 23 bacterial species over-represented in lung cancer patients likely to be resistant
at 3 months to anti-PD1 or PD-L1 or anti-PD-L2 antibodies and under-represented
in lung cancer patients likely to be good responders at 3 months to anti-PD1
or PD-L1 or anti-PD-L2 antibodies, as well as corresponding referenced species
(for already identified species) and sequences comprised therein.

| Bacterial species | Number of co-variant genes | Corresponding referenced species | Annotation | Sequences (SEQ ID Nos) |
|---|---|---|---|---|
| CAG 00048_1 | 1403 | Clostridiales | | 1151-1175 |
| CAG00211 | 2389 | Firmicutes bacterium CAG: 227 | Firmicutes | 1451-1475 |
| CAG01629 | 505 | Firmicutes bacterium CAG: 466 | Firmicutes | |

TABLE 23-continued bacterial species over-represented in lung cancer patients likely to be resistant at 3 months to anti-PD1 or PD-L1 or anti-PD-L2 antibodies and under-represented in lung cancer patients likely to be good responders at 3 months to anti-PD1 or PD-L1 or anti-PD-L2 antibodies, as well as corresponding referenced species (for already identified species) and sequences comprised therein.

| Bacterial species | Number of co-variant genes | Corresponding referenced species | Annotation | Sequences (SEQ ID Nos) |
|---|---|---|---|---|
| CAG01018 | 1135 | *Bilophila wadsworthia* | unclassified *Bilophila* | 1076-1100 |
| CAG00702 | 1609 | *Bifidobacterium adolescentis* L2-32 | *Bifidobacterium adolescentis* | 951-975 |
| CAG00549 | 1788 | *Bifidobacterium longum* | Bifidobacteria | 1901-1925 |
| CAG430 | 1970 | *Lactobacillus salivarius* | | 1726-1750 |
| CAG00389 | 2021 | *Fusobacterium* sp. CAG: 439 | | 1701-1725 |
| CAG00981 | 1189 | Erysipelotrichaceae | Erysipelotrichaeae | 2376-2400 |
| CAG00005_4 | 503 | Clostridiales | Clostridiales | 1101-1125 |

Hence, in addition to the MGS searched for generally determining if the patient is likely to respond to a treatment with anti-PD1 or PD-L1 or anti-PD-L2 antibodies, the relative abundance of following MGS can be measured in a lung cancer patient:

Additional bacterial species over-represented in lung cancer patients likely to be good responders at 3 months to anti-PD1 or PD-L1 or anti-PD-L2 antibodies: CAG00278, CAG00676 (*Firmicutes*), CAG01188, CAG0994 (*Firmicutes*), CAG1205, CAG1220, CAG1399 (*Clostridiales, Oscillospiricaeae*), CAG00112, CAG1386, CAG00674, CAG00328 (*Alistipes*), CAG00731 (*Parasutterella*), CAG0903, CAG001342 (*Ruminococcaceae*), CAG01262 (*Ruminococcaceae*).

Additional bacterial species over-represented in lung cancer patients likely to be resistant at 3 months to anti-PD1 or PD-L1 or anti-PD-L2 antibodies: CAG01629 (*Firmicutes*), CAG430, CAG00389, CAG00005_4 (*Clostridiales*).

Example 13: Gut Fingerprint Associated with Response to PD1 Blockade in Kidney Cancers (with or without ATB)

In addition to MGS outlined in Tables 1 and 2, common to lung and kidney cancers, there are some additional MGS that could participate to early relapse or response to PD1-blockade in kidney cancer patients (tables 24-25).

TABLE 24 bacterial species over-represented in kidney cancer patients likely to be responders at 3 months of PD1 blockade (the first two bacteria *Clostridium* spp. being reproducibly found in 2 independent cohorts of advanced kidney cancers proned to respond to PD1 blockade in second line)

| Bacterial species | Number of co-variant genes | Corresponding referenced species | Sequences (SEQ ID Nos) |
|---|---|---|---|
| CAG452 | 1942 | *Clostridium* sp CAG167 | |
| CAG00317 | 2130 | *Clostridium* sp CAG 230 | |
| CAG00062 | 3614 | *Bacteroides salyersiae* | |
| CAG 00510 | 1860 | *Alistipes timonensis* | |
| CAG00816 | 1464 | *Candidatus stoquefichus massilensis* | |
| CAG00215 | 2381 | *Anaerotruncus* | |
| CAG001401 | 522 | Lachnospiracaeae | |
| CAG00774 | 1519 | Firmicutes | 2076-2100 |

TABLE 25 bacterial species over-represented in kidney cancer patients likely to be progressors (poor responders) at 3 months of PD1 blockade.

| Bacterial species | Number of co-variant genes | Corresponding referenced species | Sequences (SEQ ID Nos) |
|---|---|---|---|
| CAG00481 | 1908 | *Blautia* sp. CAG: 237 | |
| CAG00541 | 1799 | *Dorea* sp CAG: 105 | |
| CAG00448 | 1945 | *Clostridium* sp. CAG: 122 | |
| CAG 00650 | 1667 | *Dorea formicigenerans* | |
| CAG01141 | 964 | *Holdemania biformis* | |
| CAG00719 | 1591 | *Ruminococcus* | |
| CAG01208 | 844 | *Coprococcus catus* | 3226-3250 |
| CAG00079 | 3078 | *Clostridium* sp. CAG: 7 | |
| CAG00722 | 1587 | *Acidaminococcus fermentans* | |
| CAG00943 | 1236 | Firmicutes bacterium CAG: 212 | |
| CAG1004 | 1161 | *Prevotella copri* | |
| CAG01039 | 1098 | *Faecalibacterium prausnitzii* | |
| CAG00903 | 1305 | *Desulfovibrio piger* | 2276-2300 |
| CAG01399 | 524 | *Oscillibacter* sp. CAG: 155 | 2901-2925 |

Example 14: Gut Fingerprint Associated with Response to PD1 Blockade in a Validation Cohort of Non-Small Cell Lung Cancer and Kidney Cancers (without ATB)

Table 26 below shows the clinical data relative to the validation cohorts. Bacteria present in this validation cohort (group without ATB) are listed in Table 27.

TABLE 26 baseline characteristics of the validation cohorts

| NSCLC | n = 27 | RCC | n = 26 |
|---|---|---|---|
| Histology | | Histology | |
| Adenocarcinoma no. (%) | 17 (63) | Clear cell no. (%) | 25 (96) |
| | | Non clear cell no. (%) | 1 (4) |
| Squamous no. (%) | 7 (26) | | |
| Undifferentiated no. (%) | 3 (11) | | |
| Smoking Status | | IMDC | |
| Former no. (%) | 19 (70) | Good no. (%) | 5 (19) |
| Current no. (%) | 6 (22) | Intermediate no. (%) | 17 (65) |
| Non-smoker no. (%) | 2 (7) | Poor no. (%) | 4 (15) |
| Outcome | | Outcome | |
| Partial Response no. (%) | 4 (15) | Complete response no. (%) | 1 (4) |
| Stable Disease no. (%) | 5 (19) | | |
| Progression/ Death no. (%) | 18 (67) | Partial Response no (%) | 7 (27) |
| | | Stable disease no. (%) | 12 (46) |
| | | Progression/ Death no. (%) | 6 (23) |

TABLE 27 bacterial species over-represented in non-small cell lung cancer and kidney cancer patients with the best clinical outcome based on the RECIST criteria: PR > SD > PD assessed by MG and analyzed by Cochran-Armitage test.

| Bacterial species | Number of co-variant genes | Corresponding referenced species |
|---|---|---|
| CAG00301 | 3187 | *Akkermansia muciniphila* |
| CAG00487 | 2806 | *Prevotella* sp. CAG: 279 |
| CAG00417 | 1981 | *Megamonas funiformis* |
| CAG01551 | 508 | *Oscillibacter* |
| CAG01018 | 1135 | *Bilophila wadsworthia* |
| CAG00534 | 2650 | *Prevotella* sp. CAG: 386 |
| CAG00472 | 1921 | *Azospirillum* |
| CAG00591 | 1728 | *Collinsella tanakaei* |
| CAG01066 | 1068 | *Succinatimonas hippei* |
| CAG00986 | 1179 | *Collinsella intestinalis* |
| CAG00048_1 | 1403 | *Clostridiales* |
| CAG01075 | 1052 | *Clostridiales* |

Example 15: GS and MGS Diversity at Diagnosis Dictates Response to PD1 Blockade at 6 Months in Kidney+Lung Cancers (with or without ATB)

Another index to predict patients proned to respond at 6 months of therapy with anti-PD1 Ab is to analyze the diversity index for gene counts (GC) and metagenomic species (MGS) (FIG. 24).
When GS >6×106 or MGS>250, cancer patients will be proned to respond.

Example 16: Dynamic Parameters Based on MGS to Predict Long Term Responses to PD1 Blockade at 6 Months in Kidney+Lung Cancers (with or without ATB)

All the parameters stated above pertained to values calculated at baseline, at diagnosis, prior to initiation of therapy.
Here we outlined some MGS for which significant changes over the course of therapy will indicate the propensity of a patient to respond or relapse.
No significant changes appear significant between V1 (prior to therapy) and V2 (after 2 injections of mAb, 15 days apart).

Modifications observed at V3 (time of the first computerized tomography scan) are the most critical ones to predict clinical benefit (MGS data not shown). Modifications associated with a clinical benefit are:
(i) A Loss of:
*Bacteroides xylanosolvens* CAG945
*Bacteroides uniformis* CAG159 (common in 2 cancers)
*Bacteroides ovatus* CAG1165
*Prevotella* CAG:255, CAG163
*Ruminococcus bromii* CAG611
*Roseburia intestinalis* CAG291
*Eubacterium* CAG:38, CAG 629 and
(ii) A Gain of:
*Ruminococcaceae* CAG1003
*Flavonifractor plautii* CAG 439
*Firmicutes bacterium* CAG: 124, CAG 629.

Example 17: Efficacy of Oncobax Across Several Tumor Models and Histological Types in Preclinical Models The following bacterial strains were used:
*Enterococcus hirae*: strain deposited on Nov. 7, 2013 at the Collection Nationale de Cultures de Microorganismes (CNCM), under the number 1-4815
*Akkermansia muciniphila*: strain deposited at the Collection de souches de l'Unité des Rickettsies (CSUR) under the reference CSUR P2261
*Alistipes indistinctus*: strain deposited at the Collection de souches de l'Unité des Rickettsies (CSUR) under the reference CSUR P723.

*Akkermansia muciniphila* was grown on 5% sheep blood enriched Columbia agar (bioMerieux, Marcy l'Etoile, France) in an anaerobic atmosphere created using 3 anaerobic generators (bioMerieux) at 37° C. for 72 hrs. *Alistipes indistinctus*, was also grown on 5% sheep blood enriched Columbia agar (bioMerieux, Marcy l'Etoile, France) in an anaerobic atmosphere created using a single anaerobic generator at 37° C. for 48 hrs. *Enterococcus hirae* was grown on 5% sheep blood enriched Columbia agar (bioMerieux, Marcy l'Etoile, France) in an aerobic atmosphere at 37° C. for 48 hrs.

For bacteria gavage: Suspensions of 109 cfu/mL were obtained using a fluorescence spectrophotometer (Eppendorf) at a wave length of 600 nm in PBS. Then mice orally received 100 µL of each bacterial suspension.
A. Model MCA205 sarcoma: the oncobax capable of compensating a dysbiosis (FIG. 25-26) are *Enterococcus. hirae*, *Akkermansia muciniphila* alone or admixed together simultaneously or sequentially, as well as *Alistipes* indistinctus. *Akkermansia muciniphila+Enterococcus hirae* and *Alistipes indistinctus* augmented effector and central memory CD8+ T cells in the tumor microenvironment (tumor draining lymph node at day 12 at sacrifice) (FIG. 27).
B. Model RET melanoma: As shown in FIG. 28-29, the combination of *Enterococcus hirae+Akkermansia. muciniphila* is very efficient in this model.
C. Model Lewis Lung orthotopic carcinoma: FIG. 30-31. This model shows that i) our conclusions hold true in the context of PD1 blockade in conjunction with radiotherapy, ii) in the absence of a dysbiosis, oncobax can still ameliorate the antitumor effects of the combination of ICB.
D. RENCA-luciferase tumor model where the combination of ICB is anti-CTLA4+anti-PD1 Ab: FMT was performed with feces from 2 dysbiotic patients. No *Akkermansia muciniphila/Ruminococcus bacterium* D16 CAG949 were detectable in the stool composition in metagenomics. The FMT did not promote the efficacy of the combined ICB therapy (FIG. 32-33).

We conclude that administration of anticancer probiotics, or "oncobax", can improve the efficacy of anti-PD1 or anti-PDL1 or anti-PDL2 Abs in dysbiotic patients, dysbiosis being based on a MG analysis focusing on *Akkermansia muciniphila*, distinct CAG of *Ruminococcus*, *Alistipes*, *Eubacterium*, *Intestinihominas butyriciproducens*, *Bifidobacteria* (*adolescentis*, *longum*), and *Bacteroides* (*nordii*, *goldsteinii*), *Bilophila wadsworthia*.

Importantly, these anticancer probiotics also potentially improve the response in eubiotic patients and they boost the efficacy of not only anti-PD1 Ab alone, but also combined with anti-CTLA4 Ab or radiotherapy.

Example 18: Blood Marker Associated with Bioactivity of «Favorable Feces Composition or Eubiosis» During PD-1 Blockade One of the best surrogate markers of efficacy or bioactivity of oncobax or FMT of a favorable stool (good MG composition) is the upregulation of PD-L1 expression on CD4+ or CD8+ circulating (or splenic) T cells (FIG. 34-37) or the upregulation of CCR9 on circulating T cells.

Example 19: FMT with Feces from a Responder Patient can Compensate a Dysbiosis in a Non-Responder Patient and Restore the Responsiveness to Immune Checkpoint Inhibitors In an orthotopic kidney cancer model (RENCA), we have shown that FMT from a dysbiotic non-responding RCC cancer patient (escaping from PD1 blockade) was able to abolish anti-PD1 efficacy in avatar mice. Oral gavage with feces from a responding RCC patient (who received anti-PD1 or PD-L1 Ab and exhibited a clinical response according to RECIST criteria) was able to rescue the antitumoral efficacy of anti-PD1 lost in a dysbiotic avatar recipient. Hence, it is conceivable to treat a dysbiotic NSCLC/RCC or breast cancer patient with a FMT from a responder patient (feces at diagnosis or after 6 months of therapy), as an alternative to FMT from normal volunteers (FIG. 38).

Example 20: FMT with Feces from a Healthy Volunteer can Compensate a Dysbiosis in a Non-Responder Patient and Restore the Response to Metronomic Cyclophosphamide (CTX)

Using a murine breast tumor model (AT3), we have shown that FMT from a dysbiotic breast cancer patient (non-responding to chemotherapy, triple negative, Ki67 high, who had a reduced alpha and beta diversity in MG analyses) reduced CTX efficacy in avatar AT3 bearing mice (FIG. 39). Compensation with feces from a healthy volunteer HV (either by oral gavage or cohousing) compensates for the loss of efficacy of CTX by restoring some kind of eubiosis (HV derived microflora).

Example 21: Dysbiosis from Patients with Distinct Cancers can be Compensated with Defined Strains and Bacterial Consortia In an orthotopic kidney cancer model (RENCA), we have shown that FMT from a dysbiotic non-responding RCC cancer patient (escaping from PD1 blockade) was able to abolish anti-PD1 efficacy in avatar mice. Oral gavage with *Akkermansia muciniphila*, *Bacteroides* salyersiae or *Akkermansia muciniphila* and *Enterococcus hirae* was able to rescue the antitumoral efficacy of anti-PD1.

In parallel, in a different tumor model, a sarcoma in avatar mice, (as depicted in FIG. 40 to 43), we were able to ameliorate anti-PD1 efficacy that was compromised in FMT-treated mice bearing MCA205 sarcoma injected with anti-PD1 alone. Indeed, oral gavage with *Akkermansia muciniphila*, *Bacteroides* salyersiae or *Akkermansia muciniphila* and *Enterococcus hirae* was able to rescue the antitumoral efficacy of anti-PD1. Moreover, a combination of *Enterococcus hirae* (clones 13144=CNCM I-4815, IGR7=CNCM I-5224 and IGR4=CNCM I-5260) and *Barnesiella intestinihominis* or a combination of *Enterococcus hirae* (clones IGR7, IGR4, 13144) and *Christensenella minuta* or a combination of *Enterococcus hirae* (clones IGR7, IGR4, 13144) and *Actinobaculum schaalii* or a combination of *Enterococcus hirae* (clones IGR7, IGR4, 13144) and *Akkermansia muciniphila* (p2261 and p3415) and *Eubacterium limosum* was efficient in doing so as well.

These consortia of commensals depicted here can be effective in the context of any tumor type amenable to a PD1 blockade, most specifically NSCLC, RCC and breast cancers.

Example 22: *Barnesiella intestinihominis* is Associated with Anti-PD1 Efficacy By performing metagenomic analysis of the stools of MCA205 tumor-bearing mice treated with anti-PD1 versus isotype control Ab, we were able to demonstrate the presence of *Barnesiella intestinihominis* in mice treated with anti-PD1 correlating with the treatment efficacy (FIG. 44). Indeed, oral gavages with *Barnesiella intestinihominis* are able to ameliorate anti-PD1 efficacy alone or combined with anti-CTLA4 Ab (FIG. 43).

We conclude that compensation with oncobax *Barnesiella intestinihominis* (strains derived from patients or mice) alone or in consortia comprising *Enterococcus hirae* isolates+/−*Akkermansia muciniphila* can restore efficacy to PD1 blockade or PD1/CTLA4 coblockade in kidney or lung cancer patients or any cancer patient amenable to a treatment with immune checkpoint inhibitors, specifically in those patients who received antibiotics or those patients diagnosed with a gut dysbiosis.

Example 23: Protecting Oncobax Decrease the Toxicity of Anti-PID1 Treatment (Autoimmune Disorders Generated with the Combo Anti-CTLA4+Anti PD1 Ab)

In the same tumor model as that used in Example 21, the inventors demonstrated that it is possible to uncouple the efficacy and toxicity of immune checkpoint blockers. Indeed, as illustrated in FIG. 45, the transfer of feces from responders reduced the toxicity obtained with feces from non responders. FMT compensated with oncobax reduced colitis scores.

Example 24: Immune Checkpoint Blockers Induce Significant Changes in the Intestinal Microbiome Composition that Participate to Treatment Efficacy (Reduction of Tumor Size)

We have performed a serial analyses of microbiome changes over time in two different mouse tumor models (MCA205 sarcoma and RET melanoma) located in the skin by analyzing the significant modulation of bacterial composition using 16S rRNA sequencing of gene amplicons of mice stools, in 6 mice/group, prior to, after 2 and 5 injections of anti-PD1 Ab alone or combined to anti-CTLA4 Abs (FIG. 46). Principle component analyses of the beta diversity show significant differences overtime, meaning that the combination of ICB induce shifts in the microbiome composition that are significantly correlated with tumor sizes (FIG. 47, FIG. 48).

The 78 bacterial species found in common in both tumor models in responders (but not in non responders) belong to SCFA producing bacteria (health-related bacteria such as *Clostridiaceae, Blautia, Faecalibacterium prausnitzii*) (FIG. 49). We confirm the dominance of certain members of the *Bacteroidetes* genus (*Bacteroides* finegoldii, *Bacteroides* Intestinalis, *Bacteroides mediterraneensis*), as well as *Alistipes onderdonkii, Bifidobacteria* and *Eubacterium* found in the human lung/kidney cancer patients responding to PD1 blockade. Based on other data from a previous patent application EP 17306509.5 (colon cancer and oxaliplatin, where *Erysipelotrichaceae Erysipelatoclostridium ramosum* were found immunogenic), we extrapolate the potential beneficial role of *Dielma fastidiosa* (*Firmicutes/Erysipelotrichia*) in the efficacy of immune checkpoint blockers (ICB) (FIG. 49).

Interestingly, common bacteria shared in responders to the combination of anti-PD1+anti-CTLA4 comprise *Akkermansia muciniphila, Alistipes indistinctus*, several *Bacteroides* spp., *Barnesiella intestinihominis, Erysipelatoclostridium ramosum* and *Flavonifractor plautii*, all found in humans (NSCLC/Kidney cancer) responding to PD1 blockade and in our list of immunogenic probiotics "oncobax" (FIG. 50). The association of these bacteria provides an ecosystem associated with clinical response to combination of ICB.

REFERENCES

Arrieta, M.-C., Stiemsma, L. T., Dimitriu, P. A., Thorson, L., Russell, S., Yurist-Doutsch, S., Kuzeljevic, B., Gold, M. J., Britton, H. M., Lefebvre, D. L., et al. (2015). Early infancy microbial and metabolic alterations affect risk of childhood asthma. Sci. Transl. Med. 7, 307ra152.

Berman, D., Parker, S. M., Siegel, J., Chasalow, S. D., Weber, J., Galbraith, S., Targan, S. R., and Wang, H. L. (2010). Blockade of cytotoxic T-lymphocyte antigen-4 by ipilimumab results in dysregulation of gastrointestinal immunity in patients with advanced melanoma. Cancer Immun. 10, 11.

Blaser, M. J. (2016). Antibiotic use and its consequences for the normal microbiome. Science 352, 544-545.

Champiat, S., Lambotte, O., Barreau, E., Belkhir, R., Berdelou, A., Carbonnel, F., Cauquil, C., Chanson, P., Collins, M., Durrbach, A., et al. (2016). Management of immune checkpoint blockade dysimmune toxicities: a collaborative position paper. Ann. Oncol. Off. J. Eur. Soc. Med. Oncol. 27, 559-574.

Clarke, J., Wu, H.-C., Jayasinghe, L., Patel, A., Reid, S., and Bayley, H. (2009). Continuous base identification for single-molecule nanopore DNA sequencing. Nat. Nanotechnol. 4, 265-270.

Eid, J., Fehr, A., Gray, J., Luong, K., Lyle, J., Otto, G., Peluso, P., Rank, D., Baybayan, P., Bettman, B., et al. (2009). Real-time DNA sequencing from single polymerase molecules. Science 323, 133-138.

Fidler, M. M., Soerjomataram, I., and Bray, F. (2016). A global view on cancer incidence and national levels of the human development index. Int. J. Cancer 139, 2436-2446.

Garon, E. B. (2015). Current Perspectives in Immunotherapy for Non-Small Cell Lung Cancer. Semin. Oncol. 42 Supp/2, S11-18.

Gensollen, T., Iyer, S. S., Kasper, D. L., and Blumberg, R. S. (2016). How colonization by microbiota in early life shapes the immune system. Science 352, 539-544.

Goodrich, J. K., Davenport, E. R., Waters, J. L., Clark, A. G., and Ley, R. E. (2016). Cross-species comparisons of host genetic associations with the microbiome. Science 352, 532-535.

Hugon, P., Lagier, J.-C., Colson, P., Bittar, F., and Raoult, D. (2016). Repertoire of human gut microbes. Microb. Pathog.

Li, J., Jia, H., Cai, X., Zhong, H., Feng, Q., Sunagawa, S., Arumugam, M., Kultima, J. R., Prifti, E., Nielsen, T., et al. (2014). An integrated catalog of reference genes in the human gut microbiome. Nat. Biotechnol. 32, 834-841.

Nielsen, H. B., Almeida, M., Juncker, A. S., Rasmussen, S., Li, J., Sunagawa, S., Plichta, D. R., Gautier, L., Pedersen, A. G., Le Chatelier, E., et al. (2014). Identification and assembly of genomes and genetic elements in complex metagenomic samples without using reference genomes. Nat. Biotechnol. 32, 822-828.

Pigneur, B., and Sokol, H. (2016). Fecal microbiota transplantation in inflammatory bowel disease: the quest for the holy grail. Mucosal Immunol. 9, 1360-1365.

Pitt, J. M., Vetizou, M., Daillere, R., Roberti, M. P., Yamazaki, T., Routy, B., Lepage, P., Boneca, I. G., Chamaillard, M., Kroemer, G., et al. (2016). Resistance Mechanisms to Immune-Checkpoint Blockade in Cancer: Tumor-Intrinsic and -Extrinsic Factors. Immunity 44, 1255-1269.

Plovier, H., Everard, A., Druart, C., Depommier, C., Van Hul, M., Geurts, L., Chilloux, J., Ottman, N., Duparc, T., Lichtenstein, L., et al. (2016). A purified membrane protein from *Akkermansia muciniphila* or the pasteurized bacterium improves metabolism in obese and diabetic mice. Nat. Med.

Raoult, D. (2016). Microbiota, obesity and malnutrition. Microb. Pathog.

Rizvi, N. A., Mazieres, J., Planchard, D., Stinchcombe, T. E., Dy, G. K., Antonia, S. J., Horn, L., Lena, H., Minenza, E., Mennecier, B., et al. (2015). Activity and safety of nivolumab, an anti-PD-1 immune checkpoint inhibitor, for patients with advanced, refractory squamous non-small-cell lung cancer (CheckMate 063): a phase 2, single-arm trial. Lancet Oncol. 16, 257-265.

Rooks, M. G., and Garrett, W. S. (2016). Gut microbiota, metabolites and host immunity. Nat. Rev. Immunol. 16, 341-352.

Shono, Y., Docampo, M. D., Peled, J. U., Perobelli, S. M., Velardi, E., Tsai, J. J., Slingerland, A. E., Smith, O. M., Young, L. F., Gupta, J., et al. (2016). Increased GVHD-related mortality with broad-spectrum antibiotic use after allogeneic hematopoietic stem cell transplantation in human patients and mice. Sci. Transl. Med. 8, 339ra71.

Sivan, A., Corrales, L., Hubert, N., Williams, J. B., Aquino-Michaels, K., Earley, Z. M., Benyamin, F. W., Lei, Y. M., Jabri, B., Alegre, M.-L., et al. (2015). Commensal *Bifidobacterium* promotes antitumor immunity and facilitates anti-PD-L1 efficacy. Science 350, 1084-1089.

Taur, Y., Jenq, R. R., Ubeda, C., van den Brink, M., and Pamer, E. G. (2015). Role of intestinal microbiota in transplantation outcomes. Best Pract. Res. Clin. Haematol. 28, 155-161.

Vetizou, M., Pitt, J. M., Daillere, R., Lepage, P., Waldschmitt, N., Flament, C., Rusakiewicz, S., Routy, B., Roberti, M. P., Duong, C. P. M., et al. (2015). Anticancer immunotherapy by CTLA-4 blockade relies on the gut microbiota. Science 350, 1079-1084.

Viaud, S., Saccheri, F., Mignot, G., Yamazaki, T., Daillere, R., Hannani, D., Enot, D. P., Pfirschke, C., Engblom, C., Pittet, M. J., et al. (2013). The intestinal microbiota modulates the anticancer immune effects of cyclophosphamide. Science 342, 971-976.

SEQUENCE LISTING (3300 sequences)

SEQ ID NO: 1 - DNA, 1668 bp, Unknown
  Description of Unknown: sequence from a bacterial species not precisely identified
atgtatattataaaattcggttctgcttccagctactgttccgtgatccttgaatatggagaaaacacgacctcaatgagtgataaaattaaagttctggctgttgatgacgctcccgccaacctgatgatcctgaaaggatgtctgcgcggcggaaattttgaactggtaacctgcaccaatgcaattgatgcccttcaggaattcaaaaagcagtatttcgatattctccttctggacgtgatcatgccgggaatcgacggctttgagctgcggaagctgatccgggaagtcgataaggagcgtccgatcatttttctgaccgccatgatcgacgacggcaacatgaccatgctcaaccagattacatgggattccaacacctattacctgaataaagtcttcgataaaaaggttctggtgcagaaaatcacggaagtcgtgaacatgcaccggacacgccagcttgacagggtctaccgcgacaatctggaatcggaactgaaactcgccggagaccttcagcggattctgctgccggactggtgcattctggacgacaaggttctggtttcttccctctatgttcccgcgatgcaggtttcgggagatattttcgaattgatcaggctggatgaatcacggtatctgttttttatcggcgacatcgccggacacggcatttccgccgcactctatatggcgacggttcaggcgattctcaaaatcaaggcgcatgagcagaatttcactgtccacggactgcttgccgacctgaacagatttttctgtgatgaactgcgcgggaatacttatatgaccgcactcgcggttctttttgatttcaaatccaatcatctggtcctgcactccgccggacaccctccgcttctgatctgtccggcaggcagagagccgctgttcaccgcaggagaagacaaaggcggaattccgctggggtggtttgcaaatgccgaataccgggcggaagataattttgagtatgattttgacgatgacaccatgtttctcggagtcacggacggggttttcgataccgccggggaagatggcgagttcatcacaaagaacgaattgcatgatattgtggaagcattgactgcggataccgatgcaacggtatttccctatcgcctgaaaagcatgatggaacagatgggatatgagaacatttccgatgatttcacggtagtcgccctccagaaacgccaatgcagagcagactgtatcgagcgcctgattccggcaaaactgtccgaggtgaacaaggttgcaacggaattctcatccatagcggaagacctgcggcagatttcggaaatagaactttgcgtgcatgaattcctgaacaatgtgatcgtccacgggaacgccggttccaaccagagaccggacctgatttacatcaatatagcaaaggaaaaggggaaattcaaaatccggggattggaacacggtaagaaatgggatccgtccaatatggaaaacattgatggacggaatgcagaagacagaagttctcccgccacatccggcaggggaatgcagattcttcaggcaatcacggaccatgtgacatacaactcttactgcgatttgaatgagacttgttttactctgaaaagcggggaaaaaaatgataactga

SEQ ID NO: 2 - DNA, 921 bp, Unknown
  Description of Unknown: sequence from a bacterial species not precisely identified
atgtcaggagaaattatcggcgtttccgccctcagagatatcctgccctgccgtccctccatgctcctgctcgaccgggtctttgcggagagcgaaaacaaactcatcggcctcaagtccatctccatgaacgaaccctgtttcatggggcacttccccggacacccgattctgccgggagtgcttcaggtcgaagcgatcgcgcagctcgccgaagtcggtctctggaagcgtcttgatccggaacgcaagggtgatttctacatcaaggagcttcataaaatcaagttccgccgccccaacaaccccggtgaccgccttgtcatcgaagtcgaactctccaatatcggcacggacagtgcggaattcaaagccacggtcaagaacaattccggcgtcgcatgcaatgcgaacggaatcgtcgcaatccgcccgaagatcacggcggcggaaccgatcatgccgtataatgaattcgataaaggggaaagcagcgtcatgagcgtcaatcagatcatggggctgattccgcaccgttatcctttcctgtttgtggactatgtctccaaaatcgaaggcagccatgtgacaggcgtcaagaacaccacgggaagtgagccgatcttccgtcagtacaaagacggctataccgtgctcatgggtgcggtccaggcggaaatcatcgcgcaggtcggggcaatttatatgctttccaatgaaaacaacaagggaaaaatcgcctacttcatgggcattgacaaatccgaaatgttcgctccggtcttccccggcgaccagctccgccttgaagtcgatattcccgacgggaaatcaaaattcggcaaaggcgaaggtttcatgtatgtcggcgacaaactggcatcccacacctgcatgcttttcgcaatcgtcgatccctga

SEQ ID NO: 3 - DNA, 861 bp, Unknown
  Description of Unknown: sequence from a bacterial species not precisely identified
gtgaaaacaattgacggaaagtatttttttttgacgtttattatgaaagagcgcaaagtacagcttctgagggtcggatttttcgcctgccccaatgtcaaacgggtctctccggcaacgatttcgccatcttttgaatgtatcgaaatcctgaccggaggcaaactcttttttgaagtgaacggagaggtcaagcaattcgagcgcggcgcagtcttctggcacaagggaggagaacacacgatctgtgaaacggatgccaatgatccctaccgctgcatcgtactctatttcaaggtcgatgacggcaaccgccccggcccgcgcgtaagcctctgggaatcctccgacgccgctgtcgatttcgcaaccgaatgccacaaggcgtttcattccggctgcgccgatatggaagcgctctcggattacgcctactccaccatccgctggaaatcctcgccgcatcaatcgtccgttgaaatcgcattccccgaacctctgaagcgtgcgctcacgtatatccagatgaactacacttcggcaatcgatccggaaaacattgccgaaaagtcgaatctgagccgtccgtatctttttgccctgttcagggaatatatgaaaacgacgccttaccactacattcttcaacagcggatcggcaaggcgaaacttctgttatccggcgggttgaccccgatcaaggaaatcgcactcctctgcgggttcgactccctggaagtgttttaccgtcaattcaaaaaagaaacgaatctgactccggcggattaccggaaaaaatattccgcatatccggaatcatggggcaggctctgcgcgttgcagaatctcaagggaaagtag

SEQ ID NO: 4 - DNA, 771 bp, Unknown
  Description of Unknown: sequence from a bacterial species not precisely identified
ggattcccgatgctgaaaccgcagataccgctgacgaaacagcttgcgccgctgattatttttctggcgatcgtgattctctgcacgctggtgatcagcaaccgccgcgcggcgaaaaagcgtgcgcaggaagctgcgatcctgccgatggaggaacagcagctccgtatggagctgagcccgttcaaatacagcggaaacatggttatggagggcgattacggtgaaagaagttcgatcccgcgtgtggattcgaccttgcagcaggcggctgattactgtgacaacggagagttcgatcaggcggaggatgtgttgcggaccgctctggtgtttcatcatacgaacccgaaacttctttccatgctcggcagcgttctttacatgcaggggaaatacaaagacgccgaaatggtgttccggcgtcaggcgttcctgcgcccgaacgacacttcggtctacaacaatctcggcgcggcgctggcgaagcagagaaaattccgcgaggcgatcacgactgcggaaaaaggtctgcggatggaaccggcgtcctcaatcgccgcactgaatctttccgggattcattcgatggcggggaatacggagaaggcgatcgaatatttcaagaaagcctatgatatgctgggggaacggattctgccgctttccggcgatccgaatttcgacaatatccgcaatcaggagggattccggaagatcattgatcaggcgcgcgaaaaatcatttcacggatcacaggcggacaaatga

SEQ ID NO: 5 - DNA, 936 bp, Unknown
  Description of Unknown: sequence from a bacterial species not precisely identified
atttttatgaaaaacagaaaatatattgatatgcaggcagccgatctgtttcaggagatttcgtttcccctgaaagtattcatgtatgattacgattcgccgtcgaatgactggcaccgccacaacggcttctacgagcttgtgatcgtgtgcagcggcaccgcaaaaaacgaactgcccggagaaacggaactggttgcgccgggaaccatcttcatgatgccgccgggagcactgcaccgctatacggcaatccgccatttccgtcactacaacgtattgttttcggaagaacttctcaatacgggaaacctgaatcttgcccgtcagcttgcatcctctccgctatggcgttttgcgggaaggcagtgttctccgtttgtcccggtcagcgaaagcgcgctgtcgaaaaccgtgctgatgctggaaacgatacgcagtgaaatgtccatccgctctccggggtggcgcgaagcggcgtttgcggagttcatccgcgtgatgatttacctgatccgcatcagcaaactgccggacagcgaatccgggcagtattcgttccagatcgggcgggcaatccgcctgatggaggagaaagtgtcgcaggagcttactctgaaatcgattgcggaatccgtgaacatgtccgaaagcagtttccgccacagattccttgcggtcacggggatgtcgccgattcgttacctgatccgcctgcggttgaaaaaggcgctgcttctcctgacctcccccacttcgatttcaagcattgcgcttctttccgggttcgcggatcagaattatttctcgcgccagttcaagaaacagttcggaatcactccgcatgaatttcagaaaaaatatgtggcgcagcagctttccgtcaatgaactgctgacggggctcatggatattgacaccctgatctgccgctga

SEQ ID NO: 6 - DNA, 1368 bp, Unknown
  Description of Unknown: sequence from a bacterial species not precisely identified
atgggcaagtacaatccagcgccgtatcaactcgacctcaaccgttatccgcacctcgtgacagacacgattccggggccgaaaagcaaagaacttcatgccagagccgcaaaatattaccgtgggctctccggacaggtcaaactgtttccggtcgcatttgaacgtggatccggctgtatgctggaagacgttgacggcaatcagtacatcgatttttccagcggcatttacgtaacgacactcggacactgccacccgaaaatttccgaaggggtcgcaaagtatgcaaagcaattgatgaatgcccacgacttcacgactgaaatcaaagtcaggctgcttgaaaaaatggcgtccgtccttcccggcgacctgaaatgcttccagctctatgacagcggcacgactgcggtcgaagcaggtctgcgcacctgccgcgcggcaacaggcaaacacgaattcatcagttgtttcatggatttccacggcaagagcggacactccatcggactcgcccgcatgacaaaattcagcggttcggcgcgtcccgaaggattctatctcgtaccgcgtcccgacacctaccgtccgtggtggacgcgtcccgacggcacacttgacacggaacgttatctggaattctatgacaagttcatcagagaatccaccaccggacaggtcgcggcattcgtcctcgaacccattcagggctggggcggaagcatcatgccgccggacgacttctttccgaaactccgcaagttccttgacgagcgcaatatcctgcttttcgcagatgaagtcctcacaagcatgggcagaaccggcaagattctctgctgcgaacactggaacgtcctgccggatgtcgtcaccatgggcaaaggcttcggaaacggcttccccgtgacctgcatggcggtgcgcactccgtatgcggacgccgtcgacaagatcagcgcctcgaccagctacggaggcaatccgatggcgtgcgccgcagctctcgcctgcttcgaggtcatcgaagaagaaggactgctggaacatgcgcaggagctggaggttctcttcaagaagcgcatggcggactggaccacgaaatacaaaatcgtcggcgacacccgctgcaagggatgtctgctcggcatcgaactggtcaaggacaaagccctcaaaaccccgttcgacgaagcgggaaagatggtctaccagaaagcattcggcaaggggctcgcatgggttcccgccgggcacatcctgcgcatgagcccgccgatcatcatgccgaatgaagtcgccctcaagggaatggacatcatcgaagaggcgatcgcggaaacggaaaaggagctgctgggttaa

SEQ ID NO: 7 - DNA, 2046 bp, Unknown
  Description of Unknown: sequence from a bacterial species not precisely identified
atgggaacaaaaagtgtaaaagtcaaaactcttgcggataagtatggcgtttccgtaaaggagatcattaaagaattggagtcgcagggattcggggatgacgtgaagagcgccagctctgtgattccgcctgatgctgttgagcttgtgaaatcttatcttgacgaactgatggcgaaaagaggcggggagcccggacgcggagccggaaaccgggacggtggaggagcggtttccgccgcatctgccggacagcaggaggttcatatcaagggaccggtcattgtcaagagccttgccgaagcccttggaaagcgcccgaatgaggtgattaccagtctcatgatgatgaatgtccttgcgagcatcaaccagatgctggagcccgccgtagccgtcgaacttgccgcgaagatgggattcacgctcgtgattgacaagcgcggaaaagaggagcatgttcagaaggatgccggcagccagagtgccgatgctccggaggaaattgaatttgcggataacccgaaagatatcattgcacgtcagccgatcgtgactttcatggggcatgtcgaccacggcaagacctcattgcaggatgcgatccgcaaaacgcgcgtcgcggcgggggaagccggaggaattacacagcatatcggcgcgtcgattgcgcactgtggcaataagtcggttacatttgtcgataccccggggcacgaagcgtttaccgcgatgcgtgcccgcggcgccaatgtgacggatatcgtagtgcttgtggttgccgcggatgacggtttcatgccgcagaccatcgaagccatgaatcatgccagggcggcgaaagtgccgatcattgtggcgatgaataagattgacctgccgaatgccaatccggacaaggtgcttctgaatatgcagcagaacggtttgatgccggaagactggggcggaacgatcggcgtcgtcaaagtgtctgcaaagacagggcaggggatcgacgatcttcttgagcgcatcctgctggaggcggagatgctggagctcaaaggcaatccgaagcgtccagccgaggcgtttgttctggaatcccagctcgaacagggatacgggccgaccgccagcatcgtggtcaagaacgggacgcttcatgtgggcgatccgatcatctgcggtgaatattacggcaaagtcaaggggttgatcgatcatcgcggacagcgcatcaagtctgcaggcccgagcactccggtgaagattgtcggtctgagcggtgtgccggatgcaggaacgaagcttgtggtctgcaagagcgagaaggaagccaaagaaatcggtgaagcgaggagcgccagcaaacgtgtggagactctctccggcaaaggcggcggcatgacgcttgacgatctgttctcgcagatggagaacggcaaacgcaatacgctcaaagtggtggtgaagactgacgtctgcggctcctccgaagcgattgtggagtctctcaagaaactgccgtccgaaaaaatcagcgtggaagtgcttcatgccggtgtcggggcgattacggaaagcgatgtccagcttgcggcttcttccaatgccattgtgatcggattccacgtccgcgtcaatcccggcgtgaacgacctggcgaagaaagagaatgtcgaaatccgtctttacagtatcatttacgagctgctggaagacatcaaggacgctatggcgggtcgtcttgagccggataaacgcgagaaagaactcggcgtagctcatatcctgaagattttcgagctgtccagaggtccgaagatctgcggctgcatggtggataagggagtggtcaaggtcggcagcaaatcgcgcgtattccggaaaggcgagctgatcttcaacggggaagtgcgttccctccgccgttttcaggacgatgtcaaggaagtgcgtcagggcatggaatgcggcatcaagctggacaacttcctcgacttcgatgtcggcgatgtgatccagttctatgaaatcgagctgaaaaaagcgacactctga

SEQ ID NO: 8 - DNA, 981 bp, Unknown
  Description of Unknown: sequence from a bacterial species not precisely identified
atgaaaaaagatactcttatccgtgtcgtggtaatggttgtcgcacttctcgcagcatcctatcttgccaatatcctgactcccatgcagaaagaaatttcgattgaaaagggagaactcaccaaagctccgattgccggtcttcacaagatcatggcggatgttgcatggatgcgtttcatcaatgtcgccggtggcatggacaccatcgacacgaagaatgtcgataaaatctccgccatgctcgaaaagatcattgcctatgatccgaacttcgaagaaatgtatcagagcggtgttctctgcatgagcaatgccgaccccaagaaagccattgaattcctgaagaaagcttgcgacaatgaatatctgaagaataattccaagctgcctttcaatgcgggattcctgctttcacgcacgatcgtcgaccagaatgatcccaacaacattctttcaaagccggattacacccaggctgcgaaatatttcagaatggcgatgcagcgttcttcccagcctgaaccttatgtggtgagcagctacatcagagccaaagcgaaagccaaagcggaagcagacaagaaaattgatgaatactatgcgacgctttctgttctttatgatgagtggaaagcatccaagaaaggttcttttgaaggcacgatcgtagagaccagctccattccggatttggaatcccgtcttctcaaagcggctcagaacgccaagaacccggttgactatgacggcaatccgatcaaaccgcttccggaatctctggctctcatcgcaaaagtccagcaggaagttcttgccgacaatcatctctgcccgaactgcattacaccgacccccgccggagcgaaattctgcacatcctgcggaaccaaggttgcagtctggggaacctgcaagacttgtcagaaggttctgaccggcggcaactactgcgccgactgcggcaccaagaacaaataa

SEQ ID NO: 9 - DNA, 1065 bp, Unknown
  Description of Unknown: sequence from a bacterial species not precisely identified
atgtctgctgtgaagcaaatcaaggttggaatcatcggatgcggcgtaatcgctccgtgtcatatcggaagttatctcaagcttccggaggtcagggttgttcatctttgcgacaaggtgcctgccaaagcggaaaagcttgccaaagagtatgggatcggaaaagtttcgcaggattacaaagagctgctggcggacccggaggttgatgccgtttccatttgtacggaccatgcgagccattcgcagattgccgtcgacgccttgaatgccggaaagcatgtgatctgcgaaaagtcgctggcgtcttccaaagagaaactggatgcgatgcttgaagcggcgcgcagacatcccggactcgttttcagcggcgttttccagcaccgtttcgatctgggatacaattatgtccgcaagattatcgccgacggtgttttcgggcggatgctgaccgcgaatctgaatgtgctctgcctgcgcaccaacgagtattacaatgcggacgcatggcgcggaacctgggcggaggagggcggagcggtcctgatcaaccagtccatccacttcattgatatgatttcgtggctgatgggcggtgtggagtctgtcgccgcctgctatgcgaacctgaaccatcagggagtgattgagtgcgaagataccgcagccgcggctcttgtctataagaacggcgcgctgggaacgatttccgcgacttccgcgagcccgattgcgtgggaacccacgatgtctttcaacggcacagccggttccatggatgtgcgtaacggcgagcttctgcggattgatttcaaggataaggctctggaggagaaaatccgctccgggttccaggagatcaaagaggagggggagagcctgatcaaatcgaaggactattacggatacgggcatccccagcagatggacaacttcatcaaagcgatccgcgaaggttctccgctgaaagtatccgtggagtctgcggcgcatgctccggatatcgttctttccatttatgaatcccataataccggaaagcgcgtcagaatcacacactga

SEQ ID NO: 10 - DNA, 2667 bp, Unknown
  Description of Unknown: sequence from a bacterial species not precisely identified
atgtctgactcagagatgccgaaagcatacgaatcctcggccgtcgaggaaaaatggtattcctactgggaaaacaacggccttttccacggcaagcccaatcccgataaaaaaccgtattccatcgtgatccccccgccgaacgtgaccggcatcctgaccatggggcatgttctcaacaatacgcttcaggatattctcgcgcgctggcacagaatggaaggcgatgaagtctgctggttccccggaaccgaccacgccggcatcgcaaccgaaagccgcgtcgaaaaatatctccgcgaaaaagagggaaccggacgcgacgaactcggacgggaggagttcgtcaaacgggtctggacatggcgcgagcagtatggcggaaccatcatcaggcagctccgcaaactcggcacatcctgcgactgggagcgcgagcgtttcaccatggacgaagggctcagcgacgccgtcaaacaggtctttgtacaactgtacaacaagggatatatcaaacgcggcaagcgtatgatcaactggtgccccgtttccaaaacggcgctctccgatgaggaagtcatctacaaggaggaaaacggcaagttctatcacttcaaatatccgttgtccgacggttccggctttctggtcgttgccacaacccgtccggaaaccatgctcggagataccgcggtcgcggtgccggtcggcgatcccagatataagcaccttgtcggaaaaactgtcgatcttccgctcacggaccgtaaaattccgatcattgaagaccagcatgccgatcccgaaaaaggaaccggctgcgtaaagatcactcccgcacacgacccgaacgacttcgaagtcggtctgcgccataatcttgacttcatcaacgtgttcacaaaggatgcgaagatgaatgaacgcgcaggcaaatacaaaggcatggaccgttttgaatgccgcaaacagattgtggcggacatggaacagctcggactgcttgacaaaatagaggatctcgttcatgcggtcggctactcggagcgcgggggcgtgcctgtcgagcccatgctcagcgaacagtggttcgtcaaaatggacgaactcgccaaacccgcaatcgaggcggtccgcaacggcacgatcaaattctatccggagcgttggaccaagacttatttccactggatggaaaacatcaaggactggtgcatcagccgccagatctggtgggggcaccgcattccggcatggtataatgacaggaacgaagtctatgtgggcgtgaatccgccggagggcgacggatggcgtcaggatgaagacgtgctcgacacatggttcagctcctggctctggccgttctcgatcatgggctggcccaaagatacgcctgaacagaaatacttttatccgaccaacgatctcgtgaccggcccggacatcattttcttctgggttgcgcgcatgatcatggcgggctacgaattcaagggaacccatccgttccgcaatgtttatttcacaagcatcatccgcgacgatctcgggcgcaagctcagcaaatcgctcggcaactcgcccgacccgctggatgtaatcgggcagtatggtgcggacgccctgcgtttctcgatcatctacattgctccggtcggcatggatattcgttatgcaaatgaaaaatgcgaaatcgggcgcaattttgcgaacaagctttggaatgcgtgccgcttccgcagaatgcagggacccgtttccgccaacttccgcaagctggaaggcatggacccgaaacagctcgcgcccgatgagaagtggattctcgcatggacaaaccgcacgatcaaggcggcaagagaggcgctggagggattcaagttccatcaggcggcgcatgaaatctatgaaatggtctggagcaccttctgcgactggttcatcgaatcctgcaaaccgcgtctctacggcgacccggaggcaaaaaaacagacgcttgcggtgcttgacttcgtcctttggaagcttctgcgcctcctgcatcctttcatgcccttcgtcacggaggaactggctcatcagatggacttcctgaaagacagtgaaagcatcatgtatgcgcactatccgacgatgttcaacgaactcggactggatgatctcatggatgacattgatgatatccttgatctggttgaggacaagttccaaatggtcagggcaggcagaaacctgcgtgtctcttatgatattgctccgggtaaaaaattaaaataccatatcaaagcggcaacggcggcgcatgaaaagttcctcacggatgagattgccaatctcaagttcatgctgaatgccgaggaagtcacggtttcaatggaagaatacaaggcggaagacggttccggggctccgtccgcccttgtgaatgcaggcgcaatctacctgccgttgaaaggggtcatcgacatcgaggcggagactgccaagctgaacaagcagaagaaggagctcctcggctggatcaagggttcggaggcgaaactgaacaatcagggattccttgccaaagctcctccgaaggtagtggaggatgccagagcgcatcttgcggaaatgaaagacaaacttgcaagagtcgaagaagcgctgaagtctctctgctga

SEQ ID NO: 11 - DNA, 1080 bp, Unknown
  Description of Unknown: sequence from a bacterial species not precisely identified
atggaagatttgcccaatatcgcccgcgtactcctgaacctttcgctcaaccggagcttcgattaccggataccggagcatctccgcggacaggtcagagccggaatgcgcgtcaacgttcctttcgggcgcggcgacggcgaacggcaggcttacgtcgtggcggtcggttccgcctcggaccgcgacgatctcaaggaggtgctttcgatctgcacggagcatccggcgctgaccgaatccctgctgaaaatcggggaatggatggcggattactactgctgtgcgcgggaactggcggtccggactctgcttccgggagcagtcaggagcggcaagatcaaggcaaagacgaaggcctattactttctgaacgatatgcagaaagccgcggattatatcaataagaatacacgggcaaagggaaaatgcgccattctgaaagccctgatgctccatccgggaatcgaagcggaaacccttgccgcagaatccggcgcctcgaaaaccgtcctgaacgaactggtaaagctggaactggtctcaatcgaagaccgcgccgtggaacgcaatccgtttgccggtacggaactgctccgcacaaagccgctcacgcccaccggagaacaggcggaggcgctgaacctgatttacaaacgcatggaacacccggactccgcagacccgcatgtgattctgctccacggcgtaaccggaagcggaaaaaccgaagtctaccttcaggcgattgcgcgcgcggtcgagaatggaaaagaggcaatcgtgcttgtcccggaaatctcgctgactccgcagaccgtcgaacggttccgcgcacggttcggggacatggtcagcgtgcttcacagcgggctcaccgacggcgaacggtatgacgaatggatgaaagtgcaccgcggcaaggtcagaatcgcggtcggcgcgcggtcggcgctgttcgcgccgttccgcaacctcgcgctgatcatcgtggacgaggagcatgactcctcctacaaacagtccgaagctccacgctacaacgcgcgcgatgtggcggtcatgcgcggaaaactcgaa

SEQ ID NO: 12 - DNA, 1362 bp, Unknown
  Description of Unknown: sequence from a bacterial species not precisely identified
atgaaaacattcctgagtattctcattcttacactgtttctcccggtatttgcgtcgcagttccgtccggacgcagatacgctgaaaaagctggagctgggatttcccggctggaagcggaccacgtcacaggcttaccgcctgccggggaacctgccgttgcccacggcatggcgtgtggtgttcacccgcgatatcgcagtaaggaacgacaaggagaaaaaccagcgggcaaaaggaatgctggtcgtctaccttctgccgcagaatggaaagctgcttcccgaaaaagatgccgctaccatgctgaaatattttgactggaagacatcgaaaaacgatctggaacagtatgagatgtatctcggtgcggggcgcggatattactggtatgccaagacggatatcgggcgcctgaatttcctgaaagaaagcatgaaactgaccggcggagaagacatgatgcaaaaaatggcggcagctctgaatgaagaggatttcgagctgtattcctcccgcgtcgccgtggagtatttccgcaataaaggcgattccgccgtcccgtatatcctgcaatccgtaaaagagtgggaacaggaacacgaaaaggagtcagaggtcccgcttccgcacctgtttgctctgaagctggcagggggacggaaggcggaagacgcgctgatgcagtttgcatactccagaaaccgcagagttgcggaggctgcgatcggcagactgctgacggaaccctgtacggcgccggataagttttatgttacagtaatgcgtcttccgatgtttacgggcgccgctctggatgtgttccgcaagagaaaaaaaggcaaaatgattctcggcgacctgcagaaactggcggcgcgtccgaagtctctgcagcagtattctcttgttgccgcggctctgcgtgaattcggcaaagggatggcgacagttcccgagtatgactccgcgaatcatatcatgttccgcgtcatgcgcaagggagatacgccggacacgcctatttttgtcacgtttgacgatacgactttgatttccgaaagtgcgatggaaacggcggagcgcaaacggattgaagagttcacaaaacagcttctgacctcttccgaccgcgaagcggcgatcatcgcggcattgtctctggcaacctacaatccacagacgaaaggaatttcggaagcctatataaaacgggtgcgcagaatcggcggagagcttcttcggaagatgccgatcgggccccgccaacagattttccagcttctcgacaaaaacctgaccgatacgcgtgaccgcgcctccttgcgccgtgtcgcctccgaaatcggcatgcgcctgtag

SEQ ID NO: 13 - DNA, 1107 bp, Unknown
  Description of Unknown: sequence from a bacterial species not precisely identified
atggaaaaggaaaagaatgcccgtgcctatgcagtagtcatggcgggcggcaaaggagaacggttctggccgcagagccgtctttccaacccgaaacagttgttgcggcttctgggaaacctgacgctgattgagcagaccatcgagcggctttccgccatctttgattactcccatatcattgtggtcacgaatacgaattatgtggctccgatgcgttccctgctctcctacctgccgcaggagaatatcattggcgaaccggaaggaaaggatactgcgccgtgtatcgcgaatgccgcggcgtatatcaaaaacacttccagagttcccgaccccgttctctgtctgtttccgacggaccatatcattaatgacaccgtgtcattttacgatgctctggcggacagtctggctgtggcggaagacacgcatcatattgtcacgatcgggatcaaaccgaatgcacccatgacagggtatggttatatcgaggtcggcgacaaaatgaatttcacttccaagaccgtgttccgtaaggtctgcgggttcaaggaaaagccctctcttgagctttccgaagcctacgtcgccgatggaaaacacatgtggaacagcggaatcttcatcttgaatctttcgtcgctgctgactgccctgaaagaatttgcgccggatatgtaccggttttatgaagcggtttccgcattttatgtgtcccatgcccccgaatccaggctgacggaactttacaatacggctccggaaatttcgattgactatgccgtcatggagaagtccgacaacatcgtgacggcggaagccgctttcgattgggatgacgtcggttcctggacctccatgcgcaaccagatcctgccggaaaagaacaacaatgtcgtccgcggtcttcatgcggggctggataccagcgactgcatcatcatcggaaactcgaatcatctgattgccactgttgacgtgaaagaccttgtcatcgtcgccacggaagatgcgactctggtttgcaatgcgaagtcggcacagcggatcaaagagcttgtcaagctgattgccggacagccggatcttgccaaatttgtctga

SEQ ID NO: 14 - DNA, 2202 bp, Unknown
  Description of Unknown: sequence from a bacterial species not precisely identified
ctcaaagccggacatgtcaaaaaggaagatctggcggaactctatgagtccatgctcgtcatccgcgagttcgaggaaatgatcctcaaactcaaaaacggcgcctatgaaatcctcagcgactatgaataccgcggtccgacacacctttccatcggtcaggaagcaacagccgcgggcgtctgctccgctctcaacatcacggacgaaatcacctccacccaccgcggacacggtgactccattgcgaagggcttccacgccatcaagagaatgaccgaggcacagctcaaggcgcgctgccccgaattctccgccctctccggcgacgcacttctggaagccgtcctcgaggaccatattttcagaaccattgccgaactcttcggtaaagaagccggctacggcaaaggacgcggcggcggaatgcacatcgcggacttccgcgtcggacacctcggagcaaacgcgatcgtcggcggcggcatcccgatcgccacgggcgcggcaatgaccaaccgcatcgacatcgatccttcgcacaaaggaaaagtcgtctgcgcattcgccggcgacggagcttatgccaacggcgttgtgctggaatctttcaactgggcatgccagggacagttcaccgatccggctctctccagcatcaacttcggtcttccgattatctactgcctcatcaacaaccacttcggcatgacgggcagagccgaccgcgaagtgacgggcgtcaatccgcttgtccgccgcgccgccggtttctccaatgaaaacatgcacgcggaagtcgtcaacggcatggacccgctggctgtcagagacgccatcgagcgcgccaagaagaccattgccgaaggcaaaggcccggtcatgctcgaattcaacccctaccgttatttcggacactccctttccgacccgagaacggaataccgcacgaaggatgaggaagcccagtggaaggcggtcgatccggttccctgcttccgccagaaactgatcgagaacggcatcttcacggaagaagaacttgccgggatggaagcaaatgtcgtggaaagaaacaagaaggctgcacgccgcgccgcggattccgacgatccgatgccggaagacgtcatcaaatacatgtataccgatacgtccagcgacaccgtccccgctccctacaatcagctcatgaagcgtggcgaccgccccgtcatcaagcgtgacgcggaaagccgcatcacctacaaggacgcgatcaaggaaggcatgatcgaggaaatggaacgcgacgcgcgtgtcgttctctatggagaagacgttgcggactatggcaatgcgttcaaactgaccaagggcatgctcgaatacttcggacgcgcccgcgtgttcaacaccccgatttccgaagccgcgatcgtcggcaccggcgtcggcatggcaatgacgggctaccgtccggtcgtcgaactcatgtatatggacttcgcgctgatggcttccgaccagatttccaatcaggcggcaaaatggcattacatgacaggcgcatcgaccaaagttccgatggtgatccgctgctccgtcggcggcggcaagggatacggcggacagcactcccagtccctcgaatccatcttcgcccacattcccggcacctatgtcgtatatccctccaacccctacgatgcaaagggactcatcaaaaccgcgatccgcgacgacaaccccgtcgtctttgtggagggtcagctcctttacaatatgaagggtgtggttccggcggaagattacacgattccgttcggcgttgcgaacgttctgcgtgaaggttccgacatcacattcgtcggctggggccccgcgatcaatgatgccgtcaaagcggcagatgctctcgtggaagaaggcgtcagcgttgaggtgatcgacgcccgcacactcgttccgttcgactgggaaaccgtcttcgcctctgtccgcaagaccggcaagtgcgttgtcatgagccagtgcgtcgatatcggaagcttcacgggcgaaatcgtttccaggatcatggaagaatgcttcgactctcttgacgcaccggtcctcaagatcggcgcgaagaacggtattgctcctcaggcgcactgccttgaaaaggcgttcctcccgagcgtcgaggaaatggtcgcagcagctaagaaaatcctttga

SEQ ID NO: 15 - DNA, 759 bp, Unknown
  Description of Unknown: sequence from a bacterial species not precisely identified
atgaattttcagggcaggacagccatcgtcaccggcggaaacggatatatcggaggaacaatcagccggaaattgctggaacaaggcgcatcggtcgccatattcgacatcgcactggaaaatgcacggaaaactgcggaggaatttgaaaatgcgtatcccgtttccgttgacctgaccaatcccgattcagttcaggctgcagttgccggaacaataaagcatttcggaaaagcggacctgctcgtgacatccgccggaggcagcgccagaagcaggatgaaaccttttgcagagcaggacatgaatgtcatccgcgggatcattgaaatgaatctgttcggggcattgcatgtaattcacgcggtggttccgcatatgttccggcagaattacggcagaatcgtcaatctctcctctctggtggctctcggaggcgtggaaggatgtgcggattacgccgcggcaaagagtggaatcatcgccgcaaccaaaacacttgcaatggagtttggaccgcataacgtcaatatcaactgcgtatgccccggcaaagtgcagcgccccggcgagatgcccgccgatccggaagcattcgcccgcaaacattcattcctgaaccggatctgttccgcggacgatatcgcggaactcgttctgttccttctttcagaaaaagcggattacattacagggcagaactacatcattgacggcggacgttccctggggttaaagggagatcaccacggcaaatga

SEQ ID NO: 16 - DNA, 1236 bp, Unknown
  Description of Unknown: sequence from a bacterial species not precisely identified
atgtttcaaaacaagatgatgaaacttcgtgaacctgtcggaaaaacttttaccgcggttctgaccggagatgtctgtccgaaatttcctgaagcgcaggaacaggcgatcaaccacagcgaaacgctggttgccggagtgaaaccgttcattgcttctgccgatctgaagatcatgcagtgggaaacgaccctgactgccgctgatacgccgatcgacaaatgcggtcccaatctgaaatgtccgccggagtgtctgaacctcggcaaggcgcttgatattgatgtgatgctgcttgccaacaaccatgtcggcgacttcggtcccgatgttgtggttgaaaccatttccaacatcgaaaaagccggattcaagcacgtcggcgcggggaaaaacctggcggacgcgaaaaagcccctttatcttgactgcaacggattgaaggttgcgattatcaattttgcggaaaacgagttcggcaccgccggcggaaacaaggcgggagtcgcgcctatggagccgttcagcaacatccgccagatcagggaagtccggcagaatgcggatattgtgatcgtcgcgattcacggcgggcatgagcattatgcttatccgtctccgaggatggtggaagtataccgtcagtttgccagtgccggagcggatattgtctggggctgccatacccattgcaatgtcggctgtgaagtctttgaagatgtgccgatcatttactctcccggcaatttctatttcccgtatcccgagttcggcggatcgcagaaaggatgctggaagaccggttatctgagcaaattctattgcgatgaaaagggtgtttacgccgtggagcttcaaccctataaattcgatatgacatccattacggcattgaatccggaagacgagaagatgttctttgaatattatgagaaaatatcctccgtgattcaggaccccgaaatgatccggcgttattttgaagcctggtgcacttggtccggtattagttatttgagctgtctgaacaaggataaagtggaaaactggccgccggactggacccggcgcgaagtcgtcaagtcatggcttccagcaagaaatctctttacatgtgaggctcacaacgatctcatgaaacaaaccttgcgcctgattgaagaacatcgtgtcgacgaggcgaaacaactgcaggatgaggttctggctctgcagaatccgccgtggatgaaataa

SEQ ID NO: 17 - DNA, 1269 bp, Unknown
  Description of Unknown: sequence from a bacterial species not precisely identified
atgagacagtttatttttctgctattcctgctttgctccataccgggctccgtcttcgccggcgagaagcaatctgccgggcctgtaccgcctgtgcttcctgctccatccattaaggatgctgcggagaacgatccttatctttataaggatatcgcttttttcctgcgcgctctggcgatcgtgagggaaaactatgtggataaggagaaagtctccgacagcaagcttctgaaagcggcgttgcggggaatgcttcaggaactggatgaattcagcatgtatgaggctccggagcgattcaaagcgattcgggaggatactgccgggcgttttgccggaatcggactgacgctttcccggcgcgggaacgcggttcaggtggtttccgtcgtggacggggcaccggctcagaaagcagggcttctcccaggagacgttctgacggaagtcgctggaaaaccggtgacgaaaatgacgtttcaggagtgtgtctcaatactgaaaggcgcaccgggaaccaaagtgacggtcaaggtttaccgccggaaaaccgatgcttatcaagagtttacattgacccgtgaattcattaaaattccatcgctccgcggcgtcagaatcattgacggagagttcggctacctccggattacgaatttctccaatccgactgccgccgatcttgacaaggcgctggaagaatttgcgaaaaagaaggtcaggggaatcgtcatcgacctgcggaacaatccgggaggacttctgaattcggcaatcgaagtatgcagccggttcctgaaaaaaggcgagcttgtggtttacacggaagggcagtccgcgcgtgcgaaacaggaatttcatgccgttgatgcgaagaaatatctggatatccctctggtcctgctggtcaacggaaattccgcaagtgccgcggaaatcttttccgggtgccttcaggatcacaaccgcgcggttcttctcggtacgaaaactttcggaaagggttcggtccagacggttattccgctgccggacaaaggggcgatgcgcctgacgaccgccaaatactacactccgagccgccgtgtcattcacggcagaggaatcactcccgacatcatcgttcccatgacgccggcttcggaggcggttcttgcgatgcagttgaatgttgcgccgggcgaagttcacatgaaaaacggcggcggcgtgaaggatgttcagttggaaagagcgctggagcttctcaaaggggtcaaccttttc

SEQ ID NO: 18 - DNA, 1254 bp, Unknown
  Description of Unknown: sequence from a bacterial species not precisely identified
atgccgtatctggagtatgacgaccacgggacaatcagaagagtgaatcttgccggcgacagggagactttcatcgggcgcgatcagcagtgtacaatctgcctggcgggcgtcccgcaggtgagccgccgtcactgcgtcgtctatttcaatacgaatctgaatgcttatgccctggcggatatgcactccacgaacgggacgaagctcaacggggtgaaaatcagccagaacgatgtgacattgaacgacggcgaccggattcaggtcggcgcgatccgtttcacgttccgcggagaacaggagcagcccgatgtgaaactggtggacccgctcaacatcgatccgctctcctatgctcccgtcattccctcggttgctcccggaatgcagaaaaattacactcagaacctgactcccggcgcatccatcgacggaatggtggtcgcggcggtgctgtccgcctgcgacgagtccgtccattacctgctgacagaccatgagccggaacagcggcggaccataaaaatcttcaagacgccgcagagtgatcccgaagcgagaaaagagttctcggacatcatctccggatttcagtccggaacgcttccgaaaacgcttctgccttataccggcggcggaatccgcagtgaggaatactgttattacacgacggactttcaggaatatccatcgcttgccgccatgatttccgcacgcgctcctctggatgagaaaaagactctgccgattattttttcgatcattgaaattcttgacgacgccaaccagcagagtatctttcacggcaatttgaagccgtctaaaattctttattcccaaaaagggtctctcatgatcggatatgggcttgcggcgtggctccgggcgcatctgaaaaacaacttcaaacagcgtcccgaatggtacgccagccccgaatggttcgcgggacaggaactgacatggaagtcggacatgtattcgttgggcatcatcttctatcagatattgaccggagtcctgccgttccgcgcggaaactgagcaggagcttgcccgaatgcatgccgaagacccgctgccgttcatcaaagaccgcaatgaaaacgcgaaggtcacaagtgtcacggaaggcatcatacgccggatgacgatgaagaacccgaaaaaccgttattcttcctggaacgaggttctgttccaactgaagaaagcgaattctctgcttgaagaacaggaaaaacaatcataa

SEQ ID NO: 19 - DNA, 999 bp, Unknown
  Description of Unknown: sequence from a bacterial species not precisely identified
atgaaagggctcagcactcattttcgcagagcgatgaatcatgcgctgtcactgatggcggcggcagtgatcatggcttttttctggtgttttttccggcttcccgatgccaatctcctgatggtgacgtttgcatttcttgccacatccgtgttatatgacgtggatggctggaaggatcgcctgaaactctccctgatcatggcgctttatgcttcaacgcttcaatttctgattggaatctgtcatcaggcaaaatttttgcaggtgatcctgcccgccctcttttcgtttttcactctgcgttcgcttgataaccggtgcgccgcatgtgccgtgatcattgtcggttacctcggattcttcgctccgggcggcttcatgccgtccatcgaccgcgccatcgggatttttgtgggcgtgatcgcgatcatgcttgccacggctctggtcgggctggtgcatctgcggcacgcctatatctcgactttcgggaagccgtttaccttgattgaggcgtggcgcattacgctgatgctgggattcgggacgtttatctcaaatgtcctgaagctctcacagggaccatggatcatgctgaccattgtcttcatctatctggcggtcaatgagacacaggatcacgtctatttttcgaagcggcgcattttttcggtgccgctcggactttttctcggcgcgatgtatatgagctgtcttgtctatttcaactatcagttcatctatctgattccccttctcggcgcactcggatttttcatcctttattattatgatgattatttcttttttaccgtgatgttcatggtggcgttttcgatttatgccgactgggcgaccggcgacatgcatcagtttcatattcgcgagatgatcctttcccgttcgcttgcaacgacgatcggaatcgtcctggtgcttttgtttcaaacttatttcctgccggaagccgggcagagaaaggcggattccgcatga

SEQ ID NO: 20 - DNA, 978 bp, Unknown
  Description of Unknown: sequence from a bacterial species not precisely identified
gtgaagaacattttcattgccggaggcgcaggctacatcggaagcgcatgtacggaatacatgcttaacaaaggatatcaggtcactgtattcgactctcttgtgaccggtcacgagaaggcggttgacaaacgcgcgacgttcatccgcggcgatcttgccgaccgtgaaaagctcatcgaaatcttcaggaacggcagtttcgacgcagtcatgcattttgcggcgttttctctggtgggggaatccatgaaagaccccggaaagtatttccgcaacaaccttgccaacgcgatcaatcttgccgacgccgccgtggaaggcaaggttcaggcgtttgtgttttccagtaccgccgcgaccttcggcgaacccagggaaattccgatcagtgaaaccgcggaacagctcccgatcaatccttacggcgagtccaagctctgttttgaaaaagtcctcaaatggtacagcaggatttacgggctgaaatatgtggcgctccgttacttcaatgccgccggtgcgaccgagaatttcggtgaagatcaccatccggagtcccatctgatcccgattctgcttcaggttgcacagggcaagcgtgagaaagccatgatcttcggcgatgactacgatacgccggacggaacctgcatccgcgactatattcatattctcgaccttgcgcaggcgcacgaaaaggcgctgtatgccccgagaagcgggcattataatctgggaaccggcgccggattgagcgtgaaagagattctcgacacggcgcgtaaagtgaccgggcatccgattccggcagacgttgttccgcgccgtccgggagacccgccgcgcctgatcgcctgttctgatctcgctaaaaaggagctcggatggaagccggaattcgagaatgccggagcgattatccagtctgtctggaactggcttcagaaacatccggacggctacggggacagataa

SEQ ID NO: 21 - DNA, 636 bp, Unknown
  Description of Unknown: sequence from a bacterial species not precisely identified
atgaaattcagaagaattctctcgttgggcgttctcgcagtcgggcttgccgtattcggaagtgcatgcggtattttcgaatcctcggatgaggaggaaaaggatcagttctaccgtcccctgaacggaagcggcccggagaaaattgatgtcaaagaccccggcagttccggggaggcgaatttgaccggggggcggattgatgattccgccggaatcaacggtcccggcgagtcgcgaagcggcagcgggctgtcaaattacgacggcttcgggacaccgatcccgggcgtgacattccagaccgtctatttcagattcgaccagtcccgtattgaatccacggaatcaggcaagcttgacgccatcgcaaactatctcaagagcaatccgggaaccggtgtcgtgatcgaaggcaactgcgatgcacggggcagcgaggagtacaaccgcgccctcggagagcgccgcgctctgaccgcgcaggaatatctgctggaacagggaattgccccgtccagaatgaaaaccctcagctacggcaaagagaaactggttgcgctcggcaataccgaggaagatcacatgaagaaccgcagggacgactttgtcgcggtcaaactcctgaatccgtaa

SEQ ID NO: 22 - DNA, 762 bp, Unknown
  Description of Unknown: sequence from a bacterial species not precisely identified
atgtcaggtcatagcaaatgggcgaatatcaagcacaaaaaagaagcttcggataagaagaaaggcaaaatcttttcaaaactcgcgaaagagatcatggtctgcgtgaagcagagcggcaaggatccgaactcgaatccgcgtttgagaatggctctgattgaagcccgttccgcaaatatgccccgtgaaaatattgaccgtgccatcaagaaaggcgccggtgaactcggcaatgtcgtttacgaggagattgtctacgagggatatggaccccagggaaccgcgatcatcgtcgagtgtctgaccgacaacaaaaacagaaccataggcgatgtgcgtctgacgtttgaccgtaacaacggcaatcttgcagccagcggcgctgtcggctggatgttccagagaaaagcgcatttcgtgattaccgatgaggcgaatgccaatgaggaaaaactgatggacattgttctcgacgcaggcgcggaggatattgaagtggaagacggcatggctgaaatctgggctgctccggaggctttcaccgatattgcaaaggccttggaggatgccggaattgaaacgaccgagtccggtattgtgcgtcgcccggataataccgtcggcgtgaatgatctttccaccgcccagcagattctgcgtctcgtggacaagctggatgatctggaggatgttcaggcggttcatcacaatgcgaatattgcaagtgaagtgttggacgagattgacgcccaggagtaa

SEQ ID NO: 23 - DNA, 1398 bp, Unknown
  Description of Unknown: sequence from a bacterial species not precisely identified
atgtttgataatcttacaaacaaattacaggacgccctgaaaaaactgcgcggacaggcggtgatttcagagtcaaatatcgctccggcaatgaacgatatccgcgacgccctgctggaagcggacgtcaatatcgagatcgccgatgaatttgtcaggaccgtttccacggaatgcctcggcgaggcggttctccgcagtgtcacgcccggacagcaggcggtcaagatcgtttacgataaactggtggagttcatgggcagttccgaggcgccgcttgcggacgggcagtctccgaacatcatcatgatggtcggtcttcacggaagcggcaagactacgaccagcgccaaacttgcgcttaatctcaggaaacgcaataagaaggtgatgatggtcgcgtgcgacgtttaccgtcctgccgccattgaccaactggaaattctcggcaaagagatcggagtcccggtttatgccgaacgcggcaatcccgatgtgacggttatcgcgcagaatgcgattgccgaggcgcgccgcaattttgtggattacctgattcttgataccgcgggcaggcttcagatcgacacgcagatggttcaggagctgatccgtctgcggcaggtcacgaaggcagcggaaattctgcttgtcgcggatgccgcgctcggacagcaggcggtctcggtggcaaaacacttcaatgacgcgcttcagcttaccggcgtggttcttacgaaactcgacggcgatgcgcgcggcggtgcggcattctcaatccgcagggttacggggtgtcccatcaagtttgtcggtatcggggaaaaaatcgagaatctcgacgtattccatccggaccgtatggcatcccggattctcggcatgggcgatattgtctcccttgtggaaaaggcagccgaggagatcgacaaggaggaagcggagaagcttcaggaaaaactcaagaagaatgaattcgatctgaatgactttctctcccagctccgccagatgtcccgtctgggcggcattgaaaatatcctcaagttccttccgggcggcgataaacttgccggaatgtccgagcttgacccgaagcagttcaagggaatggaggcgatcatctgctccatgacgaaagccgaacgcgccaatgcggagctgatcgacaatatgcgcaagcggcgtattgccagaggctgcggacgcccggtcgaggaggtcaaccgtcttgtgaaacagttcctgatgatgaagagcatgatgaagcgcaccggactgctggggcgcatgatgtccggcgcggctccgctcgcgatgggaatgcccggtttccgtactccgtccggccgcggcagcaactacactccgccgaagaagaaacgcaagaaacgctga

SEQ ID NO: 24 - DNA, 1629 bp, Unknown
  Description of Unknown: sequence from a bacterial species not precisely identified
atgaaaaaaagattgcttatactggctttgtgtctcggaaccggaggaatttcagtcgcaaatcctctggcggcgatcaacgacgatccgccgccgcgcatggagaaaatcggcagagagagaacaattccgcttgtccgggacgggaaaacggagatggagatcgtgattccggcggatgcgttcccgattgtccgctttgccgcagaggaaattcaaaagacattgcagaaagcgtccggagccgagatcccggtcctgaacgctccttccggcagcggcaggacagtgcttttcctgggagatcaggaggcggtacgcggggctgggattaaggttgacagtattccgcgtgatggttttatcctgaaaacagcgggaaggcagatttaccttgccggcagggatgatccgaaactgcgtcccgatgcgcgcggctggggcgtcatccgcgaacgcggcaccctgcacggcgcttacagttttctggaacgtttcgccggagtccgctattatttccccggcgagatcgggacggtgatcccggaaaacaagaatatcgccatgccggaaacggaactgctggaccgtccggattttcctcgtcggcgtgtcggctttttcgggaagaactggattcaggaggtggaccccggaatggcggggctgtatcatttccggctgcggacggagagtttctatgtgccatgctgtcatggcttggaaagcatgaaatatcagctccgtttcacgaagacgcatccggagtatattgcgatggatgcgaacgggaaatgttatcttgatcccggttccccgtattacggcaacatctgctataccagcgaaggaatgcgcaacgagatttacagggacgcggaggcttttctgaccggtaagcccgcttcctcgcgcggacttgcttcatgggacccttcctctgcccagccgggctttttcgacctgatgccgaaagaccatttcaaggactgtatgtgcccggagtgtcagaaattctatgccgcccatccgaagaaatcggatcttgtgtgggatcttctgaacgacattgccgggcgcctgaaaaagaacgggattcccggcatggtgacgatgctcgcctacgggcattataccgatgtgccggaggttgagttgcaggataatgttctgatgcaggtcgcggtaaacggtccgtgggcggagacgaatcccgcacttcagcggaaacatgaccggcgcattctcgactggaaaaagaaaatgaaccgcaaaccgtggctctggacttacatcggaaaatacggagcgctggagctgccgggagttccgccgctgactccgcgtgccgtcggaagctacttcaagcgtcaggcgggcaatatctgcggcggttttgtggaatccgaatcggatttcgagctgacgcagtatctgaatctctatgttttttccaaagtggcatgggacaaccggacggatgtcgatgcgcttctgaaggagcatcaccgtctgatgttcggcaagggcgccgctcccatgggcaggttcttcgaccgtatcgaagaactctggatgaaccggattgccgggcggattgtcgagacgccggtcggtcctcaggcagtg

SEQ ID NO: 25 - DNA, 1002 bp, Unknown
  Description of Unknown: sequence from a bacterial species not precisely identified
atgagaattttcagggtattcgcaccgttcggcaatgcaattgatttgacgataagaaaacttttcaaaccgttcaatcttgctttctacctgaaactggcattcattgcgtggctggcgaatctgggacagtgttccggcggattcaactttcccatcgacggaaacgatctgaaaacgttcctcaactcattccggcaggaacagccctcattccaaaatgaccccgtcctgaaaacggcggacggcaatgccacctatgaaaaggtaacatttgaagataaaaaagagacggaacgcatttccgtcaaagttgaagaaggaaaaacggaagtcacgacacccgcgcagaatgaaaatccgccgcagtctgtaagcatatcctccacaaaagacggaaaactccggtttgccggaaaagaggacaagctgacgtcaactttctggactctgcttttcatcgtcggaatcccagtcttcctgtttatcctggctctctgcattgcagtcctctgggtcatttcccgcggacggatgatgttcatcagcgcactggcggatgatacgcagcggctttctctcagggaaaaatggcgcgaaagccgcatcaccggaaattcccttttcaaatacaatatcacagtcgtagttctgtcgcttcttttcgtcctgatcttctgtccggcactctattttctcctgcaccccgtaaccaaaacatggattgcggcgccaagcgcaccgattgctccggcgcccgccatcatcgccctgctgctgactttctgcatcgcaatcccgttcggtttcgttctgggggcgttccatgaattcggaacgcttctcatgttccgcaggcagatcacggcatggccggctttcaagcaggtattcgcactggttgccgccaatatctggccggttctgaaatattatattttcatgattttcgcctcactcgtaattggtctctgcctgattttgcttttcatcgtcacatgc

SEQ ID NO: 26 - DNA, 4005 bp, Bacteroides nordii
atgagatatactgttattagttttattgtgttgttgtgctgggtatttgatacccatgcacaacaatatcatatttctacggaccatccggctgttacttttgaaaaagagaatccgcttttcttatctatatacagttggccggagactctgatcagctatccggttactttttctccggatagcaatgttgagaaccgtttggagttgatagatacccggaccggaaatccggttgcttttcaactttcggataagaagtacgataacaatcgtatttgctctgcacgtatccattttttcgcctccatgtctgccggaggaggttttaagtatgttttgcggttaggcagccggaaaatgaagtctgatcatccggtatacatcgaacgaaaaacggactgttggatacttggaaatacggattttagtgttgccattcctgtaactgctaccgtgaatgacaatatcgctccggctccaattctttctgtttcaaagggagaaggagcttccggtcgtaacaggttgtactccggtcataagaaaatagtgtccgtagagacttccgtaaaagagaatggagagctgtttgccgagtgtctggtactttatcgtttggagggaggagccgagtatcggacttctgttaaggtggtacaaggctatccgtttgttatcttcgatgaagagatgagtggaatagaaaaacaagacggagtttttgtagatatggagtggaccggcttccatccgactcataaatatgctaactgggaccgtcagaaagatgtgaccgttgctgacggagtacctgttgaacaacctctttataccagttattgccaggaagatccgcattggacaggtgaaggatggatagaacaggttgacaaagaaatggtatatcgtttgttgcctttcggaggaaactctacacgggagcaggttcctgtgatgactttttgggagagtggaaaggatgcccgtgagttgggcgtatttgtttatgaccacaatcgctggaatgatcggcaatacggtatttggcagcctactcccgatctgtctgtctatttcagatatgcggatcagaaactctattttaagtatccggtacaaaatggtacgcgctctacagcaatagcatttacccggatcggtgatacacaccccaaagtggaggctttcaataagagtattgatgatattgcggctaatggcggaaaagaccattcggccgaaatggtattccggtatacgatgatgcttcaccggcaatatgcgttactgaatctggataaggtgaagaactggatactggaatatccacgagaagcgaaacgccccgaaaatccttttgccaaaagacccaaagaaacttctgccgatcggttttataagcagatggtcacttctccgatggcgtattatatgaccgggatgaacagttttccgggtattcattctatttctcaccgcccggtttattcacagtgggtacaggattatctgacttactacaaagatttgtccgacgaacaacgtaagactgttgaggctcttttcttattggccggttatgtgaatatgcttgaaccgatgaatgccattcgtacttcattggcaggcactgccaacatggctgccgatggatgggcggtgaccggacaaacggcttttcttttcccggaacatccgatggcaaaggagtgggctgatttctttgagaagtcgattgaagtttatggtttgttttatacccgtccggaagtcagctcctatgagtctaagggaggacgttgggtagaaagtctgggagtgtacaattgggcttatctgcgtcctactgtgcattcgaatatagccttggaactgtttgacggtaaaaatcggtttgcagattctcatatggcggaaagggcccgttggatggttgatatggtaacgccgggacgagcttacccacctcatggtgcacacggtggcggcagattggtgccgcgttatgcgcctgtttatgaattaggaaactggttacagtattatgatccgctggtagccgaaaatttacggtggttgggagcgataggagaagatgtggaagagaaggcgaatgatacgaaatgggtagaggtacataagaatatgcatcagacgaaagatacaggtacgaatccgcatttgaaaagttgcaaatataccgggcatgggattgtacttcgtgccggagttgattcggatgaggaactttccatccatctgaatcagatagacaaggggcccaattaccgctggggacatcaggggcaaggcaatgcaggcggtatctatttctatgtacaagacaaggtttataccggtcatgaaaatgaggcggtaggagatcatacccagaataatacggatggcgtaaccaatttcggagtcatgaaaaacggtactttctgtaatatcggaatgaatgagctggttgcccctttatatgatctggagatagctcagatggctgaagtacgttcggcagagggaaaagattcttttgcatggcctgaatatgtatcccgcagtattcttctggtagggaccgattattttctgatttacgatcagaccggaactaattggagagctttcaaccgcttttcatggttcacccggaaagaagatgaatttccgaagattgtatttatggataaagtacgtccggagtattggacaacagcagggactgcgaagtcgaaaggcttttaccgggatggtgttggttctttgctgacgctggttacccacaagaaagaatcggtacgtgttttggatggtaaactcactgttccggcattattagcaggaaatgatgtttatgaattcgttccggataaaagcaggactccgaaggggatagtgcagattgctacagataagagccgggatattattttcagggacagtgatcccattgcctggcattcggattctgtgactttcaaaggagaagcagggatggttcgccggatgaagaacggagatctgcaactggccctgttcaaaggttctgagattgctgctgacggtctgggtattcgtcttacgggtgagacagaaacagccatcgcattgacacgctttgtaagtggagattgtaaggggagattgaagtcggacggtcaggtgacgttgactttgacaggtgtgaaagggggaaaactctatatcgacggagtgatgtacaaagggaatatagccggagtgaaactacctgccggagaacattccattgaatatacagccaaagaacctgttcctgtgcccacaacgattgaggatgttgtttatgcaaaagccggcaacatggtttatttgtcaaagccccaatcggtgtcaaaggtccgtatggaactctcgaaagatggaggcaaaagttgggaagtatcaggcacaaccacaaaaactatatatatgttgcccaaactggcagatggtaagtatcatgtacgtgctgtctctgtcaacggaaagaaagaggctgcttctgcctgtgaatatccggtttatataagtaagtctccttctcattacccggaaggcttgaaacttcaacttgattccggtcggattgatctctcctggggtcaagtattaggtactgaagtttatagggtttacagaaggaagctgggtgagaaagagttcctgaaggtttatgagggaaaagctacttcttttgcggatgaacagcttcagggagttgttcctgcctttagcctgcctggtagtctggataatgctgatgccgatagaagtggaattattgtatacgagtatactgtgaccgctttaaatggaaatggagagagtgtaatggctccggtggtgaacagtgatcctgcttcatgggcaaactggtatccatctactgaactgaagttcaaacgtcgttctgcattctggatggaaccgtatgttccggctaatgcaattcccgggaagtattatccggattga

SEQ ID NO: 27 - DNA, 4458 bp, Bacteroides nordii
atgaaacacttacttactactctttcattaggggctttgctgcttatgggtgggcctactaccgtacaagcagagaaagtcaccgtgccattaacagaagatggtgcatggtcttttaactctcaacccagtgccgtttattacaacggaaaaacttattttacctggattagttccagtaaagcattaattgttgcgtcttacgatcacacaacaggagaaaccaaagaaaaggttgtatctaccggttattcggatgatttctcgtctcctgctattacagtgagaggaaatggacagttactacttttcagttcagacaataagaaagaaaatggcttctatagttggtattccaccaatgcggaagacattacagagtggtccagttctcaaaaacagactggatatggaatcagttccactactcctcacatggtgggaaatgatctggtcgtattctggcgttcaaaaaacaatataggttactctctctttacaaatgtagccgataaaaccggaaatttacctgcagttaaaacaagagcaggatttatcggctctgatatcggaaatgcatacgcaaaacgcgacgaagttccacaaatgcgtacttgccaagctgcagatggcactatacacatggtggttacacacttaggtactggcctgacttataaaaacagcacggtacattatctgaagattaataaaaatgccacaggagacaaattagaattcaaaaaggcggatggtacagcgatttccggtatgaatgtcaccgagtctaaaagtagtgaactggatgttattgccaaaggagaggataccaacaaggtatgggcgtatgatattgcactcgatgccagcagtaatccagtagtattgtacgatgctttcacagccgcagaagatggtactacaacaggacacacctactattatgcccgctggaatggaactgcatgggaaagtacagcaattaccaccggagacggagttcctatgagcgaatacaaagcagttgagggaaatacttttaaagccaagtcttaccaggccggaggtatctgcttcggagcaaatgatttgaataccgtttacctgtcaaagaaggcagccgaaggtactttcgaaatctaccgttacgaaaccacagataatggtgctacctgggcagagaaggaggtcattacttcgggaactcctgcaggcgaactgaatatccgcccgatagccattaaagatgctcctgctgatgtattctggatgcagggtatgtatgacaatcctactaactataaaacttccatctcctgtgccggagaaggagtagcaactactggtatcttctttggacaggactcttatgaattcgtagccaacgaaacgacgaaccttgacgtaagatttgctcctctattcgctacagacaaagagtatacactcgaatcaagcaatacgggagtggtagaaattaccgcagatggtaaagtgctttgtaaagctaccggtgaagcaacaatcacagccaaattgaagaacaatgcttctgtaagtaccacttgcaaggttacagtattgggagaatccgtctataagactttcatcaatcgtattattacggatgttgttgcaagtaaaatctccactattgaccaactcgataaaaacgtagcttcttatctgacacaattgcaagacgacggttcattccctgatatagactatgcatctgatgctcgcacagactggccgccaatgcaacatcttgacagactgctcgctatgggattggcttatacccaaaccgaaagcaagtattatggcaatgatgagctgaaagctaagatggacttaatgcttacctactggcatagcaaacagccaagttccaacaactggtatcagaatcaaatcggtgaaccgcaacgtatgggacagtacctgattgttatgcagaacttaggcaaagagaaaatctctgaagacctgttcaataaatctatcgcccgcttgaaaaataaaggcggaagccccagttctcagacaggagcaaaccgtgtggacgtagctttgcactggatgtaccgcgcttgcctgacagaagatgacaacctgatgcgtgaagcaatggatcagatctactctaccattgaatatactactggtgcagaaggtatccagtatgataactcatttactcaacacggacaccaattacatatcggcgcatacggtgatgtattcctggatggtatcaccaaggcttgcagctatgcagccggcactcgttttacagtaaccggacaacagctggatatcctgagcagtctggtaaatacgtatataggtaccattcgtggtggatatatgtcatataacgtaatcggccgttcttctacccgccccggtgcaaccaagaagggaacaggcatcatcgaacgcatgatcgcattagatcctgccaataccgataaatatgagaaaaccatcgcacgtatcaacggaactcagcaaccgtcttatggcttggaaccccgaagcacacatttcttccgtggtgactacacactccaccagcgtccggagtatacagtagacttgcgcttggtttctacccgtacggcacgcaatgaatatttgaaggacaacggcgaaggtatcaagcagtacttcatgtcggatggttctaccgcaatcatggtaaaaggaaacgaatactataacatcttcccggtatggaattatgcgaaagtacctggtgtaacttgtccggaattcacagaaataccgcaagccagcacttatatcaagatgggacaatcggcatttgcaggtggtgttacagacagcctgtgcagtgtatctgcttacaagtacatagacaatgaatttaatataaactcgtcggctaataaggcatggttcttcttcgacaaagagattgtttgtctgggcaacagcatcaagtctgcttctgaattccaggtgaacacaactgtcaaccagtgtttgctggatggcgatgtagtggtttcttccaatggtagcgaatctaccttgcaggcaggagattacaattacgaggataatctggactgggcattccacggaaacgtaggttactatttcccgcagaagggcaaattgcaactgaacgcaggtgaaagaaccggtaactggtatgacatcaacaccaactatgccgatgaaacagtgaagaacaatgtctttactttatctttcaaccacggcacacaaccaactgacggatcatacgcttatatcatcgttccgggcatcagcaaggatgatgcaaaggcttataagagcgataacgtcgagatcatcatcaacactgactctgtacaggctgtttatcacaaggaattgaaaatgtacggattagtattctacaaatcagcaggtttcagcaaacatggtttgacagtggaagctgacgcgggctgcgtagtattggtgaaggatgccgataaagcagaaacagtagtatatatctccgatccgacaaatggtagcagcccgatcaacttaggcattgaaactccggctgtgaaaggcagacgtcttgttacttatcagagtgaagctccttatcaaggccgttctatgaagttcgtggtgaatgaaaacacacctgcctcaaccggtagagatgttttggcagaccgttctgcatggaccattactacttctttggcaggcccggcagatgcaactgtaggaggagacgatcctaagaatataattgacgacagtaccgtaacatccttcttgtttgtgaaaccgggaaagactttctctggtatcgtagcaccggcagattatattccttcgttcacaattgatatgcagactccgcaggaaatagaatatttcgtctatcgccaccgtgattatagcaatactacagcaagtctgagagccaatcgcatatctttctatggcaagaacaatgaagcggatgaattcactcccgtcctggagaatataaccctggatacttctgtagccgaaaataagatattgttgcctaataaagtatctttccgttatatcaaagtaacgattacagattacgacaaaattaacagcagcaccatccaggtttctgactttaacatcggtaagaaaacactgatggatatcccggaaagcggtgatccgactggtattacagaagtaaaagccggcaacagcgactttaccgtatcagtttatccgaatccggtgaaacaaggagaacaggtacagatcatcacaagtaatactcagggtatcgaattcaagttgtatgacacaacaggtagtgttcgggcacagggtaataccacaacgattgatacaaacagtctgtcacaaggcatttatatcctgcatgtaacagataaagctgccggtcagaaagccacagctaagtttatagtacattaa

SEQ ID NO: 28 - DNA, 2703 bp, Bacteroides nordii
atgatagtatcatttaatattgaatatcgtaccagctggggagaagaagtaagagtcacgggctccatccccgaattgggagaagacaatcccgaatactccattccccttcgcactgtagatggaattcactggacagcagagactgaaatacaagtccctaatgaaaaatttgtgaactatagttatctcatctggcaagacggaaaagtggtccgcaatgagtggaacagttttccccgccgcctatatctaacagatgacagtaagaaaagatactgcatcaatgactgttggaagaatcttccggaacagcagtacttctatagttcagcttttaccgaatcattgctggcacatcacagtagagcaggcgtacctcaaagttacaaaaaaagcttagtgataaaagcatatgctccacgcatcaacgaagactattgtgtggctatctgcggcaatcagaaagtattgggcgattggaatcctgacaaagcattgttaatgagtgatatcaatttcccagaatggcaggctgagatggatgcaagcaaacttaaattcccgctggaatacaaattcattctctacaataaaaaggagaaacgtgccgaaacatgggaaaataatccaaatcgctatatggctaacccggaattgaaagcgaacgaaacgcttgtcatctccgaccggtacgtctattttaatatccccgcatggaaaggtgccggcgttgctgtgcccgtattctcgttaaaatcagataagagctttggcgtaggagacttcggagacctgaaacgcatggttgactgggctgtaagtacgaaccagaaaatagtacagatcctgccaattaacgatacgacgatgactcacacctggacggactcttatccgtacaacagtatctctatctatgcttttcaccccatgtatgccgatctcaaaaagatgggtacactgaaagacaaagaagcagctgccgcctttaatcaaaagcagaaagagctgaatgcactttctacaattgactacgaagcagtgaatcagacaaagtgggaatacttccgtcttatcttctgccaggaaggtgaaaaggtgttagcttccaaggcattcaagaaattctttgaagccaacaaagagtggttgcaaccatacgctgtattcagttatctgcgcgatgctttcaaaacgcctaacttccgcgaatggccccgccataacgtatacaacgcagaggagatagaaaagatgtgccaaccgggagctgtcgattatccctttatctcaatctatttctatatccaattcaacctacatctgcaattgcttgaagcgactacatatgcccgcgaaaacggggtagtactgaaaggtgacattcctatcggtatcagccgtaacagtgtggaagcctggacggagccctactatttcaacctcaacggtcaagccggtgccccacccgatgacttctctgtaaacggccaaaactggggattcccaacctataactgggatgttatggaacaagatggttacagctggtggatgaaacgtttccgtaaaatggcggaatacttcgatgcctaccgtatcgaccacattttaggtttcttccgtatctgggaaataccgatgcatgccgttcacggactattaggacagtttgtacccgccctgccaatgagccgggaagagatagaaagttatggacttcctttccgtgaagaattcctgaaaccttatatacacgaatatttcttaggacaagtgttcggaccacacaccgattatgtaaaacagacatttatcgagccaactgatacctgggaggtataccgtatgcgtgatgagtttgacacgcaacgtaaagtagaagccttctttgccggaaaaacagacgaggatagtatatggattcgtgacggactgtacgcactgatcagcgatgtattgtttgtgcccgaccgtcaggaagcagataaataccacccgcgtatcagcgtacaacacgactttatctaccgttcgctgaacgactgggaaaaagctgccttcaaccgtttgtacgatcagtattactatcatcgccataaccagttctggcagcagcaagcaatgaacaagttgccacagttgacacaatctacccgtatgttggtatgcggtgaagatctcggcatgatccccgactgcgtcccttgggtaatgaacgacctgcgtattctcagtcttgagatacagcgcatgccaaagaatccaacttatgaattcggtcatttgaatgagtatccgtaccgttctgtctgtaccatttcaacgcacgacatgtctactttacgtggctggtgggaagaagattatcagcagacacagcgttactacaacaccatgcttggtcattacggcgctgctccggcagtagctactccggaattgtgcgaggaagtagtccgcaaccacctgtacagtaattccatcctctgtatcctctctttgcaggactggttggcaatagatggaaaatggcgtaatccaaacgtacaggaagaacgtatcaatatacctgccaacccacggcactattggcgctatcgcatgcatctgacgctggaacagctgatgaaagcagaaagcctgaacgagaaaataaaagagttgattaaacagacaggaagaaagccggaaaaataa

SEQ ID NO: 29 - DNA, 2994 bp, Bacteroides nordii
atgtttcttcacaagctttacacaggaagtttatcggttcctatatctaaaaaaacaacaattagtgtatgttttcggactattttatcccttccttatcataaagatacactatctttgaccctcagagtattattaataaaactacataccatgaaaaaacttatcattgcgactctgctcttaggaagtactccgatactttcggcacaaaaaacaatgaagttacctgccgtatataaaccggtaaaaaccgaaatgtataaaaaaggctggatagatttcaataaaaacggcatcaaagatgtatacgaagatcccactgctccgatcgatgcacgtattgaagacttactcagtcagatgaacctgaacgagaaaacctgccaaatggtgaccctctatggatacaaacgggtactgaaagatgcattacccactcccgaatggaaacaaatgttgtggaaagatggtatgggagctatcgacgagcatctcaatggattccagcaatggggcttacccccctcggataatgagaacgtatggcctgcttcgcgtcatgcctgggctttaaatgaagtacaacgtttctttatcgaagaaacccgattgggtattcccgtagatttcaccaatgagggaattcgtggagtagaaagttacaaggcaaccaattttcctacccaattgggattaggacatacctggaaccgtaaactcatccatcaggtaggactcatcaccggccgggaagcacgcatgctgggatacaccaatgtatacgctcccatactcgatgtaggacgtgaccagcgttggggacgctatgaagaggtatatggagaatcgccctatctcgtagccgaactgggcatcgaaatggtaaaaggcatgcaacacaactatcaggtagctgctacgggaaagcactttatcgcttacagcaacaacaagggtgcccgtgaaggcatggcacgagtagatccacaaatgtctccgcgcgaagtagaaatgatacacgtttatcccttcaaacgggttattcaagaagctggattgctgggtgtgatgagttcgtataacgactatgacgggctccctgtccaaagtagctactactggctgatgacgcgcttgcgtggacaaatgggtttccgcggatatgtggtttccgacagtgatgcagtagaatacctctatacaaaacacggtactgccaaagatatgaaagaggccgttcgccagagcgttgaagcgggactgaacgtgcgttgtaccttccgttcaccagattcatacgtacttcctttacgggaactggtacaagaaggcggactaagtgaagagattatcaatgaccgtgtacgtgatattctacgggtaaaatttctcgtcggactttttgatactccctatcagacagatttgaaaggagcagatgaagaagtagagaaagaagaaaatgaaatcgtagctttgcaggcatcccgcgaatcgattgtactactaaaaaatgacaagaacgcacttccattggatgtagcttctatcaggaagatagctgtctgtggtcccaatgcagacgaaacagcctatgcactgactcattacggaccattagcagtggatgtgactaccgtgctcagtggtatccgtcagaaagtagacggaaaagccgaggtgctctacaccaaaggttgtgaattggtagatgccaactggccggagtcggaaatcattgactatccgttgacaaacgatgaacagaacgaaatagacaaagcagtggcacaagccaaagaggcagatgtagcagtagtggtactgggtggcggacaacggacctgcggagaaaataaatcccgcagcagtcttgatcttccgggacgtcagcttgacctgctgaaagcagtacaggctacaggcaaaccagttgtactggtacttatcaacggacgtccgctctctgtaaactgggcagataaatttgtacctgctattatagaagcctggtatccgggatcgaaaggaggaacggcagtagccgacgtactgtttggtgactataatccgggtgggaagcttacagtcacttttccgaaaagtgtaggccagatcccctttaactttccctgcaaaccttcttctcaaattgacggtggtaagaatcccggtccgaaaggtaatatgtcgcgtgtgaatggtgccctttatccatttgggcatgggctgagttatactacatttgaatattcggatatcagtatttctcccaaagttattactcccaaccaaaaagtgcaagtgcgttgtaaaataaccaataccggaaaacgtgccggagatgaagtggtgcaactttatgtacgcgatatcctgagtagcgtcactacctacgaaaaaaatcttgaaggatttgaacgtattcatctgcaaccgggcgaaacgaaagaagtatcattcactctcgaccgtaaagcactggaacttctcaacgccaaaaatgattgggtagtagaaccgggagacttcagcatcatgctgggtgcttcttcggaagatatccggttaagtgatatcctgactgtaaaagagtatggtaccatagagacaggacaaacaaaaacagccaaccctgtcagtgccagcactaacggagaaatgaagaataatgtacttgataacaatttatccactgtctgggaaggaaataaaggagattatattacctttgctcttgagaacggagccaaagtagacggagtttccatagccttcagccgcgccaacggactaccagccgaatttgaaattcaactctcgggtggcggaggacaattccttaccgtatactcaggcactgtaaaagagtataacaaactgcttcctttccgtttcaaaggaaccactgcaagcgatctgcgtatcgtactgggcagcgaccgtgtgggtatctcagaagtgaaactggaacagttgaaaaagaaataa

SEQ ID NO: 30 - DNA, 4137 bp, Bacteroides nordii
atgacaaaaaaaatacatgatcaattaaatagaatagcgataaaaactctgctgatatttgttttttgtttcggtttcttttcatcttccaaagcaaatgatgtgtatttccatcatttgggggtaaaagatggattaacgcaaatcagtattttctctttttatcaggatgaaataggagctatgtggtttggctcatttgaaggactgaatagatacaacggacgtgagattaccgcctttcgtccttcacaaaataataagggattgacccagaatgaaatctattcaatttgtggtaataagaaaggtgctatctacttacgggccggacacgatctggtgaaatacaatgtttcaacacagcaatttacctgtttggcacaaaaagaaattaatggtatttgctattcaaacgatacgctttgggtgatatccgatcatgctatattttattatctggagggtaaagaaggtttgcgtaagttttgtgatatagatccgggcctgggaaacggaagttgtatctttacggctgataatgaatatttgtgggtagggacagaaaataatttattgtctataccattcagtgcacccgattctccgaaagtggtgttatctggtgtttttgtgaaatacctgtataagagtaagagaaatgatttgtgggtaagtacggatgcgagtggtgcttatcggatttcatctcagaatcagataacaaacttccgttattcaccgggtaagaatgggatttccgatgatcatgtgagaagtgttgttgaggatgaattcggaaatatatggattggcacattttatgggttaaataaatatgatcctattactgataaatggaaatgttatactcaaatagacaatgttccctatagtctaagtcattcgtctgtttttggtctttatagagatttacaagggaatatctgggtaggaacctattttggtggtattaatcattttaacccgagagccgatatttaccatttctatggagcgatagggcgaaataaccccaactatcttagttttcctttcgtaggtaagatggcagaagataaaaacggtaatttatggatttgtactgaaggaggagggcttaatttctttaaccgccaaacgaaacaattcaagagtttcatgcaggaagataaccccaggagcattagtcataataatctgaaatgtattaaatatctaaaagataaagatctgctatatattggtacgcataccggtggacttaatatatttgatataaaatcccaaacggtcaaggttttgaagaataatccgggagagcctgcttcattgcccaacgatattgtgaacgatatacaattttataaagataaactcattgtactgactcaggcaggagtttgtagtatggatttgaaaagtgagacgttctcttctctttctactaatgaggtaattaaccgggcagtagaaaggaagttttattatgaaacttttttgattgatagcaaagataggatgtggattgctaaatcggacggaggaggggaacggattgatttgaataataataaaataaaagaatacaatgctgtaatggaggattctacttctattggtaaatttagaattactcatattttagaggatagtaaggggaaactttttttcgggactttaggttccggattgttcctttatcttcccgagacggatacattcagaaattttacagcagaaaagggagatttacagagtaactattgttattatatagccgaatcaccttatgatcatcttatggtactgcataacaaaggagtttccttttttgatcctgaaaccagaacattgaaacatgtttgcggaatacctcaaatgagttttaaccaaggttcaagtgtctgttctaccaaagacggagaggttttctttggtggaattgatggattgacatccctttatgaacagttactttataccactaaaaaagaataccagctttattttgataaactttggatatccaacagggaggtcagaccgggagatggatctggtattctttcttcggctttatccaactataaggagattgaacttgattacaataaaaacaacctgtttatcgaatttgctacttcaaactatgtttctaataacgattttcagtatgaatataagttggtaggacttgatgatacctggcttccggcacattctactactatcagttatactaatttaagtccggggaaatatcgtctgcttgttcgggaggtatgggaagatgccaaaacggaaacaaaacaaattgaacttggcatcaaaattaatccgccattttatgctacagtttgggcttatctgctttacgcattattggtggtaggtattttatatgctattttccgctttaatgtgcggcaggcaaagttaaaggcctcattagaatatgaaagaaaggaaaaagaatatattgaagaattaaatcagacaaaacttcgtttctttaccaacatttcgcatgagttccgtacactgcttacccttattattgtacaggtagaactattgttgcaacttaataaactcaacccatccgtctacaaccgggtacttaaaatttataagaatgccagacatatgcgtgatctggtgtcagagttacttgatttccgaaaacaagaacaaggattcctgaagctgaaagtggaatatatggatattgtatctttcactaaagagatctatatgtctttttatgaatatgccttgaaacattctgttaactataagttcgaacatatggaggaaaaactgaatctttggtttgatccggttcagttgcagaaggtaatattcaatcttttatctaatgcctttaaatacaccaaagcaaaaggcagtattactgtttctatccggaaaatcaagaatgaagtggaaatacgggtagaagacgatggtgtgggtatctccaaggaatctattcacaagatatttgatcgtttttatcaggttgacggacagagttcagagtttacgttgggtacaggtatcggattggctgtatccaaaggaattgtggagttgcataagggaaacatccgggttgaaagtgaagttggtcagggtagtgttttcattgttacgttgctgacaggcaatgaacatttcccaaaagaggtattgagtgatagtgaatccaatttccatctgataaaagatggagtattggaagatctggctttggaagagctaatgctggaggaaccggctaaagagcaggagcttactaatgaagagaaagccggagaaatggatattgaatcgaaggattctgataataagcccagtattcttattgtagaggataatctggagatattggaaatgttggaagatatcttcgctcctatttatcatgtatacaaagctaccaatggtaaagagggttttgaagctacgcgcgagttacatcccgatattgttttaagtgatgtgatgatgccggagatgtctggtaaagagatgtgccataaaattaaaaacagtctggacgtatcacatatcccggttgttttacttacggcgcaaacctctgtggaatatacggttgaaggatatatgtttggtgcagatgattatgtaacgaaaccgtttaatatcaaagtacttgtatcacgttgcaataatctggtacggacccgtagaatgttgcttgaaagatttaatcatgtttctaagacaccggttgtttctaatgccatcaatgagcaggatcaggaattaatagatcgtgctactgctattatccgaaaatattttgaggatattgagtttgatatgaatgtattggctgccgaattgggtattggccggagtaaattgtatctcagaataaaggaaataaccggacttactcccaatgagttgacgcttaaaataaagcttgaagaagcgatgtatttgattactaatcagcccaatctgaatgtttctgagatatcctatcagctgggcttttcatcgccccgttattttagtaagtgttttaaatcattctatggtgtatctccacagaattgtagaaaaggtaaaaacaagagtgaagagtcagaagaagattaa

SEQ ID NO: 31 - DNA, 7398 bp, Bacteroides nordii
atgagaatgatgtgccaatatgctaatgtatcgatgtgccaatgtgctgtgctgttatatcgcaggttcgttggcacattggcacattggcacattggcatattggcacattaccccattgtcatattattcttatttttaggaagtttgcctgttgcagcgcagatactgcaacctatgcccattgttgaggaaaaggtagagtatgatgcattgaccaaccgctatttgatccgtactattatcggcgggcaggaaatggacgttcctatcataatgactcccgctgagtacttagattggagtatgaaacgctccatgcagaattactaccgtcagcgtaatgactccgtattttctaagggaaaagaggagtttgactttacgaatatgaaatttaatcttggtccggctgaaaaaatatttggtccggggggtgttcagattcgtactcagggaagtgcagaactcagtttgggagtaaagtacaacaatgttcagaaccctactttgcctgaaagtatgcgtaaaacctggggatttgattttgatgagaaaattaatattaatgtcaacggtaaggtcggggataaggtaaaccttgacatgaattataatacggacgctacttttgacttcgacagtaaaaaactgaaactgaaatatgagggcaaagaggatgagataataaaactgcttgaagcgggtaacgtgagtatgactaccggcaactcgttgatacgcggtgctacttctttgtttggtgtgcgtgccgatttacagtttggaaagttaaagttgcaaacagtgatcagccagcaggagagtgaatcaaaaaccgttaatagtaaaggaggggcacagaccattccttttgatttctcagcagatgaatatgatgagaaccggcacttctttctggcacactattttcgcgatacgtatgaccataatatggcacaattacctaatattctttccggagtgaaaattaaccgggttgaggtttgggtaacgaataagcgaggtaattatgagaacccgcgtaatattgtagcttttacggatttaggagagtctcaagcctatattagtaagggagctccgtggatcgcaatctctaaggacacccttccacctgctaatggtgataataatctttatcagcagatgacaagcacctatagtgctgcacgtaatataagtgcagtaaattctgtgataggagatatagacgggatggaaagtggcatgaactatgaaaagatagagacggcccggttattgacttcctcggagtatacagtgaatactactttaggttacatctctttaaaacagactttacaatcagatgaagtacttgctgtagcttttgattataccattaatggaaagacctatcaggtcggtgaattttcatccgatatcaaggagacgtccgattgtcttttcgttaaactgctaaaaaatacttccaactctccggatgctgcttgctgggacctgatgatgaagaacgtttactcactgaatgcctatcaggtacagaaagaaaaatttacattaaatatcacttatctgagtgacactaccggagtttatttacgttatattccggagggtaagatcaataagatacctttacttaaagtaatgaatctggatcgcttgaatagtaagaatcagctcggaggtgacggctttttcgattttgtggagggatatacggttaatgcacagaatggccgcatctttttcccggtagtagagccttttggatcgtatctggagaaaaaatttgataatccgaacattgctaagaaatatgttttcaaggaattatatgactctactcttaccgtagcgcgtcagttggctgagaagaataaattccgtttacaaggtgaatatcgtgcttcgtctgccaatgaaatacgtcttggttcgatgaatgtgccacggggatcggtacgggttacggccggtggacggacactgactgaaaattccgactattcggtcgattatacaatgggagtagttacgatcctcaatcagagtattattgatgccggaactcctatcagtgtaaatctcgaaagcaatacgtcttataatatgcagcgtaagacaatgctgggattgaactttacgtatgatttttcgcctgatttccagttcggaggtactgtgatgtatctgaaagagaagccgctgactaccaaagtggctatgggagacgaacctatatcgaacaccttgtggggattgaatgcctcctggaaacgtgaaagccaatggttaactaatatggtagataagttaccgtttgtggaggctactgctccttccaatattaatctcggattggaatttgctcagcttcttccgggacatgggggaggattgcaggacaactcttcttatatagatgattttgagagtgcacaaagtggtatcgatctgcatcagcctttgtattggcaaatttcttctacaccttctaaggcaacaggacccgacaaggcgacagaactgtttcccgaatcgggattacctgatgataatattgattatggaaagaatcgtgccctgttggcatggtatcatatcgatggattatttacgcgccgtaactcttcacttactccgacacacattaagaatgacctcgatcaactctcgaatcattatgttcgtgaggtgtacgaatctgagttgtatcccaaaaaagagctgaataatatggaagcatctactatgtctatattgaatgtggcttattaccctcaggaacgcggcccttacaatctggacagagaccttgacgaaaatggtaacttgctggaaccggaaaagcggtggggaggtatgatgcgtaagattgaaacaaccgattttgaaaaggccaatattgaatatgttgaattttggttgcttgatccttttatttatgcagatggagatgaaccgggagcggataatacacgtagaaaaaatgcccgaagtacaacagagggcggatatctgtatcttaatttgggagatgtatctgaggatatcctgaaagatggtaggaagttttttgaaaatggtttgcctattgatggtgatgaatcaaaagtagactatacaaactgggggcgtgttcctaaagatcgtagccttgtatatgcttttgataatacggcaggagcacgtaaaaagcaggatgtcggattgaatggactttcagtagaagatgaacgtgcttatcctacttatgttgagtatttggaagaaatccggccaaaattgaatgcttctgtttttgaaaagttctacgagtcgcctgcaggtgataaatatcattatttccggggttccgattacgatgcagaggaaaagagtattctcgaacgttacaaatatatcaataataccgaagggaactcggccgctaatgaagattctcctgaggggtatccgacggctgctaagacttctcctgatatagaagatattaatcaggataatacactttcggaaacagaaaaatatttccagtatcgtattcatctgactccatctgaattgaaagtgggtacgaacaatattaccgataagcgtgtcactaaagtgaaattgcgtaacggccaaacggaagaggtgacctggtatcagtttaaagtgccagtacgcagtggtacacctgttggaagtatcagagatttcaagtcgatacggtttatgcgtatgttccttaccgggttttctaaacctgtgattttgcgttttgccactctcgaactggtacgtggtgattggcgtacgtatacagatccgttgtacaaccttcagaatcctgcacctacagtgacaggtaccttggatgtttcaaccgttaatattgaagagaatggggataagacacctattaactatgtgatgcctccgggtattagtcgtgttattgatccgggacaaccacagttgcgtcagcaaaatgaacaggctatgagcttgaaagttgaaaaccttgcgccgggtgatgcacgtgctgtttacaaaaattctacgatggatatgcgccagtaccgccggttgaagatgttcactcatgccggggctttaacaggcgatgtaactgaccctaaagacggagaattatctgttttcattcgtctgggttccgattatagttctaacttttatgagtacgaaatcccgttgaagctaactccggcaggcaattataatggagactcagatgttgataaactgatagtatggcctaaagataatatgctggatattgcactttctgtgtttactgacataaagaagaagcgcaaccaaacaaagaataattcgctttcgggggtaagttatggaaagctttattctgaatatgaccctgacaaaccagccaataaggtaagtatcataggtaatccgtcacttgcagaggtgaagacgatgatgattggtgtgcgcaataattcacgtgccaagaagtcggcagaaatctgggtaaacgaattgcgtctgtccgattttgacgaagagggtggctgggcagcacagggaaatatgaatgtgcagttgtcggatcttggaagtatcagtatggcgggacatgtagagactgccggttttggtggactggaacagagtgtaagcgaacgtcgcctggatgattattatcaataccagtttactactacgtttgagttgggacgttttttcccgaaggctgtgaaacttagcgcaccggtctatttttcatattcccgtgaaaagacttctcccaaatataatccgttggatcaggatatgctgttgaaagatgcgctggatgctttgtctacaaatgccgaacgagattcattacgtaatatcgctaatacgataacgacctataagaattttagtttgagtaatatgcgtgtgggagttaccagtaagaatccgatgccttatgatccggggaacttcacaatgagctatagtcgcacgaacagacataatcagggtagtaccactgtctatgagaacgaaacggactggcggggggcactttcttacaattatgctcctgtatataaagcctgggaaccgttcaaaggattgaagagtaaatcaaaatggatgaagttcgttaaagaactcaatttgagctatctgccgcagaatatctctttcaatacggacatgaaccggcattactatgaacttcagttgcgtgatatggagaacctgagtgatccggcagaaataccagttagtgtggcaaaggattttctttggaatcgtgacttctctttgcgttgggatctgactaaaaatcttcgtatgaactttacgtcagctactcatgctgaaatagaagaaccctacggagtggtgaacagaacgcttgatccggatgaatatgaagcaaagaaagatacaatacggcgtagtctgcttagtttcggacgtccgattgattatcaacagacatttaatgctacgtataaattgccgtttgataagttccctgttacagactggatgacagcagatacgcgtttcaattcttcttatagctgggatcgtggtgtctctctatctgatggaaaagaaatgggtaatacaattgcaaaccaacggacttttgatgtgaatgggcgtctcaatttggagactttatataataaggtgccttttcttaaagagacaaatcgccgttttgctactacctcttcgacgcgtcgtcctaataatcggcagaaagcaaaacctaaacggtatgaaaaagagatacagttgaagaaagatactactataaccgttcgtcacagtttaggttcgaaaaagcctaaggtttcagcactgacggttgatggtgatcgctatcctattcgctataaggtgatagatgctaatacgatccgtattgaaaccagagatagtgtccgggtgaaactgacggctatccaagggccgaagccggaggataatccctggtataaaatagcgcaatcggcagcacgcgtcgctatgatggtgcgtaatgtaagtattacatataagaatacatatgctatgactttgccgggtttccagcctgaaataggggatatgcttggacaaacgagagggagttccggtttcgctcccggtcttgattttgcttttggtatgacaggtggagattatattgataaggcaatccggaataactggcttattcagaataattctaatatagagcctgccactactaatgctcaggaagatctacagatacgtatgaccctggagcctttgcgtgatttgaagatagaccttaatgcagggcgcacacgcaatgactcccgctctatacaatttatgtacgatggaatgcccgaggtacgaagtggtaactttaatatgactgttataacgattggtagctcttttgaacgacataatccatccaatggatattcctcgtcttctttcaatcgtttcttaggaaatctggatgtgattcaaaagagagtagaacaattgtatcaaggcgtttcccttccgggaatggagcattatccgcagacttttaatagtattagtaaatacaattcgagtgtgatgatacctgccttcctggcggcttatacgggtagggatgcgggtaaaagctcgctggatattttcccgggaatactctcgatgatgcctaactggcgtgtaacttatagcggactgagtaaacttgagtttttcaagaagtactttaagagtgtgaccctgacccatggttatcgtagtacttatagtgtgggtagttatagtacttttcagagtttccatagctatatgggagatctgggatttgtagacgatgtacagacaggtatccctgttccttcatctatatacgacgtttcggctgtttctatcaatgagcaattctctcctttatttggagtggatgtgacttttaaaaatggtatcactaccaaagtggagtacaagactacacgtattctgaatcttagccttgcagccaatcaggtagtagagagtggaacgaaggattttgtggtaggtatggggtataagattatgggactggaactcttccccgggcgtaatacgaagaactctaagaataaaataagtaatgaccttgctttgcgtgcggatgtatccttccgcaatcagtttgcactttgccgggatattcagcaagtcactacgcaggctaccagtggtaacaaagcactcaagatatctttctctgcggattatacgctcagccgcttacttagtgtgagtctctattatgaccgtcagaagaacaccccgcttgtgtctgcttcctcctatccggtgaccagtgctgatttcggtatgcgtctgaagttctcactcacgcgatag

SEQ ID NO: 32 - DNA, 3129 bp, Bacteroides nordii
atgagaatcaatctacgtctattagtagcgtttttggcctttgttgtatctgtatcgttgcaggcggccgtacaacaggagaaacgtatttcgggtaccgtaatatccgacggagaaccattacccggtgtttccgtacaggtaaaaggtgccactaccggtaccattaccgatatcgatggaaaatattctatatctgcccctgccgatgggatacttgttttccgttttgtagggttaaagacggcagagaagcctgtgaacggacggagtaccattgatgttactcttgaatccgacagtaaggaactggacgaagtcatggtagtagcttatgccacagccaaaaagtatagctttaccggagccgcttctactgtaaaaggagatgagatagccaaactacaggtagccagtgtttcgcgtgctcttgaaggtactgtttccggtgtgcaggcaagtgcttccagcgggcaacccggtacggatgccgagatacgtatccgtggtatcgggtctatcaatgcttccagtgcaccgctttatgtagtggatggtgtgccttttgatggttccgtcaacgctatcaatccggatgatattgcctccatgacagtgctgaaagatgctgcttcggctgctctttacggttcgcgtggtgccaatggagtcattattatcaccactaaacaggggcaaacagactctaaaacaaccgtcaatgtaaaagcctccttcggtggttccaatcgtgccgtacgtgattatgaccgtataggcacaaatgattatttccagctctattgggaagccttgcgcaatcaatatgccaaggatacgcagaactatactcctgctacagccgccgcacaggcttcaaaagacttggtaaccaaacttatgggggatggtcccaacccttatggacccaattattcacaacctgtaggcacggatggcaaacttgtagacggtgctacccctctgtgggattttgattggagtgatgctatggaacagcaagccttgcgtacggagcttaacctcaatgtatccggaggcggacagaagaatcagtatttcttctctgccggttatctgaatgataagggtattgccctcgaatccgggtatcagcgtttcaacctgcgttccaatatcaccagtgaaatgacctcctggctgaaaggtggtgttaacatgagttttgcgcattccatgcagaactatccggtgtcttcggataccaaaaccagtaatgttatcaatgcagggcgtacgatgcccggtttctatcccatttacgaggtaaaccccaatgatggaagtatcatttataaagacggaagtcctgttcctgatttcgggccctatcgtccttccggttctatggcaaactggaacctgcccgctactcttccgcttgataagtccgaacggatgaaagatgagttttcgggacgtacttttctggaagttacctttattccaggtttgaagttcaagacgagttttaacttcgaccttatcaattacaattcactcgatttcacaaattcccttatcggtccttcggtcactaccggaggtggctcaagtcgtgtcaacacccgtactttctcctggacgtggaacaatattgcgacttatgataagacgattggtgagcaccacttcaatatacttgttggacaggaagcctattcttaccgttatgatgaactttctgcttcccgtacgaaaatggcgttacctaatatgcccgaactggtagttggttcgcaactcaccggaggttccggttaccggattgattatgccctggtgggttatttctctcagttcctgtatgattaccaggataaatacttcttctccgcctcttaccgccgtgacggttcttcccgttttgcaccggagacccgttggggtaatttctggtcggtaggagcttcctggcgtatcgatcgtgaagacttcatggtttctacttccgattggctttcagctttgactttaaaagccagttacggagcacagggaaatgataacttaggtacttactatgccagcaaagggctttataccattgtatccaatttaggggagaatgcacttgtatccgatcgcattgccactccgaagctgaagtgggagaccaatctcaacttcaatgtgggggtggacttctctttatggaacaaccgtgtatccggttcgttcgatttcttccagcgccgttccaaagatttgctctattcacgtcctgtagctccttctatgggatatagttcggttgatgagaatgtaggggcactgaaaaataccggtattgaactgacgctgaatggtacggtgatccatacagaggatttcatgtggaaacttggtttcaacctgacacattacaagaacgtagtcaccgaactacctttgaaagacatgcctccggtaggggtgaacaagctaaaagaggggcgttccgtctatgatttctatacgaaggaatgggctggggtagacccggaaaacggagatccgttgtggtatatggatatactcgataaggatgaaaatgtgataggtcgcgggacaacgaatgtgtataaagatgctactgattattatgtcaataagtcatctttgcccaagatatatggtggtttcaatacagcattctcttataaaggcatcgagctttcggcgatctttgcctatagcgtaggtgggtatatcatgaatcgtgatatcactatgattctgcacaatggtagtgccgaaggtcgttcatggtcaaaagagatattagatcgctggacaccggataatcggtatacggatgtttcggcattgggtactacttccaataactggacttcctactctacacgtttcttgcagaacaattcctatatgaggctgaagaaccttaccctctcttacacattgccgaaacaactcgtcaaccgggcgtcgttgagtaatgtacaggtttttgtacaaagcgataacttgtttactattcatcgtaatcaggggctcgatccggaacaaggcattaccggactgacctattatcgttatcctgcaatgagaactttctcgggaggagtgaatgtaacgttttag

SEQ ID NO: 33 - DNA, 2994 bp, Bacteroides nordii
atgattaaaaaattaatgttattattaacatgtttgctggttggcacaaacataataatagcgcaaacctccaaagtaacgggcgtagtaatctctgaagaggataatttaccggtcgttggtgcctccgtttcaattattggtactgatatggggaccattactgatatagacggcaacttcgctttatcaaacattccaagttctgcacataaaatacgaatatcattcatcggtttggcaacatacgaaggcgaaatcaaacccaacatgaaggttatcctaaaatcggattcacaattggttgatgaagttgtagttatcggatacggtacgggcaaaaaattaggttcggtagtaggttcagtttctacggtcaataacaaagtattagaagcaaaaccaactatgaattttgcagatgcactccagggacaagttgccggtatgcaggtattcacttcttcgggagaacctacagccacttcttcgatgcgagtgcgtggatacacctccctcaatgcaggaacctcacctttatatatattagacggcgcaccggtttcaaatgacgttttcacttctctcaatccaaatgatatagaaaatgtgacggtattgaaagacgcctcttcaacctctatctacggtgcacgtgctgccaatggggttgtttatattacaaccaagaaagggaaaatgagtgaaaaggcaaatattacgattcgcggacaatacggaatctcccaattaccagatttcaaaaaggacatgatgaatgcacaggaatttattcagtttaaattaatgtgtgacccttctttagctaataatgcacagtttcaggccgataaagccaagatagaaaaatatggtttaagtatggattgggccgactatgtattgagagataacactcctacttattctatagatgcgaacataagcggtgcctcaggttctacaaattattatgtaagcgcaggtcattttgatcaggaaggaacctcattccaatcgggcatgactcgcgagaacttcagggttaatctcaacactaaattgaaagactggttaaagtttggagtaaactccgccatttcctatcaggattatgcaaccactctgggtatcagggacaataatgaaggcgcctgggttaattcacctcttatattagcacgcacaggccgccctatcgattttccttatgaaatcataaagaacgaaaatggaacatggtcacgcggagaagatttactatacttaccaggaacaggatatactaacccaatgatgattttccggaattcatctatcaagaatgaacgaattttaggcaacctaaacacattcattgaattaactccgctaaaaggactgaccataaaaggagcacaagcttttgaaggatatatatataaatacagaggagtaaactacccctgggaagataatgaattcaacggaaatgtctctgagcagtttcaaagagcaagcaactggactttcaccaacacagttgaatacaaacatacatttgcaaagaaacatttcatgacacttttagccggacaagaatcaatcatacacaatgcagatggcttctctgcttctggtaaaggtattgaagataaacggttaacccaattatccgccatttcagcttcatcggcaaaagttgacggtgcacgttccgagtatgtattcaattcctactttttccgtggagaatataactatgacgaaaaatactatctggacgcttcattccgtagagatggctcttcacgtttcagtaaagaccatcgttgggcttctttcttctctattggagccatgtataatattaaaaacgaagctttccttaaggacacaaaatggttgaatgatttacggctaaaagtcagttatggaaccacaggtaattcagaaatagggaactatgcttctttaggtatggtagctggtagcggcaaatataactataataatcaaagtggctgggtcattggcacagttggtaactccgatttaacatgggaaactttgaaaaacttttcaaccggtatatctacccgggtgttcgatcgtttggatttcagcattgaatactatcgaaagaaaacggttgatatgctaatggacgtacccttctcactcactaccggacattccaccggtatgggaaatgtaggtactcttttgaataccggagttgacctgaatatgaatcttgaccttttgaacaccaacaacttcagatggagcgtatatgccaatttcaactataataaaaccaaaatagaatctctgttcaatgggctggacgaactggcatttccacaatatggtttgaaatatcaggtagggcatgatcccaatgagtattactcggtgttatgtgccggagtagatcccagagacggttcgctcatgtactacgacttaaatggtaataaaaccaagacattcaccatggacaacatgcaatttaccggaaagaaaatgtttgctccttgcagtggtggtttcggaacatctttgggctggaaaggaataaccatgatgatagatttttcatggataggtgaaagatacctcattaacaacgatcggttctttacagaaaatccaaccaattcaaatatggttaacatgaatagacgcatgcttagcatgtggcaaaaacctggtgacatcactgatgtaccgcgctatggcactgcaagcgaaaacttacttcgtaccaattactttttagagaatgcagcgtttgtccgtttaaagaacctgactatagcttatgaattacctaaaaacatattgaagaaaaccaaaatcatagagggaatcagagtatttgctaccggacgtaatctactcacattcactcaattctctggtatagatccggaaattgattcgaatctggcattaggagactatcccaactcaaggcaatacacaataggactggaagttaaattttaa

SEQ ID NO: 34 - DNA, 3585 bp, Bacteroides nordii
atgaaaattttgccagtttttatcagaaaacgaatgataaagattcgattttttaatattcttaaaaaagaatcacattcattcgttctaaaagtcacagtagcaatactattcctcttcaacacaggaatgctttatgctcaaaaggtttcggttcggtacaaagacgtacccttaaaaaccgtactaaatgatgttgccaaacaatctaaactccgcctggcatacagcggcagttttacggatttgtcagtgaaggtttcggtgcaggcatccgcaaaagatgtgaaagaagtactttccgagttaactcaaaaaacaaatgtaaattttgaaatacggaacggaagtatctacatttttctgaaagaacctccccaaaaagaaaaaaaagagaaagcaaacttctcattgtccggaactgtttatgacgaaaataatctccctttgataggcgtcaatgtactgatcaaaggttccaccaaaggaacaagctccaacatggatggagaattcaccattacagcggagaaaggggatattctcgtattgtcatatctgggatacacttcgaaagagttaattgtaaaagggaaagaacccatacgggtagtcatgtcggaagataccaaggttctctcagaagtagtagtaatcggatacggtgcagtccgcaaaacagatgtgacaggagctatctccagtattaaaatggatgaattaagtgtcactacgccaacactcgagcaagcattggtagggcatgctgccggtgttgaaatcaaacagacatccggaagcccgggtgaaggtttatcattgcgggttcgtggagtaggttctatcaatgccggctcagaaccactttatgtagttgacggattccccacatcaaaagatgtatatatcaacccgaacgatgtggcttccatcgaagtccttaaagatgcagcatcagccgctatctatggttcacgtgcagccggaggcgttgttttaataacaaccaaaagaggtacaaacagcggacgggcaaaagtagaatatgattttcaatacggttttcaacaggtagatcacaaaataaaaatgctggacgcttatggtatgcgcgatttttcaatagaaagtgctaacaatgcttaccgtgactggtgtatcaaaaacggaaaggaatatagtccattacataataacgagtaccgtatgtctgttgccggagcaaccagtggaaagattttccagataccggatatctttttcaatttcgaaacaggacaacccattgaaccggcttataatacagactggcaggacgccatattctccacagctcccattatgaagcacaatctgaacattaccggtggtaatgaccgggtaaagtatatggccagtgccggatatctggaacaagacggtattatcgcaccatcttatcatcaccgctttacgacgcgcttcaacattgacggtaagctgaccgaccgtttgagtataggagtcaacacggcagcctcctataccaaaaaccgaatcgtacaggcagaaggacgtcattacaatgatggtatcattatgagtgctctcgtgatgttcccgcaattcccggtatataacacagatggttcatacgccgtcgatcagcagatgcaatatgcgagaaaatattccatagcaccggctgaaaaccccgttgcattggcacatgagattgaagatttccaaaaaagatatatgtcatccgtctcgggatatctggatttggaaatcgtaaaaggcctaaaagcaaagatctattccggaatgcaatatatatcccagacagaaagttattatcgcccctcaacagtaggaggtactattatgaacaccgacggcacaacggccggtagcggatatgtgggtgatcagcggctttcaagggcttcttacagtacacaaaccaatcttgactggatattggaagcaacccttaattacaaccgtaccttcggagatcatgggataaacattttaggaggttactctatgcaggaaaaagtatatgataactcttccatcggtgcccgtaactttgtagatgatacgattcgggaattaagtgcccatggaactgctcccggagacagttggggagatactgataaattcgattgggccatgatgtctgtattcgggcgtgtagtatactcatggaaagatcgttatacatttaccggctctctgcgtggtgacggttcatcccgctttggaaaagacaatcgatggggaatgtttccgtccgttgctttaggttggaatatatccaatgaggatttctggacgaatcacatcggagaaaatttcggagcaaaattaagagtaagctggggtatcagcggaaacaataacatcggaaattatgagcatgtagggtatatgagtgatttaggcggttacgtattaggcggccaaatagttcccacacgttatccaagcgctttcgtcgacaacttactggggtgggaaaaaacagatcagtataatgtcggaatggacttgagtttccttagaaaccgtatcaccctgtccgccaactattacaacagtatctcgaatgacttattgttcaataaaccggtatcggccattgccggagcaactcaatataaatcaaacctgtctaatgccaaaatacgcaacaccggcttcgatattcaagttgacggacgcatcctcaccggggttgtaaactggaatataggagccaatctttccctgaaccggaataaagtactttcgttacctgactctcaatccattgtcagcattggggaaagaagtgctatcagccacataacaatggttggaaaacccatcggttctttttacgggctgaacagtctcggagtaatttcagaagaagagtaccaacggatactggtagataaacaacacataggtgaagaaggttatcagctcaccggcccggccgtatggaactacgaaaatgtacaaccgggtgatgccaaatggaaagatgtcaataatgacggtaaaatcacagacgatgaccgggagatattaggagataattatccggatttcacctatggattcagcaccaatatcagctacaaaggattaagcttaagtgcttccttttcgggagtacagggagcacaggttatcagtttccagaattactacttgctgaatatggaaggtacctgtaatcaatttgcattggcagccgaccgttacaatgccgtcactaatcccaatccggctatgtatcgtgccaatattgccaccactaacaaaaacacctatggagtgtcatcctatatggtgaacgatgcatcatactttcgttgtactaacatcactttaaactataacctacctcaaaaatgggtagaaaaaataaaattaagaggtatctcactttttgcctccgttgacaatgcatttacgataaccgattacattggctataacccggatgtaaattacaagtcgggcaatctgatgccgggtttcgactggggaacttatccactggcacgagcctataattttggttgtaaactatcattctaa

SEQ ID NO: 35 - DNA, 2892 bp, Bacteroides nordii
atgacgcatatgaaaaaacgattattacctctgattgtttcgtttctcctggtatcagtatgtgcttcggcctccgattggaataatttcattatcaactacaataaaactctttatggtaaaggttctcagacctggcagataggttcttacagcagtaattggagctattttgccaataaaaacggtatgctgcaatttgatggtaactcctggaatatctttcctttgaaaaatggttcggatgttcgttccgttctgccttccgtatcacagaaaaggatttatgcaggtggaattaatgaattcggttattttgaaccgggagatgatggcaggttgatttatacttgtatgtctgattcattggatgcgacttcacgggctatcggcaatgtctggggaatacatgaaaatgataacatcctttacttacagggagacggaagggtattgaaattcctcaatggaaagtatactaccattgaaatgaattgtaagatagactgctccgatatggtgaacggagttttatatataggtactgatcatggggtgtgggtattggtagggaatactttctttccattgcagggagcggaggtattgaagtcaaaaagaattcggagcattattccttataaagacggggtgcttgttgtgacggcttatgatggtttgttttactgtgatgggcgtactacggttccgttcctgacgggtgtagagagttttatgcggcagaatgaagtgttttgtgctgctgcttcgggtggtaagattgcattgggaactatacacaaagggattttgttgatagatactcaaacaaaacggataaagttttttaatgaatacaataacttacaaaataatacggtactttctgttgcttttgaccattggggaaatctgtgggcggggttggatagtggcattgattatgtttgtttgaattcatcgctgaccaatctttattcttatccctactcttacggaaccggttatgcggctttattgtcggaagatcgtctctatttggggacaaaccgtggattgtactatactcattatccggtacagttaactgataatctgcctgatatacatcctgtggctcaatccagcggacaggtttggaacttatgccgtatagatgatgatattttttgtttgcacgaccggggtgtctttctggtggaaggaaacagcatgaaaaaaatagcagatgtggctggggcctggggatgtcaaccggtggtgggaaaaaagcgcctgatatatgttggcgtttatgacggactttatctgatggaaaagaaagatgccgtatggaaggttgtttgtaaagtagaagggttgttcgactcttgccgttttcttgaacagcagtctgcttctgtgttgtggatatgtctttccggcgagattaaacgggtaaaactcagtgatgatctgtctcgtgtggtagaaattaaatcgtataatacgaataacgggtttccttctgacaaagatatatttgtaagtaaggtggatggccggatttgttttgctactccaaagggagtataccggtataatgaatcggccgattgtatggaaccttttcaggaaatgaacctgcttcttaatggggtgaatcaatattcgcgtctggtgcagtacaataatcatctgatcagccttagtcagcaggaaatttgtattgccagtctgagaaactataagaaaggggctgaaacctgtattgtccctattgagctcccttcagttgaattggtacaaggtgccgaagtaatcgtccctgtttctgattcgttaatgattattccggattatgatggttttgctctgtttaagatcccttctcataaccagcaaaaagaccatagtgacttgatacatattcgcaatgtgtacctctcttatcctaaggattctctgatttataccgataatttcctgtcggtgaaaagtacgccggaaattgcttataatcagaatgccatccggtttgaatatggaatatcttcattgacacacggagaggagcttagctatcaatataggttgaatgaccgcaagtggtctgaatatactaatgtacagaccaaggagtatagcaatcttccggaaggagattatacctttgaagtaaaggcggtgttccgaaatggtactacggctactgattctttctcttttcgaattcttcctccctggtatcgtacgggaatagcctatttatgttatttcatgctctttttgttgctgatgtggtatgtatataagtgggatgatctccgcgtgaaacgtaaaaagcaacaggctgtggtagaaaaagataaagaactacaggaactggaaaaagaatacgaagaggaaagtgcgcgcaaggagcgtcagatagtggaactcgaaaaggagaaactggagtatgagctaaaacataaaagtcaggaaatggccaatctgatgatcaattttgtacgtaagaatgagatgctgaccgagataaagtcggacttgtttaaagttgttacagctttgaagggtgagggatcaaaagaatacaaaaaaatgctgcttttagtaagtaataagatcgattcgaatattcagagcgatgaagtattaaagaggatcgaggaacagtttgacctggtgcataataattttatgaaaaggttgggtgaaaaacatcccgatttatcattcaatgaacgtatgatgtgtgcctatcttaagatgaacctctcttcaaaagaaatagcccctttgctgggtatttctgtccggggagtagaaacgatacgttatcgtcttcgaaagaaatttgagctggatagagaagatagtttgattgattatctgagccagaagatttaa

SEQ ID NO: 36 - DNA, 2490 bp, Bacteroides nordii
atgaaaaagtttctccccgacctcatcgccattctggcatttattattctctccttcgcttatttctttccggcagtcattgaagaccgggtactttttcaacatgacagtgttgccggagtaggagcaggccaagaggctaaagaatttcacgaacgtaccggtgaaacaacccgttggacaaacagtctttttggtggtatgcccacctatcagatttctcccagttacgattctgtcaagccactaaaatggatagaaaacatctaccgcctctatcttccaccctatgtatggcttacattcattatgatgttagggttttatatcctgctgcgagcattcggattgccagcatggctggctgggttaggaggtgttatctgggccttctcttcctattttttcatactgatagctgccggacacatctggaagtttatcactttagcctacatcccccccacgatagccggcattgtgctcgcatatcgaaagaaatatttattaggagccattgtcaccgctctgttcatagctttacaaatacaatccaaccatgtacagatgtcatattacttcttatttgtcatcttatttatggtaggtgctttttttgaagaagcatggcgtaaaaaagagttgcctcatttttttaaagccagtgctatattggtagtagccgccctcatcggagtatccaccaacctgtcgaatctctatcatacttacgaatacagtaaagaaacgatgcggggaaagagcgaattggtacacgaaggtcctaaagccgaacaaaccagtagcggactcgaccgtgactatattacccaatggagctatggcatcggcgaaacgctcagccttttcgttcctaatgtaagaggtggagcttctgttccgctatcggagaacaaggctgccatggaaaaagccaacccaatgtacaacgggttgtactcacagatcacccaatactttggtgaccagccaatgacctccggtccggtctatgtaggtgcttttgtcatggcactttttatattgggatgctttatcgtaaaaggtcctatgaagtgggcactgcttggggctacccttttctccattctactgtcgtggggcaagaatttcatgccactcactgatttcttcatcgattacataccgatgtacaataaattccgcgcagtatcttccatactggttattgcagagtttacaataccactgttagccatattcgccttaaaagcaatcattgataagcccgaggtattaaaacaaaaccgccgcggagtaatcatcagctttgcattaactgcaggtgtagcattgattctggcagtagctccgggcatacttgtacccagttttattcctgcacgtgaactggcagccctgcaacaagctatccccggagatcagctcttgccaattcttgataatctgaaagagatgcgcatgaatatggtaacctcagatgcctgggcaagtttcctgtttatctgtggtggtttcgttcttcttttcctctatcagcgaggtaagttgagtactgtatggacagtaagtgccattgccgtactttgtataggagaaatgtggcacatcaataagcgttacctgtatgacgatatgtttgttccacaatccgcacgtatagaaactttccaaaaaactcctaccgatgaacaaatcctgcaagataaatcattggattatcgcgtgctgaactttgcatccaatacattcaatgaaaataatacttcgtactggcacaagagcataggaggttatcatgccgccaagttacgccgttatcaggaaatgatagatcaccatattgccccggaaatgcaagccacgttcaaagagatagcagcagccggtggagaaatggacagtgtagatgccaataagttccgtattctgaatatgctgaatacgaaatactttatattccctgtcaaccaacaaggccagacagctcctattctcaacccctacgcatacggtaacgcatggtttgtaaacaatgtgaagtatgtcaataacgccaacgaagaaattgctgctgttggtgaagtggatctgaagaacacagctgttgcagatgctaaattcaaagaggctttgaaagaaaaaactgaaaatctcaaagtagattccctaagcacaattaagttgaccaattatgagcccaatcacctgatttatgaaacgtcctctccgaaagagggagttgtagtattctcagagatattctatccgggatggcaagctaccattgacggtcagccgatagatattgcccgagccaactatattctgcgtgctgtaaacgttcctgcaggcaaacacaccatcgaaatgcgtttcgatccgaagagtctgcatgtaacagaaggcattgcttacagtggcttggcattactaattatcggagcaatagcaggattgtggatctattgcagaaagaaacaataa

SEQ ID NO: 37 - DNA, 3210 bp, Bacteroides nordii
atgcttctgttaataagctgccctctaagcatttttgctcagaacaagacaattaccggtacggttcgcgatgcgatggacgtggtgattggtgcttctgtaactgtgaaaggcaacaactctgtcggtacgattaccgatattgatggtaattttaaactctcggtacccgcttctgccaaggagttggttgtttcatttgtaggctatgacaatcagactgtattaatcggcagtaaaactcactttgatattacattaaaagaatccagtgtgatgctggacgaagtagtggctatcggttatgcgaaagtaaaacgtagagatcttacaggagctacctcttctgtttcggcaggggaattggcagctgtacctgtaatgactgcagcgcaagccttgcaaggtaaagcagccggtgtgaatatcgtgactgccggtggtgcaccgggtgcaaaagtggaagtgacggtgcgtggtggtacctctattacgcaaagtaccaaacctctttatattgtagatggatttgagatggaagatgcactaacaaacattgacattaatgatattgagaatatcgatatcttgaaagatgcttcttctacggctatttatggggcgcggggttcaaacggtattattctgattactacaaaatcggggaagaaaggcaaaacacaggtgacttataatacttatttctcgtttgacaaactttccaagaaactggatatgatgtctaatgctgagcagtttacaaaatatcagtatgagttggcagcacttcagggtggattggctaactacagtaatgttttcgataatagtttaggtgtggatgctcctgatttttacaccggtgcttatggtcgtattgctgatcgctatgccggagtttctactctcgactggcaggatgaggtttttggtggctctgccctgactcagtctcataatgtaaatgtgactgccggtacagagaaaactcaagtaatgttgagttacaacttcaacggacaggatggtttgctggctaatcatggtatgaagaaaagcgcttttcgtgctaaagtcaattcagaactttataaaggtgtacgtgtggatgtgaacacgatgttttctaacaattcagttgatggtggcggtgcttactcgggtatgaagaatgtattgcttcaacccattattggtggtacgctttttactcaggatgaattgctacatacacagacttatccggacttttctgccttggattccagcttcgatacagccaatccgcttgtacaaaacgaggcttccacttctaacaaacgttctcgtatttatacggtcaatgcaggtcttgaaattgatattctgaaatactttacctggcgtacagccggtagttatacctggacaaattccaagtctacttcttttgctgatgaaaactctacttcctatctgatggatcagaatacgggtatgaatggtagcattgaaaacaaagaatcttataaatggcaaatcaccaatacgctgaattataatcagacatttgccaaaaaacataaggtaaatgtattgttgggacatgaagtcacttattctgaatctgaaggaaataaaatggaacttactaagttcccttatcctaatatctttgggttggataagattgataatgctaccgtaaaatcaaaatcggtaagccattcgcgtaatgggattgtttctgctttcgcacgtgtaaattactcctttgatgagcgttatttgttgactggtacggttcgtggtgacggttcttccagatttgcaaaaggtaacaaatggggtatttttccttcggtatccggtgcatggcgtatttcggaagaaggcttctggaaagataataaagtggcagatgttgtcaatagctttaagttacgtgtaggttacggtacaacgggtaactgtaacattagcgattacatgtatgtcacttcttttaaagagtctgattatccgatgaataatacggtaggctctcctgtttatattgtagatgaaactttaggaaataagaaattgaaatgggagactatgcgttctactaatattggtttggacttatctttcttcaatagtcgcttgaatattactgctgaatggtataacaaccaagtagacaacctgttgttgaagagtgtgattccttcttcaaccggttataagaatcaattccaaaacattggtaagatacgtaaccgcggttgggaagtttcaatcaatacggtgaatatacagaccaaagatttccgttggaccagtgatttgaacctggctttcaaccgctcgaaggttctttctttggagaacgggatcgagagcaagactttctctgtcggcagtaaccgttcgggtatggtgaactattatgcaaaagtaggtgaaagtttaggcgatatgtatggctatatttatgaaggtgtgtatacaacggatgattttgttcagggtacagacggtaaattggtgctgaaagatggtgttgtcagacctgaaaagggaacaccgcaaccgggtgatattaagtttgctgcgaatggtgtggataaagacggtaaccctcagttcactaaaaaagagactaagattggtaatggtactcctgactgtattggaggattcaataatacctttagttatcacggatttgatttgagcgttttcatgaaattctctattggtaatgatgtttacaatgccaccaaacacagtatgagcccttatgctgctttccagaatgtacctactgaatttggcgatcactactatcgcatgatcgatccgcagaccggcaaacaggctactactttggagcgttataaagaactgaatccgaatgaggcttctgccacatggaatctgagtaaaacaaattccggttatatcacttatccttcttcatattatgtggaagatggttcttacctgcgtattgcacaagtgacactgggctatacattgcccaaagtatggctgaagaagtttatgatttctaatgcacgtctttatttcacagccaataatttggcaacgattaccggttactccggttatgaccctgaggtttctgctggcaatgaccaggttgtttgtacgccgggatatgacagttctacttatccgcgttcaagaagttacgtcattggtcttaacttaacattctaa

SEQ ID NO: 38 - DNA, 3615 bp, Bacteroides nordii
atgaagaaacacatcattgcactggcatcaacctcactactatgcagtggctcctatagccaaaatacacaaccggagaaaaagcctaaagcctacatggttgcagatgcacacctggacacccaatggaactgggatgtccaaacgaccattaaacagtatgtgtggaatactatcagccagaacttacttctgctgaagcaatatcctgactatatcttcaactttgaagggggagtcaagtatgcatggatgaaagaatattatccggctcaatacgaagaaatgaagaaatatatccgggaaggacgctggcacgtgagtggtgccagttgggaagccagcgatgctttggtgccttcaaccgaatctgcgattcgtaacatcatgctgggacaggaatattaccgtaaggaatttggagtggaaagtacagatatcttcttaccggactgttttggcttcggatggacactacctaccattgcagctcattgcggactcaccgggttctcatcacaaaagctggactggcgtaacaaacctttctacggaaaaagcaaacatccctttaccatcgggttatggcagggaatcgatggttcttccgtcatgctggcacacggatacgattatggcaaaagatggaacgatgaggatttatcggaaaacaaggagctgttgggactgaccacacgtaccccgctcaatatggtataccgctattacggtacaggagatattggcggatcacccacgttgggttccgtacgttctgttgaaaagggaataaaaggaaacgggccactcgaaatcatcagtgctacaagcgaccagatgtttaaagacttccagccttataaggatcatccggaattgcctgtattcaacggagagttactgatggacgtacatggaacaggatgctatacttcacaagcagccatgaaactgtacaaccggcagaatgagcttttgggagatgcagctgaaagagcagccgtagccgccgaatggctcaacaaagctgcatatcccggaacaactctaacagatgcctggaaacgtttcatctatcatcagttccatgacgacctcaccggaacaagtattccacatgcctacgagttttcgtggaatgacgagttaatctcactcaaacaattttccggcgtactggcctcttccattcgttcaatagccggagacatggatacacaggtaaagggcattccggtaatactctataatgcattaggattcccggtacaggacatagcagaagtagaactggaagtgcccgcagcccccaaaggtgtcacagtatatgacaacaacggtaaaaaggtggcatcacagttactatcctacacaaacggaaaagcacacctgttgatagaagcaacagtaccagctaccggctacgctgtgtacgatgtacgtacttccggcacggcaaatcgctttgctgcaacaacaagtaacacactcgagaattccatttataaaatcacattggatgaaaaaggggatatcacctcgcttctcgacaagacgcaaaacaaagagttggtaaaacagggtaaagccatccgactggctctcttcacccaaaataaatcataccactggccggcctgggaggtgttgaaagagacaatagaccgggaaccaatctctatcacggataatgtgaaaatatcattggtagaaaacggagagctacgtaaagcaatctgcattgaaaagacacacggagaatcggtgtttaagcaatacatccggctctatgaaggaagtcgtgccgatcggatcgatttctacaatgaaatagactggcaatcaaccaatgccttgctaaaagccgaattccctttgaatatagagaatacggaagcaacttatgacttaggaatcggaagcgttaaacgtgggaataacaccgatatcgcttacgaggtatatgcacaatactgggccgacctgaccaaccaggacaacagttatggtgtatcgatattgaatgacagcaaatatggctgggataagcccaacaaccatacgctccgtttaacgctgctccatactccggaaacaacccggaactatgcttatcaggacaaacaagactacggacatcacaacttcacgtatagccttgtagggcattccggtaagctggatcatgcatctaccgtagagaaggcagaacttatgaaccaacgcctgaaagcattccagaccacaaaacacaaaggtacattaggcaaagagttctcttttgcaacctcagacaaccgcaacgtaattatcaaagcactcaagaaagcagaaagttcagacgagtacgtagtgcgcgtgtatgaaaccggaggtgaaaagtcacagcaggcaactttgtcattcgcaggtgatatactcaatgcgaatgaagctgacggcacagaaaaaacaattggtgctgccaacttcaatggaaacaaactgcaaatcactattaagccctattctgtcaagacattcaaagtgcgtttgaaaagtgctgcacaacctgcatctgaaccggaatatgtgaacctgccactaaattatgaccgcaaatgcgcctcatttaatgaattccgcggagaagcgaattttgagtccggatactcatacgctgctgaattactgccggattctatattcgcagatcaaattccgttccgcctgggagagaaagagacatttaacggcatgacctgcaaaggagacacaatctatctgcccgacggacataaatatactcatttatacttcctggctgctgcaacggatgatgattatacagttacattctgctgcgggaaaaacaaagcggaaatcaccgttccttcttacaccggtttcatcggacaatggggacacaccaatcataccaaagggtatctaaaagacgccgagatagcttatgtaggtacacaccgtcacgctccgggtgaagatcaggcatacgagtttacgtatatgtttaaattcggtatcgatattcccaaaggcgctgtaagctttatcctgccaaagaatgacaagattgtgctctttgccgctacactggccaaagaagaacaacctgctatgaacactgcatcacagctattccgtacagccatcagagaagaagccggcaagatattatctacacaggaaagtccgaaagaaaacttgctgaaaactgcgaagatcatatcttattcaggctatatgaacaaccgtgaaaaaccggaatgtatgattgatggaaataaggataccaaatggtgtgatacgggtatgactccgaactatgtggattttgatttaggagaggcacaagacatcagtggctggaaacttgtgaatgcaggtgaagagagtcacacatatgttacgaaagggtgtttcctgcaaggaaagaataatctgaatgaagagtggaaaacactggacaggctcaacaataacaaacgcaatgttgtttcacgacaactgtcagaacctgccaaagtacgttacatccgcttaatggtaactaatccgacacaagacgatgaagggaaagacacccgtatttacgaatttgaagtttataaatag

SEQ ID NO: 39 - DNA, 3237 bp, Bacteroides nordii
atgaatggcaatagtatagaaatgacccgggaagtaaatcttattaaggaacccggaataaatgaaatgatcagtaatcgcattcaggaggttctgaccaatgccgggatcaattttaccatcagtgatgtatttactgatgacaaaacaaatattcttataggaatcaacggttctaaaggaaccgcagacaattatacatccgaccattcactctctaaagatgttttcaccgttacatccaataaattcgacccctatctgttacagataaataaaaaccataacaagggcgatatactcattttaggtgataacagcggatcggcctattatggactggccacattggaacaaatactggaacaagctgataataaccacttatcaaccgccacttttgaggattatgcccatacccaataccggggtatcgttgaaggcttctacggacatccctatagtgtggaaagcagacttagcctgttggattactgcaaacgatataaaatgaatatgtttgtctatggccctaaagcagatccttatcatgcaggaaaatggcgggaagattatccgtcaaccctaacagatcagcaacgctatatgggattgatcacacaagacgatttacgcagcctggctgctaaggccaaagcctgtaatgtggatttcgtatggtctattcatccggcattggaaggtggaggtataaatttcagtaatttagatcctggaatcgaagacattatacacaaatttgatgctttgtataagttaggaatacggcacttcggcgtatctatcgatgacatgaacggccatccgtacaatcaatcggaattggcagataagactcagacaaaactatatgagaaattcaacaaaaccggagtcactgaagatgacaaagtggggcctttattatttgttcctacccaatatgcattgaattacggtaccggaacactttcggccttcaaaaacatacataaagatgtggtggtagccttcaccggttatgactgcttttctaatatccggggcagtgcttgcgatcggatggcagatctgataggacgcaaccctgtcatgtggtggaacaatccggtaaacgatgattatgacgaatttctttatatgcacggactcactgcacgctggagtatagaggataaaagcccggtctcttctctgcaaggactgatattaaaccccatgaatcagggacaagcctctaaaatagccttattcggtgcagcagattactcatggaatccttcaaagttcaacgaatccgataattgggaagcttcacttgcttctatagtgaaagaaccggaactgcaagatgcacttaaaacctttattaatatagtaagcgcatataccactcatgatacgcgaacaccggaaggtgaaaagttcgcacctctttatactgctttccaatcatcttattccaaaggcaatgtacctgacgctgcggaactaataaatgagatgaaaaaagcgaatgctgcctgcaaattattagcatcattaaaagagagtgaaaaccaggagtataacctgttttatgaagatataaaaagctggcttgccaaggtggaatcaatgacagatattgttgttaagtcaatcagttttatgaaaaacgatgcagggctttctgcatggacagactttgctgagattcaggcaaaagcacaaaagatacacactgattctgcctttctgttgagtgtgtttgaaggtaaaggtaccagcacatacgaggtgtttaaagaggttcagccaactcccaaatatctggacccgtttgtagatttcctggctgacaaaataaaggattatgctccgcaacttccggacagatcacgcgagatggaaattatcaccaatatctacaatttatcgggggtatccattgaaacgaatgacatgacattattatccggtctgaacactgttacattaaaaccggaagaatacgtaggcatctattttaatgcaatcaaagaagtggcagtcgagtttctacccacaaatcttacgagtacgctatctacagagtattctatgaatggaaaagagtggagtacttttataccggaccatagcattgctcaggaaatggcctatttccgtatcaaaaacaaaagtaaatccacacatgctattccaataaatgaaatatcattcagaatgccagcatcagaaagttcaattcctataaacgtaacaacgaatatgggaacttaccaaacatacaatataaagaatgtaatagacggaaattacgccacaaaattctggagtgacaaagcacaaaaggcaggtgaatatatccaactggactttggttcgtccgcagcccgttatcagaccaccctgcattttaccgaaggagatacacctacaggagaagcacagattcagttctctgatgatacacaaagctggacaactataagtacattcacttcttcggatatttcagataagctatatacctgcaatgccaatggtcggtttgccagatacgttcgcttgtatttgcaatctgtgggaggaggagactggttccaattagcagaatttgaagtgacaggtgcccgtatcactcctgtcgcggaagacaatgaaggaaacccggtggctttattggacgaccgtagcctttcgtcgggttataaaggtaaaggagaagggcatattatctatcgttttattgagaacattgcaataaatgaaattcaaatctttcataacagcatgttcacgtccgcaagcgctaagcctaccataatgatatattccaatgggaaatggattgccaaaggagagctggatgctccctgtacttccgttccagtctccgatttaaagaatatctcgcaactaaagattagttggaataaagacaatataccggttctttatgaaataatgcctatcggagagccgtatgtggaagaagtatcccctcctaccggtatcctttctgaaacaagttcttcaaatgcttcaatttttattgaaggaaattatgtacggatagaatcccggatattaatagagaggataatcattacagatctatcaggacaaaaaataaaagatataaacgtaaatcagaactccatagaaattccgatacatgaaaaacaggttttgatagtaaacgtatatcttaataataatgagacggtaacagccaaagtagcacgataa

SEQ ID NO: 40 - DNA, 2463 bp, Bacteroides nordii
atgaatatctcttataactggctgaaagagtatgttaacttcgatcttacacctgatgaagtagctgctgcgcttacttccatcggactggaaacaggaagcgtggaagaagttcaaaccattaaaggaggtttggaaggactcgtgattggcgaagtgctgacatgtgtggagcatcctaattcagaccacttacacatcaccacagtaaatctgggaaatggagaacctactcagattgtgtgcggagctcctaatgtagctgccggacagaaagtagtagttgccacattaggtacgaaactttatgacggtgatgaatgctttactataaagaaatcaaaaatccgtggtgtggaatctatcgggatgatttgtgcagaagatgaaattggtatcggaacttctcacgacggtatcattgtgttgccggaagatgctgttccgggtacattggccaaagattactataatgtaaagagtgattacgtacttgaagtagatatcactccaaatcgtgcagatgcttgttctcattacggtgtggctcgtgatctgtatgcttatcttattcagaacggtaaacaggctacattacagcgcccgtcagtagaggcttttgccgtagaaaatcatgatcttgatattaaggtaacagtggagaatagtgaagcatgtcctcgctatgccggtgttactgtaaagggggtgacagtgaaagaaagcccggaatggttgcagaataaactccatctcattggtgtgcggcctattaataatgtagtagatatcaccaattatattgttcatgctttcggacaaccgttgcactgctttgatgcagataaaatcaagggtggggaagtaattgtgaaaacgatgcctgaaggtactccttttgtgacattggatggtgtggaacgtaagttgaacgaacgtgatctgatgatctgcaataaggaagaagctatgtgtattgccggtgtattcggtggattggattccggttctacagaagctacaacagatgtatttatcgaaagtgcttattttcatcctacatgggtgcgtaagacagcccgtcgtcatggtttaaacacagatgcttcattccgttttgaaagaggtatcgatcctaatattactatttactgtctgaaactggctgctctgctggtgaaagaactggcgggaggtacaatctccagtgagattaaagatatttgcgttgcacctgcacaggattttgtagtcaagctggcatatgagaaaatacattcgttggtaggcaaagtaattcctgtggaaacaattaaaagtattgtatccagtctggagatgaagattacaaatgaaacagctgaaggtttgacattggctgttcctccttatcgtgtcgatgtgcagcgcgattgtgatgtgattgaagacattcttcgtatctatggatataataatgtggaaattccttctacattgaagtccagcctgacaactaaaggtgatgcggataaatcaaacaaattacaaaatttagtcgctgaacaattggttggttgcgggtttaatgaaatattgaataactctttgactcgtgctgcttactatgatggattggagtcttatccttctaatcatctggtaatgttgatgaatccgttgagtgctgatttgaacagtatgcgtcagacattgttattcggtggtcttgagagtattgctcataatgccaatcgtaagaatgccgatttgaaattctttgaatttggtaattgttattattttgatgccgataagaagaatccggaaaagacactggctgcctattcggaagattatcaccttggattatgggtgacaggcaaaagagtttcaaactcatgggcgcatgcagatgaaaacagttcggtatatgagttaaaggcttatgtagagaatatattgaaacgtctggggcttgatttacgtaatcttgtagtaggtaatctgactgatgatatatttgcagctgctctttctgttaatacaaaggggggcaaacgtttggctacatttggtgtagtaacgaagaagctactgaaagcatttgatattgataatgaagtgtattatgctgattttgactggaaagaactgatgaaagctattcgttcggtgaagatcagttacaaagaaatatccaaattcccggctgtgaaacgtgaccttgcgttgttgcttgataagaatgttcagtttgcggagattgaaaagatagcgtatgaaacagagaagaaacttttgaaagaggtagaactcttcgatgtgtacgaaggtaagaatctggaagccggtaagaaatcgtatgcagtgagtttcttgttgcaggatgagtcacagacgcttaacgataagatgattgacaaaatcatgtctaagttggtgaagaatctggaagagaagctaaatgcgaaactgagatag

SEQ ID NO: 41 - DNA, 3378 bp, Bacteroides nordii
atgaaaagcaatcattattttcgaagctctaaattatgccgagctttattgattcttttactcatggtagttccggtgcaatggagcatggctcagttgaaccttaatacacctcatactaccttaaaaagcattattcaacagatccaggcacagtcaaagttccagttcttttatgacgataaactgtctgatatttcagtagaaccgttgtcattaaaaaatgcagctgtagaggatgttttgaacctggtgctgaaaggaaaaaatattagtttcaaagttgaagataatatcatctatctttctgagaaaaaggatcagaacaacaaagagcaacaacaaaccgggaaagaaaaaaagatcagcggacaggtcgttgacgaatccggtgaaccactgatcggggtgaatgtactggtgaaaggaaccacaaacggagtaattactgattttgatggaaattacgcattagtaaccaatgaaataaaccccgttatcacattttcctatattggatataaatcacaggaaatcccgttcaaaggacagaatgtaatcaatctgaccctgcaaagtgatactcagattattgacgaggtagtagtgaccgccttgggcatcaaacgtgaaaaaaagatgcttgggtacgctgttcaagacataaaaggggatgctctgacatctaccggagatgctcaggtagccaatgccctgcaaggaaaagtagccggattatctatcaactcatctacgacaggtcttggtggctctgccaaaatcaccatccgcggtaactcttctttagcagacaacaaccaacctctctggattgtagatggtgtacctttcaccgaagaaagttattcgggtgcttcaatgtatggtggagtagaccgtggcagcacttcattcgacatcaaccctgaagacattgagtctatttccgtattaaaaggaccaaacgcagcagccctctatgggtcgcgtgccggtaatggtgtgatcctggttacaaccaaaaaaggaacaaggaaagacggatttggtgtcaattattccggaactttcacatggactcaggttgctgatgagttagaacgccaaaagaaatacggacaaggaaataatggtgaatattcacctcaatcgatatatagcttcggttctgaactggacggaagtttaaagacagcatggaacggtgcagaaataccctatttgaactatggcagtaaaatgaaagactacttcaacaccggtttttcacaaaaccacagtgtagccattggaaacatgaaagaggatgcacacttccgtacctccttcggatattcaaatgcagatggtatgttcaccggagaatcattgcgcaaaatcaatatcgatctgaatgcaggtatgaaaatgaacaaatatctgtcaatggatgccaaagtttcactgtcaaacacgaaagcagaaaaccgtccgacttatggtgcgtatggagaagtttcgcaattactccttgtacccaataacatacgcctttctgacttgtcacaatactcaacccccgaaaaatttcatgtgaactggactcctcccaccactgaatacctaaatccatattacgtgaacaaacagcgtcagaatcaggatgaacgctggcgcgcattcggtttctacaacctgaaactgaactttacagattggttgtatctctctgcaaaatacgcatttgactattatcgtacccgcattgtagaatcggatctttccaacggtacgaaatataatacaatgcaggaaatagaagaagaccgcctgactcgccaggaagagaaccactttgaatcgaatgcagaatttctgctgattggaaacaataaattcggtgaaaagttccagcttaattacatggcgggtgccaactttatgtacagtgaccagaatatatatggtggtgatgtagaaaatatgacctacaagaaccaatggtactggaactttgccaataatatcaacaacgtaacagaaaacggttggcgcagagctaccaattcagtatttggttctgtacagatggcttacaatgagtatgtatctctggatattacagcccgtaatgactggtcgtcaacattgccaaaggataacaattcttacttctatccctcattcaatctgggatttgttgcatccgactttgtccgtacacattggaataaaatgcccgaatggataactttcgccaaagtacgcctttcagcagctaaggtaggtaaagacgctcctccatacgcaatttataaccgatgggaaggtggatatctgaaaggacaggccaaaaagccggaattatcatcgaccaaggccaacaataatctgagacctgaaacatcctggtcttacgaagccgggttagatatgaaattcttaaataatcgtttaggattcgactttacctattattatacccgaactactgaccagattatgacgattccggaagctgctccctggaagctccgctggatcaattccggattaatcgtcaataaaggtgtcgaagccatgatctatgcgactcctgtacaaacaaaagatttcacattcaatctgaacgtaaatctttctcacaacacatcgactgtaaaggaactgaatgaaaagaaaaagcatatctattttgaaggcgatcaattcatgcctgtatacgtaggtgcagtagaaggaggcaaattaggcgatatctatgccaagcgaatgtataaaagagacgaaaatggtcagataataatgaagaacggagtacctgtatttacaacagatgagcagtacagcctcgaccatccgattggtaacatacagccggacttactaatgtctgtaactcccagcttcacttataaaggcttcaccctgtcggctttattcgacatgaaattcggaggagatgtagtttccgtatccgaagcaatcgctaccagccatggtatttccaaacgtacggaacaaagaggcgaactactattgccgggaatgaatgaagatggtacagtcaacacacaaagaatcgatgcccaactattttatcaggcagtaggcggacgccagcaggccgttgcagaagaatttgtttatgatgcatctttcattcgtctgaaagaaatttcgttcggatactctttcccaagcctgcttttaagaaaaacgcctgtttccagtctgagagtatcattcgttggacgaaatctggcatatctgatgaaacatacccccggaacaagcccggaaggtggatatgacacaagtatgttctcacaggcacttgatttctcgtcactgccctactcacgtacttttggtttcagtatcaatgttggtttctaa

SEQ ID NO: 42 - DNA, 2469 bp, Bacteroides nordii
atgatgagagaaaaatactttatggaagattcagatgataatgcattctcactgatcgccgattttgaaggaaatgaagagcaaatgttcgatgtgaaaatcaaatcaggtgatactcttccggtacttccccttcgtaatatggtgttgtttccgggggtatttatgccggtttcagtgggtaggaagtcatccttgagattaatacgtgaggctgaaaagaaaaatatgaatatagcggttgtttgtcagaaagtagctcagacagatgaacctcaatttgaagatctgcacacaattggaaccattgggaaaattgtgcgtattctggaaatgcctgatcaaacgacaactgttattttacagggattgaaacgtttggaattgacgggtattacagaaacccatccttatctgaagggcagcatcgaagtgaaagatgaaataatgcctgacaaaaatgataaggaatttcaagctttggttgaaacttgcaaagacctgacaatacgctatattaaatcttcggattctttgcatcaggattctgcatttgctatcaaaaacattagtaaccatatgtttctggtagattttatctgcactaatttacctttaaaaaaggacgagaagatagaattactccgttacgattcattgagagagcgtacttatcgtctgttggagatcttgaaccgggaggtccagcttgctgaaattaaagcgtctattcagatgcgtgcccgtgaagatatagaccagcagcagcgtgaatatttcttgcagcagcaaattaaaacaattcaggatgaattgggtggcagtggacaggagcaggaaatagaagaaatgcgcaataaagcgtataaaatgaaatggagcgaagaagtacgtaccctcttcttgaaagagttggccaaattggaacgtacgcatccgcaatctcctgattttagtgtacagttgaactatctgcaaacgatgcttagtttgccgtggaatgtatatacaacggataatttgaatctgaagaatgcagagaaaacactgaataaagatcattatggtctggaaaaggtgaaagagcgtattcttgaacatttggctgttctgaaactgaaaggtgatatgaaatcaccgattatctgtctgtatggacctccgggagttggtaagacttctttggggaaatctatcgctgctgctctgaaacggaagtatattcgtatgtctttaggaggtgtacatgatgaagccgagattcgcggacatcgtaaaacctatatcggtgctatgccgggacgaattataaagagtttgataaaggcaggttcttccaatccggtatttattttagatgagattgataaagtaagtgcagatcgtcagggagacccttcatctgctttactggaagtgctcgatccggaacagaatacaacgtttcatgacaacttccttgatgtggattatgacttgtctaaagtgatgtttattgctactgccaataatctgaacacgatacctggaccattgcttgaccgtatggaactgattgaggttagtggctacatcacggaagaaaaggttgagattgcccgtaagcatctggttccaaaagagttggaagcaaacggaatgaaaaagactgatattaagatcccaaaagatacattggaggctattatagagtcttatactcgtgaaagtggggtgcgtgagttggagaagaagatcggtaagatacttcgtaaatcggcccgccagtatgctacagatggttattttttaaagactgagattaagcctgccgatttatatgattttctgggagcacctgaatatacccgtgacaaatatcagggtaatgactacgcaggtgttgtgacaggattggcatggactgctgttggaggtgaaatcttatttgttgaaacaagtttgagccgcggtaaaggtggacgcttgactttaacgggcaatttgggggatgtaatgaaagagtctgctatgctggcacttgaatatatcaaagcgcatgcttcattgctgaatctggacgaagagatatttgataattggaatattcatattcatgttccggaaggtgctatccctaaagatggtccgtcagcaggtattactatggctacttcattggcttctgcgttgacacaacgtaaagtgagagcaaatctggcaatgaccggtgaaataactcttcgtggtaaagtgcttccggtgggcggtattaaggaaaaaattcttgcagctaaacgtgcagggattaaagagattataatgagtgccgagaacaaaaagaacatagatgagattcaggagatttatcttaaaggactgacattccactatgtaactgatgtgaaagaagtatttgcaattgcattgactaacgagaaggtggctgatgccattgatttatctgtaaagaaagccagccaggaatga

SEQ ID NO: 43 - DNA, 3126 bp, Bacteroides nordii
atgcataagtttattgacaacattgtagccttctcactgaagaacaagttttttatctttttctgtaccacgatagccgtcattgccggagttgtatcttttaagcataccccgattgatgcctttccggatgtaacgaataccaaagttactatcatcactcaatggccgggacgcagtgccgaagaagtggagaagttcatcactatccccattgagatagcgatgaatccggtgcagaagaaaacagatatacgctccactaccctctttggactgtcggttatcaacgtgatgtttgaagatcaggtggacgacttcaccgcgcgccagcaagtgtacaatttattgaatgatgctgatctgccggatgggataacaccggaagtacaacccctctacggccctacgggagagatattccgctatactttgcgcagtgataagcgaaacgtacgggaactgaaaaccatccaggactgggtgattgaacgtaacctccgttcggtatcgggcgtggcagatatcgttagtttcggcggagaggtaaagacgtttgaagtaagcgtcaaccctcaccagcttattaattacggtatcaccgcgctggagctttacaatgccatcgccaacagtaacatcaatgtgggtggcgacgtgatcaccaaaagttcacaggcatacgtagtacgcggtatcggcctcatcaacgacctggaagagttacggaacatcgtagtaaagaatatcaatggcactcctgtgttagtacgccatctggcagatgtacacgaatcctccctgcctcgcctgggacaagtaggaagaatggatgaaaacgatgtagtacaaggcatcgtcgtaatgcgtaagggagaaaacccgggagaagtgattgatgctctaaagaccaaaatagaagatatcaacaagaatgtattgcccaaggatgtacagattgtacccttctatgaccgtgaggaccttgtaaacctcgccgtacgaacggtgacacataacctgatcgaaggaatcctgctcgtgaccttcattgtactgatattcatggcagactggcggactacagtggtagtggcggtagttatcccgctggcactgctctttgcctttatctgcctgcgtgccatggggatgtcggccaatctcttatcgatgggggctatcgacttcggtattattatagacggtgccgtggtaatggtggaaggggtatttgtggcgctcgataagaaagcacgggaagtgggaatgccggctttcaaccgtatgtcgaaaatgggactgatccgccatacagccaaagacaaggcaaaggctgtctttttctccaaactgattattatcacagcccttattcctatcttctctttccagaaagtagaaggcaagatgttctcacctctcgcctatactctcggttttgccttgttgggtgcattattattcacgcttacactggttccggtgatgtcgtctatgttattaaagaagaatgtacgtgaaaagaacaacttctttgtccgcttcatcaacgagaaggcgagcgccctgttcaataaatgctatgcacaccgcaaactatccatcgggttggcaagtatcgtagctgttgtcggattgtggatgtttactctgttaggtactgagttcctgccacagttgaacgaaggttctatctacatccgtgctaccctgccacaaagtatctcgctggacgaatcggtgaaactcgccaatcagatgaggcgcaagctcgctgcttatcctgaggtaagacaagtgctttcacagaccggacgccccaacgacggtacggatgcaacggggttctacaatattgaatttcatgtagatatctatccggaaaaagagtgggaaagcaagctgagcaagctgcaactgatagataaaatgcaggatgacctctcactctatcccggtatcgacttcaacttttcccagcctatcacggacaatgtggaagaagccgcttcgggtgtcaaagggtctatcgccgtaaaagtattcggcaaagacttgtacaagtctgagaagatagcagtagaaatagacaaaatactcgctaccgtgcaaggtatcgaagacttgggtgtcatccgtaacatcgggcagccggaactgcgcattgaattgaatgagcagagtctggcacgctacggtgtagccaaagaagatgtacaatccatcatcgaaatggccattggcggcaagtcggcttcattgctttacgaagatgaacgcaaatttaacataatggtgcggtacaaaccggaataccgccaaaatgaagaagagataggcaagatactggtacccaccatgaacggtaccatgatacccatcaaagagctggcagagataaagaccattaccggccctctgctgatattccgtgataaccacacccgtttctgtgccgtgaaattctccgtacgcggacgagatatgggaactgccgtagccgaagcacagaagaaagtgaatgcctctatacacctgcccgaaggctatacactgaaatggacaggagattttgagaatcagcaaagggctacgaagcgcctttcacaggtagttccggtaagtattgccatcatttttatcatcctgtttgtgttgttctccaacgcccgggatgccggactggtgctgctgaatgtacctttcgccgctgttggtggcattatcgcattgctcatcacgcactttaacttctccatttcggcgggtatcgggtttatcgccttattcggcatttgtattcagaatggtgtcatcatgatttcggatatcaaacacaacatacaggcacgactccccctgcccgaagcgatccagacaagtatgcgttcccgcatccgtccggtagtgatgacggcagctatggcagccattggcctgatgccggcagctatgagtcatggtatcgggtcggaatcacaacgcccgttggctattgtcatcatcggcggactgataggagctactttcttcgcccttttcattttcccgctgattgtggaagtggtatacgaaaagatgctgtatgataaagagggaaacctgaatcagagaaagttatga

SEQ ID NO: 44 - DNA, 3069 bp, Bacteroides nordii
atggatatcaaattaaaattgaagcatctgcttcttatgttgtttctattgaacatgggaatattgaatgcacaacagaaaatcaaggtgacaggtcagattgtcgacaataatcaagaggcgattattggtgcaaatgttcttattaaagggactaccattggtactattactgactttaatggtaatttcacactggatgccaatatcggttccgtattaaatgtaacttatttgggatatgttccgcaagaggtcactgtcactgcacagcagcctatggttattactctgaaagaaaatgcccaggagttgaatgaagttgttgtggtaggttatggtacgcagaaaaagatctctacgattggggcacagtcgggtattaaagttgtgtccgaattgaaacagcccgtagccaatctttctactgttttggctggccgtgtttcaggtattgtaggattacaacagaccggtgaaccgggaaatgatgctgcgaatatttgggtacgtggtattgctactttaggaggtacgtctcctttgattctggtagacggtgtagagcgttccatggatgacttgaatccggaagatatcgaatctttctctattttgaaagatgcttctgctacggctgtatatggtgtacgtggtgcaaacggtgttatcattattacaacgaaaaatggtgaaatcggtaaacctcgtattcgtgcggaatatacttatggtttcacccgttttactaagttaccggagttggccgatggtattacttatatgcaatgcgccaatgaagctgctacaacccgtggtaaagatcctctgttttctgcagaaaagatcggaatgactgcttctggtctggatccttatttatatccgaatgtagattggtatgatcagatttttaatgattgggggcataaccaacgtgtttctgtcaatgtaaatggcggttctgaaaatgttcagtactatgtatctctgtcttattatgacgaagcaggtttgtttaaggtagacaatatgcaggattataagtcggagataaaatactcccgttataactttaactccagtttgaatatgaaggtgacccctactacaaacctcaaacttaacattaaaggaaatatggcggataagaactcaccttatgtgaagtctgacgatatcttttctgctgtattccggattccggctattcagatgcctgtaatttatccgggtgatagagttccgtttctttctaccggtggtggtttgatgaatccacttgctgaattgactaagaaaggatatagaagtacgactcacagtaaggttatggctgatttgagtctggaacaaaaattggatttcatcacaaaaggattatctttcaagggtatgtttgcttatgatattgagaacaaaacatacctgaacagaacgcgtagttataatacatactgggctgattctcgtgatgagaatggggaattaattattgtacagcaaggtaactctgttgatgagtatttaaagctggaacggggtacggataaaaaccagcgtaaatattatatggaagcggctctgaattataatagaacctttgctgatgcccacactgttaccggtatgcttctttttaatagaagtgaccgttcggatttgaactcgaattctttgacttactcactgccttatcgttcacagggtttggccgggcgtgctacttattcgttcaaagatcgctatatggcagaagtgaactttggttataatggttctgagaactttactccgggtaaacgttatggtttctttccttcatttggtgccggttgggttgcttccaatgagccttggtttgaaccggtttcagatgttatcagtttgttgaaaatacgtgcttcttatggtcaggtaggtagtgaccagattaaaataggtgataccacttatcgttttggttttttgtccgaaatgagttcttccagtaatgtatatcagtttggacttcctaataatacgtatggtgtgacgggaggaaaagatgtttccaagtatgccgtaaatgtgggatgggaagtttctacaaaagccaacctcggattggacttggagttgttccggggggatcttactttaaactttgatgtgtttaaagaaagacgtgaagatatctttatacagcgtcagtctatacctgcaacagccggaattaatgtagttgttaccggtaatctgggtattgtagagaataaaggttttgaggtgaatgccgattttaataagagattcggtgattttatctggggagtgaaaggaaatctgagttataacaagaataagatcattgaagacgatactccttccaaaccttatccatggatggagagtcgtggaacttctgttggtcagcgtttaggatatatctgtgaaggcttctatactgatgatgatatcaataatccggatgtagcgaaaacggtagaacctgtaatggctggtgatctgaaatatcgtgatttgaatggcgataatgttattgatgattatgacaaaacttatattggcaaaggtaccgttccgaatatcgtatatggttttggtactactgccgaatggaaaggattctctttaggtgcattcttccagggtgtaggtagctgtgatatttttatgaatggtacagactttgttccttttgagaatgctaccgccagaggtaatcttttctctaacatcactgaccgttggacggaaaataatccaagacaagatgccctttatccccgtttggcgataagcggaacaaatcagaactatgcaacaagcgatcactggattaaaaatggtgcattccttcgtttgaaaacattagacttcggttatacgattcctaaaacaataaccagtaagtggcatatttctaatttacgtttttatgtactcgctaccaatgttttcactatctctggctttgatatgtgggatccggaacttggtaacggtaccggtactaaatatcctaatatcagtacctatagtttaggtttgtcattccaattttaa

SEQ ID NO: 45 - DNA, 5607 bp, Bacteroides nordii
atgaaacgaacaacaatgattccagccgcgtattctgttcttctgttcatcatcataagtctgagctcatgtgcaggcagtcagaaagaacttgttccttcttcggagtttacaccttatgtaaatgcctatacaggtggggtaatatcgcaatcctcacccatacgaatagaactgacccaagatcagcccgtagtagatttaaataacgaactcaaagagaatccattccgcttttcgccttcactgaaaggaaaaacatattggataagcaataacacaatagaattcctgcccgaagaaggagcgcttaaaccaggaacaatgtatgaggcttcgtttcaactgggagactttgtaaaagtagacaaacgtctgaaagaatttaatttctcattccgggtacaggaaaaggatttctcattggcaatggaaccactcgacataactgccgctacccccgagtacgcttctgttaaaggagaaatacgtttcagcgacaagattgacaacgtacaagtagagaaaatgatctcagttaatggaaatggttcttcagattatgccatttctgtaggaggcacagaaaatccgatgcgatacaatttcaacatcaaccgtataccgagggcacaggaagattacgatctgaaaataacattgaacggaaaagtggcaggtatagaccggaagattgttgagaaggtgactattccggcaaaaaatatcttccgcttcatgtctgcacaacgcatagagcaaccagagaacgggatacaaatttcgttctccgatcccgtatctaccacacaggacctaaagggactcattgaaatcgcggaactctcttcgtatacatttcaggtaatcaatgacaaagtaaacgtatacttcgagcccaatcgttccaataaactcacactgagaatctatgaaggtataaaaaataggaaaggcaaaaaactcggcacctcccattctatctccttcagtcaacccagcctgaaaccacaagtggaactacgtacagatgctgccattttgcccgactccaaaaatctgattatccctttccgggctgtcagcctgcatgctgttgacttgaatgtgatccgtatatttgaaagcaatgtactgatgtttatgcagacaaacactctttcatcttccaacgaattgagacggtccggacggttggtctataaaaagacactacatctggataaagacccgtccaaagacatccgcaaatgggaagattattctattgacctctccggactgatcaatcaggaaccgggagctatctaccggatcaccctttcattcaaacaagcctattcggcctatccatgcggagaagatgacaaagaattacaattctccgaaagttcggaccagttaactaaactatcctccgaacaactgtcagaagaagatgaagctgtgtgggatactccgcagacctactattattacaacggttccgaaggaatggactggcgacaatatcgttgggaagagcgcgacaacccctgccacatatcttactatatgggagcagaccgaacagctgcatgtaatgttctggcatccaatcttggtatgattgtaaagcgaaactcggtcaacaaattgtggattactgtaaataacatattagatactactccggtagagaaagctatagtaacagcttacaattttcagctacagccagtgggtaaagccgaaaccgataaaaacggattcactgtcattgagactaaaggtgttcctttcatcgttgtagcagaagccggaaagcaaaaagcatacgtacgggtggcagacggagaagaacagtcagtcagtcgttttgacgtaggcggtaaagatatacagaaaggattaaaaggatttgtatatggcgaaagaggcgtatggcgtcccggcgatacactacacatttcgttcatgcttgaagaccgtaacaaccggataccagataaacatcccgtagcattggaaatttataatccgcggggacaattctacaataagttaatctccactaacggagtaaacgggctgtatactttcgccgtaccaacaagagcagaagatcctaccggattatggaatgcttacgtgaaagttggaggaacggcctttcacaagtcactacgaatagaaacggtaaagcccaaccgactgaaaatcaatctacagcttccgggagagatactcaaagcctcggatggagagatacgtactactttgtcgtcagcatggctaacaggtgcccaggcttcaagactgaaaacaaaagtcgaaatgtcactctccaaagtcaatacgcaattcaagaattacggacaatatatattcaataatccggcaacagagttcacctcttcacgcatggacgtattcagcggcatgctggatgcaaacggcaatgcatcgttcactctcaaactacccgaatcgggaaatgcaccgggtatgttacaagccaatattactacccgggtattcgaaccgggcggagatgccagtatcaatacaacaagtgttccgttttctcctttcaattcgtacgtaggcatcaacctcaatcagcctaaaggtaaatatatcgagacagataaggatcatgtatttgacatcgtcaccgtaaatccggaaggaaaacctgtaaatcgttcgggacttgaatataagatttaccgcatcagttggagttggtggtgggaaagttccagagaatcgtttgagacttatgtcaacagtagttcttatacccctgtggccagcggaaagctgaataccataaacggaaagagcagtttcagattccgcatcaactatcccgattggggacgttatctggtgtatgtaaaagacacagaaagcggacatgctaccggaggtacagtctacgtagactggcccgaatggcgcggacgttccagtaagactgatccgagcggcgtcaaaatgttggctttctctctcgataaagaatcttacgaaccaggtgaaacggtaactgccattatccctgcctcagcaggaggcagagcacttatcgctctggaaaacggttcagaggtattacaacgtgaatggttggatgtatctggtaaagaagacaccaaatatcagttcaaagtgaccccggaaatggcacctaatgtctatctgcacatcagcctgctgcaaccacatgcacaaactgtaaatgatttacccatccgtatgtacggagtaatgccggtatttgtgactaataaagaaactgtactccaaccccaaattcagatgcccgacgtacttcgtcccgaaacggaattcaatgtgacagtaagcgaaaagacaggtaaaccaatgacgtatacactggctatcgtagacgatggattacttgaccttaccaacttcaaaacacctgatccgtggaacgaattttatgcacgagaagcattaggcattcgtacatgggacatgtatgacgatgtgttgggagcctatacaggtagttacagttcactgttcagtaccggaggtgatgaaacattaaaaccggcggataccaaagcaaaccgtttcaaaccggtagtacgttttatcggtccgttcagcattggcaagggtaaaagccagacacaccgaatcacgcttccaatgtacgtaggttcagtacgtaccatggtggtggcaggagaaaacggagcatacggacgggcagaaaagacaactccggtacgtaccccactcatgattctttcaacattaccccgcgtgctcagtacacaagaggagatatcactcccggtcaatgtatttgccatggagaaagaagtgaagaatgtaaaagtatccgtttcagcatcgggtggtgcacaaatcagcggtgcctcccaacaatcggtttcattcgtaaaaccgggtgaccagttagttttcttcaaactaaagactggtagcaaatccggtaaagcaacccttcgcataacagccgaaggagccgggaagaaagtctcggaaacaattgagatagaggtgcgtaaccctaatccggcggtaacactgcgtgaaagtaaatggatagaaaacgggcaaagttgtgaactatcttataggctaagcagtcgttcaccggaaaacagtgtcaagctggaagtatcccgtatcccgtcggtagatatcagccgtagattcgacttcttgtacaactaccagcactactgtacagaacagctaacttccaaggctctcccactcctgtttatcagtcagttcaaagcagtagacgaaaccgaatctcaaaaaataaaggcaaatgtacaggaagcaatcaaacaactgtatgcccgtcagttacccaacggaggatttatttactggccggggagtgcttctgccaacgaatggataacctcctacgccggaatgttcctggtaatggcacaggaaaaaggatatgccgtaaatgccaatgtactcaataagtggaagcgcttccaacgttcggctgcacaaaactggcgtacacctcaacaggataccggatattactggcaatcagatttgcaacaagcgttcagactatacacactggcattggcaggagcaccggaacacggggccatgaaccgcctgaaggagatggatcaaactctctctttacaagctaaatggagactggcggcagcatacgccttaaacggaaaaatgaaagctgctaatgagttggtatttaatgccaagactacagtagagccttattcctcttctgcaggaagctatgtatacggatcttatgaccgcgatgaatctatgatactggaaacgttgctattaatgggacgtgaacgggaagcgtttgcacaggcacaacgagtatcacaaagtttatcccgtgaagagtggttcagtacccaatccactgcatttgctctaatggcaatgggcagactggccgaaaaactatcaggcacacttgacttttcgtggacactgcatggcaaacaacaacccgctgtaaaatctgccaaagccgtgtttgagaaaacacttgccactgctcctggtggaggtgaagttacagtgaaaaataatggaaaaggagcattaaatgtagatcttatcacccggacacaattactgaatgatactttacctgcaatagcaaataatttacgtctggatgtgagatatactgatatgaacggtacggctatctccattaatccgatcaaacaaggtacagactttatggcagtagttacggtagccaacatcagtggaacttccgactacaacgacctggcactgacacatatcataccatcgggttgggagatatataatgaacgtatgatagaccacccggaacaagccacaagtactgatacgaacaacagttatacctatcgggatatccgcgatgaccgtgtacttacctatttcaatctgaaacggggacagtctaaaaccttcaccatacgattgcaggcaacctatgcaggaaccttcatattacctgctatccagtgtgaagcaatgtacgattccggagcacagacaaggactcaggccggaaaagtagtagttgaataa

SEQ ID NO: 46 - DNA, 3717 bp, Bacteroides nordii
atgaataggaattttttattaaaaggctgtctggctggaatattggggcttgctacacaattggttatagctcaaacttttgacaatgaaaaagttacagcgacatggggaatgtccggtggagtcaatgaaccatcacaggctgttgtcagtaatgaacatgcttttagtacaactgcttttgttttgggtggagagatgaacttctccaaacaacaggagtataaagggcttgacgaaaatctgagtatgaatacttataagccaagcgctcaaatgagtggggcaacagatgggtatgatctgatttactctataaaaccagctaaaggattgacttttcaaccgggacagatttcttttaaaatgggtgtatttggcacaggaggtggtatggtggatgtttatttgaagtacgccgatgggactaaaaaaacggtggcaggtactatcaagccgaatcgttccggaacctctgtaaatgccactgaatgtacatatgatttgggtagtatgtcggcaactgatgaagaactatcattgattatcagtgtatatagcctggcaaataataaagagataggtttcagtaatgtgatggttacaggtacagtaaatggtacagccgtagaagttccgcaatataatgtagcaacaagtatggaaccggagagtgcaggcactgttaatcagatgccggcaggcagtttgatggatgaagatacgaaagtaactgtgacagcttttccaaagtttggttttcattttgttaattgggtggataatagtggtaaagaagtgtcggcggaaaatccatattcatttgtagtaaaaagtaatacttcattgaaggctgttttccgggaagtgaacacttatacattttctacccgttgcatcaacgatctggaaatgcagattggttctgttacattgaacccggaaccaactgaagggaagtatgaagaaggcgtgatagtaactgctacagcaaacgaacttccaattgcacgatttttgaactgggaagatgattttgaaaattccagtgttacaacaaccgagcgcagtgtgacggtaaaacaaaatacggaacttattgcaaattatgagattcaggatttcattgccgcttataattccgataaagcagagatttgggcaaacaaagggaattatccgtttgctgccgattatacctgggacttagaacgtaatgctactgcttctgttgtgaaagtgaatgatggaagttcattgaacggtaattcgagtggtactccggtagtacgtatgcgcaagggagctgtcataagttcggtcaatggtttgtatatgaacggatatcgcagtacggatgtggcaatgcagattcagttttcgaccaggaactttacaaccgttcgtttcactgcagctttggttgcaaagaatgccgcaactgtaaactggaaggtgctttattccacagatggtactatttataaacctgttatgaataataacgaagagttgatttataaattggtcaacggactggctacaagtgttgattttgaattgccgggtgaggaagttgccgataaagaaatggtatacattcgttttactggtacaggtgatgaggttcttaatgataacaatggtgaatataacttcgataaagtcgattcggaaagtggtttgaattataccgaccatagtgaaaccggtttgggtaatatttatgtatttggtactccggttgttgaggaagatcatgaggcacctgctatcaaagctattgctccggcagataaagctactggtgtgtctgccagtggtaagattacgatttcttatagtgaacgtatccaggctggtacaggagaggctacattgactggaaacggtaaaacgattacactcgaaccggaatatggaagttcttctgtctctttccgctatgtaaatttggcttatgcgagcacatatactttggaacttccggaagggtatgtgactgatcgttccggcaataaagcaccagctgtcagcagtagtttcactgtgatggagcgtattaaaccggaagcccgtctttttaatgcgatagtagatcaaagtctggaagttagtgttatgccaacctctactgcaataggtcaatataaaacgattcaggaagctattgatgctgtgcccgtgactaataacaaaccctggcttatttttataaaagccggatattataatgatttgaataaccggacattctctaccgggaaatatacctgggaagatcagagtggcaaactatctgcttcggaagacagccgtattatagtggtagatcgtccgtttgtgcatctcattggtgaagatgtaaataaagtaacgatcgcacaagaccgtattgcaggaagtaatgctgctgacaagagtcaaccttggtataatgtggcagaaggtgccacactggtaattaagtcaaatgacttttatgcggagaatctgacgattgataatgagtggtggactaaatatgaagggaatgaaacacgtggtccgcaagcattgtccctgtatgtggaagcagatcgtgtagctttcaacaactgccgtatccgttcttatcaggacacatacctgagtccgaaaacaggaaatacgaatacgggtaataatcaacctcactattatgaccgtaactatttccgtaatactatgattgaaggtgcagtcgattttatttatggaggaggcgatgtctactttgataattgtacgctgaatattgtacgtgaatcgggaggttacattgttgctccgtcgcattatactgatcttaaggacaatcagggtaatattacacaagtaagtacgcgttggggatatgtattcaaaaatacaaagattactgctcccgttggtaaggaagataaaacacaggtatatttcggacgtccctggcacaatgagccaaaaactgtatttatcgatacggaatgccgtgtgaaaccgtatgatggttattggtatcctacaatgggtgctgtgcctgctctttgggctgtgtacaatatatgggacaagaacggatataaaatgagcgaaacatctatcgaagactattggtacgaaagcaatggtgagacgattcgtggtaaagcaaaaaacttccttacagatgaagaagctgcttcgtatacattagaaaatgtgctgagtggtgacggaagtgatgctactaccggcgtatggaatccactaccaatggtagaacaaactgccaaacctgttattagtgggatagaaggaactgctacattcggttggactgctgatgaatatgctatctgctatgtaataaatattaatggtaaagtagccggatttactactgaaacccactatgaggcaaatttgaatgatgtagttactgttcagtctgttaatgaatacggtgcattgagtgaggcttcagatgaatttatagtaggaagtattggtactggtgttgaaaatactactttggaaaacaatattagtgtaataggggggaagggcaccatttctgtacgtggtattgaaacagcaacagatatcaagatatacggtataaacggtactttggtacaaagtctggaagttcatcgcaatgtatcactctctgttccggcagggcaatatattttgaaggcaaataattcggtatccaaggtgttggtttactga

SEQ ID NO: 47 - DNA, 4281 bp, Bacteroides nordii
atgctgttgctcacagcactcttttcgtgtgtcggtacagcacctaccaaagaggtacgttttatcgactctttgaatcgaagagcgtatgcttatcgttacaaaaatctggattcgtcctatcatcctgcattggaagcctataacaaatcccgcctttacaaccagggaaaagcagaggcttgcaataatctgggattttgtgcatttatgaaaatggattttgaacgcgctgaaggtttgcacaaagaagtatacggactcactaaaaatgaactggaattgcttattgcggatgtgggactgatgaaaatctaccagcgggcgggcatgaacaaagaatattacgattatcgtaacagcgctatgcggcgaatgaaacgtattcgtgaagacagtaatgtttttgcagacaagcatgagacgctacggttgaattatgcctttactgagttttttatagtatctgccgtttactattattatcttcagcaacgtcccgaagcaatggcagcactggataagattccgcaagacgaagctttgaatgaagataccaatcaatacctttattttcattatatcaaaggatcggcttctttgtgtgaaggtgatacaccggacgaacggaaattacatgaatatgacgaactctatactacctggcgactggcttcccgtgaaggttatctttattttgtcggaaacagtatgcagggattggctaacctgctgatacctgaaggagattttgatctgattgtgtcaagacgttcacattcattgaagcagctgggcataccaattgactctttattacctttaagattgggagaaaaggccttacagactttcaaggaatacgatgacctgtatcagattgccggtgcttatgtctctatcggaaagtacttcaatgctcatggtctgtattccgaagcactcgattctctgagtaaagcactggaatgcgtaaatcatcatcatcttttgtattatcaccataatgccgatacgttggacaaactgcagccttttgtcggtgctgacaccattttcaccgaaatgacgtggatagggcaggagagagtcaaaactgtacctgaatggatatcccgtattcgcgaacagttgagtgtctcttatgcaggtttaggtatgaagccggagtccgactacaaccgcaatatctacctggatatattaaatgatacccgccaggacaaggaactggaaagtcgttacgcctatctggaagcagagtccaaacagctaaatatcgtacttttctttgctacggtagggctgttgctggtaatcgttttattctggattttcaataaacgttctaaaataaaaaatcgtatttacaccgaacggttgcaacagacgctgattctctgccgggatattacagcttctattccgatgaatatacctcttatccagcaaggtattgaccgcttgttcggaccggaccggattacattggaggttaccgaagaaggaaaggcaaatttcgttcacaatcatcggctgagccgcgatgaacaggcattggtacatatattgataccctatgtggagtgggctatggataatgagcaggccattgccaccctcagtgacgagcgtaatcaactggaaaagcaacgttatgtctatgaacaacatattgctgccaacaaacgccagaatctgataaaaaagtcgtgtcttgccattgtgaatggtatcaatccttatatagaccgcatactcaacgaggtgcacaaactgacggaaaaaggtttcatgaaagatctgcggatcaaaaaagaaaaatatcaatacattgacgagttagtgactacgatcaatgaatacaatgatattcttgccttgtggattaagatgaaacagggtacattgagcctgaatatagaaattttcagcctgaacgagcttttcgaacttttagggaaaggacgcagagcctttgaaatgaaaaatcagacactcgaaatagaacctacacaggtattggtaaaggcagacaaggcactgactttgtttatgataaatacattggccgaaaacgcccgtaaatatactcctgaaggagggaaaatacatatttatgcccgccagactgaagaatacgttgaaatatcggtagaagataacggacgcggactttctgccgaagatgtggcgcgtattattggcgagaaggtatacgattcacgtgctatcggaatgaaagatactgaggatacggaaatactgagacagaataaaggaagtggcttcggactgatgaactgtaaaggtatcattgaaaagtatcgtaaaacaaatgatttgttccgggtatgcctgttcagcgttgaaagtgaaccgggtaggggaagccgtttttatttccgtcttccgccgggagtacgaaagataataggaatgctgttatgtttgctattgccttcatacctgtgctcttcttgtgtaaaagaagctaaacaggcatttgctccatctgcaatagactccgtaggcctggctgtagattccaattatgaacaattgcttgacgaagcatcagactatgccaatgcagcctattttgctaatgtagacggttattatgaagcggccctgcaatatgcagactccgctattaaggtgttgaacaagcattataagaaatatgcccgccggccctatcgatacatgaaactggttggtgaaggtactccggccgaactgacctggtggaatgaaatgttcgattcagacttccatgccatactggatataaggaatgaagcagcggacgcttttcttgcactaaaacagttggacggatataattataataatgcagcatttacagccctttataagctgcaaagtgaagatcagtcgttggagggatactgccgccaattggaacgttctacaacaaacaagatagtaggtattatcctttgcatccttttgttggtaatctctctggcaggttattatctaatctatatacgcaaacgcctgctcaaccgtctgaatttagaacaggtgcttgagataaacaaaaaagttttcgcttcttcactgatacgttcacaggagtcggccgaagccttacagcgcgaagaggatacattgaaggagattcctcaacgactcgttgacgaagcatttgattctatcaacgaattactcacaattgatagactcagccttgccgtgtacaatgagactacccatcatttagagtttgcttccaatcctcggcttgatgtgatgcctgagttaatgcaacgttgttttaatgagcaagcttatcagtctgacgggcttgcacaggccattccattggtggtggatgccggaggagagcatcagtgtgtaggtgtgctttacctggaacgccgtgaaggaactgaattagaaacagatcgtttgctgtttgaattggtggcccgttacgtagcaattgtggtgttcaatgctgtagtgaaactggcaatgaaataccgggatattgaatctgcacatgaagaggcacaacgtgcttcctgggaagacagtatgctgcatgttcagaatatggtactcgataattgcctttctaccatcaaacacgagactgtttattatcctaataaaataaaacagatcgttggtaagttgaatacacaaaatctttcagaagcagaagaacgggagaatgtggaagctatcagtgaattgatagagtactataaaggcatctttaccatccttagttcctgtgcttcccggcaattggaagaggttacattccggcggagtacaattcaggtttccgatctttttgaatatgcagctaagtatttccggagggttagtaaaggaaaaagaaccggagttgagttaatactcgaaccaacggagggccgggttatcggagatatcaatcaacttcgttttcttcttgaaaatctgatagacgaagcgctcgatgggtctaaaaacggaatattgaaattaagagccaaagaagaggatgaatatgtacgctttctttttaccgacacccgtcgcgaaaagagcgtagaagagctgaaccaattgttttatcccaatctggcacgtatgactgctggtgaaaaaggagaactccgcggtacggaatatttgatatgcaagcaaattattcgcgatcatgatgaatttgccggacgacgtggatgccgtatcaatgccgagcctgctgtgggtggagggtttactgtttactttaccatacccaggcgatga

SEQ ID NO: 48 - DNA, 2712 bp, Bacteroides nordii
atgacgccattgaaagcaaatacattaatatcatttatactactgtttgtcttactggtgcttcctgatgaggccatgtctcaacgtcgccgaaacaggggagtagaaggaggtgtagagacatttaaccctccggcagctctgaatgcagattctttgacgactgactcggtcagaacagattctgttgttgctaaacccattaagaaacagccactggatgctccggtgatttattctgcaaacgattccattgtttttgaagaaggaggatatgctcatctttatggagatgggaaggtaaactatcagaaggtagagttgggagcacaaattatcaccatgaatatggacagtagtacggtgtatgctcgtggtgtgaaagattcactgggagtagaaaccggaaagcctgtttttaaagacggtgatacttcttatgatacggaggctatccgttacaactttaagagtaaaaaaggatatattaataacgttgtcagtcagcagggtgaaggatatgtaaccggtaataatgcaaagaaaggcgctgatgatgaactgtttatgcagaatggtaggtatactacctgtgatcatcatgatcatcctcacttttatcttcaactaacaaaagctaaagtccgtccgaaaaagaatgtggtaacggggcctgcttatctggtggtggaagatgtaccgttaccattggctgtaccctttttcttttttcccttttccagtagttattcttctgggtttattatgcctactgttcttgatgattctgcccgtggatttggtctatcggatggaggatattactttgctatcagtgatttgatggatttgaaattaacaggtgatatctttacgaaaggttcgtggaggttagggttggagacgaattacaacaagcgttataagttttccggttctttgatggccgattatcaagtgacaaagacgggagataagaatatgccggactattcggtatcaaaagactttaagattgtatggagtcaccgacaggatcctaaagcaaaccctaatgctactttctcggcgagtgtaaatttttcaactagtagttatgagcgtaccaacattggtaacttatacaattctcagttgctgactcaaaatactaagacatcaagtatcagttactcacgtacatttccagatattggtctgacattgtcggggactactaatatctcgcagactatgagagattcttctattgcagtgacattgcctgatcttaatatttcattgactcgtcgtttcccattcaagagaaaaaaagcagtaggtgcagagcgttggtatgaaaaaatttcattccaatataccggtcgtttgacaaattctatcacaactaaagatgatcggttgtttaaatcaaatctgataaaggattggaaaaatgctatgcagcacaccataccagtaagtgctacatttacccttttcaaatatttcaatctgaccccgtcattcaattatacagaacgttggtatactcacaagactgataattattacgatgaagaaaagcgtcagtgggtagctaccgatactatttatggttttaaccgcgtgtccaattataatttctctttggggttgagtaccaaactttatggtatgtataagcctatttttatgaagaagaaagagatacagattcgtcatgttgttactccgcaggtaagtgtgagcggtgcaccggggtttgggaagtattggcaggaacatgaagatgccaatggaaatatgtcgtatttttctccttataccagtcagcagttcggtacggcaccacgtgagaaacaggggacagtgacttttgatttgtcgaacaatatagagatgaagtttaaagaccggaatgactctattaaaaagataagtctgatcgatgaattaggaggttatatttcttataatatggctgctgagaagagaccgtggagtgatcttactttgcgtctacgcttaaaactgacgaaaaactatactttcaatctgaattctacatttgctacatatgcctatacgtttgataaagatggtagggttgtgactggtgaccgtacagaatggtcttacggacgtttcggacgtttttccggttggggatcttcatttaattataccttcaataatgaaacctggaagaagtggtttggtcctaaagacgacaaggatcagaaggataaagacaaggatcagaatggggaagatagcgaagatatggatgctggaaatgataccggaaccacaaaaaaggtggagaaagcacaggcggacgctgatggttatcaggtgttcaagatgccatggtctttgagtgtgaactattcatttaatattcgtgaagatcagagcaaacctattaatgtgcattcaatgcgctatccgttttcttatacgcacaatattaatgcctctggtaatatcaagctttcaaataactggcaggtgtcttttagtaccggttacgattttcaggcgaaagaagtaactcagacgtcaatgactatttctcgcgacttacactgtttcaatatgtcagcaagtctctctcctttcggacgttggaaatactataactttaagattagtgctaatgcaagtatcttgcaggatttaaagtgggagcaaagaagtcagacgcagagtaatatacagtggtattaa

SEQ ID NO: 49 - DNA, 3147 bp, Bacteroides nordii
atgttaaataaaattatacatttctctcttcagaaccgcatcctggtactcgtggcctcggtgttgttgctgattggcggtacgtataccgcaatgcatacagaagtggacgtattccccgacctcaatgcgccgacagtggtcatcatgactgaggccaatggaatggcagctgaagaagtggaacagctcgtcacctttcccgtagaaacttctgtaaatggtgcaacaggcgtgcgccgcgtacgctcttcttccacaaatggattttctgtagtttgggtagaatttgactggggaacggatatttatctggcccggcagattgtaagcgaaaagctcgcagtagtcaatgaatcattgcccgccaatgtgggcaaaccaacactgggaccacagtcttccatattgggtgagatgctgattatcggccttacggcagattcaacatctatgctcgacctgcgtactatcgccgactggacaattcgtccgcgtctgctttcaacaggaggtgtggcacaagtagccgttttgggtggcgacttgaaagagtatcaaatacaactcgacccggaacggatgcgtcactatggggtatctatgggtgaagtaatgaacaccacccgggatatgaatctcaacgccaacggtggagtactttatgaatatggaaacgaatatatagtacgcggagtactctctacagataaggcagatcagctgggaaaagccgtagtaaagagtatcaataccgtacctgtactattggaagatatagcagacgtagccatcggagcaaaagctccgaagttgggtacggcctcggaacggggaaaaccagctgtattgctgacagttaccaaacaaccttctaccagtacactggaactgacggataaactggaagcttctttaaaggatttacagaagaacctccctgcggatgtaaaggtttctaccgatatcttccgccaaagccgttttatcgaaagctccatcggaaacgtgaaaaagtcattgttggaaggggggatcttcgttgtgatcgtgctcttcctgtttctggcaaacgtacgaaccacaattatttcactggtaacactgcccatttcactgattgtttccattctcacccttcactatatggggatgactatcaacacaatgagtcttggcggtatggcaattgcaatcggttcattggtggacgatgctattgtagatgtagaaaacgtatataaacgactccgtgaaaaccggatgaaatcggagactgaacgtctcccggtactcgacgtggtattcaatgcttccaaagaggtacgtatgcctattctgaactctacactgatcattgtagtgagtttcgtacccctctttttccttacaggtatggaaggacgtatgttagtaccgctgggcgttgcttttattgtggcactgttcgcttctacaatagtggctttaacggttactccggtactatgctcttacctgttaggcagaaacaagagtgacaaaatccccaaagaagcattcgtagcacgctggttgaaaggtgtttatgaaaaagcattgagatgggtacttaatcacaaacgaatcacgttgggaagtaccattgctctgtttattgttgctttgggatgtttcttcacgttaggacgctccttcttaccgcctttcaacgaaggttcatttaccatcaatatatcttcgctgccgggtatctctctggaagagagtaacaaaatgggacaccgtgcggaaatgttgctattaactattcctgagatacagaccgtggcccgtaaaacaggtcgtgccgaactggatgaacatgccctgggagtgaatacctcggagatagaagcaccatttgaactgaaagaccgttcgcgcagtgagctcattgcagatgtacgtgagaaactgggtacaatcaccggagcaaatatcgagatcggccagcctatcagccaccgtatcgacgctatgctatccggaacaaaagccaatatcgctattaagcttttcggagatgacttaaacaaaatgttctctttaggtaatgaaataaaaggggctattgaaggtattcccggtattgccgacctgaatgtggaacaacagattgaacgcccacagctaaaaatcactccgaaacgtgaaatgcttgccaaatatggtatcaccctgccggaattctcagaatatatcaatgtagcattggcaggtgaagtcatttcacaggtttacgaaaagggcaaggcattcgatctcattgttaaagtgaaagataacttccgtgatgaagccgagaagatacgtaacctgatggtagatacatcggacggaaagaaggtacccctaagctacgtagctgatgttgtttcggctatgggtcccaataccattaaccgtgaaaacgtgaaacgtaagattgtgatttctgcaaacgtagccgaccgcgaccttcgcagcgtagtaaatgatatacagaaaaagatagatacctccgtaaagctcccggaagggtaccatattgaatatggaggacaatttgaaagcgaacaggcagcaagccgcacgctggccttgacttccttcatgagtatcgttataatcttcttactgctgtaccatgagttccggagtgtaaaagagtccggagtgattctgctgaacttgccgttggcgctgattggtggcgtatttgcgctactcatcaccacaggtgaagtcagtatcccggccatcatcggatttatctctctgtttggtatcgctacacgtaatggtatgttacttatcagccattacaatcacctgcaacaggaagagggtatgggagtatacgatagtgtaattcatggctcactggaccggttgaatcctatcttgatgacagcactttccagtgctctggcgctgataccactggcgctgagtggcgatctgccgggtaacgagatacaaagtccaatggcaaaagtaatcttaggaggtcttttaacatcgactttcctgaacggatttatcattcccattgtttacctgatgatgcatcgccgctccccacagaaggaggagatacgccaaacgacagatggtgggaatatctctaatgaaaagaataaataa

SEQ ID NO: 50 - DNA, 2292 bp, Bacteroides nordii
atgaacattagtaataatatgaagaaaaagagctttttgatagttttaggggtatgtatcgggactaccggttttgtatggggaaccaatgataaaccattgtataagaatccggatgcccccattgaaaaccgtgtggaagacctactacggcgtatgactttgcaggagaaggtattacaactacagaataaacccgttggcaggattgatgagatagaacgtgtttttggcggacagagttatggatgtacccatgaaatgggccagacagcagaagaatgtgcccgaatctataacgagttacagaattatatgctgactaaaacccggttggggatcccaattttaacagctgtagaaggaatccagggcattttacaaaataattctaccttgtttccgcatgctattgcacaaggaagcacgtttaaccccgggttgatagagcgcatgacggaggcggcaggtgccgaagcggcaacgatgggtattcatcaggttttatctcctgtgtttgatattgcccgagaactacgctggggcagggtggaggagacttatggcgaggatccttatctgattgctgaaatggggattggctttgtgaagggataccagaagcaccggattacatgtaccccgaaacattttgtagcacacggtacaccgacgggaggactgaattgtgcctttgtcagtggtggtgaacgcgaattccgaagtatgcatctttatccttttgcacgcgttattaaagaagctgatccgctttgtattatgagttgctatagtgcctatgatggcattcctgtatcagcatctccttattatatgaccgatgtattgcgcgatgaactcggatttaaaggatatgtatattctgattggggatccgttgatcgggtgatgacttttcattatgctgcctctacccgtgaagaagctgcccgcctatcgttgatagccggtgttgatctggacgtggattctgattatgaaacactggaacaacaggtgaaagagaacattatagatgaaagctatatcgataaggctgtacggcgtgttttgtatgtgaagtttgctttaggtttatttgaccgtccttatttcggtgatccggaactggtgaaaaaggtcgttcgttctgccgaacacatcgctttggcaaaagagatcgcggatgagagtgctatcttgcttgaaaacaagaataacatcttaccacttgatttatcgaaatataaatcgattgctgtaatagggcctaatagtaatcagactatcttcggagattatgcatggactactccggatacgaaagagggggtaactttataccagggtttaaaagaagtaatgaagaataaggtaaaactgcaacaggcagatggttgtgactggtggagccagaaggaggagaatattgcggatgcagtaagaattgtagaacaaagtgatttggctattgtggcggtaggtacgcgtagtacttttctgggacgcggaccacgttattctacggcaggtgaaggattcgatttgtcttctttagagttacctggtaagcaaatggaactattgaaagctgtaaaagcaacaggcaaaccgatggtagttgtttttatatcgggtaagccattggtgatgacctgggcgaaagaaaatgcggatgctgtattggcgcagtggtatgctggtgagcagcaagggcgttctatggccgatattctggttggtaatgtgaatccttcaggacgtgtaaatgtatcgtttccgcgcagtacgggtaatacaccttgcttttataattattttcctacggaccgtgtacagcgatttgaccgtccgggtacttacgaagaaccggcagggcattatattttcgagcatccttatgcgttatgggaatttggctatggtttgagttataccgaatttaagtataccgattgtaatttaagtgattctattttctcagacagaggtaagttgactgctactattgagattgagaataccggaaaacgagatgggaaagaggttgttcagttgtatgttcgtgataagattagttcggttgctacccctatcaaacaactgaaagctttcaaaaaggtatcggttaaagcgggtaaaaaggaaacggtaacgttggagctgccgatttcggaattagctctttatgatgcccgtatgaagcatatagtagaacctggtgaatttgagatacagattggtagctcttccgatcgtattcatttcaataagactattgtggtgaaataa

SEQ ID NO: 51 - DNA, 600 bp, Unknown
  Description of Unknown: sequence from a bacterial species not precisely identified
atgtatattattaattacggaggtttttgtatggcaaatgagtttgttgctgaaatagaaatgaatgcagaggataagatgaccaaaacggtaaatgtattaaaggaatcgatggcatccatccgtgcaggaagggcaaatgctaaagtgctggatcatgttcttgtggaatattacggaactatggcaccgatcgtgcaggtagctaacgtatctgtgccggagccgagaattttactgatttccccctgggatgcttctatggtaaatccaatctgcaaagcaatacaaacctcggatctgggaattaatcctaatacggacggtaaagtaatacggctgatttttccggaactgaatgaagagcgccgggcggagttggctaaacaggtgagaaaatatgctgaagatgcaaaaatagcgatccgctctatccgcagagatgctttagaacagtataaaaagctgaaaaaagattctgcaattaccgaggatgatgaaaaacgggctgcggattccatgcagaagcttacggataagtttgtggataaaatagacggcatctctgctgaaaaagaaaaagagcttatgtcaatttaa

SEQ ID NO: 52 - DNA, 294 bp, Unknown
  Description of Unknown: sequence from a bacterial species not precisely identified
aaactgctcttgctggatgagcatacggcggcccttgatcctaaaacggctgctaaggttttggcactttcagataagtttattgaagaagaaaagcttacggccatgatggttacccataatatgcgtgatgcgattgcgcatggaaatcggttgattatgatgaatgcaggaaagattattctggatgtaagagggcaggaaaagcgtgcacttacggtagagaccttgttggagatctttgcaaagaccagcggtacggaatttgataatgaccgtgcgctgcttttgtaa

SEQ ID NO: 53 - DNA, 381 bp, Unknown
  Description of Unknown: sequence from a bacterial species not precisely identified
ggcggggaaggacccggtcataaaggaggaaccatgcggaacctgattattattctggcgtttacggttgtttttgctgccggcgctgttttttctgatctgtatattaatacattgactgatgagatgcttgcgcagctggaagcctgtgaaacacagcaggatattgaagaattaacggaggcgtggagtaagcgcagctcaattgctgaacttgtgatcgatcatggcgaaattgatttgctgaatcaatatctttgggccatgcaggtggagatcgtttatgattatgatgaatttatggaatctaaaaagctggcaatggaaatgtttaagcatatagcggaacggaacaccttttctttagataatattttataa

SEQ ID NO: 54 - DNA, 603 bp, Unknown
  Description of Unknown: sequence from a bacterial species not precisely identified
gctgggtgcttcaaaataaaaactggaagtgatattcttgtgctggcaggattgggaaatccggggcagcaatatgttcaaacaaggcataatatcggctttcgggtgattgattttcttactgtggaactgaaagcgtctatgcccagagaaaagtttaacggattgatctttacggcagaggcggcaggaaaaaaaatattgctggtaaaacctcagacctatatgaatgagagcggccgatgtttgctggagctgctgcaattttataaattggaacactcggcattaacggttatttatgatgacattgatctgccagaggggaaagttcgtatccgctctaaaggcggaccgggaacgcataatggaatgcgttccatcgtttcgctgctgcacggcgaagatttttcccgtatccgcatcggtatcggaaggccggagatgagggcaatggatcttgctgcgtttgttttgggaaagtttacgccggaggcggctgatacgatgcataaggccgtttgtacggccggtgatgctgcagtagaactgataaaaaacggctgtgaagcagctatgcaaaagtataatgtatcggggtag

SEQ ID NO: 55 - DNA, 702 bp, Unknown
  Description of Unknown: sequence from a bacterial species not precisely identified
atggattcaagtgaaaattatgcagaaattttaaaaaaattagagaaagcggccgaaccggattatcgggcttttcatgcgcgccttgtgccgggggcgaatgtggcttacggcgtgagagtgccgcagctgcgaaagatggcccgtgaaatcctgaaacaggattggcggggatttttgcaaacagccagagatgacagctatgaagaacagatgcttcagggctttgtgattgcgctttgccgggaagagtttgaacaaaaatttacgcatttttgccgttttacacgaaaaatgaaagattggtgcgtatgtgattgtacctgtgcggcttttaaggagattcaaaagcacagggaagagatttttgaaaaattgaaagaaatgacacaggcagaagacgaatttaccgtaagggctgcccttgtcatttttcttgactattttgcagatcctgtgtatattgatagcgtacttgcctgtattgaggaatgccgtcatccgggatattatgcaaaaatggctgccgcatgggcgctttctgtattatttttaaccgatagtaaaaaaacggctgccgttatttgccggatggatgaatttgttcaaaagcaggcggtgaagaaaataaaggaatcctatagggtgcctaaagaagaaaagcaacggctgcagcagctgagcggacggcaaaaaggatag

SEQ ID NO: 56 - DNA, 837 bp, Unknown
  Description of Unknown: sequence from a bacterial species not precisely identified
atgatgaatctgttaaaggcagcaaaagaaaagaaagtattattggtagcccataggggtgtctgcggcggcaacattccctgcaattctctgcaagcctttcgcgccgcgatcaatcagggtgcagatatcgtagaattggatgttgaccgcagtgccgacggcgaactatttattcaacaccccggtatggaacgggtacatttgagaattcctgcttccatccgaaactataactcggcggaggtacaagaattccgcctttctaactgtgatcttgcacctaccgaatggagtatcgtacgtttagaggaagccttagagttactgcgcggcaaatgcatcgtaaacatcgacaagttttgggaaaatcccgaagccattgcaaaactggtgcgccgtttaaaaatggaagatcagatcctaatcaaaacagaaaatcgacccgaatatttgaatgacgtggaaacttatgcgccggatattccttatatgaccatcgctaacacagaagacacaactcatgaagcaatgatgaagcgcagcatcaactatgtgggtacggaagtcctctttgaaaccgaagatgctcctgttgcttcggccgaatatttaaaccaaatgcatcatgatggtaaaatcgtttggtccaatgccatcgtttataattatcgtgccgttctttctgcccatcataatgatgatatctcccttactgaagatcccgcaaaaggctggggatggctggccgatcatggctttgatttgattcaaactgactttttatttccctgcaaacattttttagaaaccaccggacgccgaactgttggttaa

SEQ ID NO: 57 - DNA, 762 bp, Unknown
  Description of Unknown: sequence from a bacterial species not precisely identified
atgacgttatttgactgccacgtaaatgctgacagcacacaacagcagaatatcagaaaatactgcgctcaggcaagacaacagggcctcgatgggttctgcttgactgagccggttgttttttccaaatccgaaagtacaataaaacttccccaattccccgctaaagagcatagcgatctggaaattttaaccggattagaaattgaatttacaccggaaacacatacaagcatggctctgcgcaccgcggggcttaatcctgattacattattaatgccgttcacagcgcagacggactgtccctacgggatatggaatattatacttcgcaaagccgaaccgatgcttacagcaattatcttacctgtgtgtttgattcccttgacgcggcttttgagtactccgtattaggccatatcacctatgtaagcaaatatgcctattacccttcgccggcactggaatggcgggaatttccggatattttggacaatattttgatgcgaaccgtctttatggggaaaggcctggaacttaacgcttcggcgtatgcatcggaaaaacttctaatgccctcactttcggttctaaagcgctaccgagagctcggcggggaaattcttacatttggttccggtgcacactcttatttgcatgtaggagcacatatgcatgatatgtgcgaagctgctattagctgcgggttcaaatactacacggtatttaaaaaaatgcgtccgcaaatgtatccgttatga

SEQ ID NO: 58 - DNA, 669 bp, Unknown
  Description of Unknown: sequence from a bacterial species not precisely identified
ttgaaagtaaaaagcacggcaatgcagaagcttttcggtgttctgatcgggctgctgatggcgtacgcaacctttttttccgcattttcttccatgctttacagtccgtcgttttatctgaaacaggattcccgctatcagatcacggagcgcgctgaattaaaaaacgctgatgaataccgcaaaatttatactgcggtcattgatgcgctgaagcacggaactgaagaagcgcagaaggcagttgtggtcaaaaaaggctatgccgaggatttttccgatacggttttctccctcggcagttttacctttacaaaggaatggcagcagttttcttctgaggttacgcttgacgaaaaatactttgaaacgctcaataagctgtatgactacggttacgatgaggcgtatacgctttttgtaaaattcctgaatgccgctgctgaggaaacggcaagctatttgcttgatgattttaccgtggaacggattgacggccaaggggctttgcttcttgccgcttccgatgcggaggaggagacgcttaccggctggcgtgtgttctcccggggggacggaaatgtgacaaaggccggggaggggagaaacggctcctcaggcgcagtgctctttgcaccggatagcgcccaaagtgttttggcctttgcc

SEQ ID NO: 59 - DNA, 453 bp, Unknown
  Description of Unknown: sequence from a bacterial species not precisely identified
atggaaactgccgaacaaaaaaagtataaagaatatgtagcgcaaaaggcgccgaaaagccgattgctgtatgattgttttaaggccttttgggtgggcggattaatctgtgtgatcggagaggcgatcagcatgctgtttttaaatgtatttgaaatggagaaaacggctgctgcttcctggacgtccatcgttttggtatttttgggggcgacgctcacggggatcggcgtgtatgataaaatcggtaaatatgccggcgcaggaagcgtagtgccgattaccggttttgccaacggcgtagcgtcaccggctattgaatttaaaacagaaggctatgttatgggactgggggctaaaatgtttattattgccgggccggtgatcgtttacggcgtttgtacgtccactttggtgggccttatttattatatcataacgaggtttgtatga

SEQ ID NO: 60 - DNA, 828 bp, Unknown
  Description of Unknown: sequence from a bacterial species not precisely identified
atgatactggatgggaaggttctggcagcagaaattaaaaatgaactgcgggagaagatcgcagcatcgggaaagaaagttgtacttgcggtcgttttagtcggggaggatccggccagctgtatttatgtaaaaaataaaaccaatgattgccgggaaatcggtgtggaatccctggagtatcgtttaaaagaggatacacagcaggaagagctgatggcgctggttcataaactgaatagggataaagaggtacatggaatcttagtgcagttcccgctgccgaaacatctggaccaggaagccgttgtgaaggcgatcctgccggaaaaggatgtggacggcttttctaaaatcaatatcggcggtgtattgatgggggacagcgagagctttgtttcctgcacgcctgccggtgcaatggaactgatcaaagccagcggtattacaatttgcggcaagcgggccgttgtgatcggccgtagtaataatgtgggcaagcccatggcgcttttgttgctgaatgaaggagcgacggtgacaatatgtcattcaaaaacccagaatttagcagaaattacaaaagaagcggatatactggtaagcgctgtgggacgcgcgcatatgataacagcagatatggttaaggaaggtgccgtggtgattgatatcgggatcagccgcattgacggccgtcaggtaggtgatgtggattttgaggctgttaaggataaggtttctgctattacgcccaatcccgggggaaccggtcctatgacgcgggccatgctgatgtgtaacaccgtgaaagcggcgggaattttatga

SEQ ID NO: 61 - DNA, 1092 bp, Unknown
  Description of Unknown: sequence from a bacterial species not precisely identified
atgtggaattccattaataatccgtatctgattgtcgctgcttatatcgaaaaatatgatgcttacagccatcctctttcggcgcatcaggaaagcatcggcagtggcggaacagagtgtctcggtaatggaattggttactatttggcgggcagtacttttgaccaaaacggtaatattgttaaactttcggacaaagtacttacgccgatcgataccaccggttatacgctttattatggcgatgcccagacaagaccgtccgctttccggaacgtaagcaaccatacctggtatgcggcacagctttctcccacgttgaattcatccggcgcagaacagatgaacaatattgcaaaggattattggtataatggacagggaaaggttattgtaaactatgaaccgcggtactgttatctgtggacgaaaaactacggcatgcgtgcgcggggatggacagcttacttaagtggtatgtttggctttgcctacggagcccaggatacatgggattatcttgccacgtataatgaagatgcagattttaatgatgtcaccgaatatattacttccgaagaaaaaacggcggcgacctatattgacgggttaaattataagagcgccaatcagttagggtatgcgcggaacttctttgaaactactgtaggggattggcagaatttaattccccggtttaatgataccgcctatttcacaaaagccaattcaggagtgctgtatcatatggccagcaacagtgataacagcaaggcagtaatatacttctatacggtttctgttaccgagggcggatttaatgatgacggtcagctggcggcggatattttgcagatgcacaacggaggctatgatatgcctgccagcagcaacggttcgtctatagcaagcacagttacgggaacagtaaaacaacttatagccggtgctacgtatcagtgcacttggttcaatccaagaaccggtcaaaccggtaccagctttaccagacaggcaggacctttaggtaatcttatcttaaattccaaaccagatggctgcgactgggttctttacattcaaaaggtataa

SEQ ID NO: 62 - DNA, 582 bp, Unknown
  Description of Unknown: sequence from a bacterial species not precisely identified
atgtctttgctgtttgcattgatgatggcaggttgtgccggatatgctgattttgcaagtgtacttcctccacaaaaaagctatcccgaagcaggggaatatgaacaaacaactgcagtaaaaggaacgctgcagatcaaaaagtctttccggggcaattctaccgggggtgttttatatctctttggggatttggagagttccaatagttttactgtaggcgagcaggggtatgtcacattttattatcagaatctggaaatcacctggccggcggaaatcattgaaagtccgggaacgggccagggaacataccgggcggcatattccaccggaaatcaagccgatgtacccaatcactttccggggacgttttggatactgattaaagaaatccctgattgtattatgctcaacaaaaaggcggttacaatcaccggaatcgataatacagcgatcgtacatcttttaaatgatgacggtacaattgcagataaagagattactgtaggagattctaatacggaatattatgaaataacctcgggcctgaatgagggtgataaggtaataatggggtag

SEQ ID NO: 63 - DNA, 555 bp, Unknown
  Description of Unknown: sequence from a bacterial species not precisely identified
atgcttgaaatgaagaatatcagcaaaatattcaatgctggtactgtgaatgaaaaggttgcgcttgaccggttgtccttgaccttggaagacggtgattttgttacggtaatcggtggcaatggcgcgggaaagtctactatgctgaatgctgttgcaggagtttttccgatagatgcagggcagattctgattgacggaacggatattacccgtcttcctgaacacaagcgggctgcctttatcggccgtgtatttcaggatcctatgacgggtacggcagcggatatgtggatagaagaaaatatggcgcttgcctatcgccgagggaaacggcgcgggctgcgttgggcaatcactgcaaaagatcgtgccagatatcgggaaatgctgaaagaactggagcttggccttgaagatcggctgtctactaaggtggggttgctttccggcgggcagcgtcaggcaattaccttgctgatggcaacgatgaaccggcctaaactgctcttgctggatgagcatacggcggcccttgatcctaaaacggctgct

SEQ ID NO: 64 - DNA, 1017 bp, Unknown
  Description of Unknown: sequence from a bacterial species not precisely identified
atgtcagtaaaagttgctattaacgggttcggccgtatcggccgccttgctttccggcagatgttcggcgcagaaggctatgaagtggttgctatcaatgaccttaccagcccggacatgcttgcacatctgcttaaatacgataccgcacagggcagctatgtagccaaaggccacaccgtagaggccggcgaggacagcatcactgtggacggcaaaaccattaaaatttacgccgaaaaggatgccgcaaaccttccctggggcgagattggtgttgacgttgttttggaatgcaccggtttttatacttctaaggaaaaggctatggctcacatcaatgccggcgctaagaagtgcgtaatttctgctcccgcgggcaaggatctgaaaaccattgttttcagtgtaaacgaaaatacgcttaccgctgaagaccaggtaatttccgccgcttcctgcaccaccaactgcctggcgcccatggccaaggctctgaacgactatgcgcccattcaaagtggcattatgactactgttcacgcctataccggcgaccagatggttctggacggcccgcaccgcaaaggggatttccgccgtgcccgtgctgccgcgcagaatattgttcccaactccaccggcgcagcaaaagcgattggtctggttattccggaacttaacggtaagctgatcggctcggcccagcgtgttcccacctgcaccggctccaccaccattcttgttgccgttgtaaaggggaaggatattaccgttgagggcatcaatgctgccatgaaggccgcttcttctgcctcttttggctacaataccgaccagatcgtttcttccgacgtaatcggcatgacttacggctccctgttcgatgcgacccaaacgatggttgcacagatcgacgaggatacctatcaggtacaggtcgtttcctggtatgataacgaaaactcctataccagccagatggtacgtaccattaaatattttgccgagctgtaa

SEQ ID NO: 65 - DNA, 945 bp, Unknown
  Description of Unknown: sequence from a bacterial species not precisely identified
atgattgatattgtttttttgggaacgccggattttgcagtgccttctttaaaagcattggtagaaaacggctatcgtgtgaaagctgtatttacccagccggatcggcccaaaggacgcggcaacaagctgacgtattcaccggtaaaggagtatgcacttcaaaaaggacttacagtatatcagccggagaaaatccgtttgccggaaccggcggccgtgctgcgcgcacttaaaccggatctgatggttacagcagcgttcgggcagattctttcaaaggaaaatttggattccgcgcgtttgggctgtgtcaatgtacatggttcgctgctgccggcttaccggggatcttccccgattcaatgggcggtaataaacggggaaaaggaaaccggcatcacgactatgtatactgctatcggtgtggattgcggcgatatgattctgcagaaaaagatcaatatcggtgaaaacgaaacagccggtgagctttttgaaagaatggcgccgctgggcgctgaggttttgctggaaaccgtgcgcctgatcgaggagggaaaagcaccgagaattccgcaggatgagaaaaaggcaacgcattttcctatgctggataaaaaaagtgcggcgattgattttgcgcaagaggcgctaaagatcaagaatttaatccgcggcttgaacccctggccggttgcctggacaatgtgcggcaaggatgtcataaaagtatattcagcgacggttttagagcaaaaagcggaagctgcaccgggtacgatcgtgtgtgcagatgaaaaacaagggcttatcgtttgcacgggggatcagctgctttctcttgacgtaatacagctgccgggcaaaaaggctatggaggccaggctgtatctgcgcggaaattctctttctgataaatttttatattatgaagcaagataa

SEQ ID NO: 66 - DNA, 702 bp, Unknown
  Description of Unknown: sequence from a bacterial species not precisely identified
gtgattgttttggcaaagatacaaatttacggggattccattttgcgcggagtgacactcaatgaggaaactcagcgctattatatcaatgatgcgattggcattgatgccttagccaaggatattcatgcggaggtagctaatttttctaagtttggctgcaccgtgcaaaagggaatacatcttgtacagaacaatttggaaaagggcgccgtttgtgattatgctttggtggaatacggcggaaatgacagcgactttaactgggcaaaaattgctgaagaaccggaacaggaacatctttctaatacgccgttggaaaagttccgtgagctttataaaaaaatggtggtgtcgttaaaaaacaacggaattattcctatactggcgacgcttcctccggtagatgctgaaagatatttttcctggatctgccgcaatggtttgaataaagaaaatattttgcactggttgggcgatgtttttgccatttaccgttatcaggaacaatattcccgtaccgttgaggctattgctgtggaaacgggttgtgagtgcattgattttcgtgcggcatttattaaaaatcgtaagattaaagatctgttttgttctgatgggattcatcccagcgtaaaaggacaggcgcttatcaaccaggagctttcccgttttgtcaagaaaaaagcccttgaggcataa

SEQ ID NO: 67 - DNA, 387 bp, Unknown
  Description of Unknown: sequence from a bacterial species not precisely identified
atggaaaagcatcctattgaaaacattatgtcctctacgatggaaagcctcaataaaatgatcgatgtggataaggtgatcggtcatgcggtaattgctcccaacggcgctacgattattccggtatctcagttagccttcggatttgcttccggcggcggagaatatgaatttccgcagagtaaaaaagaagaatttccttttgccggcggtgccggtgcgggaatttcggtaaaacccagcggatttttagtaatctccggggatctgattcgctttttgccgatacaaaaaagcagcagctgtgataaaattattgatcttgttccgcaggtggtagaacagattaagaatatggggaaggaagaagataccactgttgaataa

SEQ ID NO: 68 - DNA, 639 bp, Unknown
  Description of Unknown: sequence from a bacterial species not precisely identified
atgacgcgtttaatctttgtccgccacggagaaagccaggccaatcaactgcgcctgtttgcgggctccagtaatttcgctcttacagaaaaaggagttgcgcaagcgcaggctaccgcacaggaattaaaaaagtataaaattgatgccgtctatgcctctgatctacagcgggcttattacaccggccttgcaatcgcccggagccagccatgccctatttataaaaacagcggtctgcgggaaatttcggccggtctttgggaaagctgttcttttgataccattgccaaagactatccgcaaatgcatactgtttggacgcagaatatcggaagggcaatattaccgcaaggagaatccgtagcgcagctgtattcccgtgtaaaaactgctgtgatgaacatcatcgatcaaaattccggaaaaactatttgccttgccacacatgctacgccgattcgggcaatggaagccgtatggaattcccgttcctacgatcatatgcaaaaattcccttgggtatccaacgcttctatatcggttgtggactttgatcagggctgctggaaggtcatcgtacgcgggtataacggtcatcttggcgccttaaatacagagcttcccaaaaatatataa

SEQ ID NO: 69 - DNA, 897 bp, Unknown
  Description of Unknown: sequence from a bacterial species not precisely identified
ataataaaaataattctactacggaattatcttttattatgtcccgatatttttgcaaaatttgtctttaggaggctgaaaatgcaaaaaaaaagagtacggcattataaaaatacatattcaagcatttatatcagcttagcacttgtgctcgtgttggtattgcttattcttagtgttaccgctgtgatcctatttttgccaaaggagaatagcacggggattccgggatccattcctgtgctttcggaaatcgatgaaggcgaagcccccacagacgcggctatttatccggcaagtttattggaactgctggaacgcaatccggaaacggaagagtttgttttagcttatccgacagatcataaaaagaaatgggaggtcgatctcagcgaatataaaaacagtaaaaccgtccctctttttttacagtgggacaagcgctggggatatatagagtatggcagtgatatggcagggcttaccggctgcggcccggtatgtctttccatggttgcctattattacatcagaagtaatgacgtagcaccggataaaatgattgaatttgcaaaaaacaacggatattgtgtaaagggaaaaggctctgcctggacgctgatcagtgaaggtgcaaaaaaattgggtctgggtgtggaagaactgccattggattcaagtacgattttcaatcttttagataaagggattccaatcgtttgcgtcatgggtccaggtgtctttacatccaccggtcattttattgtgctgacaggaacgaaaaacggaaaaattactttgaatgatcctaacagccggaaaaattctgaaaaagaatggtctttatatgagtttaaggatcaaatcaaaaatctttgggcgatcagagcctgctga

SEQ ID NO: 70 - DNA, 771 bp, Unknown
  Description of Unknown: sequence from a bacterial species not precisely identified
atggccagggttattgagatagaagctgaaactgtcgatcaggctttatatatgggcttggagcagttgaagctttccattgatgaaattgaaatggaagtattggattacggcaaaaaaggctttatcggtatcggcagcaagcccgctaaggtaaggcttacggagagaagcgaagctgtaattcctgattttgtattgaataaggacaagcccaaagaacgtgcgcctcgtagggagcgcaaggaacgttcgcgcagagaacaccgtgaagaaggtcagcagatgctgaaggaaccgtattttccagaaggaacggaatttgtagaaaatgaagttacttcttttttgagcggattgatgcagctgatgcaggtagaaggaaccataaaagccgccgagactgaaaacggattgttggtgaatttagaaggaccggatatgggcgtgctgatcggccgccgcggggaaaccctggatgctatacaatatctttcttctttggtatataataaaggaaaggaagattatcatcgggtgacgatagatacagagaactaccggaagaaaagggagcttaccttgataaaattggccagaaagatggccggacaggtagcgcgtaccggacgtaaagtggttttagagccgatgagtccgtttgaaagaagaatcattcattctgccttgcagaatgataagctggttacgacttatagtgaaggggaagaacccaatcgacatgtgattatcgataaaaagaacggataa

SEQ ID NO: 71 - DNA, 1260 bp, Unknown
  Description of Unknown: sequence from a bacterial species not precisely identified
atgggattaataaaagatataaaagcaacacaagtattgaaaaagatttatggcgagcaggcaaaaagccagcttgaccgctatgcgcgtattgaagaaaaattccaggcactgttcgggaacggagaagtgctgtttttttctacctccgggagaagtgaaattatcggtaatcataccgatcataaccatggctgtgttatggcagcgggaatcaatttagatgcagtggctgctgtgagaaaaacagaggatatgaaggtgcaatttatttccgaagggtacccggataaaaatataatcgatttaacagatctttcgctcaatatcaaagaacgcggtacaaccaaagccttgattcgaggaattgcatatcgaatgaaagaggatttagggctgaatatcggtggctttcaagcgtatgtacagagtgatgttcttcggggaagcgggttatcttcttcggcagctattgaagtaatgatctatacgatatttaattatttgtataatgatggcaagttggatgctgtggaaggcgcgaaaaccagccagtgggcggaaaataattattttggtaagccctgcggtttgatggatcaaacagcatgcgctttgggaaagcttgtttttattgatttcaatgatccttctgcgcctgatatcgaaggaatcgacttcgatttcggcaacgagggatattccattgtgattaccgatgtacatgccgaccatgccgatttaacggcggaatatgctgctattactgaggaaatgaaaagtgtcgcggcctattttggcaaagaggtactgcgggacgtaaatgaaaaacttttttatgaaagtcttccgcagctgcgggagcatgtaagtgaccgtgccttaatgcgcgcaatgcatttttttgaggaaaataagcgggttttgcaagcagtagaggcagtaaagagcgataatatatcggcctttttggaagcagtaaacgcttccggtgaaagcagctggaagcttttgcagaacacgcatgcaactggcagcacggcgcaggcaatgactcttgggttggcactaagccgccgtattttaggcaaaaaaggcgcctgccgagtacacggcggcggttttggcggcacgattcttgcgtttgtacctgatgcgctgaaacaaacctatacagaaaaaatggagcgggttttcggcaaaaatgcctgtgtggaactttctgtacgtcccataggaagtacttgcgtagaattatga

SEQ ID NO: 72 - DNA, 801 bp, Unknown
  Description of Unknown: sequence from a bacterial species not precisely identified
atggcaagaatccccgaagaatttattgacagcttaatagataaagtagatattgtagatgtagtatccgattatgtttctttaaaaaaatccggaaacaaatatgtgggactgtgtccgtttcataatgaaaaaactgcatcgtttactgttgatggtcaaaaacagatgttttattgctttggctgtcatgtgggcggaaatattattggctttttggaaaagaaagaaaatcttactttttatgaaacgattgaagagcttgctaagcgtgcgaatgttccaatgccggcaggtgtcagcacagagccgacattttcccgggatttaaaaaaccgaatttatgaggcaaaccgagaagctgcaagattttattttaatacgttgtttgaacctgagggagcagaggggtttgcttatttgcaggggcgcggcgtaacggaaacgattattcgtcgttttggcctgggatatgcgcccgattcgcgggatcttttgatcaagcatttaaagagcaaggggtttgaagaggaaattcttgttacggctgggcttgccagaaaaaatgagttcggtctgcgggataatttccgtacacgggtgatgtttccgattatagcgccttctggtgagatattaggcttcggcggcagagtgctggatcattctttgcccaaatatttaaataccggagatacaccggtatttaataagcgaaaaaacctttatgctttgaatattttaaaaaagaacaaccgggggcgggctattatcggcgaaggctatatggatgttattgca

SEQ ID NO: 73 - DNA, 1680 bp, Unknown
  Description of Unknown: sequence from a bacterial species not precisely identified
gttgacggagataatgctttggttgaagcggcgctttcggcgcgttcgtttttgaacctatgtgagctgggcgttccgtttcctaccaatcggtacggcgaatatgtagggtataaaaccgaccacgatccctgtgcgcgggcaacctcggtaggccctcttacttcaaaggagatgactgaaaaactgcagcgggaggcggaacgccgcggtgttgccgtctatgaccggcagttggcggtttctattatcaagcatgaaggaaaggccgcaggccttttaacgatggatttaacggccggggagaaaccgcattttacgctttttaactgccgcaacatcatttttgctaccggcggacccggcggaatctatcaggacagcgtatatcctgcctgtcataacggtgcgaacgggattttatttgaggccggcgccagggggcagaatttgacggaatggcagtatggcttggcctcggtaagcccgcgctggaatgtttccggcacctatatgcaggtgctgccgcggtttgtttccgtagatgaaaacggctgtgagcatgaatttttaaaggaatatttcgccgatgaagggcagtgcctttccatggtgtttttaaagggctatcagtggccgtttgattcccgtaaggtgatggaggggtcatcggttatcgatctgctggtataccgggaaagcgtgatgcgctcacggcgcgtgttcttggactttacgaaaaatcccttcggaaaagattctctggattatgaggcactctccggtgaggcgaaagagtatttgaagaacgccggagcttgtttcggtacgccgattgaacgcttaaagcatatgaatgagcctgccattgaattgtatgcctccaaaggcgtggatctctaccatgaaatgctggaaattgctctttgcgctcagcataataacggcggtatagcggttgatatgtggtggcaaacttgcgtggagggtttgttcgtctgcggtgaggcggcgggtacccatggaatctatcgtccgggtggatctgcattaaacgccggtcaggtaggctctttgcgggcggcgcagtatattgcggcgaaaaggcagggcgagcctttagcgaatgcggtctttcttcaggcggcggcaccgtacgtggaagagcatcgccgcttttgccaaagcttgatgacgcacgaagatacggtacaggccttgacgcagaaggcaaaaaagcgcatgagcgttgccggaggagcgattcgcaaggaggaatttttggaaaaagcatatcgggagacagcggaggatttgcagctgctgcggcaaaacaccggcgctgcgggtgaacggcgttttatccgtgcgtatcggctgcgggatattttgatctgtcagcgaatgtatctttttgcgatgatggactatatccggcagggaaataagacacggggatcatccctgtattatgatgaaagcggtatgctgcggccgggattagaggaaaatttccgatttaccttagatgacgggcggcagaacggcacggtacaggagattgcctattttcctgaacaatgtacggcgtcatatagaagtgtacggcccttgccggaaggcggcggtttttttgaaaatgtttggcgcagttttcgggaaaaccaaaatattgattaa

SEQ ID NO: 74 - DNA, 1143 bp, Unknown
  Description of Unknown: sequence from a bacterial species not precisely identified
atgcgggaatattgggtaaaaatgctgacgcagctggcggatcctgtattggatacgtttgtttcgcgtgagaaaaaaatgcctgtggccgggaatgaagcccgtttgcaggttacatatttggaggcgttggggcgccttctctgcggtatggcgccatggctggaacaggagcagaacgatccggcagaggaagcactgcgtaaaaaatatgcggcgctggccagggaggctgttgatgcggcaacggatccggcctcaccggtagtatgtaatttttcggatcatgcaccggacgggacgccgatcagtgcgcagcctttggtggatgcggcatttttaggacaggcccttttgcgcgcgcccggagagctttgggaaaagcaggatccgcgcgtgaaagagaatttgatcgcagcttttcaaaagagcgcgggaatcagaagctatcggagcaattggctgctgttttcggccatggtgcagacagcgcttgccttaatgggacaaaaaccggatatgatgcatgtggattatgcgatgtttgcctttgaaaaatggtataaaggggacggcgcttacggcgacggagaatcctttgccttcgatttttataacagctatgtaatccatccgatgttggtggatattactgcgcggatcggcaaatattacggtgacgggcaagagcatctggaacagttccggcagcagacggtcgttcgcgcggcacggtatgccgcggtagaggaatcgttgatttctcctgacggaagctatccgcctttgggacgctctattacttaccgctgcggcgcgtttcatgctttggcgcaggcggcatacttgcataatttgccgcctttatgtaggccggcgcaggtgcgcggggcgctcgaggcggtgatccgccgtacgttagaagcggaaaacacctttgatgcaaacggttggctgcaggtgggactgtgcggtgtacagccttgtttagcggaaaattatatttctaccggcagcttgtatttgtgttcgacggcgtttcttccgctgggactgccggcgtcggatcccttttggagcgatccggacgcaccttggacaatgtgcaaggtatggagcggtgtgaacgaaaagattcgataa

SEQ ID NO: 75 - DNA, 945 bp, Unknown
  Description of Unknown: sequence from a bacterial species not precisely identified
atggaaaagtcattctcagcaataacacggttagaggcagcaaagggaaagttcggaaaagaacctttccttttagcagagcttgccgcgtattctttttcctgcggaaacataaaaataggaagaggaagcctttcgctggaactttccagtgagtttgaagaagtcattctccgtattgccgctattatcaagcgtctgtatgcaaatgcaccggaaatccgcgtgatagaaaaaagccagccgaaaaaacacacctgctttgtgcttgagatctctccgcaaacgcctgaaggacagttgctgtttgaaatcggattgctgcagggaattgatgaaaattatcgttttggaagcttaaatcccactgtttttgaaacatctgaatgttttgatgcgattttacggggggcctttttaggctgcggtgtgttatgtgatccccataaggaatacaggttggagtttgtgcttgcccatgaagaatttgccgtatatcttttaaaaagaatgctttcgtatgggtttcaggcaaagaacatgacgcgccgggatcggcacgtagtgtatattaaacaaatcgaaaatatttcggatattctgattttgatcggtgccagaaatgtaatgctggatatagaaaatatccgggtttacaaggatgtaaaaaatagaattaatcgcagtgataactgcattatcggaaacatggggaaaacaattactgcagcgcagcggcagttggcagatattttaatcgtgcaaaagaccggaatccggctttcttcctccctgagggaagcttgcgagctgcggcagaatcatcctgaagcatctttggccgaactggcagccctaagcgaaacagctacaaaatcggcactgaacaagcgttttattaagctgcatgaaatggccgcagcaattacagaaaggaagatgtaa

SEQ ID NO: 76 - DNA, 3822 bp, Unknown
  Description of Unknown: Firmicutes bacterium sequence
gtgggagtaacctttacgaaggagcagcagcaggtcatagatttaagaaaccggaatcttctggtttcggcagcagccggttccggtaaaacggcggtgcttgtcgagagaatcattcagatgattctgaataaagagcatccggtggatattgaccgcttactggtagtgacctttacgaatgcggcagcggcagagatgcgcgagcgtatccggcaggcgattgaccgggagcttgcagtggatccgtttaacgggcatttacagaagcaggcagcgttattacataaggcgcagattaccacaatcgacagcttctgtcttttcgttatccgcaatcatttccatgagatcgggttagatcccggcttccgtgtggcagatgagggagaactgaagctgttgcagcaggataccttaaatgaactgcttgagcaggaatatgatgcggcagatccgaagtttctgcagtgtgtggaatattttacagggggaagcaacgaccggcttctcatgcaatatatcgaaaagctacatgacttcgcagagagctatccctggccggaagactggcttcttggctgcatggaggattataaagctgcggatgtggaggaactgaacgggacgcagtggtgcaggtatcttacctcccatgtgtgctttatgctgcaggagctggccggaaaactctggcaggcgtgcaggctgtcagagcgtccggcaggcccttatatgtatggggagcttcttgaaaaggaagcggagatgttagagcaggcatcgatgaaggagacctatcaggaacagtatgaggtcatggagaagatcaccttcgggcgtctcccttcgaaaaaggatgactctgtggatcctgcattacgtgccatggctcagcaactccgtaatgaggtgaaaaagcagatcgagaagctgaaaggcgatttcctgttacgatctcccgaacaggtgcttgcacagatgcacagagcctatccgatggtggaggagcttatttctctggtgctcacttatgaacgtatgcttacgcagaaaaagcgcgaggccaatatgatcgattttggcgatatggagcatctggcgttacagattctgcttaccagagaggacggggagattgttccgaccagggcggcaaaggagtaccgggagtgctttgacgagattctgattgatgaataccaggacagtaatctggtgcaggaatatcttctgatggcagtttccggagaacaggacggacgaaataaccgcttcatggtaggagatgtcaagcagagcatttataaattccgtctggcaagaccggagcttttcatggaaaagtaccatacctatacgaaggaagaatccggctgccagcggattgacctgcataagaatttccggagccgcagagaggttttggagggagtcaacacgctgtttcagaagattatggggcaggagcttggcgggattgtctatgatgaggatgctgccctttatgagggagcctcttatccggaaaacaccgggaatgacacggaatatctgatttttacgcaggaggaggaaagcggagagtcggtgcgcagctttgaagccagggcaattgctgccaaaatccgtacactgtatcagagctttcaggtgacggacaaggagaccggtgcgctgcggccggtacagtaccgggatatggtgattctgctccggacgaattccggctgggcgcaggagtttaaggagacgctgcaaaaggagggaattcctgcttatgtgagcctccgcaccgggtattttgaagcctcggagatccgggagcttttgcagttcctgcatgtgattgacaatccgaggcaggatattcctctgtatggaacgatgaaatcttactttggaggctttggcgaggaggagattgcgggaatccgggccggtgtgacggacaagaagatcgaagggaaggcttcagaagataaggccaaagcaggagaaaatacctcagaagagaataccgtagtgggggatgattcagcagaagcggtagtggcagccggcaaaccggtggctctgatcgatcagttaagggcttatgatggagatttaaaagagaagatcgcggactttttaaccatattggagcattaccggcagatgtccgtttatacgccgattcataagctgctggaagcattgatttatacaaccgggtattttcagtatgtgacggcaaagcccggcggtgagcagcgaagggcgaatgtggaaatgcttttgtctaaggcggtcgcctttgagcagacgagcttttatggtgtctttcattttctgcgctacatcgagcagctgtcgaagtatgaggtggattacggagaagcggatattctggatgaaaatgctgatgtcgtacggattatgagtatccacaagagtaaaggactggaattcccggtatgcttcgtggcaggcttatccaagaaattcaatatgcaggataccacaggacgtcttgtgaccgatatggatctggggatgggagtggatgagattgacagtgagcttcgcatccagcgccgtatgacgaagaaaaatgtggtttccctgaaaatgcgtctggatacgctggcagaagaaatgcgtgttctttatgttgccatgacgcgtgccagggaaaagctgattcttacagcagttgtcagggatggagaaaagcttagggaacagattgcattatatgaaaatacgaaggccgaggatggccgaatgcgttttacggatcttttgaatgccggatcgttcctgcaatttgttctgccggcattgtctgatgcacagtttatcagcgaaggagagctgaaggaacaggaaatttccggggagtgtggacagcttctgaaaagagaacagtttatgtaccggattacgagggaagaggcgccagaagaagagcttgcacagaaggaaaagctgcggcagcgcatggaccgcaggtatgcggacgaagggttaaaggagctggtgacaaagaccagtgtttccgagttaaagaaagcacagatggatttggattttgcgggagaattgttcccggaaaaggaaatcgtgccgtatattccagcctttatgcaggaagagcagggaatgtccggggcagaccgcggaagcgcttaccaccgggtgatggagctgcttgattttgagaaggtgctggaagcaaaagcacagatacaggaacaaaatcaagaatggaagcagaatcaggaacaagatcagagtcagaaagagaagcataatgaggaaaataataaagaaatgaaccgggaagaaaaccggagcaagaaatctgagaaatcagaagcagatacttacatgattttagagttggaacggcagattgcactcatggtagagaaagagctgttgcagaagccatggagcgaagccgtttctgtgaaaaagcttgttatattttttcaatcttcactggcacagagaatggcaaaggcacagcaccttcagaagcttaaaaaagagcagccctttgtacttggcatcgcagcagaccgcgtaaagccgcagtttccgcatgaggagcaggtactgattcagggaattattgatgccttttttgaagagggtgacgatcttatccttatggattataagaccgatgccgtaaagaccggggaagagctggtgaagcgttatcacacccagatggaatactatacggaagccttagaacgaatcgttggcaagaaggtaaaggaacggattatttattcctttgcactgggtgaggaaatccggatgtaa

SEQ ID NO: 77 - DNA, 2493 bp, Unknown
  Description of Unknown: Firmicutes bacterium sequence
gcaagctcatgtggttttagaccttttgaccctggcatcatgatattctatcccttgaaaaaacatccggaatcgtctagaatggaaaaagaaattcagcatgagaggtcagttatggatattattttaaaactcaaagaagaactcaacgtggaaaaatggcaggtggaagccgctgtaaagctgatcgatgagggaaatacgattccgttcatttcccgttatcgtaaggaagtaaccggatccttaaatgatgaggtgcttcgtaatctgcatgagcggctaacctatttaagaaatctggaggaaaagaaggaacaggttcttggcagtatcgaggagcagggtaagctcaccgaggaattaaaggaaaagattctggcagcagaaaccctggttgtggtcgaagacctgtaccgtccttatcgtccgaagcgtaaaaccaaggcaagtgtagcgaaggaaaagggactggaacctttatcacagttcattcttgcccagaatgcaacggaaggagtggaggaggaagccaggaagtatattgatgaagaaaagggcgtaaagaccgtgaaagaggcacttcagggtgcagcagacatcattgcagagggtatttcggatgaagccgattaccgtgcctacatccgtgaaatcaccatggaagaaggaactctcacaagtacagcgaaggatgaaaaggctgaaagcgtttatgagatgtactacgcttacgaggaaccccttaaaaaggtcgttggccaccgtgttcttgccatcaaccgtggtgaagaagagaagtttttaacggtgaagattgtggcaccggtagaacggattatacagtatttaaagaaaaaggttattacttctgataatgaatataccactccgttgcttacagcagcaatcgaggatgcctatgagcgtctgattgcaccggcgattgaacgtgaaatccgcaatgatcttaccgaaaaggcagaggatggcgcaatttccgtatttggaaagaacctgcagcagcttctgatgcagccaccgattgcaggaaaggtagttctgggatgggatccggcattccggacaggctgtaagcttgccattgtggatgcaacaggcaaggtactggataccagggtgatttttccgacagctccgcagaataaggtggaagaggccaaggcagagcttaagaagctgatccataaatatcatgtttctttaatcagtgtcggaaacggtacggcatcgagagagtccgagcaggtcattgtggagctgatcaaggaactggatacaccggtacagtatgtcattgtaaatgaagcgggagcttccgtatactctgcaagtaagctggcaaccgaagagtttccgaattttgatgtggggcaaagaagtgccgcttcgatagcacgcaggcttcaggatccgcttgccgagcttgtgaaaattgatccgaaatccatcggtgtcggacagtatcagcatgatatgaaccagaagaagttgggagaagcactgggcggcgtggtagaggactgcgtaaaccgtgtgggtgtagacttaaataccgcatccgcaccgcttcttgagtatatttccggtatttccaaaccgattgcgaagaacattgtggaatatcgtgaaaagaatggtaaatttgcgaaccgtgcacagcttttgaaggtgccgaagctgggaccgaaggcatatgagcagtgtgcaggcttcctgcgtatccatgatggagacaatcctttggacgataccagtgttcatccggaatcctatgcagctgccatgaagcttttggataagatgggacttacgatggaggatgtgcgtaccgcacagaagcaggcagcccggcagatgagtacggcagtgaaacctgctccgaagcagaataaccggaatgaccgcaggaaacagatcgtgatccataataccaatacggctatggggaaagccctggcagctgctatgggtggttcggtgatgaaccttgaagaaaatgactcttccgcaaagaaaccggtacagaaggaatctgcggccaatacagtcaatgcaatcagcagtcttgaaaagaagatcagggataagagcaggctggctgtagaactgggaattggtgaaattaccttaaccgacattcttaaggaattggaaaagccatcgagagatcccagagagagcatgccggctccgattcttcgaagcgatgtcctcgatatgaaggatctgaaaccgggcatgattttaaaaggaaccgtccgtaatgtcattgactttggagtgttcgtggatattggtgtgcatcaggacggactggtacacatctcacagatcacagaccgttatatcaggcatcctctggaagcagtgagcgtgggtgatattgtggatgtacaggtattgtctgttgatgtgccaaagaaacggattgcactgactatgaagatcaatcaatcaggatcaaaataa

SEQ ID NO: 78 - DNA, 3525 bp, Unknown
  Description of Unknown: Firmicutes bacterium sequence
atggagaatgattgctatatgtggagaatgaagaataatgatttggaagctcgtattgggattccggatggctttaaggtaaaagggggagatggcagagccatttcttcctggaatgaagtgaaaaatgcagacggttatattctgtcttattacagagccggtgaaccggagctgtgcattaaaaccaggtattcacaaaaaccggagaaaaccattctgggttttcgaaacggggtggaatacctggcggatgtgtgtgcatatcaattttgtgatggcgtggaaatcagaggggataaatcggataaaattccgtttgtacctgtttcaatgaagttaaaggctcaaaatgtcatttgcttatctgaaaatgaatcgaaaaaaatagaagcagaatataaaaatacgattccttacgttagctttcaatcgctggatgagaatgttgccgttgtagatgaatatggaatggtgaccgccagaaaaaagggcatgacggaagtcatcagccaaatggagaatggagaatgtacaaaaacccggatcgtgtgcgaccgcgacctgtcgagaacacgggaatcagatgccatgatcatgctgatgggagatctgatgtgtgcggtaaatcatcagcgtatagtccaaaataaggaatttgattttacaggttcgtttgacgatatcagcacgattattcaaaagggagatttggcaattggtgtactggaaaccatgtgtgatgaccattctccgtatgaatgcgaagaactgagaacttcatccggaagtcctaattgtaattcaccttcaacctttatcggagctgtaaaggatgcgggctttgatgcattggttacagcaaataatcataactgcgatacgggggctggaggattgaaaaatacagtttcgttgatcagaagtaatggtatgcaaaacataggaacacttaatgataatccggtttatttttccgttaaggggataaaaattgccgtgattgctttgtgtatgattaataatggacacgaagctaaaatgaatttgtggatggaggagcttggccggtacaaaacagaattatttaaacagtatgttgatgaggcaagaaaaaatcacgcggaattcattattgcatatcagcattggggaaagatgaattcctctgagataaaatccgctcaaagaaaaacggcggaagaaatggcagaagcaggagctgatctgattgttgcatcgcatcctcatttgatgcagaattatgaaatacttaccacctccgatgaaagaatggtgccatgcgcttattcattgggaaattttctcacatcaatgaatgaattcagtgaaaacagactcggtgcggttatgtgctgtaaactgcataagagtccgaagggtaaagtgtcgtctgcaatatcgtttattccgacaataagcagagacgatgcttcctgtggtataaagataggaattgccggtggaaaagagagggaaagaattgcggagctcctgtcagagaatgcccggatgataccctcagtgccggagccggacgtgatgctgcagggctctgttgtgttgaaaaaaatattttcttatttgccggagtgccggataaatcaggatgcgtgtattatttcccagttatccatactgaacggtaaaaaacaggagttgaaggaacggtgtgcagagcgggtaaggatagatatagaaaaagaccttgaacagtgcctttcaaaaaaccgggcagaatatatgatagttgatttttatgctgctgcagcaatttctctttataaaatggatgataattattacacggcctccgatgcttttgttttatctgatttttacaaaacaaataaagacaaatttgagaaacagacacctccgtttagtgaaagcttctggaaagaacagattaggaaatatgccggacttttactgaaatattatcctaaagaaaagattgtattagttcgactgagcttttctgagacactggtagtaaagggagagatgagaaacggtaaaaaccggagcgccttaaataatcgtatcagggagctggagagctattttatttctattgtgaatccggtcgttattgatatagcagggcattatttcggagatgcacagtccacctcgccgtctgcatttgaggaacatttttatctggatactgcccataagctgagagatatttttgaaagtaagagtcatcaattttattattctgaagagaatcaggaattcagaatggatagaatattaaagtattatgataatctgatggcacgcggttatcaaaacagaatgcttaatcaggagcaattggcagataggatcatcatgtattcgtctaaggaatttatccggtcacattaccatggaataatggagttgatgaaacaccatgtggcagaccttgaagaagcagtactttatctggaagaaaatgaattaaataacgaactgctgagtgcagccaaagcaattcagatgatcgtagagaaggatctttccgggtcttatgaatgttatcggatattattcatatggaaaatgcagattctgaaggagatggcattacagttctcggaaatggtcggattcaatgtctgtgaggacgagtgtgaaattttctttctgataaaaaataatgggaaagctctggagcaatttttatccgctaaccacaaaataaaggtggatatctggggaagctgtatttccagggagataatgaatcgaaataagcgggatatagtggtgaataaatatatcttcaagcagccgcatttacttgcctttgaagctccggttccatgtgatgttccgaaggataacagtttatttgagaacaattcctggcgaagaaggaccattgaagaagcattccagcattcgggaatagatgtcctgaaagcatcatcagctgactggatcgtgatagatttttatgatttgatctgtaatgccgtaatgttcaggggacaattgtgggaaatagatgattttgttcaaagaaccggattttataagcaggtatcaggagaatgcagccggaatacatatttctttgaaaactatgatatggaatatgccggtgaacaaatgacaaggcttgcccggtttttgctcggaaaatatggagaaaacataattcttataaagacagatctgaaggatacctatattgatctggatgacaggctgcaaaagttaaacagcggaagcgaagatctggaaaagagaaagcaggcaattttgcaatatgaaaagatgtttgaggatttgacgaaatgctatgtgatcgatatttcaaagcattattatgcgtcggataaatttccgcttggtggtgctcatattgtccattatgaggatgagttttataatcagtcatgctccatattaatgcagattttttcgggatccgggcgtaaatactatgatgaggcggatgacaggtacctgtttatgagagaccagaggctgaatcgcggttag

SEQ ID NO: 79 - DNA, 2283 bp, Unknown
  Description of Unknown: Firmicutes bacterium sequence
atgggaatgcgagaaattttgaagggaacggtaatatacgaaagtggtcagaagctgaacggattaatgatgattatgagaggaacggcagtggttagttttgagggcggttcctatgagcttcatagtggagatgtgattggtctcccggatctgattcacaaggaggcaaatttccgatatgtggcgaaggagaatctggcagttgtggattatccatcaaaggtgccggagctgaagaagttttttaaggagcacggtgaggtggtgcggtattttcaatcgtccctgttccggcagctcaatgaacttctgcttcattataaggaagtgcagacggtcagtgatatgatgcaggactatctgaccggcagctatgagaattatatacggatctgcgagaacaaccatatttcgccgggggaactggagcgttatgaagagctttccaatattccgcaggaggaaaagattccggactggatttctggatattacagtactatggagcagatgctttccgtgtgggataagaacaagacagatatgaattttgtagtcggatttatgtcgaaaacctgtgatgatatgaatcagatggcaggactgtacggaagaatgaaggatcatattcaggaggtttgtgagctgctgatgaatgaaagtggtctggatcttctggagctgtatctttccctttatgaaaaaattgtaaagaagaatggtttgaaggatatttctgtgatactggtaaagaaggtgctgacaggaaccttaagccagcttgaaaaacagggttatgcgcagaaggatttttttgcggcaagaaaagcagactgtgagaacaggatggcgcagattggagagctggtgaagcggcaggcagaggcagcagcccagctggatgaggatattgttggaaagcttaagaattctcttgatcagattctgcagtatgcagaatgtgaaccggatctggcagcagaattccggaagcgtgtggagacctacaaacatctggtgaataagaacagtactgaagacgatgcgcgtatgctgcgggcaggaataactaagagctttaatcagatttatattcaggctttccagaagagcgtgaaggatactgccgttccgaaggttgtgaagatgctctttaatttcggttatatggatgaggagctggcaggaatggagaatgcggttgccttgtaccgcatggcagagcagattccgactgatccgaagcgtggcgtttattcctattatgaatggctgatggcgatttaccatggacagaaggagccgagccgtaatgaatttgacatggattatgcggattatctgcatgagcagcagcgtcttgccaggattacgaaggaagaagaggcgattttattacggacaccggaatccagagtcatgtatgaactggaaaatgtattcccaacggtggataagacaacaagcggacatatcagtacctattgtccgatcttttccgagcataatctgttaaaaacgctggattcagcagttgtaagtgcagaccgtgtggaacagattatgaatggaatccggggcgtggattacagtgcatattacagggaaacgatttatacgaatccggatgagggaatttccaaggaatatattcatgtcgaggtactgccggactttatcctgatgccgaatatcggtaccagaggtattatgtggcaggaaattgaaggaaagagaagaacgacaccggcaagaatgatgctttccctgttccatctggaggatttgcagatgtcgatcctgcgcctcaccggacagttccgctgggagatgtgcaagagagagcagggagccagatggaatgatgtttcggagcgttcccttaccagtgagtactttgactatgcacagttttataagaagaataatgagctttcctccgatgttaaggaaaagatcaagaacgatctggtgcgtgcgaagaataacttcaaggaaatgtttgtgaaggattactgtgtatgggtattgtatgaaagcagtggatcaccgagactgaacaaggtagtaagaagtattctgtttacctactgtacttttgcaaaggagatccgtgataaactggaaattaatcccatgtataaagagatgatcgcacgctattacgtgaagcaggggcagaagaagcaccgtatggataacctgattcagaagcagcggaattcggggaaagctgtgccggatgagatcctgcgggaacaggaatttttagaaagataa

SEQ ID NO: 80 - DNA, 1713 bp, Unknown
  Description of Unknown: Firmicutes bacterium sequence
atggaatccaaaaagaatacgatgaagacaaaattggaaaatatgcacctgaaggaaagaataagctacggatatagaaaagtgatcattatgatgctggtttccggacttctttccatcgtagttataggggtattgtttgctaatatgatgaattatgtgtatcgtgttaatgcagcagaccaggcagtaaaaatctgcagaatgaatgtcaattcagcagcaagaaacattcgggaaatggcattgaacgaggatgtctctacctatgagagctatgaacagacagtagaaaacctgcttgcagaggttggctcccagctggagattatgaaacagaccggagttgttccggatgaactgtatacggaatattcttctgctcttaacgattggggaaacattggaaattccattatgaaggaaattaaagcaggaaaccgggacgaggcaattgaggatattctgaatgaatgtactcctgcattaaataagagtgttgaaactgtaaaaaaactggatgaattaacggatgaactggacagacgtggtgttgcgagtaccatcatctgtgcgatagtcgggctggccggtattgttatctgtctggtttttgcctggatattgacaaaggaaacaagtaaaagagtacttgaaaccattcttgagccgttacgtgcgattgaagatgttgcaaaggaattaacagaaggaaacctgcatagtaacctggaatatcattccgatgatgaaatcggaagactggcacacaacatacgtaagtccacacgtattctgggaacctatatcgatgatatagaccgtgccatgaagctcttctccgaaggaaactttgatgtccagcctgaggtagagtggagaggtgacttcatcggtattctgaattcctttatggcatttgagaaaagcatggctgataccgtgaagggaatccagcatgtatccgaacaggtttcaagcggtgcagagcaggtagctgcaagctccaatgatcttgcggagggagcaaccaatcaggcttctgttgtagaagagctgacagcaaccgttacaggtgtttcggagcagatcgagcataattcgaatgcagcaaaggaaatcagcggaagagtcgaggatctgggtggtgccattctggaaagcaatggaaaaatgcgtgagatggtggattccatgaatgaaatcaatcaggcatcacaggagattgacaagattattgcaacgattaatgaaattgctactcagaccaatttacttgcattgaatgcatccattgaagcagccagagccggagaagccggaagaggatttgctgtagtagcaaatcaggtgaatgttctggcagatcagagtgcacaggctgcaaaggaatctgcagcattgattgaaagctctgtaagtgctgtggaaaagggcatggtggttgcaaaggaaactgcagcacagcttgaagaggtagcggatacttccaaaattattacacgagaggtaaccggtattgcagagacgctggagacgcagaccgctgaaatgaaacagattaatatcggaattgaacagattaacgatgtggtacagacaaattccgcaacatcgcaggaatgtgcagctgccagtgagcagatgaacaacgaggcaaatggtctgagagaaatgatccgtaagtttaaggttgcaaaattcgaggcttag

SEQ ID NO: 81 - DNA, 1758 bp, Unknown
  Description of Unknown: Firmicutes bacterium sequence
atggcatttgatggaattaccgttgctgccgttgcagcagaattaaaaaaagatctgttaaacagccggatctataaaattgcacagcctgaaagtgacgagctgatcatcaccttaaagaccacagacggaggacagaaacgccttttgctttctgcagacgcttcccttccgcttacttattttaccagtcagaacaaaccaagcccgatgactgccccgagctttaccatgcttttgcgcaagcatttacaaaatggcaggattactggaatcacccagccgggcttagaacgtattattgagcttcatgtagagcattacaacgacatgggcgacctttgtcacaaacgtctgattattgagctgatgggaaagcacagcaacatcatcttcgtgaatgaagacaataaaatcatcgacagcatcaagcatatttccggtatggtcagttctgtccgcgaggttcttccgggacgcgattatttcattccggaaacgcaggacaaggccgatcctcttactgttacaaaggaaactttttgtaaacgtttcctgtcaaaggcgcttcctgcccataaagcaatctattgtaacttcacgggactctctccgttctttgcacaggaattatgctatgaagtcggtgtggacggagatcttcctaccgaatacttcactgcttcttccgaagggcaaaatgcactcacccggttatatgatgccttttccgcatccatgcagcgcattaaggatgccgattttgcaccggttattgtctatgaaaacggcagaccggtggaattttccgctctgccgcttttaagctacccgaaggaagaatgtacctccttttcctccatgagcgaactgttagagcattattatgcggagaaaaacacttacaccaggatccgccagcgttccgtggatctgcgtaagatcgtgcagaccattttagagcgtgatgttaagaaatacgatctgcagcttcaccagatgaaggataccgaaaagaaagacaaatataaggtttatggtgaactgatcaacacctatggttatcacgttgcccccggaagcaggtccatggaagcgttaaattactataccaatgaaatgatcacgattccgcttgatccgcagcttacaccgattgaaaacagtaagaaatattttgataaatacgggaaactgaaacgtacctgcgaagcactctccaggcttacggtcgaagtcagggacgagattgatcatctggaatccatccagaatgcgctcgatattgcacaatctgaggatgaccttgcacagatcagggaagaaatgatggaaagcggttatatccgtcggaaagggaatgcgaaaaaagcccgcttcaagagccatccgcttcactatgtcaatccggacggcttccatatttatgttggcaaaaacaatttccagaacgatgaactgaccttccagtttgcaaccggcaatgactggtggttccatgcgaagggcagaccaggctcccacgtcattgtaaaatgcgaaggacgggagctcaccgatgccacctatgaagatgccgcccgccttgctgccttttattccaaggcaaagggtcagtccaaaattgaggttgactacctccagaaaaaaaacataaaaaagcccggtggtgcgaaaccaggctttgtagtatattataccaattattcaatgttgattgatgcagatatttccagactgactctggtggatgaatga

SEQ ID NO: 82 - DNA, 1794 bp, Unknown
  Description of Unknown: Firmicutes bacterium sequence
atgtattattcagcaggtacttatgaagcttttgcacatccggagaagccgcagggcgttgacaacaaatccgcatatattataggaacaggccttgcaggactgaccgcagcattttatctggtacgtgatggtcagatgaagggagaacacattcatttattggaaaagctggagctggcaggcggaagctgtgacggccgcaaggatatcaccaagggcttttacatgagaggcggacgtgagatggataaccatttcgaggttatgtgggatgttttccgtgatgttccttccattgaaaccgagggcgtatccgtattggatgaatattactggttaaacaagcatgatccgaactattccctttgcagagcatccgtaaaccgtggtgaggatgcccacaccgataagcagtttaagctggataaggaatccgcaatggcactttcccagctgtttattacaccggagaaggatctggaaggaaagaagatttccgatgtgctgccggattccttctgggagacaaacttctggctttactggcagacgatgttcgcattccagcgttggtccagtgctttggaaatgaagcgttatctttgccgttatgttcatcatattgacggacttccggatttcagtgcactccgttttaccaaatataaccagtacgagagcatgattcttcccttggttaaatatctggaggcacatggtgtcaagattgaatatggcatggatgtgaagaacgtcattatcgataaggctggtgataagagggttgcaaagcagatcgtttatgtaaaggatggacaggaacagaccattgacctcattgaggatgatctggtatttattaccaatggctgctgtaccgatacctcctgctatggcgatcagacgcatacaccggatttgagtcaggtaaagaatggtgccggagagtcctgggatatgtggaaaaacattgcagctcaggcagagcatggtgaatatggtaatccggatgcattctgcagcgatgtggatgcaaccaactggatgagcgctacggtagccacctccaatgaagagattattaagcacattatgaatgtctgcaagcgtgatcccagaaccggtaaggttacaaccggtggtatcgtaactgtaaaggacagtacagaaaactggtatctgtcctggaccattaaccgtcagccgcagttcaagtcccaggacaagaacatggtgcttatatggttatattccctcaataccaataagcccggtaactatgtacagaaagcaatgcgtgactgtaccggtgaagaggtctgccaggaatggctgtatcatatcggtgttccgaccgaccggattgaagagcttgccaggaatgcatgtaatacaacgacctgcttcatgccgtatatcaatgcattcttccagcccagaaaatggtccgaccgtccgctggttgtaccggaaggtgcagtaaatttcgcattccttggacagttcgcagagacgccgcgtgataccattttcacaaccgagtactccatgcgtaccggtatggaagcggtttacaccctgctgaatgtagaccgtggtgtgccggaagtctggggcagcaagtatgatgtccgtgagctccttcgcgcctgctactatgcaatcgacaagaagccgatcaccgaaatgaagctttcccttaaggaaaaggagctcctccgtatcgtgcttaagaaggtaaaaggaacggatcttgagatcctgctgaaggaaagcggattgattgggtaa

SEQ ID NO: 83 - DNA, 2625 bp, Unknown
  Description of Unknown: Firmicutes bacterium sequence
atgaaaccagtagaattacggatcagtggctggggaccctacaaggagcttcagacgattgattttacgaggatggaggaacgcgggctgttcctgattacaggtgcgaccggagccggcaagacgacgatttttgacgccatcatgtatgccctgtatggctgcatgagcggtgaggtacgggaaaagggatcggtgcgttcggactttgcaaagccggatacgcccacctttgtggagctgtcgatgacacataagggcgaaagctatcacatttaccggaacccggaatatctgcgcccccgtaagcgtaagggagcggatggaaaggaactgacgaaggagaaggaaaaggcgattctgacgcttccggatggaagcagtgtcgagggcagcagcgaggtcacccggaaaatcgaggagctgctttgcctggattaccgccagttcaagcagatttccatgatcgcacagggggagtttacgaagctcctgacagcatcctcgcaggaaaaaacgaagatcttccggcagatttttgataccggcctgtacgagagaatcgcacagctcttaaaggagcgttccaatgcgatttataaagaggtgagcggataccgtcataaaatggatgaggatgtggagctgtatcatcctctggaagagtctgcagaggtatttgcgacactggtgcagggggaagcttatgattatgaggccgtgcttgcgttcctaaaggaagaaaagaagcgcatcgggaaggaagaaaaggaagtccttgcgcagtatcagaaattagaggagcggacgcttgtgctgaacgggaagctggtggaagcacagaaggcggcagagctgcaaaagagcctcgagagggaaacggagagaaagcagctgttagatcaccggaaggaggaaatgcagcagaaggaaatacttctgtggaaggcggacagggcaggggaaatccgtcagcaggagtttttatgcgaggaatccgctaagcagatcgataaaataaaacagcagatccggcatcttcaggaggaaaccggattacgtgagcagcagatccttaccctgcagaagctgccggaatatcaggctgactttgaagcagcctgtgaacggaaggagaagctgtctgagcaggaacgggaaaatgaacataatatagaattatgtaaacaactggaagcacagctgaaacagctgcaggaggtctacctaaagctggaacaggaagagctgtttgcacggcagacgtatgaagaaacagagcaccggtatcgtcataaccttgcaggcatattgtcttcggagcttgaagaaaaccggccctgtccggtctgtggatcccttcatcatccggcaccggcggctgtcacagaagagcatctgaccagggaaaaggttgatcaggcaaagaagacatggcttcagaagcaggaaaagaccatgcaccagcatggagaaaccatggctgcaaggggaaaggcagaacaggcgaaggaaaagggcggtgagcttttaaaagccatcggacagatgcaggaacagatggatcagcttcctgcagaaatcaaagagcttttgttgaaatatacccggaaatcctttgaaggggaactgaaccgcctcttacaattacgtgtcgagcgtgcagaaaagcaggagcagatccttaccttacaggaggagcttcaaaagggacaggagcttttcagagaaagagaagaggaaagggatatcctcttaacgaagtatggctttgcttccagggaggaatatcagggcagtcttctttcaaaggagcagatcgaggccgggaagagagagctgcaggactatgagaagaactgcagggcaaatgaagaactgctgcagcatctgaaggaacaggtacaggagcttgttcttgcggatccggtaaagctgaaggaggagcttaaggaagctctggaagaaaagcgggctgtgcagcagaggctttcaaagaagcaggaaagccggaatcttacggagagaacatctgtttctttaaaaacaaagcttgccggtcttaaggagactatggagcgttataccttagttaaggggctggatgatctggcaaacgggaataataagaaacggcttgtctttgagcagtatgttttgatttcctgttttgaagagattctgtatgcggcaaacctgcggttgcagacaatgagtgctggaagatatgagctgcgacgtgtacggggaattgtggatgcccgcagcaaggacaatctggaaatggaagtgctcgactattacaccggtaagtaccgctcagtgaaaaccttatcgggaggagaatcctttaaggtctccttaagccttgcccttggcatgagtgatgtcattcaggcacagagtggtggaatccgggtggaaaccatgtttatcgatgaaggcttcggtactcttgatggagaatcactcgatcaggcgtgtctggtactgcagggattaacggagagcaaccggctgatcggacttatttcccatgtgccggagctgtccgagaagattccggatcagatccgtattcataagacgaatactggaagctatgccgaagttgtgatacagtga

SEQ ID NO: 84 - DNA, 1974 bp, Unknown
  Description of Unknown: Firmicutes bacterium sequence
atgggcaataaaggaaagtattatattacgactgcgattgcgtatacttcggggaagccgcatataggaaacagttatgaaatcgttctggcagacagtatcgccagatttaagagaaaagacggctatgatgtgttcttccagacaggaaccgacgagcatggccagaagattgaaatcaaggcacaggaagccggaattacaccgaaggaatttgttgaccggacagccgcaacgatccgcagcttgtgggatctgatggacacctcttatgacaaatttatccgtactacggacgaaccgcatgagaagcaggtacagaagattttcaagagactgtataatcagggagatatctataagggctcctatgaaggaatgtattgtacaccgtgtgaatccttctggaccgaatcccagttaaaggatggcaagtgtccggactgtggaagagaagtaaagccggcgaaggaagaggcatatttctttaagatgagcaaatatgcagatcggctgattgagcatatcaatacccatccggaatttatccagccggtatcccgtaagaatgaaatgatgaacaacttcttattaccgggactgcaggatctgtgtgtatcgagaacctcctttaagtggggaattccggtagactttgatgacaagcatgttatttatgtatggctggatgcactgacgaactatattaccggtatcggctatgattgtgagggcaacagctctgagcagtataagaagctctggcccgcagaccttcatctgataggtaaggatattatccgtttccataccatttactggccgatcttcctgatggcattgggagagcctctgccgaagcaggtatttggtcatccctggttattgatgaataacgataagatgagtaagtccaagggaaatgtgatttatgctgatgacctggtagacttctttggtgtcgatgctgtccgttactatgtactgcatgagatgccgtttgataacgatgggaacattacatgggagcttgtaacggagcgtaccaatgccgagcttgccaatacactcggtaatctggtgaatcgtacaatttccatgagcaataaatattttggcggtatagtagcagacaagaaggttaccggtgagatggatgaagaccttaaggcagtcgtaacaggtacctataagagagtatctgcgaagatggacgagctgcgtgtggcagatgccatcacggagatttttgcactgttcaaacgctgcaacaaatatattgatgaaacagagccgtgggtacttgccaaggatgaggccaacatggatcgtctttccaccgttttatacaatctggtagagagtattgcaaccggcgcttccttacttgagccgttcatgccttctaccgcaaagaagatcgtacagcagctcaatacttccgtcagaagctttgaagactgtgagaagttcggcctttatgaaagcggaaataaggtaactgcagaaccggaaattctttttgcaagactgaaggtcgaagaagtgatggaaaaggtcaacgccatgtatgcagaacgcaaggcacaggccgcaggggaaaatggggaagcagtagaagaaaatgtgattgatatcgaaccgaaggaagaaattacctttgatgattttgctaaaatgcagttccagataggagaaattatcaagtgtgaggaagttccgaagtccaagaagcttttatgctcacaggtgaggatcggcagtcagataaagcagattgtttccggcattaagcagcactacagtgcagaggagatggtcggtaagaaggtgatggttctggtgaacttaaagcctgcaaagcttgcaggagttctttcagaaggaatgctgctttgtgcagaggatgcagaggggaatctggcacttctgacaccggagaaggaaatgccggcaggagcagaaatcagctaa

SEQ ID NO: 85 - DNA, 1542 bp, Unknown
  Description of Unknown: Firmicutes bacterium sequence
atggaaaccaaaaccgcagcagtttcaatgcgaaatgttacgaagacctttggatccgtaattgcaaatgataaggtgaatctggatatttataagggtgaaattttatcgctgcttggagaaaatggtagtggtaaaaccacattgatgaatatgctttccggaatttattttccggatgaaggccagatctttatcaatggaaaggaagaggtaatcaggtcacccaaggatgcctttgatctgggtattggtatggtgcaccagcatttcaaactgatcgatgtgttgtcggcaacggaaaacattattctcggactccccggtaaactgaatttaaaagaagccactaaaagagtggaagaaatttgtcagaaatatggctttgaggtagatccgaagcagaagatttacgatatgtcggtttcgcagaagcagaccgtggaaattgttaaggtattgtatcgtggtgcagacatcctgattctggatgagcctacggcagttttaactccgcaggaaacggaaaagctgttccgtgttcttcggaagatgcgtgatgatggaaaagcgattgtcatcattacccataagatgcatgaagtagaatcgctttcagaccgtgtggctgttcttcgaagcggacagtatatcggctgtatgaaaacaaaggatacgaatgtaacggaaatgacgaacatgatggttggtcatacggtaacgttaaatatagacaggcctgatccggtgaatcctaaaccccgtattgaggtggaaggcctgacagtccgtaatgaagagggcgttgtgaagctgcaggatgtttcctttactgcgaacagtggagaaattcttggtattgccggaatttcaggctgtggacagaaggagcttttagaagcgattgccggacttcaggttacggaagccggaaccattgcttatgtagaggatgatggttccagggaaatgctgatcggtatggatccgaagaagattgcagagctgggagtttccctttctttcgttccggaggatcgtcttggaatgggactggtaggaaatatggatctggcggataatatgatgcttcgttccttccggcagggacattctccgtttacagaccggaagcagcccaggcagctggcgaatgatgttgttgagagtcttgaggtggtaactccggggatttcaacaccggtacggcggttatccggaggtaatgtacaaaaggtgctggttggacgtgaaattgcatctgcccctaccgtattattaacggcatatgcagtgcgcggacttgatattaattcttcctatacgatttatgatctgttaaaccagcagaagaagaaaggggtttccgtaatcttcgtcggggaggatctggatgtgctgctggaattatctgatagaattctggtgctttgcggcggacaggtcagtggcattgtggatgccagaacaacagataaaaatacggtcggaatgatgatgactaaagtgggaggtgaaaagaaccatgaaggagaagaataa

SEQ ID NO: 86 - DNA, 2484 bp, Unknown
  Description of Unknown: Firmicutes bacterium sequence
atggtcttcgaaagaagagcaggcgggaaaaggaaaaatgggagaatttctgattcccggaaggaaaggaggacaattatgaaaaaggtaatcgtatcgttactggttgtggcacttgtgattgggtgttttgccggatgcggaaagaaagaaaagggtgacctgcagcaacaggcagtttccagggattatgtgtataagcaggaggttatttcctataatggaagtggtacagcacccagcggactgattcagatcggggataaggtttatggttacagctatgaatggcgtgagatggatggggctgtaacgccaagagcagatattgaaggcggcggaaacactgaaaaagaagcagaagcagaggatgtcgatacggcaacagaagagactgtggcagaaccggagcctggtacggaggatgcagcagaggacattgcggaaagctattcttccatgattttttatgaaattctggaggacggcacctttggggaaggacatgagcttcagggggcaccggatcagtccattaattcatttacagcagattcacaggggaatctttactgcctgcgcaacgtgtatgtatatgatgacggcagtgataccagtgaggatctgtattacttagagcagaaaacactggatgatgaaaccgtgttcagtgtaaatctgaatgaacttccggaaataaagaagattgttgaacagcagggatggctttatattaatggactgtttgcagaagaggatgcgttgtatcttgtctgcggaagcagcattctgaagtttgataagaatggaaacatggtaggcaatgtcatcagacaggatgccggaaatgtattggatggtgcatctgttgtccgtggcagagacgggaaatatgcagccattaattatggggataatggaatgaaggtttatccgttggatcttgcaaacggtacaatcggaacggctgcagagcttgcgggaaacagctacagcttcagcttttatccgggttccggatatgatttttatgtatccgataactatgcggtttatggatataaccttggggatactaccgttacgaagctcatgagctatgtggattccgatattgatgtctggcagatcaataatattattccgatcagtgataccgagttttatggttcgtattccagtgcctctgactggcaggatggagtttctaaatttacgaaggtagatccgaaggatgtcaaggagcgccaggtgattacccttgccatggcaagcacagactggacggtaaaaagccgggtaattgagtttaataaaaagaacgatacctacaggatcagtctgattgattattcctctgagtcaggtgagtacgaggaaggtatttccagaatgaatacggatatcgtatccggtaaagtacccgatattatcctgctggatgattccatgccaacggacagctatatcagtaaaggcctgtttgcagatcttcttcccattatcgaaaaagatgaggagattgaccgtaatgacctgatgccgaatgtaatggaagctttttccagggacggaaagctatatcgtcttataccgtcttattctataagaacgattgttgcaaagacctcagatgtcggggaagaacgtggctggaccgtagaagaggcgatggctctctgggactccaagccggaaggaacggagtttattgcaggggcaaccagaagtgagatgctgaatatgtgtatgagctttgccggcagccagtttgtgaattacagtacaggggattgtgattttaacaatgagggctttctgaatttattggaattcctgaaacgcttcccggttgaaatttctgatgactattataccgatgaatattggagttcctatgacagcctgtggagaaccggaaaggtcattacccagcagatgtatctgggtgatttccgtaatctcaactatacgcagaagggaaccttcggggaaccgattaccatgattggctttccttccacagatcaggatggctccgttcttgtaccgaccatgcagtttgcaatttctgcaaagtctaagaatcaggatgccgcatggcagttcctgaggtattatctgacagaagactatcagaatgaagcacccggatttcctctcagcatgaaggtattggagaaacgggccgaggaagccatggatcgtccttattatatagatgtgaatggaaataaggattattatgatgatattatctatattgatgatgtagaggttacgatcgatccgatgacccgggaagaggtagatcactttatggagatccttaagacctttaagaatgtcggtagatatgatgatacactgattaatatcatttctgaagaggcagagccttattttaacggacagaagaatgcaggtgaggttgcacagattatccagaaccgtgcacagatttatcttcatgagatacaataa

SEQ ID NO: 87 - DNA, 2745 bp, Unknown
  Description of Unknown: Firmicutes bacterium sequence
atgttaaatgagcagacgattgtaaaatgggacaagaacgcggaaacggatctgcgcagcggcctgacgaaagcacaggttaaagagcggcagacaatttacgggccaaaccggctcagggaaggaaagaagaagagcgtactgaagctcttctgggaacagctgaatgatcccctgatttatattctgatggcggccattgccatatcgttattccttggagaagccggggaatccatgattattgcagcggtaattatcctgaatgcagttgtcggggtaatccaggagggaaaggcaataaaggcaattgaagccttgcagcagttatcaagtcccaaggcgcttgtaaagcgggacggcagggaaatggagatcccgggcagtgagctggtaccgggggatctgattttcttagaagcaggaaggcaggttccggcggatggaagactgcttacagcgagcggattgcagatagatgaagcggcgcttacgggagaatctgtagcggtggataaggaggttctgggacagaagaaggaagagagagtgtatgaccgtggaacagggaaagcagaaacggtgagttcagaagaggaaaagcttcatgcggcagaagtactgggcgatcagaagcaccttgtgttcatgaccaccatggtaacggcaggacacggggaagcgattgtgacggaaaccggaatgcagacacagatcggaaagattgccggaatgatttcggagagccgggaagagctgacaccactccagaagcgtctggcagatctgggcaaaatcttaagccttgtggcagtcggcatctgtgtattcctgttcgtggtagccgtattgcagaaacgggatatcggagaaatgctgcttacagcaatttccctggctgttgcggcggttccggagggacttgctgcaattgtgacggtggtgcttgccttaagcgtttcaagaatggtgcgtgtcggaacgatcgtgcgcaagctcccatcggtagaaaccttaggggcggtggatgtggtctgctcggacaagacagggacgctgacatgtaaccggatgacggtgaagcagtgttacgtggatggaaggctccttccggtagaagagttccggaaggaggagcatgaagagttcttaaatgcctgtgtgctttgcaacaacgcactgcttggagaagaaaatatcggagatcccacagagcttgcgttgctgatcctggcagaggaatgcggcagggaaaaggaaaatacggagaaagagtatgtacgcatttcggagtgtgcatttgactccgtgagaaagaagatgaccaccatacataaatctgtcaatggagaggttgcctatagcaaaggagctgccgaccgcattttaaaggattgcaggaccgtctggaagaacggaaaggaggctgccttttctgaaaaagcaaaaaatgaagcacaaagggcgatggaacagatggcttccggcgcactgcgggttatagcacttgccatgaagaaaaagggagatctgaaggaggaaaaggatctggtattcttaggacttgccggtatgatggatccgccgagggagggcgtggcagaggcggtgcagagctttcgtaatgcacatgtgcagacggtgatgattaccggagatcatgtggataccgcactggccattgcaaaagagcttggcattgcacaaagtcatgagcagtgtatgaggggagaggagctggagttactttcacaggaagagctgattggacgtgtggaaggtatccgggtctttgcgagagtgtcccctgagcataaggtccgcatcgtacatgccctcaaagcaaagggcaaaacggtggccatgaccggagacgggatcaacgatgccccggcgctgcgctcggcagatgtcggtgtggcgatgggaaagggcggaacggatgtagctcggaatgctgcagatctgatattgacggatgataatttttccacaattgagaaggcaatccgagaggggcgtgggatttatgagaatatccgcaaaacgatcctgtttctcctgtcctcgaatttcggggaaattatcacaatgcttgcagcggttctggccggctttccggcgacgctgaaggcgagtcatattttatgggtaaacctgattacggattccctgccggcacttgccctcggcatggatggaaacaatggcgaagagctgatgaagcagccgccgcgaaaaagcacggataccatgttttctcatggaggactgtcctgtacgctttgttttggtgtggtgatcggagtcatcagtattcttgcttttatggcagttccttatgaggaactgctgcagcggcagcttccggtgaacctttcttctatgaaaaagattctggaaatcgaatggattttaaataaagcgcagacccatgcctttacggtacttggtatgagtcagctggttcatgcggtcggtatgcgggatgtcaaccggtcggtcttccggatgaagcattttgaaaatctgtatatgctggcagctctcggaatcggactgcttttgcaggtattggttacagaggttccttatcttataacgttgtttgaaaccaaccggctgacgcttggcgagtgggggcggcttcagattctttcactgacaccgcttgccgtgcatgagctgttatgcctttttaccgcagctgggcaaaagcaagtgcgagcagaagaagtgcactga

SEQ ID NO: 88 - DNA, 1998 bp, Unknown
  Description of Unknown: Firmicutes bacterium sequence
aaaggcggtgaggatgtgcagaatatagtaaacaaaacagaaagagaacatattctggtgtgtttatctccttctccatccaatgaacgtattgtgcgaatggctggtaacatggcacaggcgttttgtggaagttttacggcactttatgtgcagacacccggatacgcttccatgaatgcagaagatactgttcgattgcaggctcatatgtatcttgcaaagcagctcggcgcagagatcgtcacaacacatggggaagatgtacctacacaaattgcagaatatgcacggctctccgatgtaaccaaaattgtaatcggacgaagcggcatacaacggcggcatttctggagtgagccaacactgacggagcggctcatcgcactggcgccggaggttgacattcatatcattccggatgctgaagtctacaaaagctatcgcggaaagcgactttccaccattcgtcctgtactcccgaccgcccgggagcttctcctgacacttggtattctggcagctgcaacgatcatcggatggctgtttttgaaacttgaccttgcaagtgccaacatcatcatggtttacctgctgggcgtgcttctgacttcttcttttacgaatggatatacctgtggtatactgtgcgcctttttgagtgtcgttctgttcaatttttttttaacagaaccacgtttgtctttgggtgcatatggaagcaaatatcccataacctttgccgttatgtttgcagcagcgcttttgaccggcacacttgccacaaaactcaaagcccatgcactattatctgcacgggacgcctatcgtacaaagcttctttttgatatgaacagaaagctccaaaaggcagaagcaccggaggaggtttatcagatgaccgcaatgcagatacaaaaactcatgcaacgggacattctggtttatcctgtgcaggatgatgcactctccacaggtattctttatccgacagatggaagctgtccacatcctgctccggctgatgatcaggaacaggatgtaattcactgggtctggcaaaaccggaagcgcgccggagcaacgactgaaacatttccaaaggcaaaacgactgtatcttgctatccgtaccgggcagcaggcttacggtgttgtcgggattccgatggagaaaaaaacacagccggacgcatttacatccagtattctgttttccatcctcggagagtgtgccctgacgttagaaagcctgcgtaatgccagagagaaggaagaaactgccgtccttgcaaagaacgagcagcttcgtgccaatctcctgcgttccatttctcacgatctgcgaactcctctgacctccatttccggcaacgccgatacattgttgcacagctatgccgcattggatgagcaaacgcggaaacagatatttacggatatttatgatgatgcacaatggctgattggacttgttgagaacttgctttccattacgaaaattgcggacggcagcgtaaaactgcacctttctgatcaggtcgtagacgacattgtatcggaagcgctccggcatatcgatcgaagatcagcagaacatcacattatggcggattgtgaagatacaccactgttgctacgggtggacgcaggactcatcatgcaggttattatcaatctggtaaacaatgccattaaatatacccctgcggactctgtcattcggatcacagcaatacatcaggaaaatatggctgagatccgtgtcatcgacaacggctcaggtatccctgatgagataaaaaaacacgtttttgaaatgttttttaccgggagcaatctgattggtgacagccgccgcagtcttgggcttggacttaccctctgtcagaccattatttatgcacatcatggcgaactgacactgaaagacaatactccgcatggctgcattttttcctttacaataccacttagtgaggtgaacctgaatgaataa

SEQ ID NO: 89 - DNA, 1914 bp, Unknown
  Description of Unknown: Firmicutes bacterium sequence
atggcagaaaagaaaaagaagccaacagtcttcatttcccaggatgaccagtatctgtttgcacaggggactcattatgatatttatgagaagctgggggcacatccttcctgtgaaaacggagaagagggaatgttctttgcggtttgggctccaaacgcaaagcaggtctatgtgatcggggaatttaacgactggaatgagagtgcaactccaatgacgaagctgggaccgggaggaattcattctgtatttgttaaaggagtcggaacgggggtattgtacaagtatctgattattacgcaggaaggggagaagctgtataaggcagatccatttgcaaacagtgcagaattacgtccgggaacagcgtcaagaacaacggatctgacaaagttccgctggacagataccacgtggatgaaggaacgtgatctgaaggattataataaagagccaatggcaatttatgagtgtcatattggttcctggatgcgtcatccacgtccggacgagcagggattctacaattatcgtgagtttgcagaccgcattgtggaatacctgacagaaatgaaatatactcatattgaattgatgggaattgctgagcatccgtttgatggatcctggggttatcaggtgaccggatactatgcaccgacctcccgttacggaacgccggatgatttcatgtatctcatcaatcagctgcataagcatcacatcggtgtaattctggattgggttccggctcactttgcaaccgatgcccatggacttggacggtttgatggagaatgtatttttgaacatccggatccgcgtcttggagaacatccggattggggaaccaagatttttaattacggaaagacggaagtaaagaacttcctgattgccaatgtattattctggatccgtaagttccatgttgatggaatccgtgttgatgcggttgcatccatgctttatctcgattacggaaagaaagagggacagtgggttcccaacaaatatggtgataacaagaatctggaagctattgaattctttaagcatctgaattccgttgtccgtggaacgtatccaggattccttacaattgcggaggaatctaccgcctggcccagggtgaccggtaagatagaagacggtggacttgatttttcctttaagtggaacatgggatggatgcatgatttctgcgaatatatgaagctggatccgtatttccgtaaggataaccactatgccatgacgtttgccatgacctataatgacagtgagaattatattcttcccctgtcacatgatgaggtcgttcatctgaagtgctccatggtcaataagatgcccggatataagacggacaaatatgcgaatctccgtgcgggctatgcatatatgcttggtcattccggtaaaaagcttctgttcatgggacaggactttggacaggaaagagagtggagtgaagcaagagagcttgactggttccttcttcaggaggatctgaacaggggacttcatgattatgtgaagaatttactggagctttacaacaaatatccgtgcctgtatgagattgataacagctgggacggatttgaatggctgaattgtgatgataaggacagaagtacatacagctttttccgtaaggcatccaatggtaagaataaccttatgtttatcattaatatgactccgatgaaatgggagaattacaaggtcggtgttccgaagaaaaagaaatataagcttttgttaaacagtgatgatgtccggtttggaggacagggtatggaagtacctgcggaaattacttcagtaaaggaaagctgtgattaccgtaattacagcctgaccctggatcttcctccgtacagtgcgctgatctttgtgttttag

SEQ ID NO: 90 - DNA, 2265 bp, Unknown
  Description of Unknown: Firmicutes bacterium sequence
atgttgaataaagaattattggaacaaaaacttggaaagtccattcaggaagcaggcgagaaggagatttatttcatgctccttgagcttgtgaaagagatggcaaaggaaagagagcgtgcacagagcgagcaaaagggaaagaagatctactatgtttcagcagagtttctgatcggcaagcttctttccaacaatctgattaatcttggaatttatgatgaagtaaaggatattctttcaagtaacggaaagagtcttgcagcaattgaagagattgagcctgaaccgtctcttggaaacggcgggcttggaagactggctgcctgcttccttgactccatggcaaccttaggcctaaacggagatggaattggattaaattatcatctgggactttttaagcaggaatttgaaaagaacctgcagaaggaaactccgaatccctggatggagccgcaaagctggctgaaccgtaccgaggtggtttatccggtaagctttggcaatctgaaggtgaatgccagaatgtatgacattgatgtgacaggttatgaaaatcacaccaataagcttcatttatttgatctggattccgtggatgagaatctggttcaggatggcatttcctttgataaaacggacattgagaagaatctgacgctgttcctttatccggatgattcggatgaggagggaagacagcttcgtatttatcagcagtactttatggtaagcagcggcgcacagcttattctggacgaaagcgtaaagcgtggctcaaatctgcatgatctgtcagactatgcggtgatccagattaatgatacacatccgaccatgattattccggagctgatccgtcttttgatggagcggggcatagcaatggacgaagccattgctattgtttcaaagacctgtgcctatacgaatcatacgattctggcagaagcattggaaaagtggccgattgcctatctgaataaggttgtgccgcagctcgttccgatcattgaggttcttgatgataaggtacgccgtaaattcgatgatgaaaaggtagtcattatcgaccgcaatgacactgtgcatatggcacacctggatattcattacggcttttccgtaaacggtgtggcatcccttcacacggatattctgaaaaagaccgagcttcatccgttttatgagctttatccggagaaatttaacaataagacaaacggtatcacgttccgccgctggctgttacattgtaatccaaggctcacggcactcttagatgaaacaatcggaagaggataccgtaaggatgccatggaattaacaaaactcttagcgtatcaggacgatccggaattccttaaaaagcttttggatgtaaagatggaaaataagaaggagctgtgtgcttatttaaaggaaacacagaaccttaccttaaatccggacagcatctttgatacccagatcaaacgtctgcatgaatacaagcggcagcagatgaatgccctgtttgtcattcataaatatctggaaatcaaggcaggaaagaaaccggaaactccgattacggtaatctttggtgccaaggcggcgccggcttatgtgattgccaaggatatcattcatctgattctgtgtctgcaggagcttgtgaatgcagatcctgaggtgagcccttatttaaaggttgttatggtggaaaactataatgtaaccaaggcagagaagctgatcccggcaaccgatctttctgagcagatttcacttgcttccaaggaggcgagcggaaccggaaacatgaagttcatgttaaacggtgcggtaacgcttggaaccgaagacggtgcaaatgtggagatccatgaacttgtaggagatgacaatatctttattttcggagcatccagtgaggaagtcattgcacattatgaaaagtccgattatgtatcaaggaatttttatgagaaggatccggatattaaggaagcagttgattttattacatcaaaggagctccttgccatcggacaggaagagaatctcacacgcttgcagaaggagcttttaaacaaggactggttcatgaccctccttgactttaaagagtactgtgaaaagaaggaagaggcctatgcctgctacaacgaccgtgagaaattcgcaaagatgatgcttattaacattgcaaaagccggatacttttcctctgaccggacgattgaagagtatgagagagacatctggaaaagcagataa

SEQ ID NO: 91 - DNA, 2037 bp, Unknown
  Description of Unknown: Firmicutes bacterium sequence
atgcggctgttttgtgcagagcacttagtgaaagcaagccaagggcgcagcttgaacttaggtgcgagccagtccggaacacttaacgagagcaagccaaaggcgcagcacgagattagtgcgagcgacaagcagagacagagagagaatacgatgtttgactttcaggaagaattaaaaaagctcccgcacagtcccggagtttatatcatgcatgatgcccaggatgaaatcatctatgtgggaaaggccattgatcttcacaaccgtgtcaggtcttattttcgtaagatcgtgggaagaggcccgcagattgacaagatggtttctctgattgcgcggtttgaatatattgttacggattccgagcttgaggcactggtgttagagaacaatctgatcaaggaaaacagcccgaagtacaataccatgcttaaggatgataagacctatccatacatcaaggtgacactcggagaggattatccgcgggtattgttcagccgtcagatgaaaaaggaccggtcccggtactttgggccatataccagtgcggcagcagtcaaggatacgattgatctgattaataagctgtatcagctgcggacctgtaataaggttcttccgcgtgatttcgggatcgaccgcccgtgtctcaattttcatattcaccagtgtgtagcaccctgtcagggactggtcagtaaggaagagtatggcgaacgggtaaagaaagcattaaatttcctgaatggagattatcaggaaacattgaaggatctgaatgccaaaatgcagcaggcatccgaaaatctggaatttgaggaggcggctcgttaccgggatctgtttaacagtgtgaagcagatttcagagaagcagaagatcaccgattttgatggagaagataaggatattattgcactggcggttgaggcagaggatgcagtagtccaggtgttctttgtccgcggaggcagactcatcggcagggagcatttttatatgacgcatgtgtcacagacgccgaaggaacagattctgcaggattttgtgaagcagttttatgcgggaactccgtttgtgccgagagaaatcatgctgcagacggatattgaggaccgggaagtgattgaacagtggctgacaggaagacgtggctcgagagtatatttacgcgtcccaaagattggctcaaaagaaaaactcgtggagcttgcagcaagaaatgcggaactgattctaagcaaggacaaggagcggatccgtagggaagaagggcgtacgattggcgcagtgaaggagattgcatcgctcctgtccctttcgaatatatcccgtatggaggcttacgacatttccaacatcagcggctttgcgaatgtcggttccatggtggtgtttgaaaagggaaaacccaaacgcagcgactatcgtaagtttaagattaaaaccgtgtcaggacccgatgattatgcctgcatgcgtgaagtactgacaaggcgtttcctgcatggtatggaggagcagaaggagctggaggaacagaataaggatgcagagcttggcagctttacgaaatttccggatctgctgatgatggatggtggtaagggtcaggtgaatattgcattgcaggtgcttgaggaactgcagcttgatattccggtctgtggtatggtgaaggatgataaccataatacgaggggactttattatcagaatgaagagatcccgattgaccgccgcagcgagggctttaagctgattacgagaattcaggatgaggcgcaccgctttgcgattgaatttcaccggtcactccgttccaaatcgcaggtacattcggtactggatgagattccgggagtcggacctgccagaagaaaggcattgatgcggcattttcgctccatagaagaaatccgcgctgccgaagtggaggagctgcttgccgtggatggaatgaaccgccctgccgctgaaagaatttatcagttcttccgtacggaaaaatcatcagaacaaaatctctaa

SEQ ID NO: 92 - DNA, 2874 bp, Unknown
  Description of Unknown: Firmicutes bacterium sequence
atgaacgtttattttccttctacggaaacggattccgcaaagcagagtataaatgttgacagagccacaactgcatatcgtacttccacccggaacgcagaacgggcaggaagaagttcatttgcattagacatttctggcacagttacggataacagcgcttacgcaggtcacggaaggaccgcagaagaggttatgcggatggcgggacaagaggataccaaggctcgtcgtgactatatggcagtaatgtctaattgtatgtccgatgaagattttgcgaagctgcaagaggaaggctttcatccgggaagtacggaaattgacacggttgtgaccattgtcgatcgtataaaagcagcacttgtaaagggtggaacagaggttgtcgggtatacggataccttaagtgatgaagagctctgtaagattacgggttcggaaagctttgccaatgaactcaaaaatcagttccatgaccgtgacattccactgaccaaagagaatgtgcaggccataaccgatacctatgaacagattaagaatatttcgaagctttcggagggttccgagaagtacatggttgaaaaccggatggaacctacgccggaggctctctatactgcacagtactctgcaccgcaggagggcagccgtcagggcacaggctattatgccgatggaaccgtgaacgggtattatgcgaagaagccggagcagattgatctggaagcactgcttccccagatcgtaaaggtgattgaagatgccggactggaggtgtccgaagagaccatcgggcaggcacaatggctgattgaaaagggaattccgctggatgaagaagccatgcagcgcttacataagcttgaaacgattgaatttccgatccgcatggagaactatctgaacagtgtgaccgcagcgattgcagatggtattccggtgaagaaggcagacctcacccgtagggaaacttatttggaggaaatccgtggtaagcgtcagctggaagagaccagactccagatgtcctttgaagcaaatctgaaattattgcgaagcggctatcagctggataccgctccggtcgaagaaaccgtgaagctcttaaagcagcttgaggatcagttatccttaagcctgacaggggaagaggacgtggttcaggctaaggaaaaattatctttgtttgatgagtccatggagctcatccagagtatccgtaccgcaccggtttccttcgtggaacagattgaacctgaggatacgttaaagaagatcgcggataccggtgaggcacagcgccgtgcctgtgaaaaggcatcccgaagctacgaagagctgatgaccgcaccgagaaaggatctgggagatcagattgcgaaggccttccggaatgtggatgatcttcttgatgaactgaaccttgccgcaaccgaagaaaaccgcagagcagtccgtatccttggttataaccagatggaaatcagtgaagagaacattacgaaggtcaaggaaaaggatacactgctgaccggagtcatacgtgagatgaagccaggcagggtattacagatgatccgtaagggcgtgaatcccatttccatgaaattagaggatctggatacatttttaaaagaaaataaagataccgcagatgatatggaatcctacagcaggttcttatacaggctggaacaggatcatgacattaccgaagaggagcgcagcgcatacatcggtatttaccgtctgatgcatcagattgaaaagaatgatgcagctcctttgggagcagccatgcaggcagatatggagctgacacttgaaaatctgctcactgcactgcggagcacgaaaaaggaagcctccaggaagctggattaccgggtggacgatcactttggcggtgtaaccgcgaaggaaagtgccatcgaatctatcacttcacagatcgaaaaaggttatgcgggggataccgcagatctttatacgcttctggatcaggcaggaagtgaggaagcacagaaggaatatgagcaggagctttatacggaaataagagaggcttataaggcagaagaagatgtaatgcagcagttaagtgattatgcacggcctattactgcagatcatctgatggcaatggataccctgttaaacgcatctgcggaaagcttccggaagatgaatgagcttctgaaaaataagaatgaaaaacagaatttcatcgcaaagcatggcgaagaaatcctgcgccatatgaacagccgggaagaaacggtacagacctacgggaaaatgaccggagagattcaggatacgttcgaacaggaagcctttgatccgcaacaggacggtatccggtattcctcagacattcgcagcatgaccggattttataagcagctgggtctgatgaagtctctggcaagagaagagaattatgagatcccgcttgagattgatggatcgcttaccgcgattaatctgaaggtgatccataatgaacaggaagagggaagagtagcaattacatttacctcggagccttttggaaagacggctgcagaattcaggctgacggaacagggactgagtggttactgtacctgtgagaaggaagcaggaaaagcacttttagaagagcataaggcagaatggcaggagcagcttgttaaggaaggaatccaaccgggtgctgtttattttacaaacacgaatggcttaaatcttaaggattttaataaaaaccagacaaaggaacaaaaatcaggcagcaaagcagactccgtacagctctatcgggcagcgaaagcatttattgcatttgtcagacagaccggggatacagaaaggaagagcatatga

SEQ ID NO: 93 - DNA, 2541 bp, Unknown
  Description of Unknown: Firmicutes bacterium sequence
cacaactttggtaaaatgaagacaggactttcgggaaggggtaagtgcatgaataataaattatataaattaatgaactggccgagaattgaaggaattgtgtattcggaggaagcaaacccgcaggagattctgggggtacataccacaggtaagaatgtcctgtttcagatgttctggcctggggcagtgaaggtaaatgtacattttatggaagagaagcgttctgaggctgcagaggtagtatccactgcaaaattggtacttccgatggaaatggcagatgagaacggtttctttgcatgtctttatcagggaaagaagccgcagcactatgaatatgaaattattgatgcccaagggaacagcagaatgattaaggatgcctatgcattcgcaccggtatccttatctaaaaaggatgctgtacgttttacttcaggcattcattataccatttatgaacatttgggagcacatccttgtacgagaaacggtgttgccggaacacagtttgcggtgtgggcgccgaatgcggtccgtgtcagtgtcgttggagattttaacaattgggacgggcgcatttatcccatgataaaggatggtacaaccggtatttttgaactgtttataccggatgttcaggcaggtgactgttataaatatgaaatcaggaaaaagggcggtctgaccgttttaaaggcagatccttatgcattccgccagcagcttcgtccggatacggcttccatcgtggaagattctcattacagctatcaggatgcagaatggatgaagaatcggaagaaatatgccgaaaagaatgcgtccatcagtgtttacgaattatatctgggctccttccgtcatggagaggatggaaaagaaagcttatcctaccgtgaactggcgcctcttgttgcagaatatgcaaaggaaatgggctatacacatgtggagctgatgccggtgatggagcatcccctggatgcatcctggggttatcaggtgattggttattatgcaccgaccgcgcgctacggaacaccggatgacttccggtacttcgtggatacgcttcatcaggcgggcatcggtgtgattctggactgggttcctgcacattttccgagagatacctatggacttgccgagtttgacggaacctgtctctatgagcatgcggatccccggaagggaagccatccgcattggggaacattgatttataattacggacgcccggaagtatccaactatctgattgcaaatgcgttatactgggcagagcagttccatgccgatggaatccgcatggatgcggttgcttccatgctgtatctggattatggacgtaaggatggcgagtgggttgccaatatttatggcggcaatgagaatctggaagcgattgaaatgatcaagcatctgaattccattatgaaaaagcggaatccggatgtgctgatgattgccgaagaatcgaccgcatggccgaaggtgacgggagctttggatgacgaaggacttggctttgatcttaagtggaatatgggctttatgaatgattacctggcctatatcggctatgatccgtatttccgtgcacatcatcataatgaattgactttcagcatgatttacgcctacagtgagaactttatgctgccgttttcccatgatgaagtcgtacatggcaagtcttccatgattggcaagatgccgggcaccattgaagataaatttgcaaacttacgattgacctatggctacgtgatgacccatccgggcaaaaagcttctgtttatggggcaggacattgcagagttccaggagtttgacgaaaccagacagacaaaatgggagctgttaaaggaacctgcacataagggaattcatgatctggtgcgtgatctgaatcacttatatcaggagctaccggcactttatgagaaggatacggaagcagacggtttccagtggattaactgcatttctcccgagaagtgcatgctttcttatatgagaaaggccttaaagccggagcagacactggttgttgtcgcaaattttgccaatatcgggcaggaattctgtatcggggttccgatggcaggcaaatataaagaaattctgaatacagatgataaggcctacggcggaaagggactggtaaacgcccgtgcgatacctgtaaatgatgaggaatacgatggacagccctgttcctttaccatgaaggctgcaccgctttctttgagtatctttaagtttgttgcctatacagccaaagagaagcagcagatcgaaaaccgcaaagcagaaacgaaagcgatccgtctggcacaggaagccgggcagcgtgcaaaagaggctgaagcagaagccgaagagctgaccttgcgtgcaaaagaattaaagaagcaggcagaagaaatcatgcagcaggcccagaaggccttacaacgtgcaaaggaagaagagaagcttgcttcaattgaatggaaaaaggcagaagaggcagcaaagaaagcaaaataa

SEQ ID NO: 94 - DNA, 2094 bp, Unknown
  Description of Unknown: Firmicutes bacterium sequence
atgagaagtaatgtaccagaaattttcggaagtatggtattcaacgatgccataatgagagataaacttcctaaagacatttacaaatccttaaaaaagaccatcgaggatggcaaagatttagatattactgtagccaatgtggttgccattgccatgaaggactgggcaatcgaaaaaggagctacccattatacacactggttccagccgatgaccgggatcaccgctgaaaagcatgacagcttcatttctccacagaatgacggacgcatcatcatggagttctccggtaaagagctgatcaaaggcgaaccggatgcatccagctttccttccggcggcttacgtgccacctttgaagcaagaggctataccgcatgggatcctacctcttacgctttcgtaaaggacggagtgctttgtattcctaccgcattctgctcctacggcggtgaagcactggataagaagacacctcttctccgctccatggaagcccttggcgaacaggccgtccgtgtattacgtctcttcggtaacaccgatgcaaagcgtgtcatcacaacggttggtcccgagcaggaatacttccttgtagataaggacttatacgagcagagaaaagaccttgtttactgcggacgtaccttatttggtgcgatggcaccgaagggtcaggaaatggaggatcactactttggagcgatcaagccaagaatttccgctttcatgaaggaattaaacgaagaattatggaagctgggtattttagcgaaaaccgaacataacgaagtatcgcctgcacagcatgagctggcaccgatcttctctactaccaatattgcaaccgaccacaaccagatcaccatggaaatcatgaagaatgtagcaaagagacataatctggtctgcctgcttcatgaaaagccgttcaagggtgtgaacggaagtggtaagcataacaactggtctttgacaaccgacaccggtgtcaacctgttagagcccggtaaatctccttatgaaaatgcacagttcctcttattcttatccgcagtcatcaaagcggtggatgaatatcaggatctgatgagagtttccgttgcatctgctgaaaatgatcatcgtctgggtgctaacgaagcacctccggctatcatttccatgttccttggagatgatctggaagctatcctggaagccatcgaaagcggtaagccatataacggaagcggtattgaaaagatggaaatcggtgttcatgtacttccttccttcccgaaggatacgacagaccgtaaccgtacttcaccgtttgcctttaccggtaacaagttcgagttccggagccttggttcttcccagtcgatctccggaccgaacatcattctcaataccattgttgcagaggaattaaagcagtttgcggatgagctcgagggtgcggaggacttcaccgaaaagctcaacgaactcattaaaaagaccattaaggagcataagagaattatctttaacggtgacggatattcggatgagtggaaagcagaggccaaaaagagaggtcttctgaacttaaagactaccgtagatgcccttcctaccttccttgcaccgaagaatgtagaactcttcaccaagcataaaatctttaccgaaaaggaaatggaatccagatatgaaatcttactggaaacctacagcaaggttatcaacattgaaggtcttactatggttgacatggcaaagaaacagattctgcctgctgtaaattcctatatcggaaacctcgcttccactgcaaagaagaagctgtcggttaccgaaggtttatcctgcaggatggaaaaagatctgcttgaaaagctttccgtactggaagattctgcttatgacaaagcaaataaactggctgctctccttgaagaaggcggaaagctttccgatggccttgctcaggcaaccttctataaggatcagatccttcctgctatggaagcattaagaagcgactgtgatgcactcgaagtagatactgcagaaagctcctggccgttcccgcagtatggtgatctgctgttccatatctga

SEQ ID NO: 95 - DNA, 1959 bp, Unknown
  Description of Unknown: Firmicutes bacterium sequence
aaaatggaaactaagaagaaacgaattgaagagcttgtcggaattttgaatgaggcatccggtgcctactatcaggggcaggaagagaaaatgtcaaattatgaatgggatgccatgtttgatgaactgacggcattagaacaggaaaccggttatattcttccggatagtccgacgcagaataccggagcagaggaaacgggaggaaaccgtgaaccgcatgaattccctgcgctttcccttgcgaagaccaagcaggtctccgagttgaaaaagtgggcagaagggcgggatatctggctgtcatggaagctggatggcctgacactggttcttacctatgataaagggaagcttacgaagattgtaaccaggggaaacggtgcggttggaaataatattacttttttaaaagatgccattaagggattccccttaaagatttcctatcaggggcatatggttgtccgtggagaagcaacgatttcctatacggattttgagatgattaatgatctgatcgaagatgatgatgagaagtatgccaatccgcgaaatcttgcctccggaaccttaagcctggatgatccgcagaaggtaaaggaacgctgtgtatatttccatgcattcacgctggtttatcgtgaagaaggaatccggtctttcggagagcagatggattatctggataaggaaggattccttacagttgaacgggaacggtgcaatgaggacagtctggatgaagtgattgcacgttggacgcataaggttgagagcgggcagatggatattccggtggatggactggtcatctgttatgatgacaccgtgtatgctgctaccggatcggtaaccggtcatcatgcgacacgtgccggatttgcgtttaaatgggcggatgtttctgcaacgtcaaagctccgctatgtagaatggtcctgcgctgcatcaacaatttctcccgtagctgtttttgaaccggtgcagttggagggaacgacggtgagccgtgcttccctttgtaatatcagtgaaatggagagacttggaatcggagaagaatgcaccctggaaattattaaggcaaataagattattccgaagtgcattgcagtaaaggaggcaaaaggctctttccacattccggagacatgtcctgtatgcggtgcgcggacgcagatccatatcagcaatagcgggacgaaaacacttcattgtacgaatccggattgtaccgccaggcagggaaagaaatataccaggtttgtaagcaagtccggaatggatatcgatggcttatcaattcagactatgctgcggtttatgaatgaaggatttgtacatgaatttgccgacatttatcatctgggacagcatgctgaaacaatccgcaatatggagggattcggagataaatcctgtgaaaacctgttgaatgcggttgaaaagagccgggaagtgaaagcggtgaacttcatatatgcgctctgtattcccatgatcggtgtcgatgccgccaggaagatcgtaggaagtgtgagctttaatggattccttgagcggatgaagaacggacagggatttgaagatgttgacggaatcggaccggaaaagtctggttctgtcatggagtggtatcagattgcaaagaataaggaagccctggaacaccttttgcaggaggttcgtattatacagggggaagctgtcagtgcggaaggaggtacctgtgccgggcttatctttgtaattaccggtgatgtacaccggtttaagaaccgtgatgcatttaaaagctatgtggagcagcagggaggaaaggtgaccggaagcgtcagcgcaaagacaaacttccttattaataatgattctgagtcctcttcaggcaagaacaggaaagccaaagaactgggcattccgattctgaccgaggatgagttcatagaaaggttctga

SEQ ID NO: 96 - DNA, 1674 bp, Unknown
  Description of Unknown: Firmicutes bacterium sequence
ttgaagaaaaaacagacagaatctgtctccagtctcaaggtaattccccttggaggcctggaacagatcggaatgaacattactgcctttgagtacgaagacagtattattgtagttgactgcggtctgtcctttccggaggacgatatgctgggcattgacctggtaattccggatgtgacctatttaaagaataacattgataaggtgaagggctttatgattactcacggacatgaagatcatatcggggcacttccctatatcctgaaggatattaatgttcctgtttatgcgacgaagctgacaatgggaatcattgaaaacaagctcaaagagcatgagcttttagggataacgaagcgtaaggttgtgaagttcggacagtccattattcttggacagttccgtattgaatttattaagacgaatcacagtatcgtggatgctgcagcactggccatttattccccggcaggaattattgtgcataccggagatttcaaggtggattacacaccggtattcggagattccatcgatttacagcgctttgccgagattggtaaaaagggtgtactggcattgatgtgcgattctacgaatgcagagcggacaggctttacgccatcggagcggacggtcggaagaacgtttgatacgctttttgaagagcataaaaatacacgaatcatcattgcaacgtttgcatcgaacgtagaccgtgtgcagcagatcattaactctgcctacaaatttggaagaaaggtagtcgtggaaggccgcagtatggtgaatatcatcgagacggcaacgaaccttgggtatctgaatattcctgaaaacaccttaattgatatagaaatgctgaagaattatccggatgaaaagactgttattattacgacaggaagccagggtgaaagcatggcggccttaagccgtatggcagaggacaatcaccggaagatttcgatcggacctaaggatacggtcatcttttcttcccatccgattccgggtaatgaaaaggcagtaaccaatgtcatcaatgagcttctgttaaagggcgcagatgtgattttccaggatgtgcatgtatccggacatgcctgtcaggaagaaatcaagctgatttattctctggtacatccgaaatatgcgattccggttcatggagagtataagcatctgcgtgcgcaggcaaagcttgcagaagagctcggaattccaaaggatcatatttttatcctgcagtcgggcgatgtgctggaatttaacgatggggaagcaaaggtttccggtaaggtaccggttggtgatattctggtagacggactgggtgtgggagatgtcggaaatgtagtactgcgtgaccgacagcatcttgcagaagatggtattatgattgttgtactgggactggatggtgcgactgatcagctgattagcggacctgatattgtatccaggggctttgtatatgtaaaaacgtcagatgaactgatggatgaagcgagggaggtcgttacccttgcagtggaaggatgcctggatcgtggcattacggattggggcaagcttaagagtacgattaaggactcactgggcgaatttgtctggaagaagacgaagcgtcgtccgatgattcttccgatcatcatggaaatttag

SEQ ID NO: 97 - DNA, 2124 bp, Unknown
  Description of Unknown: Firmicutes bacterium sequence
gtgatcgaagaaaaaagaaacgcaagtacatatgtgtttggtctggatattggaaccagaagtattgtgggaacggtaggctaccggaatcagaaccggttcattgttgtagcacagcgcgtgaaggagcacgatacccgtgctatgctggacggacagatacatgatatccagaaggtaggagacaccatccgtatggtgaaacaggaattggaggaagcgatcggtgaaaagctgaaaggggtctgtattgcggcagcaggacgtgtgcttcgcacggtgacaactcatgaagaaatccagtttcagaatgagcaggagatttcaaaggatgatatataccgtctggtatcctccggtgtggagaaggcttatcaggagtttttaaatgaagaaaaagacagtgatgtgaaattctactgtgtcggtcattctgtggtacgctactatctgaatgggtatccgatgggaaatcttgaggaacataagggaagaaatatcggcgtggatctgattgccacgttccttccggatgatgttgtagatggtctgtataaagcagtagagattgcaggactggaagtggcaagcttaacccttgagccgattgcagccatccagcttgcgattccggaacgcttccggatgctgaatattgcactgattgatgttggagccggaacaagtgatatttccattacgaacgatggctgtatcattgcgtatggaatgattccggttgcgggagatatcttaacagaaacgattgcaaagcattgtctggtggactttgcagaggcagaacggatcaaacgggaggccggaaagagcgataccgtttcttatatggacatcatgcttctcccacagacgattcgcagcgaagaagtaaatgagcttctggcaccggtgattgaagagatgtccatacaggtggcagacaagattatggaattaaacggtggaaagccggtgagcgcggtctttatcgtcggcggcggcggcaagatggccggctatgccgaggcagttgcccaaaagcttggcattgcaaaggagcgtgttgccctccggggtgaagaggttatgcagaatgtagtctttcaggaggatattaagaaggacagccttttagttacgccggttggtatctgcatgaattactatgaacagaacaataattttatctttgtaagcttcaacggcagcaggattaagatgtacgataataacaatctgacggttgccgatgtggcattgcaggcacaattcccgaaggatggactgttcccgaagcgtgggaaagcgctgaccttccaggtgaacggcaagcagcggatggtgcgcgggctgcgcggcgaggcagccgtcatagaagtcaatggaaagatcgtagacttgaataccacagtacgcgaaaatgatattattggggtaacggaatctaccgccggggatgcggcaaaggccacgatcggagatctgccggaagcaacggaaagcatttgtgtggttgtgaatggtaataaggttgagatcccgaaatttgcacaggtgaatggagtattgcagtcctcctattatgaaattcgggagaacgatgaaattgaaatgctgaattactataccgtacagcagattgcagaatttatggatctttccctgacacctggccgtgagattttcgtaaaccaccagagtgcagaatgggatactccggtttatgagaattttacggtgaactttgatctggagaatgagaccggaagcggggcttacggagaatccaacggggaagaagcagaagaagaggcagaagaaagtatagcaggaaatgcaaaagcgaattctatgaaggaagcggcgtcagaaacttccacagaagcttctgacgaagaaaagaaaccggccggaccgacaacgattattgttgtggtgaaccgctcaccggtgacgttaagcggaaaaccatcctatgtatttgtggatgtatttgataaaattgacttcgatctgacaagaccgaaagggaaaaatattgtgacaagcttaaatggcaaaccggcacaatatatggaaacgcttcatgatggcgatgtgatcgacatctattggagtaactaa

SEQ ID NO: 98 - DNA, 4329 bp, Unknown
  Description of Unknown: Firmicutes bacterium sequence
atgggtgatacagcattttttttgcatcttcggagacagaaaatctgtctgaattatcagcagggaagctttctggtaaatacccgtcccatgttatcggattcattgctgttaccggattctgaggttgaagaaaaggtactgatcagcaggcaggggcctgtacatagattggctcccgcagggagaatccgtctggaagccgaagccttggtgactttgggaagtgattatgaaaacagaatctgttaccagtttcattccagggtcagaggccgacatgccgtactggttatggaaggcgaaaattgtgttctccataatcttggcggtgatggagtatatcataacggaagaagagcgcaggaaagtaccattcttgagaagggagattccttgcagctatacggtcttttcatgcaatttcttcccccatatctcatttatgttccactggttggagaatgccgggtgatggacagtggatttacggggaaggaattacagcaaagggcaggggcggtaatggtgtcacgctccatacagaaaattccggaacaggtctgtttaccggaagaacaggaaagagaggtcttaagtccaccacagaaaaaggagacttcgcagacgccgtggattctgtccataggcccatcggttacaatggtttttccaattctgatgatgagtcttcttggaagtagaatttcgaatggaacaggaaacaactatcggtatgtgacattggcagcaggagtatgcagtgcattgcttggagtattctgggggattacaaaccggctggccagtcgtcgggaggagcggaggagtaacagggaaagaatcatccagtaccgggaatatctgggaaaactggaagcagagctgcagatgttagcacagaagggagctgggctttggcatcgaagatatccggcggttccggagtattatgcagagaaccgacttctgatattgaactggaaccggtatgaagctgatccggatttctggtttacacgtcttggaacaggaagacaggattttcctgtaaggctgaagcttccggaggaaaggaaggttttcgtaaaggattcaatggaagaggaggcagaagccttatggaagaggtttcagtatctggaggaggtaccggttggtgtggacttccgggagaattcccggcttggtgtagtaggagaagagaaacaactgcatgatggggtgttacagattttctggcagcaggtgcttcatcactcaccggaggaaatgcgtatggcctgcttctttgattcgtccataccttggcagatgagcgtttatcacagtatgaaatgggttccgcatatctggtcggaaagcggagaagtccgatttctggccgggaataaagaagcagcggccgaaattctcccggatcttaccagagaactttccgcacagaaagaacaggtttcttttctgatttttctgtttgatcccatgctgattctgggagaagttctgcaaagccttttacaggagggaaaggcggaccgggttatggtagttggaattgcagggaaagaacaggagcttcctaaggaataccgcagccggatgatctggcagaaggatcgtcaggaactgcagctgtatgaaaatgataaaaggattaccgttcctgttcagtacgataccatggaccggaagaaagcttcttcctatagcaggaactttgcgttatgggaaaggacaggaaggggaaagaatgaaggaattcctaaaaatgtggattttctggaactctttgattgcctgcggatcgaagaacttcactgtgaagtccgctggcaggaagcaagaccggaaaagcgtcttaaggcagtgattgggaaaggaatgcagggtgcaccggtatatctggatgtgcacgaaaaatttcatggcccccatggactgattgcgggaacaacaggttccggtaagagcgaattgcttcaaacctacctgctttcccttatgatccagttcagtccgcaggatgtgaacttttttgtgattgattataagggtggtggaacaggaaatgcagtcaggaattttccacattgtgcaggagtgatatccaatctgtccggtgggcagatccggagagccatgcttgcaatcagcagcgagaataagcggagacaacggattttttcccgatacgaggtgaaccatattgatgcttatatgcagctttatcgtgaaggaaaggtcacatctgcactgcctcatctgcttatcgtgattgacgaatttgcagaattaaagaaagaagaaccggaatttatgcaggaggtaatctcacttgcacaggttgggagaagtctcggggtgcatctgcttctggcaacccagaagccggcaggaacggtagatgataagatctggagcaatgcccgtttccatctttgtcttcgtgtacaggataagcaggacagtatggatatgcttcataagccggatgccgcttatctgacgtctccgggacaatgctatcttcagattgggaatgatgaattatatcagctgttccagacgggctactgtggcggcagatatcagccggaggaacagaaggaagagactgtggctcttctttcggaaaccggaaggagaagcgtactgccaaaagagaaagtaagtgatacagcagactcacttatagaatgcgttgacaattatgtaaaccatatagcagagcagcatggatatgggcgggccggactgttgtggcttccggaactggaagaagtaatttatctggaaaaaatccaggaacaggaaaaggaagagtccgaaaacgaaatcggccatgcacaggtattccgggtcgggaaatatgatgatccggaaaatcagtgccagaaagtattgtattatgaaccgcagaaacaggggcatctgggaatctgtggaggaccggcaacaggaaagtctcattttatccgccttattctggaacagattgcaaggaataatacaccaatggaggcagaatattttctgctggttgtggaacagccggggttccttttgtatgaggaacagccacattgtcttgcgctggtgcagacacctaaggatcttccggtattcttttatcagttcagacagctttggagtgaaagaaaacggatacttaatggagaaaattataagacttttatacgaaagaatccgggaaagcttccggttctgtacggcatggttgacggtatcggaaccttacgaagatatctgggagaagcggaagaggaatttctgctttccatggcagcagaggggatcagtcttggagtatttcttatcctgaccgggaatggggtggcagattttcaatcaaagctttggaataaaatcaagacaacactgtcacttgaattaagcgatccctttcagtatggggatgtgctgcggcagtatcatgggatttcgattccgaaagccggtgttgcaggacgaggattatgtaaaaaggaaaagagggttctggagtttcagaccctggcatttcataaggagggtgcaggttatcaggaggggcagcccttttatgaccggattgtgcggatcccggaatatccgaagcttatgcagttccttacggtttatcgtaagagccggaagtatgacggaacaggcagccgggtaccactggggtataacaaggaaacaggagcaattgaaattctggagcttcaaaagctttccggttttctgatatccggtgcagatcagaccggaaagagcagtctgattgatcatctgttattcagtgtgagaagtgttacagactggaaaatactgcttctggataccgaaggggaacatgccgggttaataaaggaaccggaggtgatctgctgccggaatgcaggggagctggaggaagagctgcaaaaggaacagcagaagaaaagccggcttgtgcttatgattccacatctggcagcatttacaaggcagatttactcctattgcggagaagagaaagaaaagacacagcaatgggaagagctggttggaaaacggagacagaatgtagtggtgatcggagcgtatcatccgcagcgtgatctggaagtatatgcaacaccgttgtttcaatccctggcctcctgtcagtggggagttcatcttggaggaaatgcatccttgcagagggcactggaatttgagggattgaatttttccctgttgaaccggtcggagccgccgggaaatggatttttgaaaaagggatcgggaggaggaagtgtgcagcttctcattccgtataaagaaggtgaggaatag

SEQ ID NO: 99 - DNA, 1830 bp, Unknown
  Description of Unknown: Firmicutes bacterium sequence
ccggcaaaggttgtttacctttgccggtttccttataaaaatatattgattaatgggggataccatatgaaaacaatacccagaacaaaacatagcaataagtataatcaggagaaaaaccggctggtttccaaggctttatttgaaaagaagctggatgcaatgaaaggctatgttgaggaatacttaaaaagcaatccgattgatattaagtgtaaggatattcaggatgaggttaagtatacggtgtttgtttccgtctccgatgggaagaaaagagccagggtatgtcatgcatcggctgcagattttgaagcttcctttatgaaagtaagggaaaaggtaaggactgttattgataaatacagccttacgccggtgtggatcaaaattgatgttgtggattttgttcaaaaagttccatttgcgaatttaaagaaaattttcctgtcagtaaaatataaggattttttcagaatgggattttcgctggatccatggatggatatagcttttttggaagcagaggctaactcctatggactttatgattattccgtcatacctatgaaggcatcgaagcccggtcatgagaatgttccctgtattaacacagaacaggtggaaaaatacttaggctggaatggaagaccgtgttctcctgtcatcctgccatttgtttatttctttaattgcaaaagcttttttatggacacggataaggaaatatatatgctttataatgcgggaatgcattgtggaagaagaacgatcggagagcttactcctgagtttgtaagggaaattctcacaacctcttctcagtatttaacaaggcagatgttaccgtcagataaatttatatatggttatttttcacgatttaatgcggtaatgacttcctataacatattgagacataccggaacggtatggtctatgatgtgtgcatatgaggttacaggcgataattctttactggaaacgataaataaagcaatcgattatcttctcacacaaatcagttataaggataatgagacggcatttgttgttgaagcaggaagcagggaaattaagcttgggggaaatggaattgctattattgcgctgacgaagcatatggaagtatttggggatcgtgactttacggatatgattacgcttctggcaaatggaattttatatttgcaggataaagaaaccggaaaaatgactcatgttttagacgcagccaattttgaggtaaaagaggccttccgtaccgtatactacgatggagagtcagcatatgccctgataaaggcctatgatattaccggtaataatgcttatcttgatgctgcaagacggagtattgattattttataaataagaattacgtggtacacagagatcattggctggcttatgcaatgaatgagtttaccaggtttgtacatgaagaaaagtattatacatttgcactcagaaatgcatgggagaatcgtgagaggattagaaaacaacaaacctcatatcatacttatcttgaattattgatggaaacctatgacatctacctgagaataaaagaacagaacatttcagtggattatatgaatcagattgatgaggatgaatttgttgagattatcaagtacagggcatttcatatgctggatggatatttttatccggaatatgcgatgtatatggaaaggccggataaaattcttggttcattctttgtacgtcacgatgatttcagggcgcgaattgatgacaaccagcactttattgatggctatgccaagtattataagttaattttgcataatggagaatga

SEQ ID NO: 100 - DNA, 1314 bp, Unknown
  Description of Unknown: Firmicutes bacterium sequence
atgcaaggaggaagcaggaacatggttaaagcagtcgtaggagcgaactggggagatgaaggaaagggaaagatcacagatatgctggcacagcaggcggatatcattatccgttttcagggtggtgccaatgcaggacataccatcgtaaataattatggtaagttcgcattgcataccttgccgtccggtgtattttacaatcatacaaccagcatcatcggaaatggtgtggcactgaatatcccggtattattcaatgaaatcaagtcaattaccgacaagggagtaccggcaccgaagattctggtatcagagcgtgcccagatcgtaatgccatatcatgttctttttgaccagtatgaagaggagcgtctgggaggcaagtccttcggatcgaccaagtccggtatcgcacctttttattcggataaatatgcaaagatcggttttcaggtgagtgaactgttcgatgaagacaccttaaaagaaaaagtacagagagtctgtgaacagaagaatgtcattctggaatatctctatcataagccggcgattgacccggaagaattgttaaagaccctgcacgaatatcgtgatatgatcgcaccttatgtatgcgatgtatcttcttatctggatcgtgcaattaaggaaggaaagaccattttattagagggacagcttggaaccctgaaggatccggatcacggaatttatccgatggtaacctcttcctcgacacttgccgcttacggtgcaatcggagcagggatcccaccttatgaaatcaggcagatcattaccgtatgcaaggcttattcttctgcagttggtgcaggtgcctttgtatccgaaatcttcggagaggaagcagatgaattaagaagacgcggtggtgatggcggtgaattcggagcaaccacaggacgcccgagacgtatgggctggtttgactgtgtggcaagtaagtatggctgccgtctgcagggaacaacggatgtggcatttaccgtactggatgttctgggatatctcgatgagatcccggtttgcgtcggatatgatattgacggtgaggttacgactgacttcccggtaacctggaagcttgagaaggcaaagccggtattaaagaccttacccggatggaagtgtgatatccgcggtatcaggaattatgaggagcttccggagaactgtcgtaaatatatcgagttcgtagaggagcagatcggttatccgatcacgatggtatcgaacggtccttcccgtgatgacatcatttatcgtaaaagtcctctcagcaagtaa

SEQ ID NO: 101 - DNA, 537 bp, Akkermansia muciniphila
atgtcaaacggttcaggcgttttgcgcctgaaccgtttttcatatcagaatgcgcgcatgggatttgatccagcatcattgggaatgataacactggccgctacttcagcggcagcaggtgcggcatccgcgtctgcacagaaaaaaagcgcggaagccaccagacaggcggcggacgcaaatgctgccaccctcagaaacgaggcagacctccaaaaacagacagggatggaaaatgccaaacgcatgcagcaggacgctgcgcgccaaatgggagaagcccgactggacgccgcccaatcttccctgctccgggaaggctccgttccaatcagggaacaggctttggcgacgcgtctgcaaaccaggattcaggatgaagcggcggaagccatgaggaacgcccaatccctgtacaaccgcgccaacacggagcaatacatgggccgctccaatgcgagagcccagaaaacctcagcaatgggcaccctgctctccggattcgcccagggaggaaataccctcctcaaatggtga

SEQ ID NO: 102 - DNA, 480 bp, Akkermansia muciniphila
catccttctccccttcgtgccatgagctccgacatctccaccaacaaaaaagcccgccgggattacgaaattctggacacctacgaatgcggcatggaactcaagggaacggaagtcaagtccatccgcgccggcaaggtgaatattgccgattccttcgccagggtggaaaacggccagatgctcctgtacggctgcgacatccagccctgggagacggcgggagaattcttccagcaccaggcgcgccggccccgccgccttcttctccataaacgggaaattttcaaactggaacagcagacttcccagaaaggctgctccctggtagctctcaagctgtattggaaaaacggcaaggtgaaactggctctaggcctgggcaagggcaaaacccaccgcgaccagcgctacgatttgaaagcccgcgtggaaatgcgcgaagcccagcgggaagtggcccgcatcaaccgccggtaa

SEQ ID NO: 103 - DNA, 621 bp, Akkermansia muciniphila
atgatcaatgaatccttacttcagccggatacgccatccgcgctggacatatgcaacgcggccctctccaaaataggggaggcacctctggacgcgctgattgccaatgaatccacggcatcccgcctttgcgttcttcattaccatccggcccgcagggaaaccctttgcatggcgcgctggaccttcgccgccacgcaaaccactctggactccgtttccgcacaggcgcccaattccctgaccccctatcaattcacgctgcccgcagactgcctgcgcgtgctggatgtggaatgctcggaatggaaaatgcagggacgccgcattcatgcttcctgcgccccgcttcccctaagctacattgccgatattgaaaacgccgaccaattcgatcccctcttcatggacgcactggccacccggctggcagaaaaactggccatgcccctgacgggcaaccaaagcctgcgccagaatcttaaccaggaattccataaaatcattcttccgcaggcggctaccgtcaatgcggtgcagtgcttttccaatgattcccacccgctgctggatttgctgagaaaaatcaaatcgccctcttgcccggaagaatgtgaataa

SEQ ID NO: 104 - DNA, 492 bp, Akkermansia muciniphila
gacatattgtcgcgcatttgcggctggacatggttccgggggaggaggcaggatgatggcatgcctgaagattttccctgcattccctttgtcagaacgcgccaggtagcttttcatgatacggatgcttccggggtggcccacttctcccggctgctttgtttggtggaagaagtggagcacgagtacctgcgttcccggggggtggaggttctttccccagactgcggatggccccgcgtgcatgtggaggcagattactccagctctgcggggctgggagattggctgagcatagaattaagcctgggaacggtgggaaccagttctctggaatggaaatttgctgtatttcattccgagcgtccggtgatgaggggaagatatgtagtcgtccgtgtggggaagggcggcaaacctcaggcaattccggaatcggagagggaatgcctgatttcaggcttttcaaaaggaggggatgcctgtaaataa

SEQ ID NO: 105 - DNA, 522 bp, Akkermansia muciniphila
tttccgtgtaatatttctgccatgccgactctccgccaagccgccaaggacgacatcacgctgatccatgaactggcctgccaggcttttccggccacataccgggacctcctttccagagagcagatagatttcatgatggactggatgtattcccccgccaacctggaaaaacagatggaggaggggcacgtgtacttcatcgcctcccatgagggaaaggactgcggctacctgtccgtccagccggaaggccccggcgtcttccatttgcagaaaatctacgttctgcccggcttccagggcctgcatataggaagctttctgttccgccacgccatcagctacatcagaagcatccacccggaaccgtgcctgatgcgcctgaacgtgaaccgcgataacacccgggcggtggaattctaccagcgcatgggcatgcggaccctggaacgcggggatttccacatcggccacggttactacatgacggactacatcatgggactggatatagcctga

SEQ ID NO: 106 - DNA, 492 bp, Akkermansia muciniphila
cccgccatgccggatgaacatttgattactctggaaccttacgccctgctttacacccgggccggggcgggtgtgtgcctgcgtgatccgctgaccggcaaggtgggcgtcattttcatggagctgacagacggcatggccctggaacgctgcctgaacggggaacgcccggtacggccggacacgtcttccctgctggctcactttttatccgccatggaatgccgggtgaggctggtgcttatcaacggccgcaaggatgaagtcttttatgcccgcgtgaccatagaggctgccaatgaggtgatggacaagctggtggagctggacgcccgcccttcagacgccctgatgatggcagtccggtttggaaccgcaatcaagattgttccctccgtatgggagagcatggagaacattctgccccaactggagcaactggatgcggattccccggacagccgcgctccggtatatgtgggagattcgtaa

SEQ ID NO: 107 - DNA, 789 bp, Akkermansia muciniphila
gtgttcctgaaccatttccgggccggatttatgaacgataactggtgggccattgcctctctcatcctctccctggctttcacagggctgggatggcgcctgctggcttccggccggcggtttttatatgcccatctttggatggcgtgcctctttgttctccagacaggggcgctatgcgtcaaagcgtaccagacgggaatgtgtcccatccgcggcgcttcagaggtgctcttcttcctctcctggagcatcaatctcttttatctgatgctgggacgtgcttaccgaatgtccgtgcttggcatctttacggctccggctattgccgtgctgacggttttttccctgctgataggccgttccggagcggacgtgcagggcacgcatgatttctgggtgacggcgcatgtgggcatagccatgatgtcctacggagccggcggcctggccgctgccgcgggggcggcgttctgcatgcagaatgaatgtcttaaaagacaccggattcccggcacctgtcgtgtgcttcctcccatccgtacactggaagccagcatgaagcgcctggttcttgtggcattcctccttcttctgcttggggaatggcttgggtggcgggggaatctccccattaatgcggccaagacctccattgtcattcttctcacggcaggctacagcgtcctgctgtggttcatctaccgccgcggcattccgggaaggatgttggcctgctgctgcgtggtcctctttattgcatccatgagcattttcctggtaagctga

SEQ ID NO: 108 - DNA, 1065 bp, Akkermansia muciniphila
atggcacgcatggaacaagtcagtctcatggaattgggcaagctggccgcagaaggccaggttgaagcggaagtttttgcccagattgcccaatgcgcgcagaagatgaccaaaggcaacaagccgtatctggatgtgtcttttgccgatgcggaagggaccatgggattgaaggtgtgggaggataaaccctggttccggacgcttgcttcgctgcccctccgcagttttgtgagcctgcgcggccaatgggccaagggagggttcggcatggaagttgccgatttggacgtgcggttgctggacgaacaggaaaaggaaaactttctggccggctccggaaccttgaagaaaaagcaggaagctgatctgaaggaaatctgcatgttcatcaagggcatgaatgatccgcgcatacgcgccctgtgcattgaattcattgagcagttcggggaacgcctccagcgcgccgccgccgcccgcacttaccatcatgcccgccgcggcggactggtggagcacgtggcggggatgatgcgcacggcctctgccgtctgccaggcgaatccggagctgaaccgtgaccttctgctggccgggtgtctgttccacgactgcgggaagttgtgggaaaattgctacccgaaggaggattttacgatgccttattcggaggccggagaactgctgggccatattccgctgggcattgaactggtcaacaatttgtggaagcgcatcatgtcccttccggaggcggattcctggaagacgctggaccctccttcaccggacgtgcgcatgcacctgctgcacctgattgcgtcccatcacggggaacttgccttcggttctcccgtgtttcccaagacgccggaggcggtggccctgcattacatcgacaatctggacgccaagctggaaatgttccgcggggcttatgagacaagcgaggccctggctcccagagtgctccagcgcaaggcccccctgcctgccaacgttgttcttccgctgccttccgttctccctctggagccggacggcgaagacgctctgccgtaa

SEQ ID NO: 109 - DNA, 363 bp, Akkermansia muciniphila
atgaagattgcgttaacgatttccatgctggtggtctccaacgtttttatgacgtgggcgtggtacggccatctgaagaagggttccggggcggatggcaagcccctgctgatgattatcctgatgagctggggattggcgttttttgaatattgcttcatgattcccgccaaccgcctgggcagtgcgggcgggcttaacgtggcccagctcaagattattcaggaggtgattaccctgtgcgtgtttattcctttcgccctgttctacatcggagaaaaatggaagtgggattacctgtgggcgtttttatgtgtattgggagccgttttcttcgtcaacagggagcgtttgttcgggtga

SEQ ID NO: 110 - DNA, 651 bp, Akkermansia muciniphila
atgcggagagtgttcatcagcggcggtcacggcggtttggcgcgggccatcgtggaatgtttttccgctgcgggatgggagacggatgcccccagccatgccgcactggatgtgggagaccgttccgccgtacgccgctggtttgattgccatgccgcgtatgatttggcggtttgcgccgccggaattactagggacaggccgttcctgaagcagacggaggaggagtgggacgaggtaatgaatgtgaatgtgacgggagccgcctggtgcggccgatgcgccgccgccgccatggtgcgggagaagagggagggtcaggtggtgatgatcggttcttatgcggcgctccgtccggctccgtcccaggcggcttatgccgcttccaaagctgctctggcgggcctggtgaaaagcctggcgcgggaatggggaaaggatgggattcgcgtgaatctggtgttgccggggttcatgctgacggagatgacggccgtgctgcgggatagcgtgaaagaggcggctttgtcccggcatgttttgaaccggttgaatacgccggaacaggctgcggcgtttatcctgtttttacaggatgttcttacggcggcttccggccaggtgttcgatctggacagcaggattgtttaa

SEQ ID NO: 111 - DNA, 495 bp, Akkermansia muciniphila
accgccggcgagtctccggacgggtatcgctatcaaccctcccatacattcacaacgatcatgagctccatttccgaagaagcaaacaagctggcggatttcatcctgttcacgcaacgttcctgcattctgaacctttcttcagaattgaatgagggcaaggtttcctacccccagtttttcctgctgacttatctggccagcgaagattttctgagcatgtccagcattgcccagaaaatggggcattctaccgcggccgctaccggcatggtggataaattacaggaaatgggctacctgaaacgcatgagcgcagccaaagaccgccgcaaaatcatggtcgccatcacccaggaagggcgcgatctggtagctcgcatgcgccagaacatcgttcgggacctggcagccttgatggccggagcggatccggacgcacgccaaacgcttgccgataccggaaaatccatcagaaagcgccgtttggcctga

SEQ ID NO: 112 - DNA, 1290 bp, Akkermansia muciniphila
atgttcccttttcccccggttgtccgttctttcctgttttccctgtttgaagtggcgtggctgagggctgcgttgcgcttctgcctctgtgcggcggtatgcgcctcctgctccgtggacaggcacatggaaaaaaaagcgggggaattgatgtccaggatggatgccgttcccgattggcggcagctgccgcggaaggaaatttcatggagccaggctctggagatgatgatggagcggaatattgacctgaaaaaatcggaacagtctctcaagacgacaaaacgttccgtcatcaatgtttttacccagattatccccggcgtcaatctggactggatgctgaccaaggaattgagcgacctggccagggtgacggccagcgatgtggaatacaacacgaacatcctgttcaacatgccgtccctcacccagatcccgtttgattattataccgccaaggcggccgtttatacggcggaaaagacgctggaaatgaaaaaaagggagctggtggccagattgtaccagcaggtgctttcttaccggaatgcgcagatcagctacaataaccagctgggctccctgccttatgacgatgatggcgtccagaaaaagaagctggacgtggaacgggaacggaatttgaatgagatttcccagggttttgccgtgctgctggggaatatggacgcccggtggctggtgaagcctgaaacgatgcccaggctggactggggcaggtacagggcggcgtcccgccagctggatctgctggtggtgacgatggtggccatggagctggaagcttcccgcctccaggtgttgaatgccaagttgaagttcctgccttccgtggatattaatttttacagccccactctgttttccagcacgggcgggacgtacggcggtttttttgcgggcgcgggcgatatgaaggtgaacatgagcctgcgggaagagctggatacgcgcctgacctcctggtttcagtataaatcggccagggaaagccacgaactgctgcagcgtgaagtggtgatggaactgcagcggcggcgcatcaaaatagccgcgctgctggagagccgcaggaggtttgaactttggcggggggtgctgatgaaggaaatcgcgttcaaggagtccagattatccgtttccggagaagaatatctggaacaaaggaaggatatcaggaagatgtatgctgacctggataatgaagcttccaagaatgcggaggtggaagcggctctcatcatggaatacggctggctgaagtaa

SEQ ID NO: 113 - DNA, 948 bp, Akkermansia muciniphila
atgactttccgttccattttctccctggcctgctgcgccgcagcccttctttctcccgcttccgcagccccccgccccgcagccccccgccccggagacgccaaactgagagacgacctggacgtggcttataatacatggcgtctgcatctgctgcgcggcaattatgacggctggagagccacaacctccgcctaccgccaggtgaaagtgcgcaatctggccgtctcggaaaaacgcccctttcctgcttccctgttccggcagcccatggcacctcctgcgctcgctccgctgatgtacgtaggttccgtcgtaaacggccccacggccgcagccacctactacggcaaggtggatctggggctgggccaggaacccacggattcgaacgccctggtgctgctgttcactcatgaaaacggcaaatggaaatatgaccaggcgcgctttttcaacctcacccgcctgcccgccgtcaaagaacgcctcaaacgcggagacgcctccgtgctgatggagcaggacgggttccagccccttgggaaaattcccgccgtgccgcctgtctgcccgccgcccaaatacatcgcaaaaattctggtggactgtcccggccgcaccgtccaggcgaacgtaaacaatatttccctgcatgaatttgacaacacccgcctggcggaagtcatttccggaggactgagggacgggaccaactcactcacactgaacttttccgacagcccgaacggtaaaaaaggcgccgtactcgtggaagtgtacatcatgccggaaatcccgggccacctgcccgccagggctttttcctacttcgtccccccccaggcgcaacccaaaagcggccctgtgctgattaacgtcactccggaattgctgaagaccatggagcctaagaattcttccccgaaggcagccgccgacaaataa

SEQ ID NO: 114 - DNA, 336 bp, Akkermansia muciniphila
tttatgaatatctttatgttagcacaggctcaggatgcggcgggcgccgccgggcaggaacccgcaaatatgtttcagcagattctcgccagccccatgttcatgtttgtgattatcatcgtcctgttctgggtgatgctgatccgtccccagaggaaggcgcagaaggagcagcaggcgcgcatcgcagccctgcagcgcggggacaaggtgattacaaacgcagggctgcacggttttgtggagaaggtgaatgagcgcaccgtttctctcaagattgcggaaggcgtggtgattgaattggaaaagaacgcgatcgttcaagtggagaagtaa

SEQ ID NO: 115 - DNA, 831 bp, Akkermansia muciniphila
atggcacccagctccgacaatgaaggcgccccccggaacggcaccgccggcagggaatccctgcgcgacctgccggaacatgaaaacatcgtggagcatttctacgatccggaagatcagggctcccgggaaaaacccgtccgtgaaaaaacgcctttctccctgataggcaatctcatcttcctgctgaccatagccattctggccgctattgcctggctggtttactcctcctggtgcccgcagaaaacggacgacctgcccggcttccgccaaagggaaaacgccccggatatccccagaatcctgaaacaggccatcaacagggacgcctccgtctcgttctcggaagaagacatcaaccgctacctggcttcctccatccatccccagcagcacggcgccctggccatcttcgccaccaacccggcggccggcatccgtctgcacggcggcaaggaacggccggacggaaccatcggggaaggatacatggaaatcatcatcgaacgctatacgggcatcgactcccgccagacgatttccctgttcctgacgcccttccaatccctggacccgcacaattacatggcggtgcagacccgcttcgaattctacaatgacgaaacgctgccgggaggaatccacgtggggggcaccatcggcagcctttccgttccccagggttacatgatttttctcctgcccgcgtttgaaaacctgctccaggcctacctgccgcttatccacatgattgaagaaagcggcatgggcatccatatcagtgaaggcaggctgaacctgacgcctccgcaaaagcgcacgctgtag

SEQ ID NO: 116 - DNA, 936 bp, Akkermansia muciniphila
atggtcatttaccgggaattcaaggaattgaaaagccttgccgcccccgtacactgggccatggggatgtttgacggggtgcatctgggacatgccggagtgattgccgcggcggtgaaaggggctgctcttgacggaggaattcccgccgtgctgacattccgcacccatccgctggcccgggtgaggccggaaagcgtgccgcccgccatcatgggggaagatgctgaaaaatttgccttgatggaagagctgggggtgaaggcggtgctgtcgctggaattttcttccaggctggcgtccatgagcccggaagagtttattggggaactttgttcctcctgccgggtggctcagattgccgtgggagaggactggcattttggccgcggcagggcagggaatgtagaaaccctgcgcctgctgtcctgccgctacgggttccgagtgacggccgttccttctattctgcaggacggggagcgcataagcagcacccggattcgcgaagccgtgcgcggggcggattttttacaggttgccggcatgcttggccgtccctaccgctggaagggcccggtgattcacgggcgccaactggggcgcctgctggactaccccacggccaatatgagacccggttgcgggttacagcctccccatggcgtttacgccgtgcgcgcccgggtggccggcaaaaaatacggaggcgtagccaatctgggggtgcgccccaccgtggaaggtgagacggggggacttttgctggaaacgcatttattcggccacccgggggatatttacgggcgggagatggaagtggaaccggtccgtttcctaaggccggaaatcaaattcccctctttggaagaattgaaaagccagcttgcccgggatgccgcccatgccgcggaagcgctggaggagggggagtaa

SEQ ID NO: 117 - DNA, 600 bp, Akkermansia muciniphila
agctggaaacagagctttccatgtacaactaaggccatgccgggaggaaaactgtcattgccggaatctgaacgcctggtgttacgggagtggcgggaaaaagactggcctttttttgcggctatgaacgccaatccccaggtgatgcgtttttttcccggtgtcatgacggaaaaggattctctttccatgtggaaccgtatacgggaagaactggatgaaagagggtatggattgtacgcagtggaattgaaacattccggttccttgatcggccttctcggctttcattgggctgattttgaagcggactttacaccgtgtgtggaaataggctggaggcttgtgccggaagcctgggggtacggatacgctacggaaggcgcccgtgcatgcctgaaacatggttttgcacgattcggctttgacagggtatattcttttactgcttgcgtgaatttcccttcacaagctgtgatgcaacgtgttggaatgcgaaaaatagcggaattcaatcatcccaaagtagctccggattccattctttatccgcatgtactttatgtgaaggataccttctggaaaattgaacgggagtaa

SEQ ID NO: 118 - DNA, 822 bp, Akkermansia muciniphila
atggcaaaaaaaccattagaaacaggtgctccggaagcgtccgcagctaaaaaaacggctgctcgcaagacgacggccaaaaagacggcctctactaccaaaaaggccgccgcagctgaaaaaaaagctgctgctgacgccgcttccgtagaagcacccaaaaccaaaatcaaaacggtcaagtccgccccgaaaaccgcggtgaagacaaaaaccgcgaaaacagccaaaaaggcggctgatgaaaaggcccctgtctctgaaacggttgttgccccttccgaggccccggctccttccgctcccgtggaaaaggagatgatgcccgaagctccccagaagccccaggctgccgctccggtcaaggtcaagcgggaatcgttccgccccaatcgcaatgcggaacagcaggagcgccatgaacagcatggcggagatgtctttgcccagccggaaacggtgggcggcgcctccgaagggccctttaacaagcgcaagcgccgccgccgcaataagaaaggcggcggttccgaagaccgccagcccatgcaggatgccgcttctctcaagcagttggattgtaagaaggtggcttcccgagcctggaaaatgttcctggcggaagtgtctgaagaaggccttgccctgatggacgaccagacggcgcgtgaggcggcccgccgcgctttccgctgtgcggaattcttcatgatggaggaagcgcgccgcaagcatgcccagaaagcagctctccagcagcaggagaaaacttcttctccggaagaggaacgggattccgaagaggattccggcgaagaataa

SEQ ID NO: 119 - DNA, 1005 bp, Akkermansia muciniphila
atgaccgacgcccccgctcccagacagccgtccggcgaaactctcccccctgcggaagacgaaacccgctttgctccgaaggagaacggaggagaacataaggatgaaaactccgcccccgcagccaaaaaacgtctgaaaacctccctggacgtcgtctcggaacacgctgcggaagaagaatccgcccggcaggaggattccgaacggaaagccaggggagacgctcttttctggaacctctgcctggggctgttcgcccttatcgtcatcagtgccggctatattgtttatgaaaaattttcccagcttccagaccctgtcaaagatgctcgggaagctttggaggacaatcatgcccagctgctgaagaagcaggaacagctcagggaaatacggaacaggaccgctcccaaggaacagctgctcagccttttggatatctttgaacatacggcctccgacctggaagagacgcaaaaatccattgagaaagagaaaatgcgcgtagccggcatccggggagaaatccgctcctacttcgaacgctaccgccaacacgccagagccaaggcacgcggccgcaagttcgacattctgaagacatcccattcaggcaaaacttatttgaatgtggaaatcacccgcgtggaaaatgaattcgtgcgtatcatgcacgaacagggaagcacctccattcctgccggagatcttcctgacgacatccgggaaatgctggcctacggcgacccgctgaatattacggccatgaaccagacggatgcttccctcaaatcccccgttatccgcagggcgccctcaccggccccggctgccgcccccgtgccccagcccgccaaaaagaaagtggtggtggaagatctggacccgcccgccggaaaaccgaaaattgaaacacctacccacaccggagattccggcagctcctcttccggaaacatgtgggttccccccgcccattctccgcttccccccatgcaataa

SEQ ID NO: 120 - DNA, 420 bp, Akkermansia muciniphila
atgaaactgcattccatgattattgccggcggagccggccttttgttgttgggggcctgttccccctcttcctatcagaccacatttccggaaccggcctatgtaaaggtttccaccaataacggagcttatgctccttatccggacgatcctgtcggccagcaggaactggtgtactggtataattcccttgccgctccaatgacggtggttgcggaggttcctcccactcccattgtcacgacaggttcggggccggttgttcttgattccagcgatttctccgcgaaattgtaccgcgacagaacggaaatcaaaaagaaggataaggacggcaattgggttaccagcgtgcgccccaccacccccgcagaccagcgcatgaggaattacgtgatggcttccaaaaaagcccgttag

SEQ ID NO: 121 - DNA, 363 bp, Akkermansia muciniphila
cgtattgatatggaaatcataaaaaataataaaatcatcgttcgcaaggaagacgcatcgaagaaagtgttcaagggcgtttcactggattcgctcgctgtcggagagaaatcaatggtagcaaagatgaactatgtgaaaggcaacttcgcctccacccaccaacatccgcatgaacaatgcgggtacgtcatttcaggcgaataccgcctgaacatggaaatgccggaggagaatattgaagtgctgcttcatgcaggggacagctacgccataccgggcaatacgcctcattcctttgaggtgatggaaagcggagaggttgtcgatgtgttcacaccgccaagggaggactatttgtaa

SEQ ID NO: 122 - DNA, 486 bp, Akkermansia muciniphila
gtttgtgatgagaataagcgcatgcagccccgtttccacatcgtcatgttccatccggaaattccgcataatacaggagctgccggacggttggcgctggcaacgggctccaggctccatttgatcaaacctttggggttcagtctggatgaaaagcatgtgcgccgtacgggtctggactattgggccaaggtggacctgcatgtctgggacagcctggaggaattgaagcaggcggcagcccccggcgcgcagttctggtacctgagcaccaaggcgccacgttcccattgggatgcggttttccacgcaggggactatctggtttttggaccggaatcccgcggattgccggaaagcatgctgagagaacacgcagataccgccctgactattccgatgcccggagaaggagcccgcagcctgaatctatccacagccgtagctgtcgtcctttatgaaggactgcgccagaccggcatttga

SEQ ID NO: 123 - DNA, 1143 bp, Akkermansia muciniphila
atgcagatagtgatgaagctttatattatagcaggcgaaaagagcggggacattcatggcgccctgctgttgaagaatctgctgcgcctgatgcccggcatggaggtcgcagggctgggcggccagggcatgcacgtgttatgtcccggcgtggaagactgggcggatgaagccgccgttatcggcgtggtggaggtgctcaaaaaatacggatggttcagaaggcgttttctctccattctggaaaggatacggcaggaccagccggactgccttgttttgattgattatccggggtttaatctgcggctggcggagaaggtccgcaagtgctgcccccgcaccaaaatcgtttattttatctccccgcaggtgtgggcatggcatcgcgggcgcattcccaagatggtgcgcatgctggatttgatgatgtgcatcttcccttttgaggctcccttgttccaggaagccggactgagaacggagtttgtggggcatcccctggtagatgaagttgcttccatccgtaaggagggcgtccgggatccgtcactggtcggtctttttcccggcagccggaaccgtgaaattgacaggcatttcccggtatttatagaggtagtgaaccgcctttcccgggaacggccggaactgtcttttgaaaccgccgcttccacggaggctctggcggaaagaatgcgcggcatggtgcggaaggccggcatgcctccggaactgttccacattgccgtgggaaaatatcatgagctgatggaccgcgccgccgtgggagttgtggcttccggcaccgccacgatggaagccgccttgcaccgtctgccgtacatgctggtgtacaaggttcccctgctgacgtactggatggcccgcatgctcatcaagatacgcttcatcggcatggtgaatatcctggcgcagaaccccgtggtgaaggagctggttcagtttgattttacaccggacaaggtgattgatgaaatagaacgcctgcttgtcccggaaaacagggatgccctgctggaggaaatgaaacaggcctccgacaagttggggcagggaggggcggcggaacatgcggcccaggccgtctgccgcctgttaaatgaatacagtaccttttaa

SEQ ID NO: 124 - DNA, 408 bp, Akkermansia muciniphila
atggtaaaaactaaaacgacgtacaagggcggcctccattgttccatggttcatgaaccttccggggccacgctttccacggatgcccccgtggacaacaacggcaagggcgagtccttttcccccacggacctggtaggagcggcgcttgccggctgcatgagcacgatcatgggcattgttgccgaacgtaaggggattaatctggaaggcatgacggtggaagtggccaaacacatgaatgcggatccccgccgtatcggcaagctggaagtcgtcattaccgttcctcttccgtccgattatccggacaggaagctgctggaacaggctgctctgagctgcccggtcaagcacagcctgcaccctgatattgaaatacccattacatggaaatgggttggctga

SEQ ID NO: 125 - DNA, 1146 bp, Akkermansia muciniphila
gtggatgtgaaacaattttctccggcagggataaaaaatgtgtctgttttttatcgttgcgctgccttaggcgttccggtagtgtgtgaccgtctttccgcgattgttttctgtggatattttcgttttgaaatgagtgatttatttgaaaaaaagctgttcctttccccggccgcgcgcagtcacggcggaaaagcgggctttgcgctgggccgcattctttccgtcatctttttcgtggtcgcgctgggaatgtttttcggcggtcttttcttctggctccagaagcgccaggcatccctggattccggagcggccgcgcggatttgcgccacgccggagatgttgtccggagaattgaaagccgctctgaaagacagggtggactatagtttctggcctccttatcacatttctccgatggaaaagcaggacctgctgcgcaactgcctggcggaggcacagaaatatctgagcgccgcggatgtggttcaaaaatcctcttttgtgtggaagtccctgcaatcgcttcctttaatggtcaggcattacgccatgtctccgcctgaggcgattgtcagcaggcctaaggggcctaaaagctttgccgtgtttgaggtggaggggcatccctgcgcccagctcctggttggttttgaaaagactcccgatatggaattctgttttttcaaggatgaacaggatggttcctggaagctggactggcagcagtttgcccgctttcagccgatgaactgggaggattttgtacggggaaaaggagaggatattgcggaattccgcgtatggatggttcgggagcgcatgtcggaaaataaggatgactatgcatttaagctgattgctcccgggatgaacggttccgaagagcgcagcattgcccgtcccatggtgtatgtccccagaaaatcggaaatgggcaagcgtttgttcatgttgtttaagattaatgaggagatggaacattccccataccgggtgttgaacgccaatgacgaggctgacatgctccgcgcgcgggttcttctttcccgcagcaaagagcccaaccgcaagggggaatattcctttacgctggtcaggctgctgggggaaggctggtacggcctttctttcccagaataa

SEQ ID NO: 126 - DNA, 1563 bp, Coraliomargarita sp.
atgccaaaaagagacgaagcggaaatgacgttcctcgaacatctcgaggaaatgcgctttgtcatactcaaagcaatcggcgtattcgtcatagctttctgcggagttttgattgggttcggctacttcaactcattgatgctgtatccgctaaacagcgcaaaagcaaaattggccgcatgggagtcattctcagaggaaaagacccctatttctgagcaaaaaatggggcccgtatatttggagatgaagtccgaagacggtaaaactacaaaaaaagacggaccttattacatcgtccccaaagacgactcttttgaaatttttaaagattttaaaagcgcccaaaaagacggctggtattccgacattaaactgcgctcaatgtcgtttgctacgcctattgtggtctatttttacgtcggattcctaggcgccttgggtttgtcgctgccagtggcattctatcttgccgcgaagtttatagcgccggggctgacaaaccaagagcttaaaatgttgcgacccggcgtaatagcggctatcatactattttgcgtaggcgcatgctttgcgttcttttttatactgccgatgggaatcgcatttatgtcgtggctttcgcagggaatgcagctggaaatgttcccagacgcgcaatcgtattacagcatggtgatttttgtcacaatcgcaatcggagtgacctttcagctgccgcttctcgaatttatcttgatttatttgggagtcttaaatgtacaatggctgaaaaagaaccggcgtatagtatttctgctaatcctgatttttgcgacagtggtgacacctcccgacgcgcttacccagatatcgcttacaattccgctatatctaatgtatgaaataacgcttttcttgggccaaagagcccgcagcaaaaagctagcaagagaagcaagagccgaaaggctagctgaactccgcgacgagcgcgagcgcagggaatatgtcgaaatgatggcgaaggagcggctcgccgaagaaaaagctgaagcagaggaatccgaaatagatccttccatagacacgtcccactattccctgcccgacgactatgaccccaacgaaatacatccgacccccgaagagtatggatacgcctcctacgacgaaatgcccgacggggaagaaagcgcttacgcattggattcctacattaattacggcaatttagccaaacccgtcccgaatttctcgccaaactgggaacttaacaaacccgacctcagtttcatggctccggactggagcctgaacgaagcgcaacctgctccgcaagaacaatccgatccgcaagaatcttccaatgcgccggctctgccgtccgacggcaatgactcaactcctttagagcaggcatcctccgaaaacacaaaaggcgaaccctcggcgggagaaaatctttcaggaacaacaggggcaaaagagctgtctgaatccaagggcgaaggcatggacgaaaacaagccggaacaacaaaaagatagcccgcaaataaaagatgaaaacacccagccttga

SEQ ID NO: 127 - DNA, 1794 bp, Coraliomargarita sp.
atggccggcgcgcgcgcgctatggcgcgccaccggagtaaaagaagaggatttcggcaagcccgttattgccgtggtaaactccttcacgcaatttgtcccggggcatgtccatctggataaagtcggaaaatatgtccgcgagcaggttgaaaaagcaggaggaatcgcgcacgaatttaacaccatagccatagacgacggaatcgcaatggggcacgagggaatgctatactccctgccctcccgcgaactaatagccgacagcgtggaatacatgtgcgccgcccactgcgtcgacgcaatgatatgcatttcaaactgcgataaaatcactcccggcatgatgatggcggcaatgcgacttaacattcccgcgatatttgtttcgggcggccctatggaagcgggcgtcggcaaactatcggacggagagagaaagctggacttaatcgacgcaatgatagccggcgcaaacccgaacgtctctgacgccgattccgaaattatggagcgcaacgcatgccccacttgcggatcttgctcaggaatgttcactgcaaactcaatgaactgccttgccgaggccataggcctggctctacccggaaacggaacagttgtggcgacgcacgcggcgcgcaaaaggctgtttgcagacgccgcaaaaagaattgtagacatggcaaaagcctattatgaaaacggagacgaatccgtactgccacgctcgatagcccgccgcgactctttcctcaacgccatgaggctggatattgcaatgggcggcagcacaaacactgttttgcaccttttggcgatagcccgcgaaggcgaagtagatttttcaatggcagatatagacgcgctttccagggtgactccctgcatatgcaaagtggcgccaagcactcaaaaagtccatattcaggatgtccaccgcgccggcggaataatggcaatcctcggcgagctagcgcgcgcagggcttctcaacacccagatgggcacggtttacggccccacaatcggcgaagccatttcaaagttcgacataacctcgcccgcatgttccgaggagacaaagaaattctaccgcgccgcccccgcaaacaaatacagcattgaagcgtggtcgcaggaaaactactacgactcaaacgacaccgaccgcaaatccggcgccatccgcaatgttgaaaacgcctttagcaaggacggcggactcgccgtcttgcggggcaatatagccgtcgacggctgcatagtaaagaccgccggagtcgacgaatccattttaaagttccgcggcacagcaaaagtgttccactctgaacaggatgcaagcctagcaatacgcggcgggaaaatagcccccggagacgttgtcgtaatcctttacgaagggccccgcggaggtcccggaatgcaggaaatgctctatccgacaagccatttaaagagcatggggcttggcaaagtctgcgcgctgctaactgacggaagattctccggcggcactagcggcctgtctataggacacgcctcacccgaggctgcagacggcggcgacatagcgctaatcgaagacggcgatatgatagacataaatattcccgagcgttcaatatccctaatgatttccgatgccgaactgtcagaacgccgcaaaaaaatgctcgcaaaaggcaaggacgcatacaagccggttcgcgacagaatcgtgccgaaatcgctgcagttctacgcgcgctcggtatcctcggccgcagacggcgcagtgagaaaactctaa

SEQ ID NO: 128 - DNA, 1599 bp, Coraliomargarita sp.
atggaaaggttttcaataatgataggattttcaaatctggacagcttaatctgtctatgtggagcgcgcaataggtttggcgcgctcggctttaccgggggagaggcaggcaacgccgcatacacggcagcagacttggcaaaagcggtcggggcagtcaaaatatccggggataaatccgcgcagataaaaatgctcatagccgacagccggcgcgtttctccgggagcggcgttttttgcagtcgcggggctgaataccgacgggaataaatatgtcgaagaagcggcgcataggggcgcaaacgttgtagtttcagaaaagcccgcgcctaaatattttccctcaacatggatccaagtttccaatatgccagaagccatgggcgccgccgccaaaagcttttacgcaaatccagacgaagccatgcaaatctacgccgtgaccggcacaaacggcaaaactagcgtatcgtggatggttcaaaaaatcttaaacgattctggaaaaaaatgcggactcataggaacaatacactacgatctcggaggacgctgccttcccgcaagcagaacgacgccggaagcattggaactacacgcgatgctcaatcaaatgcgcaactctggatgccgcgcagcggcgatggaaataagttcgcattcgatatcacaaaagcgcgccaacgggatacacatagactgcgcgtgttttcttaaccttacgcaagaccatatggactaccataaaacgatggagtcctattttcaaacaaaggcgtcgatgtttacgggcgcgcttggaaatcttcctaaaaatgtggttctaaactttgacgacccccgggggaaagacatcgccaagctgctatccccgtcccaaaagctcacaagctttgccatagacgatccgtctgcagatatacgagcggaaaatctggatatgaagccggggttttcaaccttcacgcttgtataccccgaaggcagaatagaatcggctgccgtaaaaatgcccgggcactacaacgtttcaaacgcccttgcggctttggcaatgatttacgccactggcggaaatataaaggaggcggtaaaatcgctggcctctttcaaaggcgttccaggaaggatgcaaaaagttgccagccccgcaaaattcgacgtgtttgtagattacgcgcacactgacgacgccctaaaaaacggactgtcaatgctgcgcaaagtagtaaaaggaaagcttcttgtagtattcgggtgcggaggaaaacgcgacagggcaaaacgtccgcttatgactagagtcgtccaagaatacgccgacatagcgtgggctacatcggacaatccccgcggcgaaaaccttgcgcaaatattcgccgacatgaaagcgggagtcatagacgaaacccgcatagcgttcgtggaggaccggcgccgcgccataaaccttgcaatagacgccgcaagcgacggagactgcatactcatagccgggaaaggacacgagacttttcaagaactaggtgacacaatcattccgttcgacgataagcgggtcgcggaggagcttctgagcctcaagggattattataa

SEQ ID NO: 129 - DNA, 1074 bp, Coraliomargarita sp.
atggaaaaagtgagagtattggttgtcggatgcggaaatatgggagcctcccatgcccgcgcgtacaataagcttgaggagtttgagcttgtcgggattgtcgacgcccgtcccgaggcggtggaagcttttaacaaatccgtaaacggcaattataaatacttttccgactacgcaaaagcgttggaggagttaaagcctgatgccgttgccatttgcacgtatccggctacccacgagccgttggctattcaagccatggaggccggatgccatgtctttgtagaaaagccgatttcgtctactgtcgaaggcgccaaaagggttgtggattgcgcgaaaaaactgaataagaaagttgtggtgggctacattctacggcaccatccatcgtggaagaaattcatagagatagccaagactttgggaaagccgttggttatgaggatgaatctcaaccagcagtcgagcggaaaaacgtggagcgtacacaaaaatcttttggattccctcactccaattgtcgattgcggagttcattatcttgatgtgatgtgccagatgactggttcaaaacccgtgcgcgtaagcggaatttccgcaaatatatcggacgaactccgtccggaacagcgcaactacggacaattgcaagtcgcctttgaggacggttcggtcggatggtacgaggctggttggggcccgatggtttccgtcaacgcatttttcgtaaaagacgtgtttggccccaaagggagcgtttccatccaggcaaaaaacgccggaagcgacaagaaatccgacgacatcgattcgcatactaaaacggagatgctccggctccaccattctgagttggattcggaaaatcattttgtaaaggaagacgagtggattagcaccgaggacgaaccgacccacgacgacctctgtgcccgggaacagctgtttttatacaatgccataaaagacgacgccgatttatcccagcatctttccgacgccgtcaacagcttgaaaatcgcgcttgcagccgacgagtcttcccgcactggcaaaatgatttatctgtag

SEQ ID NO: 130 - DNA, 1767 bp, Coraliomargarita sp.
atgaaaattatgaaagacaagtttaaaactgtttttgcgcgcatattcatacccgccatagcgacttcggcggtgctgatagcgtttcttgccgcggcaaactattccatgctcgacaggatatatttgagctccgtaaggaaaatgctcgtcaattcttcggggctaataagtggctcaatatctgaaaacgagccttttgagaagatttcaaaacggtgcgcggaattcgggaaaaaatccggcatacgcacaaccatagtggcctcgaacggtaaagttgtttttgattccgacgtcgacagcggctcaatgacaaatcatttagggcgcccggaaataaagcgggctttatcgggcgaaaggaatttttccgaacattattcaaatacgcttaaaactaaaatgctttatattgccgttcccgcaggaacggctgtggacggagaatatccttattgcgtgcgccaggcaatgccattacaaaacttgagcgtggcgaaaaaacttttcgggtatgaaattttaatgctgtcggcggcagccatattgctgtcggcaatactttcatattttatggctagaagaatcggcatgcctttgaaatcattatccttggcagcttctaaattcgcaaaaggcgattttgaggcgcgcgcggaaaaatgcaatattccagagatagccgaagtcgggtctgcaatggcgtccatggctgcggatttaaaggcccgcgaacattcgcttacgcggcgcaactgcgaactcgacgagatattttcgcatatgtcggacgctgtgttcatatgctccagcgaaggcaggattctaaggatgaattccgcatgcgcgcagatattttcaatttcaaaagatcctccgcttcagacggcggaggcgcttagaaattcaaagctgcttgcgttgatagagaagacatttgattctggctcggaaacatcagcggaaatagaggtagggagccagcctcaaaagactttttcggttgttggaactatgctaccgtatgaaagccgcgtccccagggctattttcgtgatgcacgatatttcctatataagttcaaacgagtctttgcgccgcgaatttgtggccggagtttcacacgaattaaaaactcccataacagcaataggaattgcagccgaaactttggaggaaaccgaaaacccgtctgacaggcgccattttattgaagttatccaaaaggaagttgaacgcgtaaacatgcttgtagacgacatgcttttgttgtcgaaattggattttgcggcaaatatgaccggtgatttcggggagttaaacgttctgtccgtaattgaggaagcttgtatatcccaccaaaacgctgcggaaaaagctggagacaaaatttccgtcgattgcgacgacggcatttatgtaaagggcgattttactctgcttcaaatcgccgtgagcaaccttatcggcaacgccataaaatacggaggcaaaggttgcaatatacatatatccggtgtaagaatcggtggcgacgtggctttgacagtcagcgatacgggcccgggaattgcatccgaacacttggggaggctttttgagcgcttttaccgcgtagacaagggccgttcccgcgcgttgggagggacaggtttgggccttgcaatagttaaacatattgcgatgctgcacggcggaaatgtttctgtgaaaagcgagctcggcaaggggtcgagttttacgataaccctaaagtctctctaa

SEQ ID NO: 131 - DNA, 2280 bp, Coraliomargarita sp.
atgcctcccgcggatgccgttgttgtatctggtttcggagattctaagaatatttcattcgaccgcagatttgcttcttttgattcctcaaccggagtattgcgggtggattcgcttaagtcggcgcacatgtttcagccaatcgtaaggtccttgaatttgaagccgaatacgaattatacgctgtcatttaattaccgcgtggaaaatccaaatatgaaagagcatttctttcacatattggtgcgcaccggcgcgaacgaagacatattgtgggaaaacgagggcgaaagcgctcagtttaagcggctcgaatacaaatttacaacgcctccaggcggaaaactttatagcgttcagattcacgcgcggggaaaatttgtaggggagctttcggattttaaactggtggaagggttcggcgagaatttgtatattgccgcgcccgaagccagaaaattctgcggggatttaggaaaaattccatccggggcagaggattttgaagtgttgccgcccgcgccgtcgtctgaaaaaatcgtcaatgccgcggattttggaatatccgaagattgcgaaaacttcgtcgcaaaaatgaatgccgcgattgccaaatgcagggaaatcggcgcgtcgaagctagttttgaacaagggaatttataaggtcgcaaacgacggagagataaatttttcggatttgaaggattttatttttgacggatccggttccacgctcgtttacagaaaaaattacggaggcaattttaatataacaaactgcaggcgcatggtttttaaaaatctcaaaatggactgggactgggaaaacgacccgattgccagccttgtggaggttgttaaaatagagcgcaacggagactcctacttcgacgcgaagtttttggactacgagaattttcccaacaaaaattcgcgcatagcaatacttaccggatacgatatgaaaaattcccacatcaatgcgccgggccttttcacccgcgtattggagctaaccaagggaaaggggataacgcgccgcgaatgggtggcgccaaatgtcttacgggttaattattcaaagaacgatttggccccgtttgagattgggcagcattttatatttgcccattattattacgacatgcacggattttttctgcgcagcaacgagcatctctcattggaaaacgttgagatactatcgtgcgccggccacgcgttcgccgttgcgggaacccaaaagtactggcagttgaaaaacgtaaaaatcggaattcccaaaggctccaaagccagatatttgtcgtgtgccggcgaccacttgcatatagcttattccgccggatactttaaaatgctgtcgtgcgatttcagcggcggcaacgacgactgcctcaacgcccacgactgcagcatctacgcccaaccggtgccgggagagaaagggaagtcgaatgttctgcgcactttaagcaaaagaaacgtatcggagttttacgccggcgacgagatagagctgcgcaatgacgattattctccgacggggtttgtgtcgaagattgtgtcggtaaaatggccctccgacggttccggaatgtgcgatattgcatttgaaaaagacatccccaaaccttccggaaacggatttgttttgttcaacagaaggtacggcacaaaaaacataattatacgcgactgcaattttcacgacacgaaagcccgagcgattttaatgcttggctccgacgtcacaattgagcgctgcagatttgcaaacctcgctggaatggcggtcaagattgagacgggatacacgttcaactcgtggtgcgaggggtacggcgccgacaacattgttctgcgcgactgcgtctttgaaaatgcctgcatgcgcagctccaaatccggcagaaactgcaaggacataattataagctcgtattgcaagaccgacccatcgcgcgaaaaggcgaagttcccgattctcacaaatattctctttgaaaacaatacgtttaaaaacgtaaaaggcctgcttgccgaaatccattccgcagacaatgtgatatttcgcggcaacgagatttatccacttgcgcaaacagacgcatcggcaggcttaaaggagatatttttgattggaaattctaaaaatataaagatagtaaataacaatattgtctcgcgaaattcttcttcggaatacgcggtttgcgcggaggataaatccacccggggcatagtgtttgcgggcaatcggattgttgagccttaa

SEQ ID NO: 132 - DNA, 1767 bp, Coraliomargarita sp.
gcggttcccccaaaaggtccgcgctttattttttttgaatttaagaaaaaaggaaagactagtaagatgaacgctcaaaaatacgaacacaggtttgaggtaaaactgcctaaccgccagtggcccaatagaaaaataacgtctgcgccaaagtggtgcagcgtcgatttgcgcgacggcaaccaggctctggctatcccgatgaatatcgacgaaaaattgaaactttaccagacgctgctaaaaataggatttaaagaaatcgaagtcggtttccccgccgcgagcgagacggaatttaaatttatacgcaaactaatagatgaaaatctagtccccgacgacgtttctttgcaggtcttgacccagagcagggagcatttgataatgcgcacgtttgacgccctgaaaggctgcaagaacgccatcgtccacctttacaacagcacttccgccttgcagcgaaaggtgacgttcaatatgacgcgccctcaaataatagacatcgcccgaaacggcgcaaagctggtgcgcggcatggccgacgaacttcttgagcacggcacaaaaatccgcatggagtattctcccgaaagcttcagcgataccgagcttgatttcgcactcgagatttgcgaggccgtgatggaaatttggaagcctacgccagacaacaagcttatcgtaaacctgcctgaaacagtccagtacaatactccgaacatttacgccgaccagatagaatggatgagcacaaacatatcccaccgcgactgcgtggaaataagcctccatacccacaacgaccgcggaacgggagtagcctctacggagttgggacttatggcgggagccgagagggttgagggaacgctattcggcaatggcgaaagaacgggtaatttggatattgtcacggttgccttaaatatgatggctgacggtgtcgattcaaagctggacttctcaaatttgccgcaaatccgtgcagtttacgaggaatgtacccgcatgtcagtccctccgcgccatccgtatgcgggagacttggtattcacggcgtttagcggttcacaccaggacgccatcaaaaaaggcatggatattcgccgcaaggagcatttagacaagtgggaggttccatacctattgatagaccctacggacatcggatgttcctacgaagccattatccgcataaattcccaaagcgggaaaggcggagtggcgtacattttggcaaacgattttggatttgacctgcccaaggcaatgcaccagcaggttggcgattttataaatgcttatgcggataagctgggcaaggaacttcagccttccgagatttttgacgttttttcaaaagagtttgtgaagcgcgaatcccctgtaaagcttgagtcgtacaatgtgtcttctcccggtggagtcggcgcggatgattccaatcaagtttgcatagaggcaaaattgcgcgtaaacggcgaggaaaaaacagtgtccgcccgcggcaacggccctattaacgctttggttaaagcttttgaagcaaacggaatgaaaaactttaagctggtagattatcgttcccacgcaataggcaggggctcggcgacaaattctgccgcttacatatgtttggaatctctggagagcggttctaaaacttggggcgtaggggtagattcaaacattgaatctgccggtctcaaagggctgatttgcgcatataatagaatgcggcagccgacatcctgcctctcttaa

SEQ ID NO: 133 - DNA, 1212 bp, Coraliomargarita sp.
atggaggctaaagggattttgtcagtcggggattcgaatgtttcggatatgccgcggcgcatgcgcacaaaagtgcttatggtcgacgaccagcccattatcggggaggccataaggcatatgctcgcggcggaggaggatgttgatttcttcttttgcgaaaaacctactgaagctttgtcgatggcggcaaaggtgaatccaacagtgattcttcaagatttagtgatgccggatgttgacgggcttactctggtcaagtttttcagggcaaatcccgccacgcgcgatgttccgctcatagtattgtcctcaaaagaggaacccgacataaaatataaggcgtttgagcttggcgccaacgattatatggtgaaatttcccgacaagcttgaggtcatagcgcgcttgcgctaccactccaaggcatatataaatttatgcgagcgcaacgaggcaatggctaggctgcaaaaaagccaggcggccctaaaaaacgaattggatgaggctgcgcgctatgtgatgggactattgcccgggcgcatggatactccagcgctttcaacagactggatttttaaaagctctaccgagcttggcggagattgcttcggatacgaatggctggacgaaaaaaacttcgcaatatatcttttggatgtttgcgggcacggagtcggggcggcgctgctttcggtttctgtgatgaatgtgcttcgctccaaaagcttggctggtgtcgattttaaaaaccccgacgaagtcctttccgggctaaacagcgccttcgacatggacaagcaaaacggaatgtacttcacattttggtacggagtgttcaactcccaaacgcgtgttctagaatacgcctctggcggtcatcctcccgccattctaatagactcatccggattaaaaaaactaaagaccggcgggatggtcataggaggatttcaaaatgcgactttcaagaaagctaaaatagatgtgcaaaaaggcgcaaagttttttgtttttagcgacggagtttacgaagtggagtacgccgatggtaagggtatgatgagctttgacgactttgccgaggaacttaagtctgattccggttgtcaacgtaaagtggagcagatgatgcgtttttcgcaatctgcacagaacagggagcttttcgacgacgatttctccctttgcgaagtaattttcagataa

SEQ ID NO: 134 - DNA, 2382 bp, Coraliomargarita sp.
ttggactgggcggatgaatttaacggaagcggacttccagacgaaaataaatgggactatgaagtaggatatgtccgcaacaacgaagtccaaaaatacgtcgcaaaaaataccgccaacacaagaatggaagacggatgcctcattatagaggcgtcgaagaatgcctccggcgaggtttcaagcgctagcataataacgttgggcaagcgccattttttccacggcagaatagaagtaagggcaaaagtccctaccggcaaaggcacatggcccgcaatttggtgcctcggaattaaccgcgaacaagtcagctggccgcgctgcggagaaatcgacataatggagtatgtcggctacgaccctcaaaaattccaccacaatgtccacactttggggtccaaacaaaccgacgtcggagcaatgaatactggaacaagcataaacgtatccgacgcctatacgcaatttcacgtgtttgcccttgagcgtacagccgataccatgaaattttttatagacgggaaactaacctacacctacaaaaaagacgccgcccatcccgactattggcacggcatggaccagccccactatctgcttataaatctagccataggcggcagctggggcggccaacagggagttgacgattcgatattcccggctaaatattatatcgactatgttcggtattatgtcgcagccgattccccgcgcaaatacgtttcgccctacggcagcgacctcaatgacggcaattcatgggaaaccgcctacgccagcttgggcaaagcaatatcccactgcgactgttccaatggaggggaagtctgggttgcatccggcacataccgggaattaaccgcaatcaatatgcgcaacaatcttacaatcagaggaggcttcgcggggtttgaaacttccgcagaccagcgtgaattcgccgctccaaccatattgtccggatcaaacgccagacgcatatttttcaactccgggcttgactccagcgcagttgtagaatccgtgacattttcagagggttttgccgatatgggaggagccgtttacaacgacaacctaacttccgcaaaatttataaactgcaattttaagaacaactctgcagccacaaacggcggagcggttttcaacaacaactcgtctgcatatttcgagagatgcatttttgaaaaaaacagcgcaacctcaaacggcggcggagccgtatacaacaactattttagcgccgcgaaatacgagtcctgcgagtttaggagcaatactggatacaagggggccggcgtttacaattcgcacgaggcagattctaattttaataactgcatattcgcaaataactcgactgcaggcgaagtgggaggaggatttttctcaaccggcggatcagcgaacaagatagagaactctttatttgagtcgaattttgggattcgcgggggagcggcttatatttcatattccgaagccgaatttgtaaactgcactttcactaaaaaccgcgccgacggaattgcggcaatttccgcaaacggcgcaaaagtgcgcgctataaactgtaccttcgccggaaatacagccgaatggggtgggtgcctaaacgcccaaagctcgtcagaggcaaaaatagcaaactcaatattttgggacaataccgggacatacgccacgcaaataaactcggacgaaacgtccggctgccttgcagccaacagtgttgtccagggaggataccagggggaaaacatatccgcaaacaatccgaaactaatgcgcctctccgacaacggaggaattgtccccacaatggcgctcccgtcggacagcccagcaataggagtcggaacaacggaaaccattttcggggattgcatcccgcccaatagcgacgcgcgcgacaaaccaagaaattccccatgttcggcgggggcattcgaataccaattccccgtgagctacgatatttgggctgaagaaaacctgcgagggaaagactcgtctccggcgtccatactctgctgcgacgcaatatcaaacctgcaaagatacgcccaagccgtgtccgtttctgggatagatgcgtcgctggctccgctttcatcgccgcacgccgctccgattgagctatgttccgccgtctcaggcgcccccacgcttaaatttagaaggaataaatatatggattcctccgtagaaataaccccattttacagcactgacatgataaactggattccgcttgaaagcgaggtttgcgacgattctctccccgacgcctacatactccagacagttcccgcaaatacttcaggagagaaaatcttctttagactaaatatagaaaaaacgcttgactga

SEQ ID NO: 135 - DNA, 1044 bp, Coraliomargarita sp.
atggcggatatcgatgaaaaaacatcgcgcttcgaatgcggatcagaaggctcactaaacgaagattccggcggctgcggagcgcgcggagactgccatggcgaaagttcctgcggggagtccagcggatcgggagtttgtgaaaattcctgcgcaaatgagagcgaagaatctagcttggctgttgttgccgaaggcggctgcggcgcgtgcgagaatggttgccaacacaagccggaatgtttcggcgaaaagcgcggcagcggagtgcagggatttttgcgctggggatgcggctgctttgtggtatccttgtttatggtgctggtgtttctcttgtttgccggaaatgttgttgtcagcgtgtcaaaagacgccgtatcggctgttggagatttgggttcttgcgcttttgattctgcaaaaggcgtggctgctaccgttgcggaacgcctaagggcggatcccaaaacaacagtgtatgtcgaccttaaactcgtaggcgccgagggtgtggacaagctcgtgtgcgccgaggttcgcagggatgtcggcaaggttgtaaagtttgaagactttaagtttttttctgccctgcttaagatacgcgcggctgcggtattcgaatattatgtgcctcttgaaaaaatgcgcataggtttgtccataaatcccggcggtaaattggatgtttgtgtttttttccccgctccccgccttagcgttcccgtaaaatttaacataaacgagtacgaggtaaacaagagttttattccaaagttaaatgcggccgcaaacgaatatatgcgcgtcgatttcccgcgcatacttgaggagtacgggaatcaggaggatgttgtttcccatgcccgcgaaatcgcccgcaaaaggctggaacagaccgtgcgcggggcaattttgcctcttataggcatatccggaaattcgggagagcgcgtaagaatagtttttgattccgcggagcttgaaaaacccgcgcagattacgcacgaagtaaacgtcaaagcgggcagcgaagactag

SEQ ID NO: 136 - DNA, 2496 bp, Coraliomargarita sp.
atgcaacaattcacaccaagagcacaacaagtattggcgcttgcccggaaggaggcaatacgctttaagcacaattatataggcacggaacacattctgcttggcataataaaactggggcagggtgttgcggtgaacgtattgcgcaaaatgggaatcaatcttgaaaatgtcacccgtgaagtagaaaaacaagtcggttccgggtttgactccggcgatgtttcggatttgcagcatacgcagagagtaaaaaaagtattggcttttgccgcctatgaggccacccagctttcccataactatatcggaacggagcatatattgttgggattgctgcgcgaaggagagggcgtggcggctaccgttctcagggagctgggagtggatatcgcgacctgccgcgcgcagatactggctgaactggatccaaattttgttggagatactcccgaaacagaaatacgcgaacaagagtttggtcagcaggagcgccccgacggcgccggacagaagaagactgccttggaggcgttcggaagggatcttacggcactcgccaaggaaggcaaactggatccggtgatcgggcgagccaacgaaattatgcgcgctgttcaaattttgtgccgcagaacgaaaaacaatcctgttttagtgggagaagcaggcgttggaaagaccgctattgtcgagggcttggcgcaggaaattgcaagcggggaagttccggaacttttggcgggaaagcgcgtcattgctttggacatggctttaatggttgccggcaccaaatatcgcgggcagtttgaagagcgcataaaagccgtaatggatgaaatagaaaaatccagggatgtaatactttttatagacgagctccatacaattgtcggcgcgggagccgccgaaggcgctatggatgcttcgaacatatttaagccggctttgtccaggggaacgcttcagtgcatcggagctaccactatggcagagtaccgcaagtttatcgaaaaagacagcgctcttgacaggcgttttcaaagcatcaaggtcgaagagccttcgagcgacgacgctgtaaaaatcctaatgggattgcgcgcaaattacgaaaagcaccaccattgcatatactccgaggaagcgcttgtttctgcggtaaagctttctgaaagatacataacaagcagatttcttccagacaaggctatagatgtaatagacgaggcaggcgctagggcgcgcataaaaatgatggagcgcccccaagaagtattggcaatatcttcaaaaatagaagagcttgcgcgcaagaaagaggacgccattcgcgagcagcgttttgaagaggccgcgacattgcgcgacgccgaaaaatcattgattgcgcaaaaagaagatgttgtaaaagcatggaaaaaatccttggagtctaagcgcgcaaacgtatcggaggacgatatttacgcggttgtgtcttcttggacaggaataccgctttccagaatggagcgcgaggaaagccaaaaattgctgtccttggaaagttatctgcgcgagcgcgtggtcggacaagacgaggccacttcggcaatagcgcgcgctcttaggcgttctcgtgcggctttgaaggatccaaagcgcccgataggttcgtttatgttccttgggccgacgggagtcgggaaaacttatcttgcaaaaatattggcggagcaaatgttcgggaagcaggagtcgctgatccagatagacatgtcggagtatatggaaaaattttccgtatcgcggctaataggctctcctccgggatatgtggggcatgaagacggcggacagcttaccgagcaagttcgcagaaagccgtatagcgttattttgttcgacgaaatagaaaaggcccacccggacgttgcccaactgcttctgcaggtcttggaggacggaaggcttaccgacagtttgggaagaacggtggatttccgcaatactatcataattatgactagcaatgtcggcgcgcacattctacaaaaaagcccgtcgatgggatttgacgcgggttcaaacgtcgaaaatgactacgagaaaaataaggaaaaggtaatggacgaaatgaaaaaatcattccgtccagaatttctcaaccgcataaatgatataatcctatttagaatgctttcgaaggatgatatgggcaaaattgtgcagctggaattgaaccagcttcgcaagaggcttgccgagaaaggaatgtcgatagacgtggacgaatcggccatgaatttcttaatttcaaaaggctgggacgaaaaatatggagcaaggccgctaaagcgcgcgatagaacgcgagcttgaagacagtctcgccgaagaaatactgaagggaaatatttgcgagggaagcggcgaaataaaaataacaacttcgcaggacggcaaaaagcttgagttctctcaatctaagcgtaaacattgcaaaaagctttaa

SEQ ID NO: 137 - DNA, 2040 bp, Coraliomargarita sp.
atggaagaaaaagtgtctgaacataagtggaacttttttaaggccggaggattttatcaagtcgatatatccgacgcgtcggacatagagaacattggctccctggaccagaagctatgggcggctcttagctgtcccaccgacgggctcgtatttgattccaagacgcttgatctcatagattccgacaatgatttaagcatacgccacaacgaagtcgtagcggctgtcgaatgggtatgccgttttctgaaagacaagtccaagctattagagtcgtccccttcgcttgagctttcgaatatagacgattcatcgcccgagggcgctgccttgttggcgagcgccaagcaaatattggcggatttgggcaaacccgatgccggagaaataaccgttgaggacttttccgatccgttaaaaatatttgccggaacggctttcaacgcagacgggataataacaaaaatttcctgcggaggcgacaaggaacttgaaaatgtgctttctgacataattttggtggagggtggcaaacctgaccgctcgggcgaaattggtgtggacgaatccgccataaagaaattttattccgacgcaatggaatatggggcatggctggatgcccctaatgccgacagcgcaatattgcctttgggctccgatacctgcgcggcaaattccgccttggaaaaagtagccgataaaatagacgatttttttgtgcgcgcggaaattatggctttcgactccactgccgactccctggtgaatccttccgcctcaagcctttccgacgcattgtccgtaggattgtctttccagtcgccagttttgcgcgaacttcccatttcccgcatatgccccgattgcagcctaaatcttctttcaggaataaacccggcatggaaagacgccgccgaagcgtttgctaaattagttgcgtcgcccgcgctcggttccgatttcaacggggagctgacttcgtcgcaatggcgcaagataaaaagcatgtttgttccatattcaagctggttcgcgtcaaagccatccggcgcaataacgtcgatttcggcggagcgtgtgcgcgcgattctttccgaaaaccggttggatgatttgttgaaacttgtcgagcgcgacaagtctttgcagccgaaaatcgacaacatcaacaatgtcgagaagctggtgttgtttaatgcaaacatcttcaagctgctaaaaaattttgtaagtttttcagacttttacaaagagaaggtccccgccatattccagttcggctctctatatatagaccagcggacgtgcgacttgtgcataaaggttgaaaataccgccgcgcacgcgcagatggctgctctatgctatgggtatttgctttattgcgtatgcaagaggcgcggcgaagacgatattaatatagttgccgttgtcactgccggcgacagcgacaatctgattgtcggcaagcacggcatattctacgacacgcgcggcagggactgggacgccatggtcgtaaaaatagttgcgaattcaattgaagtgcaccaggcgttcttttccccttataagcgtcttgtaaaatgggttagcgagcaaattgccaagcgcgcaagcgcagaagacaacgaaaatatgaagaagcttgcggcgattccattggcggcaggatcaccgcctcaggcggccgaatccgacaagaaaaagaagctcgacgttgggactgtcgccgctttgggcgtagccgtaggaggcgtcacaaccgcttttgggatgtttttggagtttgtgttcggcatgggaatatggctgcccttgggcgtcgtaggtattgtgctttccatatctctgccgtcggttttaatagccgcgataaagcttcgcgcccgcaatttggcaccaattttggatgcaaacggttgggctgttaacggaaaggctaaagttggaatcgcattcgggcatgggcttacaaagcttgccagattgccgcgcgggtcgaaaatcaatacaatagtttctaaaaaataa

SEQ ID NO: 138 - DNA, 1209 bp, Coraliomargarita sp.
atgaagaaaacaattgtatgcgcggcaatgtccgcaatattttttgctgccaatatattggcggcaaaatccaacgccgaaaaactctcaaacgacgcttctttgcaattcgggttctgccgcccaaaccttatgtgggttaacgacaaaaaaaagtgcgaagaaattctcgacggaataaaagcctccggagccaaatgcgtgcaacttaccctgcgcgagaattccgccccgacgctccagcacatcgaatatgcgaactcaataggattgccggtaaatatgctcataatgccgatgcaagactttatgctcgacggggccaacccccgcccaaaatctaaaaacttctggagcgtttacggagtttcccaagtagatttgaagaagtttgaaaagaagctggacgaattgtttaaggacattgcccaacgccgcctgaatattctttctatagagctattcaacgaaattaattgggtggatttcaacggagatttgcaaaccgtagaaggcggggcgattataaacgaaaacaattacaaagactttccgttcatggaaaaatatatagaaggaatggaaaaatacacgcagttggtttcgattctgcgcagaaaaatcgacagcgcatataccggaggaaaaaacaatttgcccaagccattgctcgtatgcggatctccagtccttggcggagactcaaattggcttaataaagtaggaggttctgtaatagacttaagtttccactacaaaattcttgccggcaaatttgacggcgcgcccaaagccgaaaacgtattcgacaaaactgacgcagtagccgcgcacatctatcccggaatagaaagcatagacaacaatcctcaaacatgcgcagccacagccgaaaaaaccgtgagggcctacatcgacccggtttacgaatttgccccgcgcgacatactaatatttataactgaattttcattctcaagttggctcttccgcaacgaacccgacccgcaggctgcccgagcccaaactacaaaaaattttcttatgcaattttcaaagacgtctctcaaagacgtaaactggggatgcatatttcattactgctatgacgacgacgacaattggggagcaatagcaaaagacggaacaatcaggcgccccatgctcgacatatttaaggagacatatccgcgggaaccgataaaataa

SEQ ID NO: 139 - DNA, 1347 bp, Coraliomargarita sp.
tttttgaaaggacgttatattatgcggcagatgtctttttccgacggggcgcaatcgcaacctctggcagcaaggcttcgcccgcgcgacttgtcggagttcgtggggcagacgcacttgcttggcaagggcaaagttctatacaatattatagagggcgataagatttcgtcgatggtcttttgggggcctcccggtgtcggcaagactacgctcgccagaatcatagcaaacaagacgcgttcggaatttgtcgatttttcggcggtgacaagcggaataaaggaaatacgctccgttatgcaaagcgccgagcaaaatggaagcttcggaggcaggacgatactttttgtggacgaaatccaccggtttaacaaggcgcagcaggatgcgtttttgccgtttgttgagaaaggcagcattatattgataggcgcgacaaccgaaaatccgtcgtttgaaataaacggcgcgcttctttcgcgctgcaaggtgtttgttttgaatgcactgaaagaagatgaattggtgcggcttctttctcgcgcgctgaccgacgaacgcggattcggcggaatgaaaatttcaatgccggacaaaatgttggaggctatagcagtctttgcaaacggcgatgcccgggctgctctctccacgcttgaaatgttggttttaaatggaatttcgcgcggtggcgggcgcgtggaaattactccggaaatattggagcagtgcacgtcaaaaaagtcgctcttgtacgacaaggacggtgaggagcattacaacctgatatcggctctccataaatccatgcgcaattccgaccccgacgcggcggtatattggcttgccaggatgcttgaggcgggcgaagatccgctctatgtcgcgcgcaggattgtccgatttgcttcggaggatgtagggcttgcggattcaaaggcgctgggggttgctgtcgacgcctaccaggcatgccatttcttgggcatgcccgagtgttccgtccatttgacccacgccgtggtttacatgtcgatggcgccgaagtcgaatgccttgtatttggcgtacgagagcgccaagagcgacgcgctaaaacagcttgccgaacccgttccgctcgtaatacgcaacgccccgacgcggctgatgaaggagcttggatacggcgaaggctataaatacgcccataatatgaaagacaagcttgccgatatgcagtgcctgccagattctcttgaaggcagacaatattaccgccccaccgaggaggggctggagaaaaaatataaagccagattgggggaaatcaaggagtggaaaagtcaaatgaagggcaaatga

SEQ ID NO: 140 - DNA, 954 bp, Coraliomargarita sp.
atgaaaatcgacaatctaaaaatatttacgggcaggtcccaccccgccctgactgaagcaatttgcaaacagctttctttgcccgtgggcaatgtgctggttgaatcgtttcccgatagcgaaacattcgtgaaaattctagaccatattcgcggcgacgatgtttttataatccaacccacaagccgcccgtccaatgaaagcgtaatggaactgctaattatgatagacgcagcgcgcagggcttcggctaaacgcataacagcagttcttccgttcttcggatatgcccgccaagaccgaaaagaccaaccgcgagttccaataactgcaaaacttatagccaacctgctcgttgcctccggcgcaaacagagtcttgacgctagacctccacgcgacgcaaatccaaggatttttcgatattccttgcgaccatctttacgcatctccagtcatttacgactatttaaaagataaaaatttagacaaccttaccgtattctccccggacgtcggcgggctcaagcgagcgcagacatacgcaacccttttggactgtccgcttggatttattgcaaaacgccgcataagcgcggaagttgtcgaagccacaagtctggtcggagaagtcgaagaccgcgacatattgatagtcgacgacatgactgaaaccgccggaactctcaccgccgccgcaaagattttaaaatccaaaggagcgcgcagtgttagggcagccgtcactcacgctgttttaaccgactccgcatgggggaagctgcaggagaaatggctggacgaactcattgtgacagactccactccgcctgatccccgctataaggattatcccataacggtattatccgtggccccactccttaccgaagcgattttgcgcatacacaataatatgtctgtgacttcgctctttaaggtgaagggattttaa

SEQ ID NO: 141 - DNA, 1275 bp, Coraliomargarita sp.
atgacttcaaaagaactttttgagaaatgcaaagaattgatacctggcggagtaaattctcccgtccgggcgtttagaagcgtaggtggcgagcctttctttactcgttccgctcacggggcgcatctgcaaacttgcgacggaaaggatttgatagattttgtctgcacatgggggccggctttatttggacacgaccacccggttatacgcaatgctatcgcgcgcgccctcgaaaacggaacgtcttttggaacgccttcggaaagcgagcttaaaatggcgcagctaatcaatagaatgattccgtgcgcgcagatggttcgtatgacaaactctggaactgaagctacaatgtcggctatccgccttgcccgcggatataccgggcgcgacaaaatagtgaagttttcgggatgctaccacggacatgtcgatagcctgctcgtaaaagctggaagcggcgcactgacctttggcaatcccgattctgcaggtattcccaaagcgctggctgagttgacgatggttcttccttttaacgatacggcagccgtggatgaatgttttgaaaaatacggcgatgaaattgcgtgcgtgattctggaaccatacccggcaaatgtcggactcatagttccgaacgtcggttttctgcggcatttaagggatatatgcacccgttttggttcattgcttattttcgacgaagtaataaccggatttcgcgtagccgcaggaggcgcccaggctagagagcgggttatgcctgatctttgcgctcttggtaaaattatcggcggcgggcttcctgtaggagctttttgcggtcgcaaggaaataatggaatatattgcccctttggggcccgtgtatcaggcgggaactttaagcggcaatcctcttgctatggctgcgggagtagctgccttggagcatattttgcaaactaatccgtatgcggaattggaacgcaaaagctcttttattgtaaaagccgtttcagaggctgcaaaagagaagggtgtgcctttgcaaaccccgcaggcggcatctctgttctctttcttttttaacgaaaacaaagtggaaaattattccatagcgttaaaatcgtctacgcagttgtacggaaaattctttaaggaatgccttgcatgcggagtatatttggcgccctctgcattcgaaatatgttttatgagtacttctcatacagacggcgatttgcagaaagcagcagaagttatgtgccgagcaatttctaacctttaa

SEQ ID NO: 142 - DNA, 1767 bp, Coraliomargarita sp.
gtggatttcttgctgctcgtggaagcgcttttgcctctctttatatataatatagtttttatggcagaaaaaaataaaattgtcggcggaagtaagcctaattactcctacgctcttgccggattggccaagagagtccagaatcccaacgggacttggtcgtttaagatattgtgggggcgtgtttttatagcttttatattattcatggctcttttgtggggcgcaatttccagcgcgatttattgcatatttaagtatggaagagactatgatgaaatgactttctaccaggctttgattgcgcctttagacatgcaggcccaccgcgagcggataggtgaatataacgccagaaaagctaaagaatacataaaagagcgcaaatatagggaggcgtatatgagccttgccaatgcggtcgggcgctcgcctaaaaatatagaggcgcggcaaatgcttgccgagtttaatttgtcttttggtcgtccggatatagcattggaaatcatggaggttgggcttatatacgctacggaaaatacgaaatatattcgcttgtatatgcgccttttaatagaccagaacgaagacaaacgcttggttttggtcgccgaacgccttctttcaaagggcaatataaaaaatccggaagttgtcgcgtatttggcgatgtcgctgtcttctatttatgcgcttcatggcaattacgacaaatcaaaggagtaccttgtaaaatacaagcttgataagactctgcctggaatcttgcggctgtctaaaaacgaatgggaacagggcaaccgcgatgctgccataaaggttattgccgacaattttgattatgcgcataacaaggagccgttgtattccttgctagtgaattattataccgtgatgaaagatttggacaaggcccggcagtattcaatgctcaggtctatcgaaaatcctttttcgcttgaacagcgcatggaatatttgaacctcctaaaaaagtcaggggatgtagaaaatctgaaagcagatttggataaattgttcaatcaatataagaacaacaacaaggggatgttgtaccttgcaaattacgccgcagacaatggtgatgttgaattgatgcgcaagatttacgacactgcaattacaaacaatttttccatagctccgtattgccttctatcccttgaaacaatgctgacaaacggtgaatataaggctgcgagcgattttgccgaggagattctcaaagataaacccatgtggataaagcgttatgaggacgtattaagctgcttgcgcgccatagcttattatggaataggcaataacaatatggccgatattctattgcgcgatgtagtaaagcgcggaacttgttcccccaaagttttggtggcgacagctagaagattggataatttgggcgggactctcatggcgcatcggttgttggaaaatacggttgatagatatccgcgccaccagctggctttggcgaggctggttcagatggagataaaaataggcaattcgacaaatcttgaaaagcatgttttgaagttgctgcaaatgcgcaggccgtcgcgcgagcttatagaagacgcccggagaaagcttgcaagcgatagatttatatttacaagggacaggggcaggattctcgccgagatagacgggcttataaagaacaatacgagttttgatcttggcggcgaatccgagtccgacagaataaccgattctgacgagcctttggatttttaa

SEQ ID NO: 143 - DNA, 1020 bp, Coraliomargarita sp.
atggtgatttttcggcaaaataaaaagatgacatcttttacagcgcccatttttacttgcttgaaaatttgcggatattattttagcttgcgttgtatggcgacgaaatatgtatgggataaaaagaccgacgaagagctgcagctctggccgtcttctagcaccgagcgctatatgacacgcccttttctcccgaccggggacatcaactcgcgcaatagaaaaaccatagtcacgtccccgcaaaatttgcctgtggattcgctcgccaggcgcggaatttctgctgcggctttgacatcccataagagcggatactatcaatccagaagcggggcgccgtttcacctggtaatctatacgcttgtgggaagcgcaacgctgaaattggaaagaaaaaaaatcaagatatccaaaggcagcttttttgccgccccagcaggcagcccatacgagttctcttcggacgaatcggggtggcgcgtattttggttccatctgactccgtcgcgtttgatagacagggcgctgggagagagcgcatttgttcgcgtctcagcgagttttgactctgtagtttccgcgtccgaaaaatatttgggcgaggtttatcgcacgcgcccaaggctgaatattctggagtttttggcggataaaatattatgtctggtaaaaaaagacattttttctgggactcggctgggttgcgctccgatagataaaataatatctgaggtagaatcggatccgctaaaacattggagtgccggagaactgtcgaaacgcttgggagtttcatgcgcgaagtttaatagaatgtgcgaggaaaattattccgaaacgtttgccaagattgttcttcgcctgcgcatgagggcggctttggatatgatggccaacggttcgcgtttttctgaaatcgcggaaaaaataggatacgcagacgcatatactttttcaaaggcgtttaaatcctattacggcagcccccccaagtccataagggcgtctctgctttaa

SEQ ID NO: 144 - DNA, 798 bp, Coraliomargarita sp.
tattgtggcaaagtgaaacctataatttccatattggcggcgtttttttccgccgcgctcctaaacgcgcagacctccggagaatccacggacaagcttgcgcagggatatgtttacatccatacgctcagaaacgagccgtccatcgaaagaaatggagccgaattaagattgaagcggcgcgacatagtccccgcaaacggattgacaatcgaaacggttaaaggccaatgcgcaatgcttgtcctatcaaatcgaacggtcatttttgtgaaaggaaacgccaagcttaccattgaaaactttgagcaggcaaccccctttgattttcaacttgacgacgaatacgaatctacccactcccaattgagaataagcctcgattacggagaaatatatatggcgatgctttcgccgcgcccgactagccgcacgataataaaaacgacattcggcgcagtagaacccaaaactaccgccatgtacatttcctgcgacaaaaagaactcaaagttcgcaatattcaacgggcaggcggtgttctgcggacttgacaacaagcgcgactttatacagcagggacaaatcggtatagtggaagagctggaaagcaaaaaaatgtatcccttgaaaatagagccgatgagctcgctccaagaggacaggcatgaaaaagtcctagaactctgcaaactggcaatgcaatcgactgaaattaagctctcccgcgaagggaatttctcggctagaagactggttcctaaggacttctttttgcgcaaacacaatatgaactga

SEQ ID NO: 145 - DNA, 1101 bp, Coraliomargarita sp.
atgctttccgaacttggagattttgagaattggtgcggacctttgcgcctctttagatatttgtcgtttagatgcgcaatcgccatggcagtggctttttttatcgggggactttgcgccccgcgcgccatagaaattttgcataagataaagttcgggcaaagccttagaacaaaggaagaagtagggaaacttgccgagctccacagcggcaaaaagggaacgccgactatgggaggaataataatctacgcctccgttatggtatcctcgctactcttggcaaagataaacgcgctcgttttcacagccctgtttgtttacaccgccctgactttattgggattcgcagacgactatctaaaaatagtaaagaaaaacagcaaaggcgtatcaggcaaaacaaagcttgcgattcaggctttgacaacgcttgtggctcttgccgtattgctgttttcaaaagactacggatatattatgcgggaattgtggataccgtttatgaagtatccgctaattgaatgcatgccggtttggtttgcggcgctgtttttatttttcgtgattgctggatccagcaacgcaataaacttgactgacggagtggacgggctggcaataggatgcactgtttcagtcactctggcttacgcgattttcagctatgttgccgggaacacaatcgcaaccgaatatctattcattagatacattccgggagccggagagctgacggtagtgtgctgcgcactattaggggcgtccctcgcattcctttggtacaactcatatccggcggaagtctttatgggtgacaccggatccctggcgctaggaggactaattggaatcattgcctttatgactttgcagccaacgacactcgtaattgtcggaggagtattcgtaatggaggcgatgtctgtaattttacagggtgcatcctacaagtccacaaaacggaggatattcctgatgtcccctatccaccatcattttgaactaaaaggctggccggaaacaaaagtagtcgtacgcttttggattatatcgcttatattcgcccttgcaggcttggcgacgttgaaaataagatag

SEQ ID NO: 146 - DNA, 1125 bp, Coraliomargarita sp.
atgcggaaatcccaaaaaaattccttttttggagcgtggatagcggtagtgcttcccgtattgtttctaagcgcgctgggattgcttatattaatgagcgccggcgcgaatagagctgatccgtatgccattgtccgcaagcaaacaatatggctcggagtggcatttattgccggaatttgcgccacgtttgtggatttaaaacttctaaaacgcatttccatacccttggcaatcgcaactattgtgcttttattgctggttcttatcccgcaaattgggaaagaagtcaacggatcgcgcagatggcttgaaatagggccaatagtcgcacagccaagcgacatcgcaaagttctccctcatcattcttttgtcctcgtatttgcacgacaaccagcggaaaattaaagacgttgcaagggggttgtttgcgccgctggcaattgtgggatgcttctgcgtgcctattatattggagccagactatggtacaacggctctctgcggaggagttggactggttcttatttttctggcgggcgcaaatatcaaatggctattttcaatgttcattgctttagcctcggtcttttgcgcaatggtgtattttaaccccgtgcgccttcagcgcgtgctgagctttttgaacgtagaagaaacgaaatcagacgggtcttaccaactgtaccaggcaattctggcattcggcaacggaggaatttcaggggttggaataggacaagggaggcagcagctttcctttttgccggaagctcatacagattttgtctttgcgattgtcggagaagagcttggaatggtctgcacgtttctggtcgtcgccctatttttggccctatttatagcagctatttacaatattagaaaagctccaaacctttttgaattttcgttggcgacaggagcaatgttgatgattgtattgcaggctcttttcaatatgtgcgtagtgaccggacttgtccctaccaaaggaatatcgctcccatttataagttatggaggatcaaatttggtggcaatgttcgcgtttacggggctgctcgtaaactgcatccgcgcgtggagcaaaccgacaacaatcagagtatccgatttatga

SEQ ID NO: 147 - DNA, 1344 bp, Coraliomargarita sp.
ttggacaatttcttaaattcaattaaagaaaaaaatatgaaaataaatatttgctcggcgattgtttttataggctttttagggatgtcgctaacgtcgttaggagagtctcgccattctgattctcccatgtttgacggctgcaagggtaaagttgttgcgggatatcaagggtggttccggttcccgggtgacggttcaggcgccaacggctcaaactgggggcattggggaagtcgtgggcaagagttcggaacgtctcattgcaccattgatatatggccctacacaaaagaatatcccaaggtatatgcgacaaattttaaaaatccagacggttctgcggcatgcgtgttcagttcttacgacgaaagcactgttgatgtccactttaaatggatgaaagaatacggaatcgacgctgcgtttcttcagcgtttctattcctacacaaaaaatgcagttgcgcgtccgcataccgtaaaaattttagagcattgcctaaaagccgctaaaaagcacggagtgggaattatattgatgtacgatgtttccggaatgccaaagggcgaggtcgcggacggtttgattgccgacttcaaaatgatattggattctttaaatcttaccggcggcaagaatactccctatcttttccacaatgggaagccattggtttgcatatggggaataggatttaacgacaggcattattctcccgcggatacagacatattgaagtttttcgactttctaaaaaacgacaagacttacggcggatgttcagttatggtaggcgttcccacttactggcgcacgctagacagggattgcgttaagaatccggactttcacaaatttataaaagagcaggtggatgttctttctccgtggacagttgggcgccttgagatgcttgacgacggaaggattttgcggggcggaatggactatgtaaaggaggtaaaagctgataaagagtggtgcgactccaataaaataacttatatgcctgttgtttatcctggtttttcttggtataacaaaatgcacgaacatataaaaggaactaaattcaaccataccccgcgggcaaagggaagatttttctggaatgtagcctcgggggcggctgaggcgggcgctgaaaccctttatatagctatgtttgacgaggttgacgaagcaactgcgatttttaagctggagcctaatcctccacgcgcagatggagttccgatgctggacactgaaggtttgcctcccgatcactatcttttccttgcgggaaacttcaagaaactccttaaaactgggaaatcagctccgatgccgtcgcgttag

SEQ ID NO: 148 - DNA, 1056 bp, Coraliomargarita sp.
ttggttgaagctggaattatgcgcaggcaaagccacaacctatatgcggcgggaatttcgcacgactgcgcaaatgcgcaattagtcgggaaatgctcacttgccccggacgaatgcactgctatcgaggataatttgctgaagaactccgatatttctgaaatactcattttaagcacgtgtaatagatttgaattttactttgcggcagattccgcggaatcctcagaaaagattctatacgagctggctcgcattggcaaacccgccggggattttagggaaaattcatatgaattttcgaacaagggcgctttgcagcacatatttgaagtagcctccggactaaaatcccaaatggttggagaaaccgaaattctagggcaagtaaaagccgcctatgcgcgcgcatgcgcggcgggacattgcggggcaatactaaacgcagcattccaaaaagccgctcaatgcgcaaaatggattaggacaaatacggatatcggccatggcaaaataagccttggcagcgtttccgccgaactggctgcgagaatttttgaagatatatccaaagcaaaaatattgctgataggatccggtgaagccggaaaacttgttgcagacgccctgtttgtaagaggcgcgcacaatataaccgtggcaagccgcacatgggcaaactcaaacgaactggctaaaaaggtcggggcaaccgccgcatatttgcaggacgcgctttctgaaatatcaattttcgacatagtaatatgcgcgagccgctctcctagctacttaataacgctcgagtcggcgcgcgatgccatatgcgcgcgcgcaagcaatccgatgtttctcatagatttgtctgtgccgaaaaacatagacccatattgcggagatctggaaggaatttttctctacaatctcgacgacctctccaagatagccaatgaaaacatacaagcaagaatgggagaaattggcctcgcaaagactgaaataaccaggcgttcttctatggtagccgaaaggctctttacaaaagtctcgctttaa

SEQ ID NO: 149 - DNA, 1782 bp, Coraliomargarita sp.
atgagaaagaaaagcaaaagagctgaaagcatctttatttcgaggggcaggtttgcgtttgtcataacatgcctcgcgctcgttttttgcgccgtgttcgccaggctctactatttgcatgttgtccgcagcgacgccagcatacaagcagccgacaaagtcagaaacaaatttatgacaatatccgcaaggcgcggcgacatagtcgacgcccgcaaaaatcttctggcaacaagccgtccggtgataactatcggcgtggatccagtggattttacattaaaagcggattcggaaacttttgaaaagctgcaaaaagccgcggaaattcttaaagttgattttcaagaactgaagaaaaagtgccatgacaaccaagatggaagccgctggcggaaaatagccgaaaacatcgacgaaaatacatacaagaaaattcaagatctaaaaatcaaagggatttacggcaatagaaattacatacgcgtgtatcccgccggcccgctaatggcacactgcatagggtttgtaaacaaggaatttcaaggcgtaatgggaatagagcagcagttcaatttctatttgaaaggccaggacggatggattgaaacagaacgcgacggtaagcgcagggagctaacccatttccgcgccagagaagtaaagcccacagacggaatgaatgtggagctgacaatggatctggttatccaggaaattgttgagaaagaagtccgcaggctcgccggagaatacagcccaaagtctatatccataatagtcagcgaccccaacaccggatacattctggcgctcgcaaactatccgagtttcgacccaaacaaatataaccagtacgaccaggatatgctgagaaaccgcgccattagcgaccagtacgaacccggatcaacttttaaaattgtcccaatatccgcagcattaaacgaatccctcgtcggcccagacgacgttttcgactgcaacgccgcaactatgaactacaagggcaaagccctccgccttcccaaagaagcccataccatgggcaagctgagcgtccgcgaaatcacaaaaaaaagcagcaacaagggatctgcccagctcggcgggcttttaggagaaaacaagctgtacgaatacgcaaaacttttcggatacggcgaaaaaacaaacataggcctgttgggagaagcaaccgggacgctccataaggtaaaagactgggacggcctaacaataacacgcctgccgatggggcatgccgtagacgcaaccccgcttcaagtgcattgcgcaatgagcgtaatcgccaaccaaggcatatacatgcagccgcagcttatacgcagaatttacgataaaaacggggatactaaaatagaataccaatctaaagccgtgcgcagggtgataagccccaaaatttcaactttgatggcggaaatgctgtccgaagttgtcacaaacacaggcactgcgcgcagagcgcaaatagaaggatttaaaatagctgggaaaaccgggacttcccaaaaaataattaacggcaagtacagcacgcgcgaacatgtcgcgtcgttttcagggtttttcccagcacaacgcccgcgtttggtcataactgttgttgtggacacaccccgcatgaaaggggtcggatacggcggaatagtggctgcgcccgcgtttaaaaacatagccgaacagtcggcgaactatttaggcattcaaactgacgacaagttcgaaaaaactgtcgcatggaaaggttttcaataa

SEQ ID NO: 150 - DNA, 1581 bp, Coraliomargarita sp.
atgaacgccgcaagaataacgcttaaaaaaatctccgccgcccttattttagccgtatcggttatatcgccgttttgcgctgaagccaaagacgcactgtacgccggcagcatatgcctagacgccgacgcaatatctgcaaaatccggaaagccatcaaaagaaattctaaaaataaaatccgataaaatccccgcatggatattcgactccaaaggagaaaacgctgtatccggaaccttggacaaaatgccggaaggctaccgcggattaaaggtggagattgtcgcgactcctttgaatgcgcctaaaagcgcatttacagaggatgtctaccgcgcgacaatatttcaaacggagaaaaattcaacaacgccaataaacaaacttaaatgcgtccctgtgcgctcaaaagtccccgcagcgcccctgtcattaaaaactatcgaacttgaatcctgctatccggcaaaacccggacttccggtaatagtgtcaatcgaacggctaaaccgcgacccttcagataccttcgacgcagcatccgctttgctcgagataaggctgactcccgtaaaagaccgccctacccctttcgttgtggaagactcaaaaggatacaactcgtggcccatgatgcaggcgctgggaaacaaattagtatgcgtttacagcagggggcaagcacatacaataaatgaaggcgcccgcaacgcgtatgtaaaaacatctgatgacggcggaaaaacctggtcaaaagaaaccgtactttccgactctcccgattacggcgaagttccaatcgggaaaggcctggacgaaaactccgagatgctcgtatggattaggtttgtgggaaaagaccgcatgcacaaactttacaggacaaaagacggggtgaatttcacgcacatatcaaccccggtactagaccccatgccgatgcaaatcacagatgtattccatgtgcctacggtaggcctaatggctatatggtttacaggcaactacggcaaagacgctctcaacgcatggggtacgcttgtcagcaaagacaatggcaaaacgtggacgcaaacaacagtggaatccggcttgaaaaatatcgactggaatacggaacaatccgccgtatacctagggaacgggaaaatactggcaatagcgcgcgtagagcacagctcggattccacaaatagagcccaattccagcttgaatcctccgattacggcaaaacttggacacgccaaagaacaaatataggagatatttacatatctaccccaagcttgatatacgacaagcaaacggggcttgtaagcaactactactaccaacgcgcgcgcggaatgcttaaacgcagagttgtagctgccgataaaatattcggcaaccctctatcgtggccttcaccggaaatagtggctttcgccagcgcagtcggatacgacgcaggcaacgtaaacgcgacttttataggaggaacgcattatctcgcgtactattcaggggacagcaaaaacgcatcaatcctcgtatccgccgcaaaagccccggattctgaagacaagggaaagtag

SEQ ID NO: 151 - DNA, 201 bp, Bacteroides sp.
ctgaggaagaggaatgacatgaaagtcacccgtttcgacctttctggcggtacaactgaccagacacaacagcagcgcataaacacaccacagacttacaacattgatttttttcataaatattattatttaagcgagtggaaaacgacttccaacatcgctgcaaaaataatctattttttccatatcagtcaaggataa

SEQ ID NO: 152 - DNA, 417 bp, Bacteroides sp.
atgtggaaatattatgctttgttgtcggctttctttgcggctttgacggcagtctttgccaagattggtgtaaaggatatcaatcccgatttggctacggccatccgaacgactgttattttgataataacgtggggtattgtctgttgtgaacgtcagatagccagtatcagggaagtgagtacccatacgtggttgttccttgtattgtcgggagtggctactggcctgtcttggcttttctatttcaaggctttgcagacgggtgatgtttcgcgtgtagctcctgttgacaagttgagtgtagtgatgaccatttgcctctcctttctgtttctgaaagagcctaccactcctcgggtcatcattggagcgctattcattacttgtggaagcattcttatgcttttaaaataa

SEQ ID NO: 153 - DNA, 846 bp, Bacteroides sp.
atgaaaatagtacatgctatcaaggacttgcaggaggcactggccgacctgcgtgcccagggtaaaacggtaggcctggtacctacaatgggtgctttgcatgcggggcatgcctcgctcgtgaagcgcagtgtggccgagaacgatgccacggttgtcagtgtgttcgtcaatcctacccaattcaacgacaagaacgatttggctaaatatcctcgtacgctggaggccgactgccgcttgctggagcaatgcggagccacggtagtctttgcgccttcggtcgaggaaatctatcccgaacccgatatgcgccacttcagtttcccgccgctcgacacggtgatggaaggggcttaccgtccgggtcacttcaacggcgtctgccagattgtgagcaaactgttcgacttggtgaagcccgaccgcgcctacttcggcgagaaggatttccagcagttggctatcattcgtgagatggtccgtcagctgaagtttcccctccagattgttggctgccccatcgtccgcgaggccgatggcctggctttgagcagccgtaacacccgcctctcagccgagcagcgccagcaggccctgaagatttcgcagaccctctttgccagcgtcgactacgctgccactcacaccgtggcccagacacagcagtttgtcgaggatgccatcgccgccgctccgggccttcggctggagtatttcgagctggtggacggcaacacgctgcagaagattaccgactgggccggcaccgactatgccgtgggttgcatcaccgtcttctgcggggaggtccgcctgattgataatatcaagtacaagtcttaa

SEQ ID NO: 154 - DNA, 141 bp, Bacteroides sp.
atggagattacagaaatattgcatatctttgtccctgtattcagattcggatatgatggttacttcattcaaacggttggtgacgttgctccgcagcccttatcccgagttgcggcaacggtggaagacggtggtgctgcc

SEQ ID NO: 155 - DNA, 189 bp, Bacteroides sp.
atggcaaagaaaacgaaaggaaacagagtacaggtgattctggaatgcacagagcagaaagacagtggtctgccgggaacttctcgttacatcactacaaagaacagaaagaacactaccgaaagattggagctgaagaagtacaatccgatcctgaagagagtgacagtacacaaagaaattaaataa

SEQ ID NO: 156 - DNA, 654 bp, Bacteroides sp.
atgacttacagagactacttacaacaactgatttacaagattatcaatcccgtcgtgcagggcatgatccgggtggggattaccccgaacttcgttacgaccaccggcctggtgctgaacatcgtggcggccgttgtgtttgtatatgccggttgggccggcgaggaactggcgctgacgcttgccggatgggcgggcggcattgtgctgtttgccggcctgttcgacatgatggacgggcgtgtggcccgggtgggaggcatgtcgtccactttcggtgccctctacgactccgtgctcgaccgctacagcgaacttttcacccttttcggcattctctatttcctgctctttcagggatatttctgggggagcatcattacggctgtcgctctggtcggctcgttgatggtgagctatgtgcgtgcccgtgccgagggtctggacctggattgcaaggtgggcctgatgcagcgtcccgagcgtgtcgtgctgacggctctgggtgccatcttctgcggtgtcttccaggactgcacggctttcgacagcgtgtacatcctgattgctccgttggctgtgatagccgtgttggccaactggactgcctttgtccgtatcaaccattgtcataaactgttgaagaagcaataa

SEQ ID NO: 157 - DNA, 228 bp, Bacteroides sp.
atgggacctgtttgtcgtcaagctgaaggctggctgaaacgtaaagctcaatctgcaggccaaggacggtctactggtgaacaagcggatggaagtcagaaagttttgaaaaagaaagggatattcttgtttcgtgagcaagtaatgtctacctttgcgacatatttaatagaagaggcgcgtggcggttcgaaaccatgggccggacgcgctcccttctttctgtga

SEQ ID NO: 158 - DNA, 519 bp, Bacteroides sp.
ttgagtatcaatgaattacattttttgcttgcaaaatcaactgtcacagcagccatccgcgggaagcagaaaactgccgtcccctccgcagttttttgcctgaaaagagaaaaaattccgcccggcatcgaagcacaacggccagccccgcagacaggccgaccgcacccgccggcccgaacaaaaacgggaaaacaccgccgcggctatcggaaagcaccgctttccgccctgcaaatcagcgcgttagttttattaacagtaaattcccgttttgttaacagattttcacaagaaatcgataccccatttttggccgtacgccaccgaagccgtacctttgctacacaggcacggggaaaagccgcatcgccaccacggaaggggattcaaaaaaagaccagcaccctaccctttccgtccgcccagcaccagatgcagccatccccagaggccgaggacgatgacgagcagcgtctggatgccatggaccaggagggcaaagagagacgcatcggc

SEQ ID NO: 159 - DNA, 432 bp, Bacteroides sp.
gtgcaactcgctgttctacaacagccacgacaacatcgtcgccctgcccgccaacaagctggctgtggtcgaaggcctggagggctacctcatcgccgagtcggacaacgtcctgctgatttgcaagaaggacgaggagcacgccatccgcaagtacgtgaacgatgcccagatcaagatgggcgaagactatatctaagggaaaaagaacaaaccgatacctacaggaaaggggcggccctcatgcgggccgccccttttttcggttatcgtcgaaggaggttaggagtctcagaacgctgtgcggatggcctcggccacagccttgaactcttcatccgtcaatgtcagcttggggttggagaagagcatgtccttctcgctctgcatggggatgaggtggatgtgtgcgtgaggcacttccagtcccag

SEQ ID NO: 160 - DNA, 180 bp, Bacteroides sp.
gctgtcagtttatctgttgtccaagatagtgatttcggacgagaaaagcaaatctttcaaggaaaatcggaagtgccggtgatggtttgtaccggctgtcttctgtcatgcttgatgggaggaacagcttgtgccctttgtgcttcccgaaaatattttctactcttttatacttattaa

SEQ ID NO: 161 - DNA, 207 bp, Bacteroides sp.
atttccggccacggtgagaagaagcgcttcaccgtacgcaagatgtcgggtactgtaggtgtagagcgtatcttccccatcgagtcaccggccatcgacagcatcgaggtgaacaagattggtaaagttcgccgcgccaagctgtactacctgcgcaacctcaccggcaagaaagctcgtatcaaagagaaaagagccaacgcctga

SEQ ID NO: 162 - DNA, 405 bp, Bacteroides sp.
gtgcgtctgcctgaatacccttatctttgcgccctcaaaccaaccataaacagacgttctttggagaagttgcgccacatcctgaagtatttccttcccctgctgtttctgtcgtattggggaggagtgacgctgttcacccactcgcatgtggtgaacggtgtcatcatggtgcactcgcatcccttcaaagccggtcaccagcacacgtcgggccaggccgagaccattcttttccttgaccattacgaggcctcttccgtgcctgtgctgcttgctgccgtcccctgtttctgtgccctgctgggcttgctggcggtggtgcgctgcacgcgcctctgcctgccgcggctggaggacggcatccgtctgcgcgctcctcccgccagtgtcttcttcgcctga

SEQ ID NO: 163 - DNA, 324 bp, Bacteroides sp.
gtaatgagtaaattacatattaagaaaggcgacacagtttacgtaaacgctggcgaagacaagggcaagactggtcgcgtattgaaggttctcgttaagaagaatcgtgcgatcgttgagggcatcaacatggtttccaagagcacgaagcccagcgcaaagaacccccaaggtggtatcgtgaagcaggaagcttccattcacctgtcgaacttgaacccggtagaccccaagactggcaagggtactcgtattggtagaaaattgagtgcggacggcactttagtgcgttattctaaaaaatcaggagaggagattaagtaa

SEQ ID NO: 164 - DNA, 1227 bp, Bacteroides sp.
atgcaccgaatcacattaatcctgctcctggccctgctcctgcccgacctgtacatctacctggtgtacatcgtgcgccgtacgaagaactttgcatggcgtgcagccttctggctcccctccgccgtgctggtcgtgctgtacctgtacctcatctacctgacgggcgacaatgccctggcccaccatccgcaggccatcggccgcctggccatcgccgtcatggcactggccgtacccaaaatcttgttcatgctctgctcgctgctcggcatcctgtgccgcggactgggtcgctgcctgtcggccgccctgctgcacacgccgttccgcaagccgcaggcaccgttcatcgtccaccgcacgccgttcacagccgccgggctggtgctgggcgtcgtgagcttcgtcaacgtgatttatggagccacagccggcatcacgcgtttccaggtgaagcacgtgacctacgaatcggagcggctgcccgagggcttcgacggctaccgcatcgcccagttgtcggacatccacatcggcagttggcagggccgccccgaagccgtggaaaagctggtgaagctcaccaacgaacagcaggcggacctcatcgtctttaccggcgacctggtgaaccagcagagccacgagctggacagcttccgcccgaccctgtcgcgcctccaggcacccgacggcgtctactccgtactgggcaaccacgactacggcacctactaccgctggaagaacagccgcgaggaggccgacaacctgcaatacctgcgggagcagcagcaggccatgggctggcggctgctggacaacagccacgccattctgcaccaccgcggagacagcatcgccctcatcggcgtggagaacgacggagaaccgcccttcccccaacatgccgacctgccccgtgccaccgagggaacgcaagggatgttcagcatcctgctgagccacaaccccacccactggcgccgcgaggtgctgcccgagtcggacatcgacctcatgctgtccgggcacacccacgccatgcaaatgaccctcttcggccgctcgctcgcctcgctgaagtatcccgaatggtcgggcatgtaccgcgaaggctcacgtgccctctacgtcaacatcggcatcggctacgtgggcctgcccttccgcttcggcgcctggcccgagattaccgtcatcacgctgaagaaaaagaaatag

SEQ ID NO: 165 - DNA, 864 bp, Bacteroides sp.
atgcagacgaaaaagaggaaaaaaagcaaagcgttctggaacaacatcaagttcaagtacaagctgaccatcgtcaacgagaatacgctggaagaggtggtaggcctgcacgtgtccaagctgaacggcatctccgtacttctgtccgtactgaccgttctgtttgtgatagcctcgctcatcgtggccttcaccccgctgcgcaactatctgccgggctacatgaacagcgaaatacgcgcccaggtggtagacaacgccctgcgcgtggactctctccagcgactggtagagaggcagaacctgtacatcatgaacatccaggacatcttccgcggcgaggtcaaggccgacaccatccagtccatcaactcgctgaccaccctgcgccaggattctctgatggaacgtacccaacgcgaagaagaattccgcaagcaatacgaggaaaaggaaaaatacaacctgaccaacgttgccaccggaccaaccgaaggactgaatttctactgccccacacgcggcatcgtatcgtcttctttcaaccccgaacagcgacattacggaacggatattgccgccactcccggcgaaagtatactggccactctggacggtaccgtcatcctgagcgcctacactgccgagacaggctacatcattcaggtgcagcacagtcaggacctcgtatccatctacaagcactgcggttccctgctcaagaaagaaggcgactcggtgaaggccggagaagccatcgccctggtgggcaacacgggacagctgactaccggcccacacctacactttgagctgtggtaccgcggaagagccatcaaccccgaaattcacatcgtattctaa

SEQ ID NO: 166 - DNA, 594 bp, Bacteroides sp.
atggacaaattcagttatgcaatcggcctgggtataggtcagaatcttttaagtatgggtgccaaaggcatctcggtagacgacttcgcacgcgccatcagcgacgtgctcaacggcaacccaacggaaatcacccataccgaggcacgcgacatcgtaaacaaatatttcgaagaaatggaagcccgcatcaatgcggaaaacatcgagaagggcaagaagttcctcgaagagaacaagcagcgtccgggcgtggtgaccctgcccagcggcctgcaatacgaagtgatcaaggaaggcaacgtaggccactatgccaagatagacgaccaggtgcagtgccactacgaaggcactctcatcgacggtaccctcttcgacagctccatcaagcgcggccaacccgccacgttcggcgtcaaccaggtcatccccggctgggtggaagccctccagctgatgcccgaaggagccaagtggaaactctacatccccagcgagctgggctatggcgcacacggcgcaggcgagatgattccgccccacagcacactgattttcgaagtggaactcctgaaaatattatccaaataa

SEQ ID NO: 167 - DNA, 630 bp, Bacteroides sp.
atgttgacagaactgaaagtaaccgattttttggataaagtggcgggcaacgaccccgtgcccgggggcggcagtgtggccgccttgagtggcgcgttggcctcggccttgggagccatggtggcccggctcaccgttggcaagaagaactacgaagccagctgggacgagatggagtgtgtggcggccgatctttctgccgcccgtgaaggctttacagtcgacatcgaccgcgactccgaggcctacgaccgcgtatttgcctgctttaagatgcccaaggccaccgatgaagaaaaggcggcccgcagtgcggccatccaggaggctacccgacaggcggccctggtgccaatggaagtggcccgcaaggcctttgccctgatgcccgccctgacctacgtggcccgtaacggcaaccgcaacgccgtgaccgatgcctgtgtggccatgatgtctgcccgcaatgcggtgctgggcgcgttgctcaacgtccgcatcaatctgggctcgctgaaagacaaggagtttgtggctgccctgcaggccgaggccgacgacctcgagcggaaagcctgcgacgaagaagcccgtttgctggaatccatcacccaagaattacgcgtatga

SEQ ID NO: 168 - DNA, 270 bp, Bacteroides sp.
gaaggtatagtgttcggcatagtagcgtccgccttcgtgttcacgctggaggcgcatgctcatgtagacgaagaggacgaccacgaagatgacggcgaaggccaggatgccgttgcctatcatgaattgtttgttggtgttcagacggtgtgccatagcggtgttctttcattgattgttgcggcaaatgtaccgataatctccgaactttcagcacgaaatgaacatattcttggattgggcggttttttgcttgcatcggacgattaa

SEQ ID NO: 169 - DNA, 354 bp, Bacteroides sp.
atgatgattgaagtattgaagtccaagatccattgcgcccgtgtcacggaagctaatctgaattacatgggcagcatcaccattgacgaggacctcatggatgcggccaacatgattgccggcgagaaggtctacattgccgacaacaacaatggcgaacgttttgagacctatatcattaaaggtgaacggggctccggcaaggtctgcctcaatggcgccgccgcacggcgtgtgcagcccggcgacattgtcatcatcatgtcctacgcactgatggacttcgaggaagccaagactttcaaaccgacggttgttttccccgacccggacaccaaccgagtggtgggctga

SEQ ID NO: 170 - DNA, 504 bp, Bacteroides sp.
atgatccattctccattttccattatgaaaatacgtgtaggtttcggcttcgatgtccaccagctggtggaaggccgtgagttgtggttgggcggcatacgcctggagcacgagaaaggattgctgggacacagcgatgccgacgtgttgatacatgccatctgtgatgccctgctgggggcggccaatatgcgcgacatcggttaccatttccccgatacggccggtgagttcaagaatatcgacagcaagattctgctgaagaagaccgtggaactgattgccaccaagggctacacggtgggaaacatcgacgctaccgtctgtgccgaacgccccaagctgaaggcacgcatccccgagatgcagcagacgctggcccgcgtgatgggggtcgacgaggacgacgtgtccatcaaggccaccacgaccgagaagctgggcttcacaggccgcgaggaaggcatttcggcgtatgcgacggtgctggtggtgaaagaatag

SEQ ID NO: 171 - DNA, 363 bp, Bacteroides sp.
atgaaaacgatgtcattgaacaaagcagacttcttaaataaagtagccaactatgaaacaagcccctccgaatggaaattcttgggcgaaagaccggccatcattgatttttatgccacctggtgcggtccttgcaagatgctgtcgcccgttcttgaagaactggcagccgaatatgcaggaaagatagatatctataagattaatgtagaagaggaagaggaactggcaggtgtattcggcgtcagaagtgtccccaccctgctcttcgttcccatggaaggagctccgcaaatggctcaaggggcgttgcccaagaacgtgttgcaggaagccatccggaacgtactgctgccagaatga

SEQ ID NO: 172 - DNA, 354 bp, Bacteroides sp.
ttaaaaactaacagaagaacctttatgaatttaatgaccgtatttctcttgcaggcttccgtatcgggaggcggtgctgaatggacgtggatcatgctgattgccatgtttgccatcatgtatttctttatgatccgtccgcagaacaagaaacagaaagaaattgccaatttccgcaaatcacttcaggttaaccagaaggtaatcactgctggtggtatccatggcgtgatcaaagaaatcaacgataacgatgtaatactggaaatcgcttcgaacgtcaagatccgtatcgacaagaattctatctttgccgctgcagccgatgccaacggcagccaggccggtaaataa

SEQ ID NO: 173 - DNA, 738 bp, Bacteroides sp.
atgatacagaccgacctgctgacagccgacaaagaccccatgggggccgccatcctcgactacctggagcacgggaaagccgacaagctgcgtgtgttctcctcccagtttgacgaggacgagatacccgtccgcaccctgttccgcaccgagaagcagatgtctccgctggaacgcaccgccctgcaactggcctccggccgcatcctcgacgtgggagccggaagcggttgccacagcctggccctgcaggcggcaggcaaggaagtggaagccatcgacatctccccgctctcggtggaagccatgcgccggcggggagtggggcaagccgtgcaggccaacctcttcagcgacagcttctgcggggcctacgacaccctcctcatgctgatgaacggttccggcatcatcggccgcctggagaacctgcccgccttcttccgcaaggccaaacagctgctccgcccgggtggcagcatcctgatggactccagcgacctgcgctacctgtacgaagacgaggacggcagtttcgtcatcgacatcgcaggcgactattacggcgaagtggacttccggatgcaatacaagcaggtggaaggcgacccgttcgactggctctacatcgacttccagaccctttccctctatgccgcacagaacggcttcacggccgaactcgccaaggagggcaagcactacgactacctggcccggctgcgcccgaaagcgtga

SEQ ID NO: 174 - DNA, 129 bp, Bacteroides sp.
atgtatttaattttgttcttgctcagtgtcatacaggtgtggaattgctttttccgcaaaagtacgccattattttcagataatcaaaaactctttggcatcagtttgtttttaggaaccgaaaattaa

SEQ ID NO: 175 - DNA, 360 bp, Bacteroides sp.
atggaccaaacaaagaaactgatagaacaaattaccgaaggtatccaagataaaaaaggaaagaaaatcgtagtggccgacctcacccgcatagacgacaccatctgcaactacttcatcatctgccagggaaactcgcccagccaggtgaccgccatcgtagagtctgtcaaggaatttgcacgcaagggcgccaacgtcaagcccttcgccatcgacggcctgcgcaacgcccagtgggtggccatggactatgccgacgtgctggtgcacgtcttcctgcccgaaacgcgcagctactacaacctcgaaaacctctgggccgacgcccaactaacccaaatacccgatatcgattaa

SEQ ID NO: 176 - DNA, 732 bp, Unknown
  Description of Unknown: Intestinimonas sequence
atgaatcggaacgaggaatattgggccctggtggcccagctgagcgacacgccgccggagctggagggcacagtggagcgggccaagtcccgggcccggaagcggaccctcaagcggtggctgggcatccctgtggcctccctggggggggtggcggcagccttcgtgctgctggtgaactgctgcgtcccctttgcccaggcctgcgggcgcatccctggcctccgggacctggcggcggcggtggccctctcccccagcctgaaggcggcggtggagaacgacttcgtccaggtggtggaccaggagcagacggaaaacggcatcaccttccgtctggactacctcattctggacaccatgcagatcaacttcttctactccgtctccggcggggactatgaccgctaccacgtctaccccagcatcaccggccccgacggagaaaagctggagggttactccatcgtcagcagcgagaccacgcccggcgatctgggcgacttcaacgtcaactacgccgacgacctccaggtgccggaggccctgcgcctcacctgcgcggtgaccgcccagcgggaggacagggacggctccgccgtcgcccccgctgactccagcatctgggacgagccggaacctgcccaggaaccggaggtggtggccaccttcaccttcgacctagagctggacgaccgcttcaccgtcccggggaagaccatctccctgaac

SEQ ID NO: 177 - DNA, 633 bp, Unknown
  Description of Unknown: Intestinimonas sequence
accatcgacttcatgtggggcatccggttcaacaatgagaagagctggttcgaggccaacaaggagacctacctccgggacttctaccagcccatgcgggagctcaaccgggaggtgtgggagcggctcaacgccgccgcccccgacctgggcctcttcggcaaggtgagccgcatctaccgggacgcccggcggctctatggccggggaccctataaggaccacctgtggtggagcatccagcggcccaccgacgaggagtttgcccggcggccggtgctctggttcgagctggagccggagggctggtcctacggcatgggctactaccaggccccgccggtcaccatggccaagctgcgccaccggctggaccacgaccccgccccctttgagaagctgcttcggcagatcaagaagcaggaccgcttcaccctggagacggaggcctacaagcggcccaagggccatctgaacgccctgctggacccctggtacaacgcccgcagcttcgccctgagccgggaccacaagggccatcagcccgtcctctactcccacgacctggtggacctggtgggggaggacctggagaccctgctgcccatctaccggtatatcctgtcggtggag

SEQ ID NO: 178 - DNA, 537 bp, Unknown
  Description of Unknown: Intestinimonas sequence
gagggacagcagaccacgcccaggatcgtcgccacggaggtgccgcccatgcccgaggtgaccatggcagcgcccgcacccgcgcccgcgccggcgcctataaagcccaagttcgtggattatgagacaggcgccttctatatggagaagcccgagcatatgacccacctggtggggaacgtgctggtggtgaagaaccatccccggatcctgttccgcggaaagctggactcgctgcagagtgcggtggtcctggcccaggtggacatccatgaccggggcggcagccaggctctcatcgacgacctgggggacattctgaagatcctgcgggagatgatgcgctgcgacgtgctggatgagcccttccagatggacaccatcatcggactcacccacgccgagctgcgggagcagtcccacgatccccagcggttcttcggggtcaaggccatggtcctgcccgactacaccatgggacgggacttcgcgctgctcaaccagctgcgcaccgacgtacgcgagacggaagtggcg

SEQ ID NO: 179 - DNA, 1347 bp, Unknown
  Description of Unknown: Intestinimonas sequence
atgcttacaggcgccgatacgattctgggaggtcatctcattatggacctggtaaagcattttttcaagttcgtcatcccctctatcgtctccatgtggatcttttccctctacaccatggtggatggggtctttgtcgcccgtggcgtgggagaggtcgccctgcgggcggtaaacctctccatgcccttcacttcctttatttttatggtgggcatcctgctggccaccggcacctccaccgtcatctccatcgccctgggccagggggacctggagcgggccagaggttatttcaaccagaacctggcggtgaccggagcggccagtctcctggtcaccgtactggtcctcctcaatctggacaccgtggcccggttcctgggcgccactccggacaccctggtctatgtaaaggaatatgtgggcaccatttccgtcttcgccctctttttcaccgtctcctacaacctggaggtccaggtgaaggccaacggcgccccccacatcagcaccgtgggggtcatctcctgcgccctcatgaacgtggccctggacgccctcttcgtgctggtcttccactggggggtatggggagccgccttcgccaccggcctggcccaggtcacctccacggcggtctttgccgggtactttctcacccaccgccagcggctccggttccagcccttccgctgggagctctccgcctaccggcgcatcctgcctctgggcctctccgaggggctcaacgagctctccaacggcctggtcatctttctcttcaaccatgttatcctccgggtcatcggcgagagcggcctcactccctacaccatcatcagctatgtcaacaccctggtgctcatgaccatgacgggcatcgcccagggcatccagcccctggtgagcttccacctgggggcagaggagcggcccgtctgtcaccgcctcctccggtacggcatgactctggccctgaccctctcggtggtcttcttcctgctggtggaggtgggagacggggccatcgtgggtttcttcctggaccgggatagccccatgttcggctactccatcaccgctctggggctgtacgccttctccttcctgcccatgggcgccaacgtggtcatggccgccttcttcaccgccgtggagcggcccgccttcgccctctccatctccttcggacggagcctggtcctcatggccgcctccctgctcaccctctccgccctcttcggggacaccggcatctggctgtccaccctgtgctccgaactgctgtgcctcctcctcacggccgcctgcgccctggcctaccgaaggggtttggcccgatga

SEQ ID NO: 180 - DNA, 717 bp, Unknown
  Description of Unknown: Intestinimonas sequence
gcctcggtggccatggtgggaccttacctgatgggcggcctggccgcggtctacctgctgtggctctgctacctgcttctgaagggtccgcgccggcccctggtgcccctgtgctgctcggtcatcgtgctcgtcgccgccctggtgctcaatcacgccgcctactgggcggggagtctcaccatgacggtgctggacgtaggtcagggccagtgcgtggtgctctgctgcggggaccgggtggcggtggtggactgcggcagcaccggcgaggacgccggtgatctggcggccggctacctgagcaccatgggcatcaagcgggtggacctgctggtgctcacccactgccacagcgaccacgccaacggggtggccaccctgatggaccggctggaggtgtccaatgtggccctgccccaggtcatcgaggcgccggagctccagaccgaactcctggcccgggcggaggcagaggacatccccactctgatggtgtgggatgacgtgatgctggagtttggagacgccgtgctcaccctgtacggcccgctgggcagcggcgacaccaacgaggagggcctgagcctgctgtgtgagacggcggacttctccgccctcatcaccggggacatggaccagatcgtggagggacggctggtgaagtacggaaacctgcccgacatcgatgtgctgctggtgggccatcacggctcc

SEQ ID NO: 181 - DNA, 414 bp, Unknown
  Description of Unknown: Intestinimonas sequence
atgaagaccgtcccggacggtgtcaccgtaccggggcggagggaaaggggagcggagaccaaggccttcgctcctcttgaccacgtttcggggcgtggtaccgccatgcccgaccctgggccagtgggcccaaacaaagaggtgaaacccatgcctaaaaacgacgacaagcggtcggtccgctgttccttctgcggcaagcaccaggagcaggtggcccggatcattgccggacctggggcctatatctgcaatgagtgtgtccagctgtgcatgagcattctggatgaagcgggcgacgagcctgtggaggaccgggccgatatccccgatgtgatccccacgccccgggagatccgggatgtgctggacgagtatatcatcggccaggaggcggccaaggtggccctctcc

SEQ ID NO: 182 - DNA, 495 bp, Unknown
  Description of Unknown: Intestinimonas sequence
atgctgtatgccctgctcgcggcggtcctggtggccgccgaccaggtggtcaagtacctggtccgcgcaaacatccccctggggacctccgtcccctttctccccggcctggtggagctcacctacgtgaagaacaccggcgccgccttttccatcttctccgaccacacctggatcctgaccctcatctcggcggtggtggcggtggccatcgccgtggccctgctgcgccgggtgatccgccacccctttggggtcaccaccctgacggtggtctttgccggggcggtgggcaacctcatcgaccgggccctcttcggcttcgtcaccgacatgttcaatttccagttcatgcacttcgccgtcttcaatgtggccgacatctgcgtggtctgcggcggcatcgccttctgcgtctacttcctcttctactacgacaagctggagaaaaaaggaggagccgacggccatgacggaagttctgctgagggctga

SEQ ID NO: 183 - DNA, 588 bp, Unknown
  Description of Unknown: Intestinimonas sequence
acgcagctcggatgcgcgggggagagaaaaagcccctgtgtattcgagttgcctgtttttacaggaccaaccaccaaaaatggaaagcaggtgaacgccttgcatgaagtgatcctcagcgtgggcatcgacatcggcacctccacgacacagctcattttcagcaggctgaccattgaaaaccgggccagcagctataccgtgccgcggatccagatcgtggacaaagaggtcatctaccgcagtctcatctattttacccccctgaagtccaatacggagatcgacgccgaagcggtgaagaagatcgtccgggacgagtaccaggccgccggcatgacgccggaggacgtgcggaccggcgcggtgatcatcaccggcgagactgcccggaaggagaacgccaacgaggtgctggaggccctctccgacctggccggagatttcgtggtggccaccgccggacccgacctggagtcggtgctctcggcccggggcgccggcgccgacaagctctcccacgaacaccgcaccaccgtcgccaacctggatgtgggcggcggcaccaccaacattgcagtctatgag

SEQ ID NO: 184 - DNA, 924 bp, Unknown
  Description of Unknown: Intestinimonas sequence
atggacacccccatcccccagcaggccaaaaacatggtggtcatgaacgccgaggccgacgtggagaagatcgcctccatggtggatttcgtcttctccgccgttgacatgaagaaagaggagatccgcgctctggaggaggcctacgcccgccacgagtgtccggtgatctccaacaattccgcccaccgctggacggaggatgtgcccatggtcatccctgaggtgaacccggagcatatccaggtgatcgaggcacagcgaaagcgactggggatgaagcgcgggctcatcgcggtcaagtccaactgctccatccagagctatgtgcccgccctccatcccctgcgcggcttcggcctggagcggatcctggtgtgcacctaccaggccatctccggcgccgggaagacgttcgagtcctggcccgatatggtggacaacgtgatcccctatatcagcggcgaggaggagaaatccgagcaggagcccatgaaggtctggggccgggtggaaaacggcgtcatcgtcaatgccgtcaagccggccatcaccgcccagtgcctccgcgtccccgtgtccaacgggcacactgccgccgtcttcgtggattttgaaaaggtgcccccgatggatgagatgaaggccatctgggcggaataccggggccgtgctcaggagctcaagctcccctctgccccccagcagttcctccactactttgaggagcccgatcgtccccaggccagacttgaccgcggcctgggcaatggaatgaccatctccattggacgtctccgcccggatacccagtacgattacaagttcgtgtgtctgtcccacaacaccctccggggcgcggcaggcggtgcggtagagcttgccgagctgctgtgcgccgagggctacatcgtcaaggcgtaa

SEQ ID NO: 185 - DNA, 882 bp, Unknown
  Description of Unknown: Intestinimonas sequence
gtgaaagcattgaatctgaccgaacttgtcaaggcatccggtatcgtgggcgcgggcggcgctgggtttcccacccacgtcaagctcaacgccaaggccgaatgctttgtggtcaacgccgcggagtgtgagcccctcatcgagacggacaaatatctgtgccgcacctatgcgcctcagatcgtcgccgcggtggtggcagtggccgcccacctggaggccaagcgggcagtcatcgcactcaaaggaaagtataaggctgagatcgcggccctgtccgacgcgatcaagctggcggatgcccccgttgagatcttcgagatggggaccttctatcccgccggcgacgagcagaccatggtccagcaggtcaccggccggtcagtgccggagcggggtctgcctctggacgtgggctgcgtggtggacaacgtgggcaccctgctcaacatcttcgacgccatccagggccgtcccgtggtggataagttcctctccgtggtgggtgaagtaaaggcccccatcatgctccacgtccccgtgggcaccgccatcaccgagtgcgtgaaggcggcggagccgaccatcaccgactacgccctgatcctgggcggccccatgatgggcaaggtgctcctgagccaggcggacatcgatgccgcggtggtcaccaagaccaccggcaacatcatcgtcctgcccagggaccactatctgttccagcgggccaccctgcccatggaggccatccggcaccagacccgcagcgcctgcatccagtgccggatgtgcaccgacctgtgtccccgatacctcatcggccatcagatccgccccaacctggtgatgcggaacctctggcgggagccggggatggaggac

SEQ ID NO: 186 - DNA, 507 bp, Unknown
  Description of Unknown: Intestinimonas sequence
ttgagacagaacgtcccggacaaccgccagctgctggtggagcacatcgtgaacggacagacggatttttaccgcctggcgatgagctatgtcaaaaatcgggatgcggccatggatgtggtccaggaggccatcgtaaaggccctcagcaaggtggacaccgtccgggagccggcctatctcaagacctggttttaccgcatcctcatcaacgaggccatgaaccattttcggcggaaccgtaacctggtgtccctggaggacgtcatggtggaccgggcggaggagccccgggacccgggggagcggctggacctctatgacgccatcgaccggctgtccttcccggagcagaccgtcatcaagctgcgctactttgaggacatgaagctggaggagatcgcccaggccaccggggccaacctgaacacggtgaagtcccggctctacaaggccatccgaaagctcaaggacatgactggagaggagatcgactatgcaccctga

SEQ ID NO: 187 - DNA, 444 bp, Unknown
  Description of Unknown: Intestinimonas sequence
atggaacagctgcactttgtggatgcctgcaccgatgaacacttccgcgccatgtccctcatccacgccctgggctggcgggacacctatgtggatgcggtgccggcggagtatatggcccgggagatcaccgatgagcggtgggtcccctttttccgggacgactaccgcctcaagcgctgtcacggtcttttgctttacagagatgacaccccggtggcctgcatcaactacggtcccgcccggacggagaactacaacgccggcaccaaggagggctccgactttcctaacgccgcctacgccggctggggagaactcatctccttctacacccaccccgacgaacggggcaagggctatggcggcctgctcattgaggaggccatgaatcgcctgcggcaggagggttacaagaactgcttcgtctttgtcctccgggag

SEQ ID NO: 188 - DNA, 507 bp, Unknown
  Description of Unknown: Intestinimonas sequence
gagtacatcatccgggatctgctccagcagggcgcctgcatcgactccttcggcgtgggcgagcggctcattacctccaagtcggagccggtcttcggcggggtctccaagctctccgccgtggagcgccccgacggctccatcctgcccaagatcaagatcagcgaaaaccacgccaagatcaccaatccccacttcaagaaggtctaccgcctctttgaaaacgacacgggaaaggccatcgccgacctcatctgcgtccacgacgaggtcatcgatcccagtcagcccctggagctcttcgacccggaggccacctggaagcgcaagaccatcaccgatttcaccgtccgtgagctgctggtccccatcttccatggcggcgagctggtgtatgagaagccctccatcgaggctatgcgcacctggtgcgcccagcaggtggacaccctgtgggacgaggtcaagcgctttgaaaatccccacaactactatgtggacctctcc

SEQ ID NO: 189 - DNA, 1182 bp, Unknown
  Description of Unknown: Intestinimonas sequence
gtgtccgaaccaaagcgtgtccccaagaagacggcggccaagcgcccccggcgggactggcacaagaccgtggtggggctgctggccctgctgatggcgctgctgatgatcctgcccatggtgaccatggtgttccagacggcgggcgccgccacacaggaggagctccaggcccagatcgacgcgggaaagtcccaggtggccgatctgaacgaccagatcgacgccctgggggagcagctggacagcatccagaacgacaagaaccaggcgctgcagcagaagagcctgctggagcagcagatcaacgccctcacccagagcatcaacggtgtcagcgccaccattgcccagtacgaccagctcatcgctgagaaggagacacaggtggctgagacccaggccaaggaggaggagcagtacgccctcttctgcaagcgggtgcgggtgatggaggagatggggaccgtctcctactgggacatcctgtttggcgcttccaacttttccgacctgctggaccgggccaccatggtcagcgagatcatggactacgacaatcagatcatggatgagctggcggccacccgtcaggagctccagagccagcaggagagcctggaggcctcccgcgccgaccagcaggcccagaaggacgagctggaggggcagaagagcgacctgaacgccaagaaggcggaggtggaccagctcattgagagcatcaaggcggacgagtccaagctggagcaggcggaggcccagctgaaggcggaggccgaccgcgtcgacgcccagatcgtccagaagcagaaggagctccaggccctcatcgccgccggacagatcagctttgatcccggctccggctggcagtggccggtgcccggatactacaccattacatcggtcttcggaccccgtatccaccccattaccggccggccgggcaaccacaccggcaccgacatcgccgctcccggcggcaccaagatcctgtcggcccggggcggcgtggtgaccatctccacctataacagctcctatggcaactatgtggtggtccagcacgacaacggcatctccaccctctacgcccacatgaactcccgggcggtctccgagggcgatgtggtgacccagggccaggtgctgggttacgtgggcaccaccggctcctcc

SEQ ID NO: 190 - DNA, 819 bp, Unknown
  Description of Unknown: Intestinimonas sequence
atgtttcccatgaatgtgtttatcagtgccgacattgagggtacctgcggcatcaccgactggtcggagaccgagcgctccaccatggacgactaccgccccttccagaagcagatgacccgggaggtaaaggcggcctgcaagggcgccctggagggcggcgccaagggcatcctcctcaaggacgcccacgactccgcccggaacatcgacgcctctgccctccccgaggaggtgcgcatcctccggggctggaccggggacctcctctccatgatgtccggcctggacaccgacgatttcggggcggtcctcttcaccggctaccacgcctgggcctcctgccccggcaatcccctctcccacaccatgaacctgcgcaacgagtacgtcctcctcaacggcgtcctggccagcgagttcctcatcaacacctacaccgccggctactacggcgtccccgtctccttcctctccggcgacgccgccctgtgcgacttcgccaaggagctcatccccgagatggtgaccgtgccggtgaacaagggcgtgggcggcggcgtgctgtccatccaccccgacctggcggtggagcgcatccgcgccggcgccaaggaggcggtggagaaggcccacaagtgcaaggtgcccatgcccgaccactttgaaagccagatccgctttcgagagcacaagctggcctacggcaagagcttctaccccggcgctaccctggaggagggcaagatcgtgtgcttctccaccgacgactggtatgagatgctccggttctaccacttcgtgctcagcgacggctga

SEQ ID NO: 191 - DNA, 717 bp, Unknown
  Description of Unknown: Intestinimonas sequence
gcccagatcatcaacgccttcctgccctgggcgcccatcggcaccgtggtcatcatcctcaatgcccccctcttcctgctggggtggcggctgctgggcggccacctgctcctctcctccctctacgccatgttcgtctcctccctggccatcgacgtgctccacgccctctataccttccagcccatggaccccatgctggccaccatctacggcggcgtgctcatggggggctccctgggcatcgtcttcctccagggcgccaccaccggcggcaccgacctcatcgcccggctgctgaagctcaagctggcctggctgcccatgggcaagctcctcatggccatcgacctggtggtcatcgtggcggtggccctggccttcggcaacgtgtacagcgccctctacggcgtggtggccctcttcctctcctccaaggtgatggacatggtcctctacggcctggacaccgccaaggtggcctatatcatcagccaggacccccgggccatcgcccagaaactcacccgtgatctggaccggggcgtcaccatcctccagggccggggcgcctggtcgggccaggacaaggaggtgctcatgtgcgccttcaagcagcggcagatcgtggccatgaagcgcatggtcaaggaggtggaccctgccgccttcctcatcgtctgcgacgcccacgacgtcatgggcgaggggttccgt

SEQ ID NO: 192 - DNA, 909 bp, Unknown
  Description of Unknown: Intestinimonas sequence
atgagcacgcgcatcagcgacaccaccgatctccaggccatcagccggaagcgggacgtgcggcggaagaccatccctgccctggcccaggccggcccggtatcggtgtggatgatcctcttcgtcaccatccccatgctctacatcatttacatcagcttcatgtcccggggcgtcttcggcgacgtggtctacgagttctccctggagagctaccagaccctgctggacgccacctacttcaaggtcatcctaaaatccctccaggtggccctcttcaccacggtgctctgcctgctgctgggctaccccttcgcctactacatcgcccgcaagcccccggaaaaggcctcccggctcatcatgctcatcatgatccccttctggaccaactccctgatgcgcctgaacagctggctgctcctcttccagaccagcggacccatcaacaacttcctccagtgggccggcatcaccgacgcccccatcaccttcgtctacaccgacggccttgtggtgctgggcatgatcaccaacatgctccccttcgcggtgctccccctgtacagctccattgagaagctgcaaaaatccctgctggaggcctcctccgacctgggtgccaccccccgggagaccttcttccgggtgaccctgcccctcaccttccccggcatcttctccgccgtcatcctggtgttcatccccagcctgggcatctacaccgtctccgacatgctgggcggcggcaaggttctctacatcggcaacatcatcaaaaaccagttcggctccatccgcaactggcccctgggcgccgccctctctgtgctgctgctggtcatcaccggcgccctcattttcctctacacccgcttttccaagctggaagatatggaggtggtgtaa

SEQ ID NO: 193 - DNA, 726 bp, Unknown
  Description of Unknown: Intestinimonas sequence
ggggactttttcctgggccagcccctctccagcctgtccgcccgggtgaagggcctgcccattctcttctgcgccgccgaccgcaacggccaggtcatcatccccgacggctccttcgtcccccgggcggaggaccggatctacctcatcggcgcccccgtgggcgtccacgagttcttcaagctcatcggacgctacgcctccaacatccgcaacgtcttcgtggtgggcggcggacgcatcagctactacctggcctccatcctggagcgcatgaacatgcgggtaaagatcgtggagctcaaggaggcacgctgccgccagctctccgaggacctgccccacagcctcatcatcatgggcgacggcaccgaccaggagctgctggagtcggagaacctgggggagtccgacgctttcgtggccctcaccgaccgggacgaggacaacctcatcatctccctctacgccatgcagcgggaggtccccaaggtggtggccaagtgcaaccgccagaactacaccggtatcgtccgccacctgggtctggagagcgtcatctcccccaagctcttcaccgccaaccagatccttcagatcgtccgcggccgccagaactccaagggcagcgtcatgaacaccctctacaagatcggcgacagcggcgccgaggccatggagttcgtggtcaaccagaccacccgccacctgggcacccccctcaag

SEQ ID NO: 194 - DNA, 606 bp, Unknown
  Description of Unknown: Intestinimonas sequence
ggtatcaccctggtctccggcgtatccttcgtggtgccccagctcatcgtggccaagttcaccggccctgagctggccgttatcgtgggctgcgtggtcagcctgggctgcaccattctcatggcccgtgcccggaaggggaaggagatccccgccgagtacaatatgagcgctggcaacgccaatgccaaggccatcgacggcaacaaggcccttgtgtcctggctgcccttcatcctcatctttgtgctgctgctggtcacctccaagctggtgccccctgtcaacagcgctctggccggcttctccagctccatcaagatcagcacctccgccaatgccggcaacgcctccttcagctggatcaacacccccggtatctggatcttcgtggctgccatcatcggcggctttgtccagaaggcaacccccaagatgatgatcgacactctggtggccaccgtcaagcagatgtccaagaccatcatcaccatcatgtccgtgctggccgtggccaagatcatgacctactgcggcatgatcaatgatatggctgtcttcttcgtgtccatcaccggcagcttctatcccttcgttgcccccatc

SEQ ID NO: 195 - DNA, 969 bp, Unknown
  Description of Unknown: Intestinimonas sequence
atgaaaaaatatcgacgcagtctgctctccctccttctggctctgagtctgagcctctccctgaccaccccctgggccctggcctcctccgcagcaccggagaccgagaccccggcggccaccgaaacgccggagaccacgccgccgggaccggtggtggaggagaagaagccggtggagagccagctcctcagcgacatgcacatcgaggccgccgccgccatcctggtggatgccgacaccggcaccgtgctctacgagcagaacgcccatgagcagcgctatcccgccagcatcaccaaggtgatgaccaccctgctggccatcgaggccatcgaccggggggagctctccctggaccaggtcatcaccgtgggggacgaggtgaaccgggaggtgggagacggcagctccacccaggacatcaagcccggagagcagctcaccctccgggacgtgctctactgcgccctcatcgcctcggccaatgaggcctgcaacgtgctggcccaggtggtgagcggcagcgtggacgactttgtggacctgatgaaccagcgggccaaggagctgggcatggaggacacccacttcgccaacacccacggctaccacaacccggaccactataccaccgcctacgacatttccctcatgtgcatggaggccatgaagcacgagaccttccgcaccatcgtcacctccaagagctacaccgtcccggccaccaacatgcacgaggcccgggagctccacgagaccaacgccctggtgtccacctggcggatcacgggctactactaccagtacgccaccggcatcaagaccggctccccccccgaggcgggctactgcctggcctcctccgccaccaaggacggggtgaacctggtggccgtggtgctgggggcggagaaccccaagaacgaggacggctccaccaaccggctccagttctccgagtccagc

SEQ ID NO: 196 - DNA, 1209 bp, Unknown
  Description of Unknown: Intestinimonas sequence
gtgtccggcaccggcgccatcaagcctctccactcctacaaggtcaccaccctggtgaagggcgaggtgctggaggctcccttcgaggagggccagacggtacataagggcgacctgctcttccgcatcgactccaccgacgtggagacctccatccaacaggctcagctctccctggagagcgcccagctcaactaccagcagctcctcaagaaccaggaggacaaccacaagaacgccaccgtgaaggccaccgccaccggcgtcatcaccaagctctacgtggacgagggggacatggtctccgccggcgctcccatcgccgacattctggaccgggacaacatgaagctgaaggtccccttccactccgccgacgccgccgccttctacgtgggccaggccgccaccgtcaccgtggacggcaccatggagaccctccccggcaccatcgacaccatcgccgccaccgattccgtgggccccggcggcaccctggtccgggacatcaccatcgtggtccgcaaccccggcgccctcaccgacacctccagcggcactgccgccgtgggcaccgcctccagcgcctccagcggcaccttcgcctatggcgagagcaagcaggtcatcgccaagacctccggtgagctcaccagcctcaccgtgaaggagggcgaccgggtcatggaggaccaggtcatgggcggctttgacgagaccgacatggacacccagatcgccaacgccgccatccaggtcaagaacgcccagctcaccctccagaacgcccaggaccggctggaggactactccatcacctccaccatcgacggtaccgtcatcgagaagaactacgacgtgggcgacaccctggacacctccaccgccagcaccaccggcatcgcctaccccgccgtcatctacgatatgtccgccctcacctttgatatcagcgtcaacgagctggacatcaacaagatcgaggtgggtcagaaggtggagatcaccgctgacgccgtggagggcgagaccttcaccggcgtggtggacaaggtgaacatcaacggcaccaccgccagcggctccaccaactaccccgtcaccgtcctggtggacggcacccccgaggccctcaagcccggcatgaacgtctccgccaagatcatcgtggaggacgccggcagcgtgctctgcgtgcccgtggaggcg

SEQ ID NO: 197 - DNA, 471 bp, Unknown
  Description of Unknown: Intestinimonas sequence
atggacaaaaagcgcatcatccaggtggatgaaaaagtcccccttcccatgctcctgcccctgagcgtccagcacgtcttcgccatgttcggcgcgtcggtgctggtccccatcctgttccagatcgaccccggcatcgtcctcttcatgaacggcttcggcaccctgctcttcatcctcctcaccaaaggcaaagcaccggcctatctcggctccagctttgcctttttggcgcccgccggcggcgtcatcgcggccaagggctttgagtacgcccagggcggctttgtggtggtaggcctgctgggctgtctgctggccttcatcgtgtggaagttcggcaccgactggatcgacgtcattctgccccccgccgccatgggccctgtggtggccctcatcggcctggagctggccggcaacaccatcacccccggcaagaccggtgccgacctcacctccggtccccac

SEQ ID NO: 198 - DNA, 1089 bp, Unknown
  Description of Unknown: Intestinimonas sequence
atcatgatgcccatctcttcctgggcggcggcggtgtccggtgtggccgagtccatggagggcgtgtccggtctgcagctgttcatcagtgccatcccctggaactactacgccatcctgaccatcttcaccctgattatcctggccgtctttgacgaggacttcggccccatgaaggtccacgaggacaacgccaagcggggcgacatctacaccacccccgagcggccctttgagggcgccgatgacgagagcaagaactccaccaacggcaaggtcatcgacctgatcatccccgtcatcgtcctcatcgtctcctgtgtcagcggcctgctgtacaccggcggcttcttcacccccgacagcggcacctacatgaacgtgatggatgccttcgccaactgctccgccgccagcggcctgatgtacggctccttcatcgtggtcatcttctgcttcatctatttcctggtgctccgccggagcatgagcttcacccaggtcaccgactgcatcgccgagggcttcaaggtcatggtgcccgccatcctgatcctgaccttcgcctggaccatcagcggcgtcaccaacgacctgctgggcgccaagtacttcgtggagcacttcatgcaggcctatgccgagtccctggcgaacttcctgcccgccgtcatcttcctggtgtccgtgttcctggccttcgccaccggcacctcctggggcaccttcggcatcctgatccccatcgtggtggccaccttcggcgtggacgccggcaccatcctcaccatcggtctgggcgcctgcctggccggcgccgtgtgcggcgaccactgctcccccatctccgataccaccatcctggcctccaccggcgctcagtgctaccacctcaaccacgtgaagacccagctgccctacgctctgactgtggccgctgtctcctgcgtgaactatgtcctggccggcctgatccagaacgtggtcatcaacctcatcatcgctttcgccactatgtttgcggttctgatgatcctgcgtgccaccctcggcaaggacaaggtggccgcccggtctgcggcaaagtaa

SEQ ID NO: 199 - DNA, 798 bp, Unknown
  Description of Unknown: Intestinimonas sequence
gccgtctccttcggctccgtcccctggcactttctcgtcatcgccgccaccgtggccattctggtgctgggcgtggccgccggcatcgagaagatcagcaagttcatgatgcccgccttctacgtgttcttcctcatcatcgccgtgcgggtggccttcctccccggggcggtggagggctaccgctacctgctggagcccgactggtcctacctcttcaagttcgaaacctgggtcatggccatgggccaagccttcttctccctgtccatcaacggcgccggcatgctcatctacggaagctacatgaagaagtcggagaacatcacccgccagtcggtgatgaccgccctgctggacaccatggccgccctcctctccggctttgccatcctccccgccgtcttcgccttcggcatcgcccccaacagcggtccctccctcatgttcatcaccatcccccgggtctttcagcagatgcccggtggccgcatcctcgccctcttcttcttcgtctccgtcctcttcgccggcatcacctccctcatcaacatgctggaggcggtgggcgagtccctgagcaagggcgtcaaactcccccgcaagaccgccatgatcgtggtgggctgcgttaccttcgccgtctccctcttcctggagtccctccccgccatgggctcctggctggacgccgtcaccatctatatcgcccccttcggcgccgtgctggccgccgtcatgatctactgggtcctgggcctcaaggccatccgggccgagctcatggagggccgcacc

SEQ ID NO: 200 - DNA, 357 bp, Unknown
  Description of Unknown: Intestinimonas sequence
atgcggaaacggctcctggccgcactgtgcgccgccgccctgctggcggtcctcatccagggctacgccgccggggaggagtgggacgccaacgtcatcttcctggccctcaacgactcccccgtccccctcagcgacagcaccatgcccatcaacgtgggcggcaccatctacctcccctacttcatgctggacgccaaccagaacggcggcatccggctgggcatcatcaacggcgggcaggacaaggtgaagaacaccctcaccctctacaacaccgagccaaaaaacctgaccttcgacctgcggaccggcatatcctacgactatatccccgacggcgaccggcagaccccc

SEQ ID NO: 201 - DNA, 645 bp, Unknown
  Description of Unknown: Clostridiales sequence
atgcttgcttggtgggaatcgctggatgcactggaacgcggctttgctttcgttgcatttccggccacagcgctgctgttgatccagatggtgctgacgctcatcggccttggccacgatgcggatgccgacctagatcttaccatcgacattgacggcgacggtgtgccggatatcccggacatcagcgccgcagacgcagcttccatcggagaccatgacgcaggggttggggcgggcctccagcttttctccctgcgcgggatcatcgcgctcttctccgtcggcggctgggtcgggcttgcctttttgcgcagcggcacggatcgcggccttgcggtgctgcttgccgttgcagcgggcgcgcttgcgatggttttaacggcgcttattctcaaatccttcctgcggctgcaatacaacggcacgcttgatgtgcgcaacgccgtgggcctttccggcacggtctatctcaccatcccgcctgcgcgcagcgaaacgggtaaagtgacgctgcttttacaggagcgtttgacgcagatcgatgccgtgacggattgcgaaacgcccatcaaaaccggggcggaagttgtggttgtgggcgtatccggaaaaacgacgctgatcgtgcagccgaaaggctga

SEQ ID NO: 202 - DNA, 1203 bp, Unknown
  Description of Unknown: Clostridiales sequence
atgattgcatcccttgcactgatcttcctttccggcatggcggccgcatcgctctgccaaaggcttcgcatgccgcggcttgttggcgttctggtcgtcggcatcgcagccggcccctttgcgctgaaccttttaggtgcttccatcctctccatctcagccgacctacgcaaaatcgcgcttgtgattatcctgatcaaagcagggctctcactcgacccggctgaactgaaaaaggtagggcgccccgcgctgctgatgtcctttctgcctgcatcgctcgaaatcgcagcctttgccctgttcgccccatccatcttcggcatttcaccggtcgaagccgcccttatgggcgcggtgacggcggccgtttctccggccgtggttgtccccaaaatggtacagcttatggagaatcggcttggaacggagaaaggtgttccacagctgatccttgccggtgcatcgctggatgatgtgttcgtcatcgtccttttttccacgttctgcaacatcgcccagggcagctccgcctccgccgccgattttgcgggcattccactttccatcctgttcggcgttcttgcaggtgtcgcggcgggtaccctgctcgcactgttgtttgaagcggcgcatgcgcgccggcgaaccgtgcgcaacagcgctaaaacgattctcgtccttggcattgcctttctcctcgtggcgttggaagacatgcttaaggcacgcattccgttttccggcctgctcgctgtgataagcatggcttgcgtgctgcgctgcaagtgcccgccgaccgtttcccagcggctctctcagaaattcggcaagctgtggattgctgctgaggtcctcctgtttttcctcgtcggcgcagcggtagacctgcgttatacgctctcggcaggtgccaaagcgcttctgatgctcatcatcgcgctcacgctgcgcgcctcaggtgtgttgcttgcactcaccggcacaaacctcaaccgcaaggagcgcttgttctgcgtgatttcctgtcttccaaaggcaaccgtccaggctgcgattggctccgtgccgctttcccttgggcttccctgtgggagattgatcctgtccatcgtcgtgctgtccatccttatcacagcgccgcttggcgcgttgggcatggagctaagttgcaatcgtctgttgcaaaaacagcagcgctga

SEQ ID NO: 203 - DNA, 1383 bp, Unknown
  Description of Unknown: Clostridiales sequence
atggcggaaaaacgatatgaaatggatatgtgttcagggcctcttctgagcaaaatcctggcctttaccctccctctgatcctttcaagtatgctgcagctgctgttcaacgctgcggatgttattgttgtaggccggtatgccgggagcactgcgcttgcggcagtgggttccacaggcgccctcatcaatctgatcgtcaacctgttcatggggctttccgttggcgtaagcgtaaccgttgcgcgccattatggcgcacgggaatacgcggatgtgaccaccgcagtgcatacggcaatcctcatgagtttaatcggcggaatcgcagccggggcattcggcttttttatggcaaaaccgctgcttgcgctcatgggttcccctgcggatgtcatcgatcaggcggcgctgtatgtgcgtatctactttatcggcatgcccgcttccatgttttataacttcgggagcgcagttttgcgcgccgtgggcgacacaaagcggccgctctattatctcagcgcagcgggcgtgctcaacgtgctgctgaacctgcttttcgtcatccggttttccatgggggtagccggcgtggcgcttgcaacctccatttcgcaatacctttccgccgcgcttatcgccatctgcctgatgcgctcggaaagctgttaccggctgcactgggatgagcttgcgcttcataaggacaaagccctccccattatccgcatcggcctgccagcagggttgcagagctccatttttgccatttccaacgtggtgatccaatcctccatcaacagctttggctccattgcaatggccggaagcgctgccgccgcaaacatcgaaggcttcgtttacgtttccatgaattcagttgcacaggcttcgctttcctttgcaagccagaacatcggtgcacgccggtatgaacggatcagcaagatcagccgcacctgcctgctgcttgcggccctcttcgggctggtgctcggcaacggcgtttatttgctgcacgatacgttcctgcgtttctattctccggatcccgccgtaatcgaagcgggcgccttgcgcctttccgtgatatgcaccacttattttctttgcgggctgatggatacactcgcctgcatcctgcgcgcgatggggaaatccctgttgccgatggtggtaacaatcatcggcgcctgcggccttcgggttctttggatttacacggtattcccgctggaccgcacgtttttcacgctgttcctgtcctacccaatcacctggggcgtgacggctgcggtgcatgctgtgtgttattttttcacaaagcgcacgatgctccggcgcgcgcaggcgagcgcgccttcggaagcaagcagcacttag

SEQ ID NO: 204 - DNA, 1233 bp, Unknown
  Description of Unknown: Clostridiales sequence
gtgagccgtgcaaagatacagcgagacaaagcgcggcgggaacatgccgggcttgaatttgaggaattatttttaaggagagatataccgatggaactgaaggaactgcgggcaaaatttgacgggatcgatgataaaatcatcgaattgttcgttcaacgcatgaagacttccgggcaaattgccgccgtaaaacgaaagaacggccttgcgatactcaattccagccgcgagcgcgaggtgctcgatcatgtgatggaccgggccggggacggcatggaactttatgcgaagctgctgtatcaaaccatgtttgaagtgagccgttcctaccagcattggctattggatgatacaagcgaattcatgcacgagattcgcgcagcggcagagcgcacacccgcgctgttcccgcagaaggggatcgtcgcctgccagggtgtagagggcgcatattcccaacaggcatgcgataagctgttcgccatgccgcgcatcatgtatttccggcattttgacggtgtgtttcaggcagtgcagagcggcatgtgcaaatacggcatactgcccattgaaaacagctcctatggctccgttgcccaggtgtatgatctgatgcgcaaccacaagttctacatcgtgcgcagcatcaagctttgcgtgcgccatgcgcttcttgcaaagcacggcgtgcgcctgcaggatgtgaaggaggtgttttctcacgaacaggcaatcggccagtgcagcgcttacctgaaagcgcatcccgaaattaagatcacgatttgcgaaaacaccgcggtagccgcgcgcatggtagcggaaagcgacagaaaggacattgcggcgatctcctccgttcactgcgcgcagctttacggcttgcatgtgctggaggaacgggtacagaacaacgacaataactatacgcgttttatctgcatcagcaaggaccttgagatctaccccggcgcaaacaagatcagccttatgctttctgcgcgggacaggcccggcgcgctgtattccgtgcttgcgaaatttgctgcgctcggcgtgaacctgacgaaactggaaagccgcccgcttccgggaagcgattttgaatttattttttattttgatatggaagcctctgtgctatccgatacggtgctcaaaatgctttccgaactgatggctgagccggatgtgtttgtattcctcggcaactatgcggaagtagtctga

SEQ ID NO: 205 - DNA, 1443 bp, Unknown
  Description of Unknown: Clostridiales sequence
atggttgcaatttatcttctggtgacaacggttgcgctctttgcgatcagctttgtgatctcggggcttgtggaatcgttcttggtgacccagcgcacggaaacgcaatccgaggaaacgatgcgccttgcgctggagcttgcgccaaagcttgacccttctgacacgaacgagctttatgatttaattgttgagcgagcgcagacaatgaacggcagaatccttgttctggatgttgacgccgtggtgcgcgccgattcagcttcctatcaaaatgggttccaactgccttaccgcgaggtgcgggatgtgcttgttgcgggcaaacaatcttcttatgggtttcataaaattgaccggacggatgatgcggagaacaatatttggacgcgcgccgagcagacggtttgggcggtctattatactgcgcccattacgctggatgggttttatgttggagccgtgctgttttcaacgctgctgcaagacgtagaggacgccgtgaacagcatcattacgaaaattaccgtcgcctttttgggggtggtactggtgatggccggattgagctttgcaatgtccaatgtggttacaaagccgattttggagctgacgaacgcaatccgccgcatgggaaaacaggggggaggcgtgcgcgtggaggtgcacggcaccgatgaaacggtggagcttgggcgtgccttcaacagaatgagcgagcaaattgaagcgcacgaccgcgtgcgcgacgaattcgtttccaacgcttcacacgaactgaaaacgccgctttccaccatgaaactgctttccgaatccatcctttatgaggaaaacccggatcctgcgctgatgaaagagttctttcaggacgtaaaccatgaagtggacaggctttcacgcgtaatcacggatcttttgcgcttggtacagatcgatgaaacggaaagcaaggtgcaggctgtgcctgtacggctggatgccgtggcgcaccgcgtactggaacgcttgcagccgcttgccgacaagaaggggattgcgctgcgtgccgcgctgcaggaggcgacggttgcaggcgacgccatgcgccttgaacaggtggctacgaatctgatcgaaaatgcgctgaaatataccgacgaagggcatgtggaggttcgtgtgcttacctccgatgaggaagcgctgcttcgcgttacggacaccggaatcggcattcccgaagaggcgcagacgcatgtgtttgaacggttttaccgcgtggataaagcgcgttcgcgcggaacgggcggaacagggcttggccttgccattgtggaacgggttgtggcgctatacaacggctatgtcgaggtggaaagcaagctgggcgagggaagcacattcacggtgcatctcccgctttgccgcacggacgcggcggagaaaggaggaacagcatga

SEQ ID NO: 206 - DNA, 960 bp, Unknown
  Description of Unknown: Clostridiales sequence
atgagcaccatactcgaggtcaaggacctgaaaaagtattttaaagtgaatgccggcctcctgcacgcggtagacggcgtaagctttaagattgaagaagggcaaacgctcggcgtcgtcggagaatccggctgcgggaaatcaacgctgggccgcgttgtgctgcatcttctggacaacaccggcgggcagattttgtaccacggcgaagacgttacaaccgtttcgcgcgaaaagctttctgcactgcgccgcgaaatgcagattatttttcaggacccgttttcctcgctcaatccgcgcatgacggtctatcagaccatcgctgagccgatgcaaatcatcgggggctacacgcgggcgcagattgaggaacgcgtttctgaaatgatggacattgtcggccttgcggcgcgctttgtgaacagctatccgcatgagcttgacggcggccggcgccagcgcatcggaattgcgcgtgcgctcgtgctgaacccgaaatttgtggtgtgcgacgagccggtttcggcgctcgatgtgtccatccaggcgcaggtgctcaacctgatgctggatattcaggagcgcatgggcctgacctacattttcatcacgcacgatttgtccgtggtgaagtatatcagcaacgatatcatggtcatgtaccttggccagatggttgaaaaggcgcccgcggatgaactgtttatgcaccgctatcacccctatacgcgtgccctgatcagcgcggtgcccataccggacattgaccacaagcgtgagcggattcagcttaaaggcgagctgacgtctccgatcaaccccaagcccggctgccgctttgccgcaaggtgcatttatgcaaagcccgagtgctttgaggtaaatcctgagattgaagagatcacgccggggcatttcgtgcgctgccactgcgtgcgggagctcaacaacctgtaa

SEQ ID NO: 207 - DNA, 1767 bp, Unknown
  Description of Unknown: Clostridiales sequence
atgttcccggaaatgtggatggatgagctccttcagaagacggatcttgcaagcctggtttccgaatatgtcccgctttcacaaaaaagcgggcggctttggggttgctgcccgtttcataacgaaaaaaccccctctttttccgttcagccggacaagcagatgtattattgctttgggtgccatgcaggcggtggagccattcaatttgtgcgggaaatcgagaggctctcctttgtggatgcggtgaagtttttggcgcagcgcgcaggcatggagctgccggatgaggtggatgacgaccgcctcaggcgtgagcgtgcgcataaggaacggctgtatgcagcatgcaaggaggcagcgctgttttaccaccgtcagctgctgtcgccgggaggaaagcaggcgcaggcataccttgcaaagcgcggggtggatggcaagcttgcaacccggtttggccttggctttgcgctggaaacatgggatggcctgacgaattatcttgccgggaagggctacacgaacgacgagttgatcgacgccgggcttgcaattcgcgggaaacggaagaacggttgctacgatgcttaccgcaaccgcgtaattttccccattatcgctacgagcggccgggtaatcggctttggcgcacgcacaatgaagaaggacgagcagccaaaatacatcaataccggtgatacgccgatttacaataaacgcagcaatctgtatgcgttgaacatgcaaaaggggaaacacccggttgaccttgtaatggtggaaggctatatggatgtgattagccttcatgcgtgcggaatcgacaacgcggtggcgtcccttggcactgcgcttacgcagcagcaggcccggctgatgaaacgctatgtcgagcgcgtatatatttcttatgacggagatgcggcggggcagaatgcaacgctgcgtgggttggacatccttgcggctgaagggttggaggtgaaggtaatctcgatccccggcaacatggacccggacgattatgtgcggcgcaatggaaaggcagcgttcttgaagctgaaggacgatgcgaacacgctcaacggctttaagctttcgcaccttgcgacgcagttcgaccttcttactgcggatggccgcgaaggatatgcaaagcgcgcgtgtgcgtttgtaggcggcctcgagcctgtggaacgcgagcggtacatcccggtaattgcccgcaacgcgggagtttcccttgatgcagtggaggcacaatgcgggcttgcaaagccggttgaaacgaataacactgccaaaaatcggaatactaggaataaaattcgcgaggcgaaagttaccgaacccgatcgaattgagcagacgctgctcacctgcatgcaggcttcgcgcgaaaataccacatatgcagcggagcggatggccgaggcgggggtaacgttttcccaagaagggtttgcgggatatgcggatgcattgcttgttgcatattctacgagtgaaacgccggatatggcgcgcttgctcgcagagctcccggagcagcaggcggaagccgccgcaatggcgatgacagccgacccattggaaggggaagctgcctccgtgattgatgattgcgtagaaaagctgcgctacaaacagattgatgcgcgcctgaaggagcttgcagacaaaatgagcgccggagaaggcgacaggacggtgcttctgcgtgaacacgcggagctgatgaagaaactcaaagagtttaaatag

SEQ ID NO: 208 - DNA, 750 bp, Unknown
  Description of Unknown: Clostridiales sequence
atggaaaacacaaactggatcaaactgatgagctcgagcgagtttgccgagcgcaagaaaacctgcgacacggttatcatccctgtcggcgcaacggaagtttacggaccgcatatgcccatgggcagtgatatcatcgttgcgcaggatgtggctgaactcgttgccgcgaaaaccaacgccatgatcgggccttccctcgaagtcggcgaatcatactcactgaccaaataccccggcacgctttacctgcgccccacgacctggatggctgtgatcgaggacttcatggcttccctgctgcgcctcggctttaagaacttcatgttcatcaacgggcatgccggcaacgtccccatggtcggccaggtttgccgcccccttgagcgtgagctcggcattaagaccgctcaggttgactggtggcgtttcacgcagcaaaaggcgcttggcgtttgcgaaaccacgggctggatgtgccatggccatgcaagcgagtgcggtacttccgtaatgcttcaccttcatcccgaatacgtagacatgtccaaggcggaacgcgtaacccccaaggaaggcgaagaatacggcaagtttgatgattttattgactacaccgttttcaacgagaccaccgagtgcggcatccttggcgatgcaaccatcgccactgccgaaaagggcaaagttgtcgttgagcgctgcgtagaccgcattgcagagtatatgcacgagaaattcggctgctga

SEQ ID NO: 209 - DNA, 768 bp, Unknown
  Description of Unknown: Clostridiales sequence
atgctccttgcgatggacatcggcaacacgaacatcaaaaccggcatttataaggacggcaggctgctcaattcctggcgcatgacaacggatcttcaccgcacctcggatgaactgggcgtgcagatggagtcgtttttcgggcatctcggcctttcaacgcgggatgtgtgcggcatcatcgtctcctcggttgtgccgtcgatcaactacaccattgagcacatgtgccagctttatttcttcggacaacagccgatgatggtaagttcttccttggaactggggctggatatctggtatgattaccctgaattattgggtgcggaccgcatctgcaatgccgttgcggcgtaccgcagctatggcggcccggttgtgattattgatttcggtacggcaaccacattttccgtcgtatctgaggacggcgcatttctcggcggcgcgattgggccgggcatcatcgtttccacggatgcgttggttgaaaaggcagccatgctgcacaaggtcgaatacatcaagccggatcatgccatttgcaaaaacacgaaggatggcatccagtccggcatcattaatgggtatgttgggtttgtggaaaacatcgtgcggcagatggaaaaggaactgagcgcaccgcccacggtggtcgcgacgggcggtatgtcttccatgatcgctgccgaaacggattgtatcgatgtgcttaacccgacgcttacgctggaaggcctcaactttatctaccgtatgaacaagtaa

SEQ ID NO: 210 - DNA, 2034 bp, Unknown
  Description of Unknown: Clostridiales sequence
atgaacgaattcaaggtggtgtcgccgtttgaaccgcagggcgatcagccgcaggccatagaaaagcttgcggcgggtgtgctgcgcggcgacaaaacacaggtgctgctgggcgtgaccggcagcggcaaaacctttaccatggcaaaagtgatcgaacgtgtgcagaagcccacgctcgtcattgcgcacaacaaaacgcttgccgctcagctttgctctgagcttcgggaattctttcccggcagcgcggttgaatattttgtctcctattacgactattatcagccggaggcgtatattgcctcctcggatacgtatatcgaaaaagtttccacagtcaacgatgaaatcgacaaactgcgccacagcgccacctgcgccctgaacgagcggcgggatgtgattattgtggcttctgtttcgtgtatttacgctctaggagacccggaagaatacctgaagctttcgatttccctgcgcgagggcatgcggatcgagcgggatgaggtgatccgcaggcttgtagacatccaataccaacgcaacgagatcgatttttcacgcgggacgtttcgtgccaaaggggatgtgctggacatcttccccgtgaactggtcggacaaggtgctgcgcgtagaattttttggggatgaaatcgagcgcatcagcgaggtgaatccgcttaccggagagattttgcttcagcgcgcgcatgttgccgtgttccccgcatcgcattatgcaaccggcaaggaaaagctggaggcggcaatcggggagattgaaaacgacctttggaagcgcgtagacgagtttaaggctgtggacaagcttcttgaggcacagcgcattgaacagcgaacgctgtacgacatcgaaatgatgcgcgaaataggctattgccagggcattgagaactattcccgctattttgacggacgcaaacccgggcagccgccgtttacgctgcttgattattttcccaaggatttcctcatgattgtggatgaatcccacgtgacgctgccgcaggtgcgcggaatgtacagcggggatcgttcccgtaaggaaaacctggtggaatacggctttcgcctgcctgcggcgttcgataaccggccgctgcgttttgaagagttcagcaagcgcatcaaccagctgatctgcgtttctgccacacccggggagtatgaactggggctttccagccagacggtggagcagatcatccgcccaacaggtctgattgacccggagatcagcgtgcgccccgtaaaaggccagattgacgatcttttgagcgaggtaaagcagatggcggcgcgcggatatcgcacgcttgccaccacgcttacaaagcgcatggcggaaacgcttacggaatatttggactccatgggcgtgcgcgtgcgctatatgcattccgacattgaaacaatcgaacgtatggagatcatccgggatcttcgtttgggcgagtttgatgtgcttgtgggcatcaacctgctgcgcgaagggcttgacttgccggaggtcggcctcgtggcgattttggacgcggataaggaaggctttttgcgttccacgacttcgctcatccagaccgtaggccgtgctgcgcgcaatatagacggacgggttattatgtatgcggatgagatcaccgattccatgcgccgcgcgattgaagaaaccaaccgccgccgtgaaaaacagcaggcgttcaacatcgaacacaacatcacgccccggagcgtgaaaaaagccgtgcataacgtgctggaaatttcacgcagggcgaaacaggacgaaggcggcatgacggaagcagaacgtcaggaacgcattgaaatcctgcgcacgcagatgcgccaggctgcggcagaactggacttcgaggccgcggccaagctgcgcgatgagctgtttgcgctcacaggcgacggcgctgccgtgaaaaaacctgcgcccggcacaccgggcagcgcaaagaaggcgcgcggcagagcgcgcaagtcacccaggaaataa

SEQ ID NO: 211 - DNA, 624 bp, Unknown
  Description of Unknown: Clostridiales sequence
atgcgcgaagaagtcgattatttgagcatgacggacgaagcgctcgtcgcgcgttcccacgcgggggatacgcgggcggacgaagcgctttacgaacggtataaaaacgtagttcgcatgaaagcgcggccatacttcctcatcggcgcggaccgggaggatctggtgcaggaggggatgatcggcctttacaaggccatccgcgattatacgccggaccacaatgccggcttccgttcgtttgcggaaatgtgcattgtgcgccagctcatcacggccatcaaaagtgcaacacgcaaaaagcacgcgccgctcaacacctatgtttccttctatggcagcgcctattctgaggaggaaaaagaacgcacgctgcttgataccatggcaacggtgcgcaccgaaagcccggaggatgcgtttatttccaaagaaaatatggagcgaatcctcggcagcatcgaaaagctgctgacgccgcttgaaaagcaggtgctcgatctgttcatggatggttactcttaccagcagattgcagcgatgctcggccgcggaacaaaaaccgtggacaacgcgctgcagcgcatcaagcgcaagctggaaaagtatttgcaggaggagtga

SEQ ID NO: 212 - DNA, 741 bp, Unknown
  Description of Unknown: Clostridiales sequence
atggatcatcagcccgtggttacggcggttctttttgatttggacggtacgcttctgcccatggatcagaatgcgtttatccatacctatttcggcgccttggctcggaaagttgtgccgcttggctttgcgcaggagcccttccttgcttccatgtggaaaggcacgagcgcaatgcttcaaaacgatggtacgcgcaccaaccgggaagcgttctgggatgcgtttgcatccgtttggggggaagaggctcgctcgctcgaagctgctctggtcggcttttatggaaacgaattcaacgtcgcgcgcaccgtggtagggaaagtgcaacccgtgcgggcgctgcttgacgccctgcgcgcacgcggccttacgctctgccttgcaacaaaccccgtcttcccgcgcgtagcggtggaaacgcgcctttcctgggtcgggctttccttctcggatttctcgcatgtcaccacctacgaaacagcgcgtttctgcaagcccagcttagggtattaccgggaaacgcttgcggccatcgacaaagcgcccggcgaatgcctgatgatcggcaacaacccggtggacgatatgtccgcattgcagctcggcctttcgggctttttgctgacggattatcttgaaaacgaaacgggcgtggatatctcccgttatccgcgcgggggatttccggcgcttgtggaatttctcgaagcgcagctcggggaaaaacttttttcctga

SEQ ID NO: 213 - DNA, 1596 bp, Unknown
  Description of Unknown: Clostridiales sequence
atgagaaggatcaaagcctgcgcctgcttgttggcgctgctcacttttgccgcggcgcttggcggatgtacagccacgaatgagattcctcccgccatcattttaagcgaccgcatgccgccggaacgcggggaagctgcgaacaagagctcatttgaggcggaattgtacttcctgtctcaggacgaaaaaagccttaaagtgcaaaagcgcgaggtgttttatgacacgcagaccagccgtgccgaggcggcgctcaatgcgctgatcgccgggccggacgtggacaggccggatcttaaaaggagcgtttccgcgctgtcccggctaaaccgggtagagctatgcggagaagtctgcaacgtctattttgaagttgataagtttatcccgagcgctacggagtggctcaaaacgcgcgctgccgttgcagccacggtggctgcagccgagggggtcgatacggttaacgtttacttttatgaacaggaacttggatatctggggtatacgcttggaagcatgtctccgctggaagaagaacttcctatatatctaagaaacatggagcggacgtataaggcgctttataaggctgaaagcggtacggccatcacggaggatacacagtatgtcacgcagatggcaacgctctactttgcaaatgcggaaggcgcgctgcttacggcacgcaacgcggaagtaagctatcctgaaggaagcacaaagtccgaaatagcgaagctgcttattgaacggcttgccggcggagacgcgcaaggcagccttgaaccggttttgcctgttgacttcaaactcctttccgacccaaaggtgatatacagtggaaagacggaaagcggagtggaggatacggagagcgattgcatcatcgaactggtaattgaacaaccggatgcggccaactatgatgaagcgattatgtgtggcgcgctgacgctgaccataaccggattcattccaaacgtgaacggagttcggatttgtatcggcgaagaagcgcagccggccgcgccagtgaatcagaaggatgaggaacaagccggaggtacagcagcggagacggaaaacatcaatatcctgcaaacgctcggaagggatgtgcttcgccgcgtagattttaccgatcagatagggcatgaaatcaccctctactatccggatgcagacggagccgtactgtatggggtcaagcggatcatcccgcaggctgcggcgtacaatccgcatgcacggctgcaggaactgctcggcggcgttgccgatcccggcgttgcctatccgctgtttacggcggaggatgtgaaggatgtttacttgagcgggaatgttgcggtgatcgattgggcggaagggttcgcccagaagctgcgtgcttttctggatggagattcttccatggcaccgtcaagacgcgaaagcatgttcatttacggcgtggtgaatactttgaccgacatgcccatgatctccagcgtttggatgcttgaaaacggagagaagctggacacggttgggcagatctatttgggcaatgcgcttgtgcgcaacccggggttgatcgtggaggagtaa

SEQ ID NO: 214 - DNA, 1140 bp, Unknown
  Description of Unknown: Clostridiales sequence
atgaaacgaaaaatcgcgtttctgcttgtagctgcgttgctttttgcgtgtagcggctgcgcagaaaaaatagaggaggcatcgttgccatccagctccaactcccctgcggaaccggaaacgcccgggcagctgaatgcgggcgtgcctgccacagcagccggaaaaggctttgacttaattggccttgtgatagatgacgatggttctgaccaagcctacatgaccatgtacggcttcttgcataccgcagaaaacctttcctatgcggcgaaaatataccgtgcaaccgcaggagaagggatgctttccgccgtggacgaagcgattgcggacgatgtgaatgcacttcttgtgttcgatccaacctgcgaaagcgatgccgcaatcgggcgcgctgcagaaaatgggataaaggttgttgtgccgtattacgaaagctctgccgtggggcttgatgcaaacatcatagcggatacctcggaatattatgatgagcttgcccgtggccttgccgagcgcatgacggagcgaagcctgaagtccggccgcattctggtttatggggcggatacggcagcatgctatgcagcattttcggcatctattgcgtctgcctatccgcagttccgcgtggatgcattcgaccgcacggcagtcgatgagcagggggccatcgacgaacttgcaacctatctgctctataaccgggacataaagggtatgtatgtagtggacagcgaggcggcatccattgcgattcaggcgcgttcaaaagcgcagaaaacgttccgtgcggaaggcgctccaagcccgacgccggaacccacccctgcacccggcatgacgccggagccaacacccaacccaggtctgcttactcagatcaccattacggtgttttgcaatggtttgagcgacgacaattatggtttgttcagcgacaacgacatctatgcactctgcatcgagccttattatgaggctgcggcagaggcaaccatggcgcttgataagcttttgcgcggcgatacagtgcctccggtttcccgcgtaaacaggcctatcatttacaacgacacagccgacaagtacaaagccatttttgaacaaatgaaagctttgtttaacattacctga

SEQ ID NO: 215 - DNA, 726 bp, Unknown
  Description of Unknown: Clostridiales sequence
atgacagatgaaattaaggaggaacgcaccatgcttgaactgaagaacgtaacgtacacatatgaaagcaaatatcagaaggtgcaggcgctgcgtggcgtcgattgcacatttgaaggcgggcgcgtctatgcggtgatcggaaaatccggcagcggcaaaacgacgatgctttccctcattgccgggctggatctgcccacgggcggcgaggtgctttttgaagggagggctaccggttccatgcggctggacgattaccgcaggcagcatgttgcgatgatctaccagagctttcgcctgttcccgctgatgacggctatggaaaacgtgatgtaccccatggagatgcgcaaagtgccgggcgcagaagcaagaaaacgggcaacggggctgattgcgcgcgttgggttgccggaaaatgtgctgcaccgctatcccgccatgctctccggcggagagcagcagcgcgtggcaattgcccgcgcgcttgcgatggataccaggcttttgctggcggatgagccgacgggcaaccttgataccgcgagcagcgaaaccgttgtgcgcatcctgcgggatcttgcgcatgaggaagggtattgcgtcatcatcgttacgcacgatccggcgattcttacatatgccgatgaagtttaccgcatgacggatggcgtgcttcggagagaagctgccgcagaaggcgcttcctccggcgtggtgtaa

SEQ ID NO: 216 - DNA, 1500 bp, Unknown
  Description of Unknown: Clostridiales sequence
atgaacatcagagccatcggattctatatcggccatattcttcggatcgaaggcgtactgctcgttccggcgctgcttatcgccctgttttgccatgagcgggagtcccttcacgctttcgggatcaccatactcatcctcgctgtgctgagcatggcccttctttcgctcgggcgccgcgggccgttttggaagcgccgccgcgatgcggaaaattcacgctttggcgaaggcatccatgcgcgcgaagggttcgtaatcaccgcgctcggttggattgcgctttccttgttcggcgcgttcccgttttacctaagcggtgcaattcccagttttgccgattgctggtttgaaaccgtgtccggtttcaccacgaccggcgccaccatcctttctgagattgaagggctgcccaacagtcttctttactggcgttcctttacgcactggatcggcggcatgggcgtgctggttttccttcttgcaatcatccccatgtccaagggaaacggggaaacgttccatttgctgcgcgcagaaagccccgggccttccgttggcaagcttacgcccaccatgcgccacacggcgcgcctgctttacgcgatttatgtagcgctcaccgtcatcatgatcggttttctgctcgccggcggcatgccgttgtttgacagcgttgtgcacgcgtttgcaacggccggcaccggaggtttttccatcaagaacgccagcattgcggcctatgacagccattatctgcaaaccgtgatcgcagtgttcatggttcttttcggcgtaaacttcaatgtgttccatttaattctgtgcgggcgggcatcgcaggcgctgcgcagcgaagaattgcggacttatctcggcattattttcggcgcaacattcctcatcgcactcaacatccagccgcagttctcatcgttgggcgatgcgtttcaccacagcttctttcaggtttcttccatcatgacgaccaccggtttttcgacggtggatttcaacctctggccggaattttcccgcatgatcctcatcgcgctcatcatcatcggcgcatgcgcaggttcaaccggcggcggcatcaaggttgcgcgcgtcatcatcctctggaaagcgctcaagggagaaatgcagcgcatgctacgcccgcgcaccgtaaaggtcgtgtgtatggacggcaagcagctcgacagccatgttatccgcggcgtgttcgcctacatgactgggtttatcgccgtgtgcctgctttctttcctctgtatttccattgaaaactacgatatggaaaccactgttacttccgtgttgacctgcatcggcaacgttggcccgggccttagcgtcgtcggcccaatggggaatttcagccatttttccatcctgagcaagctggtgctctctgccgacatgctcatcggcaggctcgagattttccccttcattcttctgttctccccaacgacttggaaaagcagaacctga

SEQ ID NO: 217 - DNA, 1158 bp, Unknown
  Description of Unknown: Clostridiales sequence
atgctgaagctgtggaaaaattgtgacctttatgcgcccgcgcacctcggaaaacaggatatcttggtgctgggcggccaaatttggaagattggttccgacctgtccgcatgggaagccattccggaaatcgaagttcttgatttgggcggttcgatcgtttgccccggcctgattgatcttcacgtgcacgtaacaggcggcggcggtgagcaggggccggcctcccgcacgcccgaaattcagctgagcgagctgacaaagaacggcgttacgaccgttctgggccttttaggcaccgacggcatttcccgcagccttgaaaacctgctgttcaaatgctgcgcgctggagcaatacggccttacggccaaaatgctgaccgggaactatcggtatccttctccaaccctcacgggcgacgttgcgcgggacatcgccctgattgaccggatcatcggtgttaaaatcgcggtttctgaccaccgcagttccaacatttccggcgaggagctcgcgcgccttgccacggaagtgcgggtcagttccatgttggcaggcaaagccgggctcgtcgtcatgcacatgggcggcggggaacaacgcatggctccactgttttgggcccttgaacattccgatgtgccgccggaaaccttccttcccacccactgctgccgctctccgcagctgatcagcgacgcggtccgcttcaataaaatgggcggcacaattgatttcaccgccgatgttgccgaaagcgaagcgggaaccgccgcagcagtttattccgccttgcagcagggcgccgatccctcccgcatcaccatgagcagcgatggctgcggaagccagcctgttttcgacgcccatggagcatgcaccggcctgacctactcaacccccgctacccttcttcaggaattgcggcggatggtttgcctgaacggcatttcctttgacaccgcgctgcgcttctttacggaaaaccccgcccgcgtaatggggctcgcaggcataaagggtacgctccgccccggggcggatgccgatcttctcgcattggataacgggtatgcagtgactcatttgatggcgcgcggaaagccctttgtgtccttcggcaaggcggtatgcaagggcacctttgaaccgtaa

SEQ ID NO: 218 - DNA, 1692 bp, Unknown
  Description of Unknown: Clostridiales sequence
atgccctttacatcccccctgccgcgcgattataatagaacagaaagcggcacgctgcgcgctcccgcgactgatttcgaacagaattattttttatataatgaggtaaccggcaaaatggctgaaattgcaaccgaaaacaaagcgccttccagcggaaaaaagctgaaagtctggctgattgtgctcgcagccgtgctcatcgtaggcggtgtcgtcctttttctcaagatcaaaagcgacagggatgaagctctgcgccaaagcatcatcggttccggaacatttcaccctggcatcaccgttgcgggcgtagatgtttcgggcatgacgcctgataaagcggcggaagcactcaaagaggctgaacaatcgttggttcaggatgtttcgttccgcataaccgacggcgagcacacctataccttcgatcagcctcatttcgacatcgcgtttgataccgaggccattttggccgaagcaatggcgcttggccgcgagggcgatttggattcattgcaggctgagcttgcggacattgcggaaaatgggcgcagctttgacctttcctataccgccgtgccgcgcgacgcagagagctttgttgcggaaatggcagccgaactcgatatgcccgtcacagacgcgacgttcagcgtaaagcagcttgaattgaacgaagataccgaagcgcttgatgtggtgaatatcggatttaccgaagaagagcttgtcgcaggtgcggatttgcgtgataaacggtttgatttcaccgaaggcacagcgggccgctgcctggatcaggacgcgcttgtggcggagatccgggaacgcgccgaagcacgggaatacggcgaaatcaatttcgagcttcagccgctctatccctccgttaccgtcgccacgctcaagcagtccctcgtgttgcgttcaagcgcgtggaccagctacgcaaagggcaactacggccgtgcaacacgcgttcacaacatgacgaaagcctgtgggttgatctacggcacggtgctgcagccgggcgatgttctctcctgcaacgacctgctcggaccccgctatgaaaaatatggctggcaaatggcgcccgcagtcattgaaggcggtgctgccacagaggatcagcccggcggcggcgtatgtcaggtttccacgacgatgtataacgctgtgttgatgggagattatcaaatcgtctaccgtcaggcgcattcaagccgtctgagctatgtgaagggcggcctggatgcaaccatcaacacgggcacaatcgattttaagtggagcaacaacacagaggccccgatttatgtattcacctggatcgacaaaaacgaaaagaaaatctggtgcgagatttacggccttccgttctccggtgattttgacgaaattgagctgtattccgacgagaaggagccgatccagcccaccgcggacgaattcattcccaacgcttccctcacctacccctactggatggtaaagaatgccgccaagaaaggctatgtttacgacacctataagatttacaaaatggcgggtgcagaggtgcgccgtgaaaagatagccacaacaacgtataagatgcatccaaaccgctattttgtctggccgggctatgttccgggcactccgttgcttccggaatacaaattgaccccagttgtcgaataa

SEQ ID NO: 219 - DNA, 1383 bp, Unknown
  Description of Unknown: Clostridiales sequence
atggaaggaatcatcgccgcagtcgttatcgcagtgctgctgttctcgctgcttcttgtgctgctcacgcgctacaagaagtgcccgtcggataagattatggtcatttacggccaggtgggccgcaacaaggatggttcaagcaaatcgtccatctgcattcacggcggcgcagcgtttgtctggccgctcgtgcaggcataccagtttctggatctcacgccgatgtccctgcaggtagaccttgtcaacgcgctttcccgccagaacatccgcgtagacgttccctcccgcttcacggttggcatctctaccgagcagggcgtcatgcagaacgcggcggaacggctgcttggcctgagccttgcttccatccaggagcttgccaaggacatcattttcggccagttgcgtctcgttgtggccacgatggatatcgaggagatcaacactgaccgcgacaagttccttgaagcggtttcccgcaacgtggaaaccgagctcaagaaaatcggccttcgcctcatcaacgtgaacgtaaccgatatcagcgatgagtcgggctacatcaccgcgcttggccgcgaagccgccgcaaaggccatcaacgatgcgaagaaatccgttgccgagaaggaacgcgacggcgccatcggcgaagcaaacgccaatatggaccaacgcatcaaggtggcgcaggcaaacgcgaccgccattcagggtgaaaacgatgcgcgcatcgatgtgacgcgctccaacgccaaactgcgcgagcaggaagcggaagcccagcgcatcgccaccgcagcggaaaaggtacaatcggcaaaagcgctcgaggaatcctactccgcagagcgcgcggcagaagaagcgcgcgcggcgcgtgaaaaggctacgcttgaggcggacatcatcgtgaaaaccgaagtggaaaagcgccgtattgagctggaagccgaggcgcaggcggagcagatccgccgcaaagcccgcggcgaagcggacgcaatctacatgcgcatggaagcggaagcccgcggcgcgcaggaaatgctcatcaagcaggcggacggtttcacgcaggttgtggctgcggcaggtaatccttccgatgcgctccggctgatgcttgcggacaagatggaagctctgatgcagattcaggtggacgccatcaagaacatcaagatcgacaaggtgaccgtttgggacggcgcgaacggcgaaaagagcgccacggcgaacttcctttccgggatcgtcaagagcatcccgcccatgcaggagctgttcgacatggcgggcatgcagctgccaagctacctcggcgcgcccaaggctgaagaagcgcccgcggccccagaggtcacggcagaataa

SEQ ID NO: 220 - DNA, 699 bp, Unknown
  Description of Unknown: Clostridiales sequence
atgaatacgaaatcggtcacaagaaaaaagaagcggcctgccgtgcgtacgcgccgcgtgttgtttgctttgcttgccgctgcggcggttgtttgcctgttttttggcgcggaggccattgagcgtgccgtgaaacgcgcggaatacgtgccgcttacggcggaggagatcgactatgctctgctgcgtggtcaggaggctgagacggaggatgcgcgcctttcggttgcgcagtgcgccgtaagccttgtggacaaagtacattacttctggggcggtaagagcagcgccatgggcgaggacccgcgttggggcgaactgacggaggtcacgagcgcaggcagtgaaagcacgggcacagaaaagccttacgggctcgattgctccggctttgtggcctggtgctttatccagcaggggctcagcgccgccgaggtggaggagcagatcggcatgggcacctggacgcagtgggacaggacggagggaatcgcctggaaggatctgcgcgtgggagattttgtgtttcagaatgcataccccaccaacaagggcaaccacatcggcatctgcatcggctttgatgaggcaggcgcgcccgtcttcgcgcattgcgcggcagggttcgacaatgttgtcgtgacccgggcgggagacgtgttccgctatgcacggcggcccaatttttatgcacaataa

SEQ ID NO: 221 - DNA, 816 bp, Unknown
  Description of Unknown: Clostridiales sequence
atgaaacgttccctcgcctgccttctcgcgcccgcctgccttgcggcggccctttgtgcagggtgcgcattcggcccgcaagccacgcctgcgcacccgccggtagacgtgacgctcgtacccgaaacagcagcgcctgtactcacgcccagcccaactcccgtgcccagccccactcccgcgcccacgccggaacccacaccttccccaacgcccacgccggaaccaaccccttacaaaagcgcagactatccccttccccccaaaagcctgcgcacgcgggagggtggacgttacccggaagaagcgcggctcaatgaaaatcccgatcatttttacaccgtagtggatctcacaaaccaggcggtattcgtatatgaaaaggacagcgccggcgaatacaccgtgctcgtgcgggagatgatctgctcctccggcatcgaagacggccaccgcagcccacgcggcacatttaagatgggcgaggattacaagcgcttcgctttcttcgtgcattttgattgttatgcgcaatattggtcccagatccgcgggcggatctacttccattccgtgccttattccgaacgggatgaccgctacctgatggaagacgaattctggcttctcggccagccggcctcacacggctgcatccgccttctgccggacgacgcgcaatgggtctatctttacctttgccccggctccaccgtgaccatcacggacgagcttccggcggatgcggcgctcgtggcccgcctactgcccaaagaaacgcccacgccggattgttatgaaatcgcatccgattaa

SEQ ID NO: 222 - DNA, 738 bp, Unknown
  Description of Unknown: Clostridiales sequence
gagactgcaatgaaaaagctcgaacaggtttatgaaggcaaagccaaaaaggtgttcaaaacggacgatgagaaccttttcatcgtggactacaaggacgacgcaaccgcgttcaacggcctgaaaaaaggcaccatcgccggcaagggcgcaatcaacaaccgcatgaccaacagcatgatgcagcttttggagcagcacggcattccgacgcatttcgtaaaggaactttccgagcgggagacgcttgtcaagcatgtgaaaatcgtgcccattgaggtgattgtgcgcaacgtggccgccggctcgcttgcaaagcgcctgggccttgcggaaggcacgcgcctcaagagcaccgtgcttgaatactgctacaaaaacgatgaattgggcgacccgatgatcaacgattatcacgtttacgccatgggccttgccacgaaggaagagcttgaaaagatcgcggcatactccttcaaaatcaatgagatcatgaccgcgttctttcaggaaatcggtgtggatttgatcgacttcaagctggaatacggaatcaccaacgacggaacgctcgtgcttgcagatgaaatttccccagacacctgccgcttctgggatgtgaaaacaggcgaaaagcttgataaggaccggttccgccgcgaccttggcggcgtggaggaagcatatcaagaaatgatgaagcgcctcttggcgcacaatgcgggcgggcagaactga

SEQ ID NO: 223 - DNA, 1215 bp, Unknown
  Description of Unknown: Clostridiales sequence
atggcagtattagacaagttcaagaaaaagaagattcagggtgttgacgataccgagtacctgacgctgcgcgacgaacggcgcatcagcaaggaaaacgcgaagattacgcgtgagtttgagcgcaacaaggcgcgcaagaacgtgcccgaatcggaatacctttcccaaatgcgggacagcaggaacgttgttgagttcgatgatctgcacacgtatttttataccgatatcggtaccgtgaaggcggtggacggcgtaacctacgacgtgccgcagggcaccacggtggggatcgtcggcgaatccggctgcggaaaatccgttacttcgctctcgctgatgcagctcgtgcaggcgccgcaggggcaggtcgtctctggcgaaatccgctatcttgcaagcgatggaaaatgctacaacatcgcaaagatgcccagaagcgagatgctgcatatccggggcaaggagatctccatgatcttccaggagccgatgacaagcctgaacccggtgttcaccatcggcgagcagatggacgaggttgtgctgctgcatgaagaaggcgctacggcggaaagcgcgaaagcgcattccatcgagatgcttcagctcgtcggcatcgccatgccggataaggtgtatgcaagctatccgcacgagctttcgggcggcatgcggcaaagggttatgattgcaatggcactttcctgcggcccccgcctcatcattgccgatgagcccaccacagcgctggatgttaccattcaggcgcagattcttgaccttttgcgcggcattaaggataagatcaacggcagcatcatgctcatcacgcacgaccttggcgttatcgcggaaatggcggattatgtcgtggtcatgtatgcgggccgcatcattgaaaagggcaccgtgcgggagatcttccacacgccgaagcatccgtataccgttggcctgatgcgcagcaaaccgagcgtaaacaaagcggtggatcggctttacagcatcccggggcaggttccgaacccgatcaacatgcccaaccactgctattttaagaaccgctgcgaaaagtgcaccgaaaagtgcggcggcgaatatccgccgatgctgcagttctcccccacgcattttgccgcctgttacctttacgaggaagaccgggatgcggtttactttgatgcgctcacgggcaaaaagagcgaatga

SEQ ID NO: 224 - DNA, 705 bp, Unknown
  Description of Unknown: Clostridiales sequence
atgggcagacaaaagcagaaaaaacgggaaatacgagccgaaagaacagaatttgcgcagttttgcgccatggcgttcggagagctttggtatttgcttaaactgaatcttctgttcctcacagcctgcatcccaattgtgacggttccgatggcggttacggcagggctgcgcatcacaagcagccttgcggcaggcaaacagcccccgctttggcgcgcattctgcagcgcgttttttggtgaatggaaacgcgcgctggcctgcggatgggcgcttaccctgttgcaggcgctggctgggttcggcgtgtatgcatatgccgtaatgatggaagcaaacccgcttgcgctgcttgcgctcatcgcagccgcattgatttttgcggctcttttctccttcagcctttatttttattccatgctggccatgtgcaggctttccctgcaggacatgctgcgcaacgcgctcatcctggccgtttcggaacgctggcgcaaccttgtggcaacccttgcagcagtgctgtgcggcggggcgtccgtgctgttttttccggttacgctgccgctcgccatattccttctgcctgcgcttgcgctgcttgcggcttcttgcgcaatcaggccgggccttaagcgctgcatgcgggaggatgaaaacactccgggcggcgcaggtgcggagccgcaagaaggacggtga

SEQ ID NO: 225 - DNA, 891 bp, Unknown
  Description of Unknown: Clostridiales sequence
atgacagtgaaaaggcatgcggagcgtgtgcgcccaaacgcccggcaggtgcgtgaaacgctgatgcgtatcgtgtttctggttacggcctgcatttccatcctcgccgttatactcatttgcatcttcatgtttgcaaacggcatccccaccatcgcggaaatcggccctgccaattttctgctcggcacgaaatggaaaccgctcaacggcatcttcggcattctcccgatgatcgtcggaagcctgtatgtgacggcgggcgccattctcatcggcgtgccggtcgggattctctgcgccgtgtatcttgcccgtttctgttcaaagaggctgtaccgggtgctcaagcccctgattgacctgctcgcggggattccttccatcgtgtatggattcttcggcctcgttgtcattgtgccgctgattcagcagctcacggggggcagcaacggtaaaaatatcctcacagcatccctgatgctcggcatcatgatcctgcccacgatcatcagcgtttcagaaagcgcaatccgcgccgtcccggaaagttattatgaaggcgcgcttgcgcttggcgcaacgcatgagcgcagcgtatttttcgccgtacttcccgccgccaaatccggcattctcgccggggtgattctgggcgtaggccgcgccatcggggaagcgaccgccgtaaaaatggtggcgggcaaccagccaatcctgcccacaagcatcctgagcggcgtgcgcacgctgacttcgaacatcgttgtggaaatgggctatgccgaaggcctgcaccgggaagcgctgatcgccacggccgtcgtgctctttgtgtttatcctgttgattaacctttccttctcagcccttaagaaaaaggagggataa

SEQ ID NO: 226 - DNA, 1785 bp, Eubacterium sp.
ggaggcaatgtaataatgaaaaaagattcacaaaatcaaaattcacaaaaaacctccagccagacagttaaaaaagtaataataaggataaaaaaatactgggtatttttgatattatcaattattatggcgacaataacagtagcatcgtcactgtatgtgcctatacttgtcggtaatgcaattgattatattattggaccatctaatgttaatttcaggctgattgcacagattcttgctgaaattggcgttgttataggaataacagcactttcacagtggattatgaatatatgtaataataagattacatatcatgtaacaagagatataagagatgaagctatagaaaagatagaacatctgccattaaaatatatagatggacattcatacggtgagattgtcagtcgtgttattgccgatgtagaccagttcgctgacggcttattaatgggatttacacagtttttctcaggtgttatgacaatacttggaacactcggatttatgttatcaataaatgttaaaattacacttgttgtagttcttattacaccggtttcattttttgttgccagttttattgcaaagagaacatataaaatgttcaagcttcagtcagagactcgtggagagcagacagctctcattgatgaaatgattggaggtcagaaagttgtaagtgcttattgtcatgaagaagaggcagtaagacagtttgatgaaatcaatgacagacttcagaaatattcgcttaacgcgatatttttctcatcaataacaaatccttcaacaagatttgtaaacagccttgtatatgccggagttgcagttacaggtgctatatcagctatatatggaagacttactgtaggacagctttcatgttttttaagttatgcgaaccagtatacaaaacctttcaatgaaatttcaggtgttgtaacggaacttcagaatgctatagcatgtgcttcgagagtatttgaacttatagaggaagagccggaagctgcagagatcagtaatgcggttaatcttgaaaatgttgacggacgagttgatttaaatgatgtagaattttcatatgtccctgataaaaagcttattgaagattttaatcttcatgtaaaaaaaggtcagaaaattgccattgtaggacctacaggatgtggtaaaacaacaattatcaacctccttatgagattttatgatgtaaacagcggctcaatagatgtgtcgagtgttgatataagggagcttacaagacgttcactcagggcgggctatggaatggttctgcaggatacgtggcttaaaagtggtacaatccgtgaaaatattataatgggtaagcctgatgcaacagaggaagaaataatcgaagcggcaaaggcagctcattcacacggattcataaaacgacttccaaatggttatgatacagtaataggtgaagatggcggcagcctttcacagggacagaaacagcttttgtgtataacaagagttatgctttgtcatccacctatgcttattcttgatgaggcgacatcgtctattgatacgagaactgaaatcaagatacagaatgcatttaataagcttatggaaggaagaacaagttttattgttgcacacagactttctacaatccagtcagcagacgtgattctggtaatgaaagacggtcatattattgaacagggtaatcacgaagaattacttgctaagaatggattttataagaaactttatgaaagccagtttgcacaatag

SEQ ID NO: 227 - DNA, 1488 bp, Eubacterium sp.
atgcaggattttattaaaattaataaagatgataatgttgctgtagcattaaagcctattgcaaaaggcactactcttaatgttgcaggaattgatgtgacaactgtagaagatattccacagggacacaaatttgtaattaaagctatcaagaagggtgaaccggttgttaaatatggtttcagaattggatttgcacaggctgacattcctgttggagcatgggttcatactcataatttaaagacaggtcttggtgaattacttgattatacttatgagcctgaaggacataaagatgtagagccaacagaaccagcttattttgaaggatatatgagagagaatggcaaagttggtgttcgcaatgaagtatggattgttcctacagtaggctgcgttaattcaatcgcaagagcaattgaagcaacagcaagagcaaataagcctgaaggcgtagatgaagtagttgcatttacacatccttatggctgttctcagacaacagaagaccaggagaatacaagaaagattcttgctgaccttatcaatcacccaaatgcaggtgcagtgcttgtactcggtctcggatgtgaaaacagccgtatagaagttctcaaggattatataggtgaagtaaatccggacagagttaagtttttacaggttcaggatgttgaaaatgagcaggaagaagcagagaagcttatgaatgagcttatggcttatgctgccaacttcaaacgtgaaaaagttaatgcaaaagaacttattattggtatgaagtgcggtggttctgatggattgtcaggtatcacagctaatcctacagtaggtcttttctctgatatgcttgtatctaagggtggtacaactattctcacagaagtacctgaaatgtttggtgcagagacaattcttatgaacagatgtgccaacaaggaactttttgagaagacagttcaccttatcaatgatttcaaggaatactttattaaaaatggacaggagatttatgaaaatccatctccaggaaataaggatggcggtatcacaactcttgaagataaatcacttggatgtactcagaagtcaggttcatctcttgtaaagggtgttcttgcatatgcagaacctgttaatactaaggggcttaatcttctcagtgcaccgggaaatgatcttgttgcagctacagcctgtgcagcatcaggtgcacagatggttcttttcacaactggtagaggaacaccatttgcatcaccggttcctactgttaagattgcaacaaattcaagacttgcaggaaataaatctaattggattgattttaatgcaggtagaattgttacagatgaccttccacttgaagatgctgcaaaagaacttttccagcttgtgcttgatgttgcttcaggaaagaaagttaaagctgaaattgcaggtttccatgatttagcaatctttaagcagggtgtaacattataa

SEQ ID NO: 228 - DNA, 1938 bp, Eubacterium sp.
atggagattgttatgtcggttcaggattatatgtcagctttaaagctggggaaaaaagagtatcatgcatgtgtcaataagggagcatatccatatcttccggttcttgagaatcttgtttcagatgatgagattgattctgaagtaagcctttcggttgaccagattccgttaaggcttgttgtcggaacatgtaatgcttcaagaactaatgcatttgcgggcaatttcatgccgcttcttgactggggaacggaattttctgcaaaatgggcgagtcttagtgacagccaggttaatgaaggaataagagacccgattaaagtatatgaatatatgaacaagttttatgtacttgaaggaaataaacgtgtaagtgtattaaagtattttaatgcagttacagtcaatgcagaagtaatacgaaagattcccaaaaagtcagataatccggaagttaagatttattatgaatttatggaattttacaaatgcacaaggctcaatgatatatatttcagcgaagtgggaagttttccgtcacttatgaagcttgtgggaattgagccggataaaaagatggatgaggatgccaaaaaagattttgtgtcatgctttttatcatttaagaatgcttttgattcaagaggcggcgacagatttgattatccggtaggagacgcattcctgagatttattcacattttcggatatgatacagttaaaaagatgacaccgtcagatatggcaaagaatgttgcaaaatcatgggctgaattcgtattgttgtcagaagacagtgcagttgatttaaagatgaatcctactgtaaatgagcctaagaaaaacattttgagttatctccttcctaggccagacagcggaagcaagaaactgaaagttggatttatatatgaaaatacaccacaggattcggaatggtgttatgcacatgaacttggaagacagtatatagatgatacatttggtaagcagatagagacgataagcattactaatgtcaagccggaaaaagatgatgagcatgctattgagatgatgataaaaaatggtgcagaccttatatttgtcacatctccggcaatgactatagcaagtgtaaagatggcgattgcacatccggatgtaaagattcttaactgttcgctcaatacatcgcataagtatataaggacatattatgcgagaatgtatgaagcaaagtttcttacaggggttcttgcaggagcactggcaacacagaataagattggatatgttgcacagtatcctgtttatggtacagttgctaatattaatgcatttgcacttggagcgaagtttgttaatccaagagcgaagatttatctgaaatggtcgtctgtaaaaggtatcaatattgaagaagaattcaagaaagaagatattcactatatttctgaccaggatatgataactccacagtgtggttcaagacgttttggattatataataatgaaggcgtcggcaacagacagcatatagcaatgcctgtatggcactggggtgtattttatgaaaagcttatacagagcatactcagcggctcatggaagaaagatgaggattctgacagcggcagggctcttaattactggtggggcatgtcatcgggagttgtcgatttaatctgttctaataaagttccggtagagacaagaagactggttgaactatttagaaaagttatctgtaacaatgaatttgaaccattttctgatgagttatatgaccagaaccgacatcttcagaataaaaagggacatgagatgagcccggaggatattatcacaatggattggcttcttgataatgtagttggtgatattcctgcaattgatgagcttgatgaaagtgcaagagcaataatggtaagtcaaggaattacgagagaataa

SEQ ID NO: 229 - DNA, 1455 bp, Eubacterium sp.
atgacatttttgcaggagtatagggcgatgaatagaagaagagttcttaaaattcttggtaaaattcttatgacagaggcgatgcttatggtaccgtctctgatagtttcactgatatatggcgatggtgacactatgtattttattggtacaattgcatttgcggcaatagcaggatttatcctttcatgtgtaaaagcaccggaacgtaagatgggtagccgggatggatactgtatagttgcacttgcatggataattatatgcataataggtgctgttccgttgtttcttacaggacagttcaggtcttactggtctgcactttttgagatagtttcgggttttacgactacaggtgcatctgttctttcaaatcctgaatatctgccacatggtgtacttttctggagaagttttacgcactgggttggcggaatgggcgttcttgtatttgtacttatgataatgcctatggaaaatgaaaattcaatgcatcttataagagcggaggttccgggacctgtagccggaaaacttgttcctagaatgaaaaaaacatcaataattttatatggaatatatactgctatgacagcaatacttgttgttttattgttatttggcggcatgaatgtgtttgatgcttttgcaacagcatttggtactgcgggaacaggtggatttgctacatcatctgcaggcatagcaggttatgacagtgcatatatagagattgtactcgggattttcatgcttttatttggtgttaattttaatgcatattatcttatacttataaagagatttacagatgcgttaaagattgaagagattcaatggtattttgggattgtaggagtttcagttattgcaatagcaatcaatatatgccatagcctgtcggcagtttccgtgtctttgagacaggcgtttttccaggtgtcaagtattataacaacgacgggatttgcaacggttgactttgataaatggccggagttttcaaggcatcttcttgttctactgatgataatcggtgcatgctcgggttcaacgggcggtggaatcaaagtatcgcgtgttattgttatggtaaagagcttttttaatgaaataagacatattatcaatccgagctctgttacagcagtgaggacaaatggcaagcctatggataaagagacacttatagcggtgagagtttatgtagcatcgtattttattttgatttgtctgtttacactggtcatatcacttaacggacttgactttacaacaaatctgacagcagttttatcgtgttttaataatataggaccgggacttaatcttgttggcccaatgtcaaatttctcatgttatgccgactgggcacaggttatactttcagttgccatgctcacgggacgacttgagatatttccgatgttcatgctgttttcaaaatcggtt

SEQ ID NO: 230 - DNA, 1287 bp, Eubacterium sp.
atgaacagacagagtgatgtgattgaaaattgggaatatgggcttcttacattgcttaataatgccctaaatctgcctgtatctgaaaaaaatgatgctattgaagtaaaaagcattattgaagatgtaagtagaaaactcgattcagattctatacagaaatttaatgaatatagtgaagatgaatggaataagattatcaagacggcagacggccacggggttctgccgttaatagcagatgagttatattttatggattgcgtgcctgataatattaagattaaggcggttgcaaaagcaaaaaaaattgttatccagaacagccgtctttcatacctgactaatgagtatatgagcattttaaatgatgccggaattacggcagtgcttttaaaaggtgccggaacggctgcatattatccggtaaagagtcttagaaaatcaggtgatattgatatactcattcctgataagctgcagtttgataaagctgtaagtgtgcttgaactgcatggcgtggttataatgggggaacagcatgcatggcatcatgttgaaatgcataatgagaccggcgtaataatagaacttcacagggcactggcagaacagttcgatgatgacgatgtgaataaaaagattgagcagtatactgaagaaatgtcagttcataatattttaaaaaatattgatggaatgaatatagtatgtcctgagatggcatgggaagcattaagtcttgctattcatatgctgcaccattttgtgagagcagggttcggactcaaacttttgtgtgactgggttgtattctggaatagcgaacatgatgaaagtcagaaaaatacattttattcaatgataagcagcattggaataacaggttttgttaaagctgtgaatataatctgtataaagtatcttggaatgaaaaaagaaaatgttttttttatgatacaggatgaaaaaacagaagttaataccgatatattccttaaagatattatcgaggcacaggaatttggcagtaccaaagatgaaagaatggttgtgcttcgtggcagcaggtttgcagactatgtaagagagttccatcatcagatgaaacttaacaatcccgataagaaagataataagctgttgtggccttatctctgggttaaaacatttgcagtttttgtaagaaataacaggactgtaaggaaaacaacaatatgtagtgtactaaaaagtgcaggtgcaagaagcagggttgcatatgatatgaaactgtttaaaaaatag

SEQ ID NO: 231 - DNA, 1920 bp, Eubacterium sp.
atgggagaattcggaacgcatatgaataacgaagaacttagacgtaataaatacagaagaaaaaaggcaatgcttaggaaagtacaaaacaaaatgggcgttgccttttttgttataattcttgcactctttgcattggcagtgagaatacttctcatcaattataatcacggagaagcttattctaagacggtacttgaccatcagagttatacatctacaacaataccttacaagagaggtcagattcaggatgctaatggaacagttcttgcgtatagtgagagagtatacaacctgatacttgacccgaaacttatattgtctgatgaaaagtataaagaaccgacacttacggcattgacagaatgttttgatttaaaaagaagtgatcttgagtcaattcttgcaactaaaagcacaagccagtatgagaagctgttaaaagagctgacaaaagatgaaatctcagaatttgagagccgtgtggaagatacaaaaaataatccatatataaaaggtgtgtggtttgaagacagctatataagaaaatatccattttctacactggcggccgatgtaattggatttgcaagtgctgcaaatggcggtgagcttgggcttgaaaattattatgatgaggaactgtccggaaccgatggtatttcatacagttatgtaggtgaaaatcttgatgttgagacacaggagaaaaaagctgaagatggctataatcttgtgacaacaatagattataaagtacagagcataattgaaaataaaataaaagaattaaatgtcgaaagaccatcaaagtcaacggctgtaattgcaatgaatccaaagacgggggagattcttgcaatggcaagttatccgacatttaatcttaacaatccgagagacctgagtggtgtgtacacacaggaagaattgagcacaatgactgatatagagatgactaatgccatgtatgcattgtggagtaattattgtgtttctactatatatgagccgggttcaactttcaagccatttacggtagcagagggacttgaggaaggtgttatacatgatggcgatacattttactgcggcggtttcatggaagtcagcggaagcataatcaactgccatgaacacagcggacatggtactgttacagtaaaagaaggtcttatccagtcatgtaatccgactatgatgcagattgcagcaaagcttggtggtgtgaaaattgcgaaatatgaggcactttttggatttggtaacaggacaggcattgatttgccgggcgaggaagccggtcttacaatcggtgagaagatgaaagtcattgatgcagcatgtaactcttttggacagaatatcaatgtaaatatggttcagatggcagcggcattttcatcacttgtaaatggtggtaattattatcagcctcatatagtaaaaagaattgaaaagagtacaggagaagtcgtaaaaacgatagaacctaatcttgtaagacagactgtaacatcagagacatcacagctgctacgcacatatttaagagccggcgtagatgaaggacttgccagaaagtcaggtgttgcaggatatgctatcggtggtaaaacgggaacggcacagaaacagccgcgagaagataagaagtgggttgtatcttatataggatgtgcacctactgatgacccacagcttgtgttgtatacagtaattgatgaaccatttgagacaaacggaacatcaggaagttctcttgatgcacttaatctttcaagaagtatctacgaggaggctcttccatatcttaatatttataaagatattaaggcagaaccggttgatacaaccaatagtgcagttgaatcaactgtagaacttccggatacaacaaatacaaataataattaa

SEQ ID NO: 232 - DNA, 2229 bp, Eubacterium sp.
atgctctttaaggatagcttgaagggcatccttttttatgcagacgacaaggtaatcacggcaaaaacagggaggattgttatgggacataaatcaaaaagaacatatgataaagtgtttgaagacagaaaaaatatgctggaggatcttattttgcataacgacctctatgtaccaatgaaaactaaggagcttgcaatacttatgcaggttccgaaagaggacagacatgagctgcaggcagtgcttgattcacttgtagcagagggcagaataggcgtatcaaaaaaaggcaaatacagtaagcctgaaaatacagctattattggaatataccagaagacaagccgtggttttggttttgttgttgtcgaaggcagggaagatgatatttttatcaaagaatctgacgatggcggagcatttcatatggataaagttatggttgccataacagcagaaaaacatggagataagagatgtgaaggcaagattctcaagattcttgagcatcagataaaagaggtggttggaacataccagaagagtaaaacatttggatttgttgttccggacaataaaaaaatctgttatgacatttttgtgccacaggaaaagtccatgggggccgtgacaggacataaagttgttgtagagcttacttcttatggtacattgaaaaagaacccggaaggtcgcgtaaaggagattatagggcatattaatgacccgggaacggatattatgtctataataaaagcatatgaccttccgatggaatttcctgaaagtgtaatgaaatcattaaatgatattcctgatgaactgtcgcctaaagattatgccggaagagttgatttgcgtgatttgcagacagttactatagatggtgaagatgcaaaagacttggatgatgcaataactgtatctgaggaaaatggaatctatcaccttggagttcacatcgcagatgtgagcaattatgtaaaagaatacagtcctcttgacaaagaagcatataagagaggcacaagtgtctatcttgtagaccgtgttataccgatgcttccgcataagctgtccaacggaatatgttcacttaaccagggctgtgacaggcttgcactcagctgtcttatggatattgatgaaaaaggcaatgtgatttcacataagatatgtgagtctgtaatcaatgttgacagaagaatgacttatacaaatgtaaaaaagattcttgaaaatgaagatgaagaaattttaaacgagtataaagattttgctgatatgttcagacttatggaaaagcttgcactgatactgcgtcagagaagattcaaacgcggttcgattgattttgattttccggagacaaagattacgcttaacgataagggtgaaccggtggaaataaagccgtatgacagaaatacagcgacaagaattatcgaagatttcatgcttattgcaaatgagacagtggcagaagattatttctggcaggaaataccattcctttaccgaagtcatgaaaatcctgatcctgagaagataagaaggcttggaacatttatcaataattttggatattcgataaaaataggtgatgagattcatccgaaggagcttcagaagcttttggggaaaatagagggaagcgacgaggagaatttaattgcacgccttacacttcgttctatgaaaagagcatcatatacaacggagtgcgtaggtcatttcggacttgctgccaagtattactgtcatttcacatcgccaatcagaagatatcctgatttacagattcacagaattattaaagaaaatctgcatggtggtatgagtgataagagaagtgagcattttgctgctattcttcctgaagtcgcaaagcagacaagtgctacagaacgcagggctgatgatgcagaaagagatacagataagctgaaaatggtacagtatatggaaaaacatatcggagagacatttgagggtgttgtatccggaatgaccgcatggggaatatatgtagaacttccgaatacaattgaaggaatgattagtgtagcctcgcttcgtgacggatattatatttatgacgagaatcattatgagatggtaaatgagacaacaggaaggacattcaagctgggtcagagacttaatgttaaggttatcaactgtgataagattcttagaactatagattttgaactggcagaataa

SEQ ID NO: 233 - DNA, 2130 bp, Eubacterium sp.
tacgttgttatttacaataaaatttataaatggtataataatttaaaatgtttttgtttgatggagattattatgaagagcaagggcagaaatcagatttataaattgtcgggaaaactgaagtcatatattatgtggccgctatatgtaggcataatacttttaattgtcactgttgttatgtatgtcaaagatacatcctgtggtaatattatgctgggttttgtcatgctttatgcagttgtttacgggattatgattttttatctcagacccggaattatgcatgagatgatagaattctcttctaattattcacaggtacagcatcagcttttatacgaacttagtgttccgtattgcctgcttgacaataacggacgtgttctgtggatgaacagaattatgatggaaaaaactgataaaaagaaagatttccgaaaaaatatacaaagcatttttccacagattaagccggaagtatttccgacaggagaagatgcgaaagagatgcgtcttgcatataatggcagggattatcttgtagagatgaagcggattgctgttgatgcacttacgcagcaggttgatataattgagacagaacagaataattcgtttattgcgatgtatatgtttgatgagacagatattaacatgtatatccagaaaataaaggatgagcgttttgttgttggacttatttatattgataattatgaggaagcacttgaaagtatagatgatgtcagacgttcattatttataggtcttatagataagagagttaataagtattttgcgtgtggttctgcgatagtaagaaagatggaaaaagacaaatatcttgctattttcagatataagtatttagagaaacttatgtcagacagattcagtttactcgaagatatcaagagcgtaaaaatcggcaatgaaatgacacttacattaagtatcggtgttggcacaggtgcaagtgattatgcaaaaaattatgatgttgcgaaatcagccatggatcttgcacttggacgaggcggagaccaggctgttgttaaagatggcgagaagacactttactatggcggtaagagccagcagatggaaaaaaatacaagagtaaaggtgcgtgtaaaagcacatgcattaagacagattcttgaaccgacgcagacggtccttataatgggacataaacttgcagatatagatgcatttggttcggcaattggtatatatgtaatatgcagacgacttggcaagaaagcacacattgtaattaatgatgtgacaagcagtgttaagccatttatggacagattcattaacaatgatgattatccgagagatatgttccttttgaaagaagaagcaccggaatatgtagattcacagactgcagttattgttgttgatgttaacaaggctaagatgacagagtgtccggctcttcttgatatatgcaggacgataatcgtatttgaccatcacaggcagtcaagcgagcctattacaggggcagtcttgtcatatgttgacccatatgcttcatcagcggctgagatgattactgagatgattcagtatgttgaagatggtgtgaaaataaaggcatttgaagccgatgcactgtatgccggaatcaatatagacacgaatggatttaataataagtcaggtccgagaacatttgaggcagcagcatttcttagaagacatggtgctgatgtcacaagagtaagaaagatgcttcgtactgatatggcagaatacagggcagttgcacaggcggtaagcaaggcaacagtatacagggatgcatttgccataacagtatttgacggtgaaggagttgaaagtccgacgataggcggtgccaaagctgcaaaccagctgcttgacatatcaggaataaaagcatcatttgtaataacagcctacaataatattatatatataagtgcacgttctattgatgaggtaaatgtacagcttgtcatggaaaaattaggcggaggcggacatatgacaatcgccggtgcacagcttacggattgtactgttgaccaggcagtccagacaataaaagttacattggattcgatgatacaggaaggagaaatataa

SEQ ID NO: 234 - DNA, 2115 bp, Eubacterium sp.
aacatggatgtaagccagtatttagagatatttattgatgaatcaaatgaacatttacagagccttagtgatcagttaatgattcttgaaaaagaacctgaaaacagtgatacaattaatgaaattttccgtgccgcacactctcttaaaggtatggcaggaactatgggctataagagaatgcagaatctcacacatgatatggaaaatgtattctcagaagtaagaaatggtaatatgaaggtcacatcagaccttgttgatgtattatttcagtgccttgatgctcttgaagaatatgttaataatattcaggagacacaggatgaaggaactaatgataatgagcctataattaaggcactcaatgcatttattgcatcagaaaataaagatgctgcaccagctgaagaaaaacaggaacaacaggcagaatctgcaccggcagagaaacttcaggcagatgaacatggtatcagcatggaacttgctgattttgaaaagaatgcggtaaatgaagcacttaaaaaaggaatgcatgtttacgagattaaagtaacagttgacgaaaattgtatacttaaagctgcaagagcttttcttgtatttaagaatcttgaaggacatggagacattataaaatcagatccttcagtacaggatatcgaagatgaaaagttcgattttgattttcagattgttattttaacagaggaaagttttgatgatatcatcaagataattaagaatgtatctgaaatcaaagatgctgatggtgaagaaataacgaaggcttttccggaagaaaagaccgaagaggagccaaaagaagaaaagacagaagaaaaagctaagcaggcttcaaaagcacagtcatcaaatgataagaaagatgctaatggttcaaagaagccggcaggtgcaaaacagcaggctgccaatagtaaagcaaagcctgtcggacatactgtacgagttgatattgaaaaacttgatgtgcttatgaatcttgtcagcgagcttattattgcgaagaatggtcttgtttcagcaagcagtgaagaaggctcagagagcattaaccagagctttaatgaacagattgaatatcttgagagagtaacaacaaacttacatgaatcagtaatgaaggtacgtatgatgcctatcgagagcgtagtaagtaagttccctcgaatgataagagatttgagcaagaagcttgataaaaagatggaattatacatgtcaggtgaagatacagaacttgacagaacagttattgatgaaatcggtgatcctcttatgcacctgttaaggaattcagctgaccatggactagaaagtgccgaagtcagaaaagaaagaggaaagagcgaagttggttctattttccttgatgcatatcaggatggtaacaatgttgttattgaagtccgtgatgatggtaatggtattgatattgaaaaagtaaagagtaaagctatagaaaaaggaaatattacagaagaacaggctgcaataatgtctgataaagaagtaatagatctgcttttcaaaccaagtttctcaacttccgataaggttactgatgtatcaggccgaggcgtaggacttgatgttgttaaatcaaagattgaagcacttggcggtgatgttgaagttaagtctgtatatggtgaaggaagtacatttattataagacttccattgacacttgcaattatccaggcacttatggttaagctcggagatgaaaaatatgctatttctcttggctcaattcagacaattgaagatattcctgtaagtgagataaaatatgtacatgcaaaagaagtaatacatcttcgtggaaatgttattccgctcattcgtctcagagagcttcttgatgtaccgggagaacaggaagaacaggaaaatattactgttgtcatcgtcagcaagggagataagcaggctgggcttgttgtagatagtctcattggacagatggaaattgtaattaaatctttaggcaagtatatcaacattaataagatgataagcggtgcaactatcttaggtgatggttcagttgctttgattattgatgcaaatactcttgtctga

SEQ ID NO: 235 - DNA, 2655 bp, Eubacterium sp.
atggctgaatattcaccaatgatgcagcattatcttgcgacaaaaaaacaatataatgactgtatattattttacagacttggcgatttctatgaaatgttctttgatgatgcaataactgtatccaaagaacttgaacttacacttacaggaaaagactgcggacaggaggaacgtgcacctatgtgtggcgttcctttccatgctgccgagacatatatcaaccgccttgtatctaacggacacaaagttgcaatatgtgaacagatggaagacccgaagcttgcaaaaggcattgtaaaacgtgaagtaataaaaattgtaactccgggaaccaatcttaatgcacaggctttggatgaaacaaaaaacaattatcttttctgtatatattatcaaggagatgttataggtgtttcgatatgtgatttctcaacaggtgattattttgttacagaattaaaatcggaaaatgagcttattgatgagataaataaatttgttccgtccgaaataattgtaaatgaatactttgccatgagtggtattgatttaacagctgtaaatgaaaaactgaatatttcaatgtcaacacttgaaaactggtatttcgatgaggacagttcaatcaaaaagctgttatctcattttaaaatatcagcacttgacggtcttggtgtaaaagattatccgacaggtatcattgctgcaggtgctcttcttacatatctttatgagacacaaaaaagcgatatgtcacatattatcacgctcactccttatacaacaggaaaatatatgcttattgacagttcatcgcgtagaaatcttgaacttgtagagacactccgtgaaaaacagaaacgaggctcattaatctgggttcttgataagacaaagactgctatgggtgcaagagcactccggtctatgattgagcagcctcttattaataaagatgaaataataaacagacagaatgttgttgaagaactttgcaataaccagattgacagggaagaattacgtgaatatatgaatcctatttacgatctggagcgtcttatgacaaagataagctgcaagtcggcaaatccaagagatttgattgcattccgtaattcacttgaaatgcttccgtatataaaacaaattatcggtaatttcaaatcggatttatttaaaaaatattatgaagatatggatgatttaagggatatctataatcttattctttcagctattgttgaagaacctcctatatcaatgcgtgaaggcggaatgattaaagatggattttcagcggaagctgatgaattgcgaagagcaaagacagaaggaaaagaatggcttgcacagcttgaagaacgtgagcgtaacaatacaggaatcaagaatctgaaagttaaatataacaaagtgttcggttattatcttgaagtaacaaattcattcaaatcaatggttccggacagctgggttagaaaacagacacttactaattccgagcgttatacaacagacgagttaaaacatcttgaagatgttattcttggtgccgaagacaagcttaatagtcttgaatatgatttattcagccaggtgagagaacacattgcaacgcaggttgtaagaatccagtcaactgcaaaagcaattgcaatgatagatgtatttgcctcactttcagttgttgcaatgcagaataattatgtcaagccaaaaattaatgaaaaaggtgttattgacataaaaggcggcagacatcctgttgttgaaaaaatgatgaataatgatatgtttatcgccaatgatacttatcttgataatgcatcagaccgagtttcaattataacaggtcccaatatggctggtaaatcaacatatatgagacagactgcacttattgtccttcttgcacagaccggttcatttgttccggctgacagtgccaatatatgtattgtagacagaatatttacaagagtaggtgcatctgatgatcttgcttcgggacagtcaacatttatggttgagatgacggaagttgccaatattctaagaaatgcaacacctaagagtcttcttattcttgatgaaataggaagaggtacaagtacatttgacggtttaagcatagcatgggctgtggttgagcatatcgcaaatacgaagcttttaggtgcaaaaacactttttgccacacattaccatgaacttaccgaacttgaaggaacgcttgatggtgtaaataattactgtatagctgtaaaagaaaaaggcgatgatatagtatttttacgtaaaatcataaaaggcggtgctgataagagttacggaattcaggttgcaaagcttgccggagtgcctgatgttgtaattgagcgtgcaaaagagcttgttacggaattaagcgatgctgatatttcacagaaagcaaaagatattgcacaatattccaaaaagcttgataagctgaataaagaataccggaaagtagatgaacttgaagtaaagcagatgtcactttttgatacggtaagtgataatgacatagttgcagatattaaaaatcttgatataggacacatgacacctattgatgcacttaacacattatacaagcttcaggaaaaaataaataaccgctggtaa

SEQ ID NO: 236 - DNA, 2136 bp, Eubacterium sp.
gagactatgggcagaatatttaaaaatcttgtaccatactggaagtctgtaattatgatactggtacttcttgtactgcaggcgttttgtgatttgtcacttccacagtacacatcggatattattgatgtaggaatccagaataaaggtgtcggacatgttatgcctgaggccgtaacagaggatgaatataatctggcacagctttttatgacagacagtgaaaagacaatctggcaggaaagttatgacaatgataatggtatttacagatgcaatgtaaagagcgaaaagaaactgtcatcttatgatgatgaacttgttttaccgcttataattaataatcagatggcagatgaagaaaaacagaagcttcttgctatgtcacaggcaggaatgttaagcgatgaaatggtttcacagatcagggaaaaagctgaagaaacagttgatacgatgggttctacacttgtaaagtcaatgggaatcgcatatgcagtaaagcaggatactaatgctggaattgatatggatgcattgcagacaaagtatctgttgggttcaggagccaagatgatagcgatggcacttcttgttgcacttactacagttcttgttggacttgtagcttcaagagtagcagccggaatcggacgtgatttgcgtggcagtgtatacaagaatgtaatgaatttttcaaatgcagagatggataaattctcgacagcatctcttataacgcgaacaactaatgatatacagcaggtacagcttgtgactgttcttatgcttcgtatggttttatatgcacctatactcggtgtaggcggtatttttaaggtgatgcagacaggtgcaggcatggaatggattatagcacttgcggtgcttataataatcggaattgtaatggtacttatggtagttgcaatgcctaaattcaaacttatgcagaaacttgttgataatgtcaatctcgtatcaagagaaattcttacaggtctttccgtaatacgtgcattcggacgtgaaaagaaagaagaggagcgttttgatgatgccaataaggcactcactaagacaatgctttttacaaaccgtgtaatgacatttatgatgcctcttatgacatttatcatgtacggaattaatgtacttatcatatgggtagctgcacataagattgacagcggaagcatgcaggtgggtgccatgacagcatttatcacatatgcaatgcagattgtaatgtctttcctgatgcttacaatgatgtcaattatgcttccgagagcagcagtttcagctaacagaatagatgaagttttaaatgaaaaatcatctataagagaccctgaaaatcctgaaagacttgaagaacacaaaggtgttgtaagctttaaccatgtgtcattcagatatcctaacgctgatgcagatgttctttcagatattgattttgtagcaaaaccgggagagacaacagctattgttggaagtacaggatgtggcaagtcaacacttatcaatcttataccgcgtttgtatgatgcaacacagggaagtgtcctggttgatggacatgatgttaagaatataacaatggaagatttaagaagcgaaataggttatgtgcctcagaagggtgtacttttctcaggtactatagcatcaaatttaagatatggtaaagatgatgcaactgatgcacagattgaggaggcagcttcaatagctcaagcaacagaatttatagacagcaagagtgcaaaatatgacagtcctattgcacagggcggtactaacgtgtcaggtggtcagaagcagagactctctattgcgagagccattgcaaaggatcctaagatatatatctttgatgacagtttttctgcacttgatttaaagacagatgcagcattaagaaaagccttatcatcaaaagttaaggacagcactgttattatagttgcacagcgaatcagcacaatacttcatgctgaccagattcttgtaatggatgaaggcagaattgtaggtaaaggtacacatggagaacttatgaattcatgtgatgtatatcagcagatagcacgttcacagatgtcagcaaaagagcttggagaggaggcataa

SEQ ID NO: 237 - DNA, 1572 bp, Eubacterium sp.
ttatatattaaatataattataggagaaaaacaatggtaaagagtgtattggaatatctcgagaattcagcagcaagatttcctgataaaaaggcagtcgctgatgacaaaagcagcatgacatattcagaacttgtaaataatgcacggaatattgcggcagggcttcttccttacacagaaagaagacaggcagttcctgtatacatggacaagagctgtcatacacttgctctttttatgggagctgtaatggcaggatgtttttatgtctgccttgatccaagccagccggcagaaagaatcaatatgattcttgagacgcttgaggcaaaacttatggtcgttgatgaaaaatcagcaaagaagcaggcgaagcttggttttgatggccctgttcttaatattgacgagcttatgacacatgaagtgacagaagaagagaacgaaaaacttgcacagataagaagtgaagctctagatattgacccgttgtattcaatatttacatcaggctcaacaggtgttcctaagggtgttatagtaaatcaccgttcagtcatagactttatagattgctttacagatacatttaacatcagtgaaaatgatataattggcaatcaggcaccatttgattttgacgtatcagtaaaagatatttattcaacattaaaatgcggtgcaacaatccagattatacctaaacaattattttcatttcctacaaaacttcttgattatcttgatgacaataatgttacaacacttgtatgggctgtttcggcattgtgtatagttacaactttaaatggctttgagtacaaggttccgtcaaagattaataaagtaattttctcaggtgaagttatgccgataaaacatcttaatctctggagaaaagcatatccggatgcgatgtttgttaatgtatacggacctacagaaatcacatgtaactgcacatattatatagttgacagggagtacgaacttgacgagacacttcctatgggtaaagcatttcctaatgagagagtattcctgcttgatgatgacgataatattatcactgaatcacagccgggtacaacaggtgaaatttgtgtttcaggaacagcagtgacaatgggttactataacaatccggaaaagacagatgcagcatttgttcagaatcctcttaataacaaatataatgaaataatatatagaacgggcgacttaggatattataacaatgacggtcttatgtgcttttcatcaagaaaagatttccagattaagcatatgggacacagaatagagcttggtgaaattgatatggcaatcaacgcagtggacgatgttgtaagagcatgctgcatattccatcaggacgcaaataagattcttggattctatgagggagctgcagataaaaagactattacacatgttcttatgcagaaacttccaaagttcatgattccacaggaatttatccaggtagaatcaatgcctataacaaagaatggtaagattgacagaaaacttcttcttgaaaattatatcggaggcgaaaatgcttag

SEQ ID NO: 238 - DNA, 1761 bp, Eubacterium sp.
atggatatgacatgtgacgcacttattaaatcacaggaaattatggattttatcatatataacaatccatggtactataattataatccgtcagataaaatagaaaacgcatgcgtaattgaagtggatgagaacttttcaattggatatggaaagctttcaggtgatatgaaaatgagcataagcaatcttggatatcagacaatacctaagctatatggaataatggatacatcaagtatggatgcggctggtattacgtcttcgttaaaccagccgtttcttaatgtccgcggacagggtgtaattatgggaattgttgataccggaatagattatacacatgaagcattcaagaaaagcccaaatgtcagccgtatagctgtaatatgggaccagacgggtgagtggaataatacagaaaatcaagagagcagaagcgactatgttagcagtgtatacaaatatgggagagtctttactaatgaagagataaatgcagcactcaaagcacagtctgacggcgggaatccttatgaatatgttccagaaaaagatactgacggtcatggcacttttatagccggtattgcagcaggaagccagacagatgaattctgtggagcagcaccggagtgtgaactggcagtcgttaaacttaaagaggcaaaagattatcttaaagaatattttcttgtaaacagagagacagcagtatttgaagagacagatataatgcttggtgtacggtttctgcttgattatgctgctaaaaggaaaatgccgcttgtgatatgcttcggacttggaacaggaagcggtccaagaacaggtgcaacgccattggcaagtatgcttagtttggttgcaataagaacaaatgtagtagttgtttcttgtatgggtaatgaagctgcaggaagaacacatatatcaggtgaggcactttcatctgtatcaccatatacaatagaattaaatgtaggtaaaaaagaaaaaggattttcaatggaaatatgggcaaatacgctcgatgtgctgtcagtttcagtaatatctccgtcgggcgagagtgtgccaagattatctgcaagaacaggcatgacaaatgtgttaaagtttatatttgaaaattcacaggtagaagtagattacagagtggtagatacattatcaggatatgaagtgatatttttcagatttattaatccggcacagggtgtatggaaaattaatgtatacagccttacaaatataaaagggagttttaatggatggcttccgattaataatttcctgcagtcagacacattttttctgaattctacgccggatacaacattgacagaaccagctgcagaatcaagaattataagcattgcatcatataatcatctgacaggtgctataagtatagagtcaggcaggggatacagtgcagataatgttgtaaaacctgaacttgcagctcctggtgttaatgtatatggcccacgcaccggaggaggatacacatatagaagcggaaccagcattgcggcggcacatgctgcaggagcagcagcactgttacttacatggggcgtatattacggcaatgcaaaatatcttggaacaaatgacgtgaaatatattcttattcgtggagcagtaagggatgagagtgtaacatcttccggcagtgaagagtttccaaataacatatggggatatggcagacttaatctgataaattcgtttctggaactccgtgtgacataa

SEQ ID NO: 239 - DNA, 1425 bp, Eubacterium sp.
gtggtggcaggtatggataatacaagtaaagattcacttgaacaattaaataaagacatcctggtatctattgctgatgactgtatgactgcatatatctgccttaaaaatccgggaacggaaatctgttatggttatgaagatgttaaaaaagcattggcagatgccggtgtaaaaatgggaatcaatgatgaacttatccacagaattttatcggaaaaaagatataacagtatggaaacagtggcagaaggaaaacatgttgaagacggtgaagatgcaagatatcaattattttttaatacagatgtcagtaacaagccggtaatacgtgaagatggttcggtcgattattataatctgagactttatgaacttgtgagcgaaggagacaagcttgcagaatatatacctcctacaaaaggtgtgtttggatatgacgtaaggggtaagcttcttgtgccaaaaccgggcaaacctaagacaaagttaagaggaaaaggatttaccgtatcggaggatggcaatacatattattcagctattgacggaaaagttgaatacaggaatacggaccttaatgttattggggttttgcagatagaaggtgatgttgatcttaatataggtaatgttgattttaacggtgatgttgaaataagcggcaatgttataagtggggtttctgttactgcaaaaggaaatgttacggttggcggcttcgttgaaggtgctgtcataaaagcggataaagatattattttaaagaaaggctctaacggaaaaggcgttgccaagatagaggcaaaaggcaatgtcacagcgagctttcttgaaaatctgcgtgtttactgtgatggcaatgtatattctaattcgattcttaactgtgaaatatcagcaaaaggaaaggttatcgtttcggggagcaaaggcgtcatatatggtggtgatgtaacaggaatgcttggtgttgagtcagcatcaatcggtaactcgtcaaatgtttctacgattgtaagaataggtgctgcaaagcaggtacataaagattatcaggatacgcttgtgaagttaaaagaaattacagctgagatagatacgcttgaaattgttacacataagtatgaaaggctgcgtgaagccgcaccggaaagatttgacagggaaaattataataaaattatacagtcaaagataataaaaaattcgcagaaagccaaacttcaggaagaaaataagcagctttttgacctcataaaagaagcgacagtttcgggagtaaaagtttataagacattatatccgggcgtgaggatttatgcggaaaatgttatatatgatgcccagacggaaagaaaccatatctttctaagaagaggcggggatgcaatgagaattattgaactgggcgatgatgagtaa

SEQ ID NO: 240 - DNA, 2040 bp, Eubacterium sp.
atgaagattaagaaaaatgacctgtttattggaatttatctgctctctgcggttattttctttattatttcaatcccatcgtggctgcttgatattcttctggcactcaatatagcagttgcacttattatattatttaatgcgttatatgcaaaagaagtgcttgatatggcatcatttcctacaatgttgttattcacaactatttttagaatttctctcaatgtatcttcaacaaagcttatccttactaaaggtgatgccggtaaagtcgttgatacatttggaaagtttgtaggcggcggcaatcttgttatcggtgccataatatttatagttctcgttattattcagtttatagttattaataaaggtacagagcgagtagctgaagttacagcacgattcacgctcgatgccatggcaggcaagcagatggcaattgactctgaccttaatacaggtgcaatcacagataaagaagcagctgaaagaagaaagaagctacagcttgaaaacagtttctttggttcaatggatggtgctacaaagtatgtaaaaggtgatgccactgcaggtcttattattaccggcattaacattgtcggtggtattgtaatgggcatgatgtataacgggctcagtatcaatgaagccttatcaaagtatacaatacttacaatcggtgatggactctgtagccagataccatctttgcttatatctcttgcaactggtgttcttgtaacaaaagcatcaagtgatggtgaacttggcgatgagattgttggacagctgttctcaatggacagggttcttatgatggttggtggtgctcttacagtattaggtgtatttacgccacttcctatatatgtatttgttccttttggtgtagcacttattcttgcaggaagaaagcttggagataagaagggtgaagaacagatagaggaagaagtggaacgtgaggagacagaagcacaggaaatcaggaagccggagaacgttgtcagtcttcttaatgtagaccctattgagttggaatttggttatggtattattcctcttgccgatgtcaatcaggggggcgaccttcttgacagagttgtaatgatacgacgccaggttgccctggaacttggtgctgtagtgcctattatccgtttaagggataatatccagctcaatcctaaccagtatgtaattaagataaaaggtatacaggtgagtgaaggtgagatattgtttgaccattatatggctatgaatccgggatatgttgaggaagagattacaggtattcctacatttgaaccgtcattccatcttccggcaatatggataacagaaagtcagagagaacgtgctgaatcacttggatatacagtagttgacccgccatcaataattgcaacacatctgacagaagttatcagacagcatattgctgaacttcttacacgtcaggatgtacagaatcttattaataatattaaagaaaacaattcaacgcttattgaagagcttgtgcctaaacttcttggtgttggtgaaatccagaaagttcttcagaatcttcttgaagaaggcatatcaataagggatcttgtaactatatttgaaacacttgcagatcatgcaccggttacaagagatacagatattcttacggaatatgtgagacagagcctgaagcgtgcaatatccggaaaatattttccaccgaacgaagttactaatgttgttactctcgatccggcggttgaacaggatattatgggttcggtaaagaatacagaacagggatcatatcttacacttgaccctgaaaaaacaaaaaaaattgttgccagtcttaaagatgcaattaagaaacttgaagatatgggcaagaatccgatagtaattacatctccgatagtaagactttattttaaaaaacttgtttcggattacataaaagatataattgtgatttcatataatgaagttgaatcaaatgtggaattacagtcagtagggatggtgacagaataa

SEQ ID NO: 241 - DNA, 1407 bp, Eubacterium sp.
atgaagatttataatacacttacaaagaaaaaagaagaatttgaacctcttgaaaaaaataaggtaaaaatgtatgtctgcggacctacagtttacaatcttatccatatcggtaacgcaagaccgatgatttgctttgatacagtaagaagatatcttgaatataaaggatatgaagtgaattatgtatctaattttacggatgttgatgataaaattataaagaaagccaatgaagaaggcgtttcagcagaagaaatttcaacacgttacattgctgagtgtaaaaaagatatggaaggcatgaatatcaagcctgctacaacacatcctcttgctacacaggaaatcggtggcatgattgatatgattcagacacttattgataagggatatgcttacaatgtcaatggtactgtatattacagaacaagaaagtttgaaggatatggcaagctatcaaagaaaaatattgacgaccttgaggcaggacacagagatataaaggttgcaggagaggacgaaaaagaagatccgcttgatttcgtactctggaaacctaaaaaagaaggtgaaccttcatggccgtcaccttggagcgacggaagaccaggctggcatattgaatgttcagttatggcaaagaaatatcttgcagatgagatagatatccatgcaggtggtgaagatcttatatttcctcaccatgaaaatgagattgcacagtcagaagctgcaaacggagtacaattcgcaaaatactggatgcacaatgcatttttaaatattgacaataagaaaatgtcaaagtcactcggtaatttctttacagtgcgtgacataagcaaagaatatgaccttcaggtattaagatttttcatgctttctgcacattaccgcaatcctattaatttcagccatgatttgatggaatcagcaaagaacggacttgaaagaattgttacagcagtagctaatctcaaacatttatctgaaaatgcaaaagaaggcaacatggcagcagatgaagcagaaaagattgcatcacttaaagagatgtatgacaagtttgaacaggcaatggatgatgattttaacacagcagatgctatttctgcagtttttgaaattgtaaaatttgccaactcaaacagcagtgctgaaaatacaaaggaatatatagatacactcataaagaaaattacaacacttacagatgttttaggacttaaagtagagaaaaaagaagaaattcttgatgaggatattgagaaacttattgcagagcgtcagcaggcaagaaaagacagaaactttgcccgtgcagatgaaatccgtgatgaacttcttgccaaaggaattgtacttgaagatacaagagaaggtgtaagatggaagagagcctga

SEQ ID NO: 242 - DNA, 1734 bp, Eubacterium sp.
atgaaaagaatttggatgtatttaaaaatgtataaaaaagagtgtgtgcttgcacctctttttaaaatgctggaagcgacatttgaactgtttgttccacttgtagtttcagcaattattgatgtaggtattgcaggtgcagacaagggatatattgtaaagatgtgttttgtgcttgttgcactcgcaataataggacttacatcttccattacagcacagtattttgcagcgaaagcagctgtaggatgttctacacagatgagacatcatttgtttaaacatatacagagtctttcatttactgagatggatacaatcggaacatccactcttataacaagaatgacaagtgatattaatcaggtgcagaatggtgtaaaccttgttttaagactgtttttacgttcgccatttattgtatttggtgcaatgattatggcttttacaatagatgttaaggctgcacttgtatttgtaggtgcaattcctatacttgcggtaattgtattcggtataatgctttcgacaaggcctttatacaagaaagttcaggctggtcttgataagattcttggaataacaagagaaaaccttactggtgtgcgtgtaataagagcatttaataaggaaaatgaagaagtatacagattcaaaaagtctaacgaagagctcaatcatctgcagaagtttgtaggcaagatttcaggacttatgaatcctttgacatatgctgttgtaaatatttctataatcctgcttatatggattggtgctgtacgtgttaattccggcacacttacacagggacaggtagttgctctttacaactatatgtcacagattcttgtagagcttattaagcttgctaatcttgttattaatatcacaaaggctcttgcatgtgcaaacaggattgatggcgtatttgcagttaaatcaagtatggcagatggaaaacttgatatatctgaaacagggaaaaatacacaggttccggctgttgaatttaaaaatgtatgtctgaaatatgccggtggtggagaggaagctcttacagatattaacttttcagttatgccgggagagacagtcggtgtcattggtggtaccggttctggtaagtcttcacttgtaaatatgattgcacgtttttatgatgcaacaaagggcgaagtaaagattaatggcagaaatgtaaaagagtataatatagagtcgcttagaaatcatgttgctgttgttatgcagaaagcacttttatttaaaggctcaattcgtgacaatatgaaatggggcaaaaaagatgcgacagatgatgagataatggaagctcttgatatttcgcagtcaagggaatttgttgagaaaaaggacggaaaacttgatgcgtttatcgaccagggaggaaagaatctttctggcggtcagagacagcgtcttactattgcccgtgcaatggtgagaaaacctgatatattaattcttgatgacagtgcatcggcacttgattttgcaacagatgctgcattaagaaaagcaatacgagggatgaagttatcgccgacacttttcatagtatctcagagagcagcttcgcttatgcatgcagataaaattattgttcttgatgatggcaaagttgcaggaattggtacgcatgatgaacttcttgcaggatgcgaagtttatcaggaaatctattactcacagtttaaaaaggaggcaatgtaa

SEQ ID NO: 243 - DNA, 1770 bp, Eubacterium sp.
atggataataacgtgttttttaaaggtaaagctataatagatgaacagtttaatattttgtcagtagatgatgagcttaaagattttttaggagacaatctcgttaatactaaaattgcacgacttatacatccaagtgatataaaccagcttgagacagctgtaaagaatgtccagagtgaatcgggatttgttacggcacttagaatggtagataatacaggaagatacagatggtttgtttatattatagatgaagctgaacctgcggataatgtttgtaacagcagaatatgcagtatatcgatttttgatataagagtattttttaaacatacagatacaaaggctgataacacatatatggaatatttcagtcttatggagtatcttatgttctcatatgacgtatcgactgacagattgagaatttttatgatggagagccaccagcaggtagatttttaccggggaactttagctgattggcgtagaacaatgcttgccaatggcaatgtatatggtgttacacgcaatatatttgattctttttgtgatgattttgccaatggaacagagatatttgaacgtgagtttaagatgaagatatttgagaattcacagggaatggaatggtgtcttgtcaaaggtaagactatcatagattttaatggcaaaaagcatgtaattgccacaatgtcaaagataagccctgtcaatgatgaagagcatgtatatcttaattcagatgcacttgatgtaggaacggatattcttaataagcgtgcgattacggaatatacaaagaggctgattgagtcaaaacccggatgtcctgttacaattgcaattatagatatcgataattttaagacgattaatgatgagtttggtcatatgtttggagatgaggtaatatgcaatgttgcagatgttattaaagagtctgttgagggaaagggtgtagccggaagaattggcggagatgagatgtttatcgttgttgaagggctcaagagcaatgatgagataagaaatgtgcttcgtacaatccgcaataacgtctcatttatgtataataaccagcctgataagccgcatgtcacatgttctatcggttcatctacatatccatgtgacggacagacatatgaagaactttttaatatagcagataagatgctttatcttgcaaaagagaaaggcagggacagatatataatatatctcccggatttgcatgaggattatgtgaagggcaaaggaatgcctaattcagaggcatacatgttctacaagtacaaaaaaatcggggttgttaatgatatagttaatgcttatagaaaaaatggaaaagactgcattatggagtcagctgataaaataaagagagcttttgcattagacagcatatttatttatcaccatacaggagaagcctgggagagaaagattataataggtaacaaagatattgctgaagataatgattatcttaacgataaggcatatatagctgattttacggaagatggtattgaagttattgataatatcaatttttttgaaagacgagcaaaaaatacggttaaggcatttattaatatgggaattaaccaggctgtccagattatagttaatgtcagtgatgaaaacgatgttattgtttcatttaacagaaacaggcagatgagcaagtggagcgagatggatatagtatatcttgcaatacttggtaatatatttggaaatggaatatacaatgattaa

SEQ ID NO: 244 - DNA, 1518 bp, Eubacterium sp.
ctgcaaagtagtttacttgaaatagcagtttatgtatgttacaatggcaaaagcaataaatttaatatacgaaaggcggatttgagcatgaatgacagataccagacacctcttgcggaaagatatgcgagcaaagaaatgcagtatattttttcgcctgatatgaagtttaagacatggagaaaactttggattgcactggctgagacagaaaaggaactcggacttgatattacagacgagcagattgaggaactcaaggctaacaaagacaatatcaattacgaagatgcaaaaaagcgtgaaaaagaagtaagacatgatgtaatgtcacacgtatatgcatatggacttcagtgtcctaaggcaaaaggaattatccatcttggagcaacttcatgttatgttggtgataatacagatattattgttatgacagaggcattgaagcttgttcgtaaaaaacttataaatgtaatcggtgaactttctaagtttgcagataaatataaggcacttcctacacttgcatttacacacttccagccggcacagccgacaacagtaggcaagcgtgcaacactctggcttaatgaacttgttatggatttagaggatgttgattatgtactttcaacaatgaagcttttaggatgtaaaggtacaacaggtacacaggcctctttccttgaattattcaatggagatcatacgaaaatccgtcagatagatggaaagattgcacaaaagatgggatttgacaagtgtgttcctgtatcaggacagacatattcaagaaaagtagatacaagagttctcaatgtacttgcaggaattgcagcgagtgcacataagttctctaacgatatcagacttttacagcacttaaaagaagttgaggaaccatttgaaaaatcacagattggttcatcagctatggcttataaacgtaatccgatgagaagcgaaagaatggcatcacttgcagattttgtaattgcagatgcacttaatccggctatcgtatcatcaacacagtggtttgagagaacgcttgatgattcagcaaataagagaatgtcagttccggaaggattcctcgcagttgatggtattcttgatttatatcttaatgttgttgacggacttgttgtatacgagaaggttattaacagaagacttatgtcagaacttccatttatggcaacagaaaatattatgatggatgcagttaaggccggcggagacagacaggaactccacgaaagaatccgtgagctttctatggaagcaggaaagagagttaagcaggaaggccttgaaaataatcttcttgaacttattgcggcagatccaatgtttggtgtaacacttgatgaacttaaagctaaacttgatccttcaaagtatgtaggacgttcaaaagagcaggttgaagaatatcttgcagaaattatcaatcctattcttgatgctaataaagaagaactcggaatgacagctgagattaatgtttaa

SEQ ID NO: 245 - DNA, 1530 bp, Eubacterium sp.
atgcctaatatatttgatggaatacgaaaaatgtcagacgaagatgtcaggcttgaaatagccctgattacacagactaatcttcttaatgctgcaaaagagaccggtaataagctggtcaactcgcttgcagatgcagccaattcatttatgcaggcgttcgcttcatctaagtctatagattatcagatagtgcgtgtttcagatatggtacgaaaaaatataatacagcttcatgctgatacaagaagtgaacttgaaatacggcttaaagaactcattgtacaaaaatgtgggctgacagcacaggaatcattgacagtaagtgaggaaagactttcatttctggcagcagctgaagcggcaaaattgtataatattacaaaatatgatactcctgctaataaaatagaaaatgtcagcatatactataacgaagcatttattgcggcattacatcagtgtcttgtacgtcaggatgcaaaggatgttgcagatactgatttgagaatacagaaaagaatagatgaaatatctatagaagataagagagaattacataaaagacttatgcctaaagaattttcgggtaaaggcatcggaagaatactgagattagagaaaaaaacgacgtatttaaaggatgttatacagatacttggagtacaggtttttgatgaggtagctgcatatgttacagcaagcgtcaatgtacttaaaagcttcaaaagaatatcatgtgcacttatggcacagcttgtatggaaggcaaaaaatgcatatggtacaggatttggcgtcaatgaaaaatctctgccatcatatactacggaagaaaacggggcgatgcagcgaaaagaaattacggattttcatgcaatgctaaaagagatacagacacagaaggctgcagttgaagagtatgataaaaaactggacaggctttatgagcaggtttcaaagacaggtgaaaaacttcagagtgaaaaagatttacttgaaaaagaacgtgtgcaatttgataaacttgcatcacaaaaagatgagtacaatgcagggaaacattctgagagtgacacaaaactatattattcagaagtaaataatataaacagacgcattggacaatatgagcagtctgtttcaaaacttgagcagaaaatgaaagaacttgatatatcaacaggcgagtgtgaaaataacaaggaaaatgctgcaaaagaggcagagagaatggcaaaagaggcagaattgcgggaacatgaactttctgagattataaaaaacaaatggggtgcattttattataaaatgacatttgaagatgaagtatttgtacaggctgtgacacttcttacacttgacggaagaattgcagttgaaagaatgatcaaagaatttcatgatacacctgacagtcaggcatttgatacaccctcgtcatccggatgcattatatgtgatacagtggctgatggtcaggtaaagttatatcacgaaggcatacatataactaaaataggaaaataa

SEQ ID NO: 246 - DNA, 2094 bp, Eubacterium sp.
atgaataaagataaaaagatactattttcatggaaaagaataattgcggtatttatgctgtttacaatgcttgcagcatcaattgccggagtgtcgcagtatttcggacctgttgctgtaagggccgaaaatgcagtcgccacgggacatgtgaattcaggtgtttccgggctgcgtgtgcgtacacagcctgatacgcaaacaggacagattataacggttgtcgatgattcttttacatttgacatttatgaaacagtatatacaagcgatacttattattggtacaaaataggctttgactacaatggttcatatacttatggttatataagtggtgaatatacttcaaaagataattcttattcggaagatatggattttgaaagctatcttaatgagcagggatttccggattcatataaggatgggctgcgtcagcttcatgcagattatcctaaatgggtttttgttgcagatcatgtcggaaaagactggaatgaagttattgacaatgagaatgttataggacgaagccttatatatggcagtgcaaagagttcatggaagtctgttgaatcaggatgttataactggaattcgggcgagtggacagagatggacagcggtggctgggttcaggcttcaagagaacttatcgagtatactatggaccctcggaatttcctttcaaatccatatatatttatgtttgaaagtcttgcatatgattcttctttgcagaacgaatccggtgtagagcagattatatcaggaacatttatggaaaattcgagccatgatttatcttttgaaggaaatgattatacatatgcgtccggacttatgtttgcgggcagacagtcaggtgtgagtccttatcatcttgcaacacgtattttacaggagcagggaaatacgggatacggttcatgcatttccggtaatgttgcaggatacagaggatattataattattataatcagggagctgtaaagagcggaaatatttcagctgttgtaaatggcatgatatatgcaagccgctcggattctgattcgcttcgtccgtggaacacacgaatgaaatcaattgtcggcggtgcaaagatgattggcagcagttacataaaccgcggacagagcacgatttattatgaaaaatttgatgtcgtttcatcgtcaccatactggcatcagtatatgactaatgttatggcacctagaagtgagtcgcagaaagcagcaaatgcttattcagacagcacaaaatataatacaggtcttgtatttacaattcctgtatacgataatatgccgcaggagacatgtacagcacctgatggcgacggagatcctggtaatcttttatcagatatgtatgttgacggacattcaattacaccgtcattcaagaagtatactcaggattacagccttatcgttgacaataatgttgacagaataaatattaatgcatctgcaatatcaggttcatcatgggttgacggagcaggcgaacacaggcttaatgttggtgaaaataatatagaagttacggtacatgcagaaaatggttctgacaggacatattatcttacagtagtaagaaaagagccgtcagaaaatccaaatcctccatcacctgatccggcaccggaaaatccgtcatttgatacaggatataatcttgacagtgacaatatgtatatttcgggcgtaaaagctggtgacaatgcaggaactgttcttggtaatgtgaggacacaaaatgccacagcttatatctgtaacagaaatggagatagaaaaggcgatggcgatataattgcaaccggcgaccgtcttgtcataaatgataattcaggtaatgaatatgcttcttacacatttgttgtctatggagatattaatggcgatggtgagattgaccttatagatattgttaagattaagagacatattcttgaattatcacagcttaagggagaattcctgcgtgctgcggatattaacagggatggtgagattgaccttatagatatcgttgctgtaaagaggcatattcttggaatgaaagagattacacagtga

SEQ ID NO: 247 - DNA, 1680 bp, Eubacterium sp.
atgtttataagcagtgtattaaaagtattagtaaggaggtttccggtgtcatatcaggcattatacagaaaatggagaccaaccgccttttctgatgtcaaaggtcaggaccatatagtcacgacgttacgtaatcagattaaatcagacaggattggacatgcttatctgttctgtggtacgagaggaacaggtaagactacgatagctaagatatttgcaaaggctgtaaattgtgagcatcccatagacggaaatccgtgcggtgaatgtccggcatgtaaggcgattgcggcaggaacatcaatgaatgtgattgagatagatgcggcatctaacaatggtgttgacaatatccgtgagattcgtgatgaagtacagtattcaccgacagagggtaagtataaagtatatataatagatgaggtccatatgctctctataggtgcgtttaatgcacttttaaaaacacttgaagagcctccgtcatacgttatatttatacttgcaacaacggaagcacacaaaataccgataacaatcttatcaagatgtcaaagatatgattttcacaggatttccatagagactatttccgacagattatctgagcttatgaaagctgagaatatcaatgttgaggaacgtgcaatacgatatattgcaaaagctgcagatggttcaatgcgtgatgcattaagccttatagaccagtgtatagcattttatctgggacaggatttaaagtatgaaaatgtgcttgaagttctgggagcagttgatacggcagtgtttgaaaatatgcttgcacttataatgtcgtcagatgctgccggatgcatgcagcttatagaacagcttataatgcagggcagggaacttggtcagtttgtaaatgatttcatatggtatttaagaaatcttttactcgtaaaaactacggatgatgaatcgaaacttgctgatataatagatgtgtcagaagacagccttgcacagttgaaggcagactcatcaaaaattgatgagggcacgcttatgcggtatataagagtgttgtctgatttgtcaaatgagctaaagttttcaacgcagaagcgtattaaacttgaagttacaataataaaaatgtgcaagccttcaatggaaaaaaatgacagcgtggaagaacttgccgggcgtgtcacacttcttgaaaataatcttgaaaagacatgtaaggagcttgaaagcggtgcgtttgcagttagttcaccagttccgtcagcaggtacatcaatcagtggaactgatggtatacaatcacagaaaccggtagaaaagcgtgtcatagaggctcttccggatgatgtaagacagattgcagcatcatggaacggcataatcaatacaattgatgacccgatgtatgttgcgtttttaagacaatgccatgttactcttgcaaaagacggcataagtcttgagataatggtaaaatccacatcggcatataatgcaatatcaagagaagaggaagtaaatcgtcttattgaggttattgaagaaagaaccggcataaaggtaaatataataattacaaagctggcagatgatgaggattttcaaaacagatttacagatataagagaacttgttaatatggatatagaagtagatgataaggaggaatacatctaa

SEQ ID NO: 248 - DNA, 1959 bp, Eubacterium sp.
atgattttatcatgtaaccatataagcaaatcgtttggcactgaccagattataaatgactgctcatttcaccttgaagaacgtgaaaaagctgccataatcggaatcaatggtgccggaaaatctactcttttaaaaatcattgtcggtgaacttcccgctgattcaggaaatgtgactgtctccaaaggaaaaactctcggttatctttcacagcaccagaatctctcaactgacaagactatatatgatgaacttctgtctgttaaacaggatttaattgatatggaaaatactatccgcagtctcgaaatacagatgaaagatgttacaggcgatgaacttgacaacctgctttcacagtatacaagacttaatcatgaatttgagatgaataacggatatgcatataaaagtgaagttaccggtgtccttaaaggtcttggatttggcgatgaggatttttctcttcatgtaaacacactctcaggcggtcagaaaacgcgtgttgcacttgcaaaactgctcatatcaaagcctgacatcatcatgcttgatgaacctaccaaccatcttgatatggattctattgcatggcttgaaaattatcttctcacatataatggaagcgtcttaatagttgcacatgacaggtattttcttgataaaattgtcacaaagattatcgagattgacaacactgctgtcacggtattttccggcaattatacagactatgctgccaaaaaagctgttcttcgcaacatgaaattaaaagaatacctaaaccagcagcgtgatatcaaacaccagcaggaagtaatcacaaaactgaaacagttcaaccgtgaaaaatcaatcaaacgtgccgaaagccgtgaaaaaatgcttgacaaaatggaacttgtcgataagccaacagaattaaacgacaaaatgcatatacgccttgatcctaaggtggtaagcggcaatgacgtattaactgtcaaagacctttcaaaaagttttggcgataactttttattttcaggtcttgactttgaaataaaaagaggcgaacgcgttgccctcatcggcaataacggaacaggcaaaacaacaatacttaaaataattaacggtttaattcctgctgattatggtgaaatcactctaggttcaaaagttacaatcggatattacgaccaggaacatcacgttctcgaccctgataagactctgtttgaggaaattcaggatgcttatcctgaccttaacaacacacagataagaaacactctcgccgcatttttatttaccggtgacgaagtatttaagtatatcagggatttgagcggtggcgaacgtggacgtgtatcacttgcaaaacttatgctttcaaacgccaactttctgattcttgatgagccaactaaccatcttgatatagtttcaaaggaaattcttgaaaatgcactcaataattacaccggaactgttttttatgtctcacatgacagatattttatcaacacaacagccacaagaattattgaacttacaggacatacaattgtaaattatatcggcaattacgattattatatcgaaaaaaaggatatacttacaccaaaagcacttactgatgctacagctgccattaatgacagcatggcgtcatcagcctgtcagacaccgtcatcagcacaggggtcttcaaaggcagaatggcagcagtcaaaagaagaagctgcaagacttaaaaaacttaaaaatgagctgaaacgcacggaagacaaaatcagccagactgaagaacgcatcagtgcaattgatgaagaatataacaatcctgatattgcaagcgacacagcaaaacttgtcgaacttcacaatgaacgcacttctctctcggaaatgcttgatgaattgtacgaaaaatgggaagagctatccgaagaacttattgacaaataa

SEQ ID NO: 249 - DNA, 2202 bp, Eubacterium sp.
acaaaaaagaggagaagattaatggcagctttattaattttagtcattgtggcagcactgctggcacttggatatgcggcatttaactttatcggcgtcaaaaagcttgatgaaggaacagatcgtatgtcagagatcgcggaagctatcagagttggagctaacgcatttattacttatgagtataagattataggtattgtagtggttattattgcaattatatttgcagcaattttttcagtccagtatggaaaattcagctgggagccatcagtatgtttcatcatcggagttgtgatgagtgcatcagcaggatgggtaggaatgaagattgcaacttatgcaaatgtcagagtatctaatacagcaagaaagactaagaatatcggttcaacactcaaggtagcattaaagggtggttctgtaatgggattatgtgtaggtggtttcgcacttcttggtttattccttgtatacataattttcggttacggtcttaatatgatttcaatcagtgcacttcgtgatggacagcacatcttcacacagtgtctttcatgttatgcattgggatgttctatcgtagctatgtttaaccgtgtcggtggtggtatttatacaaaggcagcagatatgggtgccgaccttgtaggtaagacggaagcacacattccggaagatgaccctcgtaacccggcaacaatagcagataacgtaggtgataatgtaggtgatgttgcaggacttggttcagacctgctcgaatcgtttgtaggagctatatcatctgcaattattcttgcagtaagcttattcctttcaaatatcgcaaataaacttacggtttcagatacacttcttatgaagatgatgtattttccacttgtttttgcggcaattggccttattgcttcgtgtcttggcatcgcatatgttcttattaagaaaggctcagatagtcctcacagggatttgaatatttcaacatggagtgcagccgtaatcacaatcataggcggctttgttgcgacatattttatgtttaagcctgaaactaaagcggtacttgatgttgcaggatttaagacaggatatacatcaccttggatagcagcgtcacttggtgttattagtggtgttattatcggtgcaatagcagaatattatacaagttatgattataatccgactaagaagattgctgagagtgcaaaagaaggagcagcacttacaattacacagggtcttgcagtgggcatgaagtcttgtatgcttccactcattatccttggtataacaacatacgtttcatatgctgtgtccggaatgtttggtattgctatggcagctgttggcatgctttcatttgtatccgcaacagtttctgttgatacatatggacctatttcagataatgcaggcggaattgctgagatgtcagaacttgagcctgaggttcgtgagattacagataaacttgattcagtaggtaatacaacagcagcaatcggcaaaggttttgccattggttctgcttcatttgccgcactttcacttatggttagtttcctttatgcattccagcctgaaggttcacagcttgaacttaactttacaaatccgcttattcttgctggtgccttaatcggtggtgcacttcctttccttttctcaggaatgcttattgaagctgtagccaatgcggcacgtaagatggttgatgaagtaagaagacagtttaaggaaattcctggaattcttgaaggtaaagcaaaacctgattataagacatgtatagagatttcttcacagggagctttaaaagagatgagaatgccggctattctttcaattattttccctgtaatttcaggtttccttttcggaccttactttgtaggcggacttcttatcggtgcaacactttcagctattatgcttgcaatatttacaggtaatgcaggtggtgcatgggataatgcaaagaagtatattgaatcaggtgtttttgagggacagggcaaaggttctccggcacacgatgcggcagttgtaggtgatacggtaggtgacccgcttaaagatacagttggaccatcacttgatattcttatcaagattatgtcaacggtttcacttgttgcagcggttcttttctacaactacaacctgttatatctcattttcggaatcagataa

SEQ ID NO: 250 - DNA, 3081 bp, Eubacterium sp.
atgcaaaaatgtgataatattaaaaagaatatagtttcttcgcaaaacaaggaggataaaatcctctcctcgctggagagactcggattttgtaacacaaaacaaggaggatttatgactgatataaataaactgaatttatcaaaatatgatgtaatttccgttgaaaagcttgaagatttagattctacagggcttttattaagacataaaaagagcggtgcaaggattgccattgtttccaatgatgataataataaggtattttctataggttttaagacaccgccgtataacgatacagggctgcagcatattcttgaacattcgacactatgcggttcaagaaaatatcctgtgaaagacccgtttgtagaactttgcaaggggtcgctcaacacatttcttaatgctatgacttatccggataagactgtatatcccgttgcgagctgcaatgatgtggatttcaaaaatattatggatgtttatatggatgcggtattttatcctgatatttataataagccacagatttttaagcaggaaggctggcattatgaacttgaaaatgaggatgatgagcttaaaatcaatggcgttgtatataatgagatgaaaggtgtatattcgtcaccggatgacgtgctttcaagatatacatgtgtatctttatttcctgacacgccttacagatttgagtcgggcggtgagcctgctcatattcctgagcttgattacaatgaatttcttgattatcacaagaagttttatcatcctgtaaatagctatatttatctgtatggtgatatggatgtacaggaaagacttgattatcttgacagggaataccttagtgattttgatgcagatgatgtagatattgacgcatcaattcctgcacagaagagttttgaaaatgatgtttttaaggaatttaattatgctgtaacggatgacgaaccgcttgaaaataatgcatttctttcatataacaaggttgttggaacatcacttgatgcaaaactttatcttgcaatgcagattcttgattatgcacttatcatggctcccggagcaaagttaaaacaggctcttattgataaaaatataggaaccgatatttacagcagttttgagacatctgtgtatcagccgatttattcaattattgctaaaaatgcagatgaaaataagagacaggagttcacagatacaattaatgaagtgctcagtgatattgtaaaaaatggtattgatatgcgtatgattgatgcgggaatcaattattatgaattcaaataccgtgaggctgattatggtgcatatccaaagggattaatgtattatctcacaatgatggacagctggctttatgatgaaaataagccgtttattcatattgaggcgggaaagacatttgagcagattaaaaaagaaaaagagtcaggattatttgaaaaaataatcgaggagtggcttgtaaataatcatcatggttctgttatatcgctggttccgaaaaggaatcttgaaaaagaacttgaagataagacaaagtctgagcttgcagattttaagtctaagctgacaaaagagcagatacagcagtatgtgcgtgaaacaaaggaattaaaggaatatcaggacgagccttcaagtcaggagaatcttgaaaaaattccaatgcttgcactcaaagatattggaaaaactccggcaagactttatatcgatgaaaaagaggaaaatggtatcaaggttattcaccataatatgtttaccaacagaattgcatatattatgatgtcttttgaatgtaagagtgtatcagatgaacttgtaccatatataggactcctttcatcagtgcttggacttatggatactgataatttcacatatcctgaacttactaatgaaatcaatattaattcgggaggactttcatcagattctgcaatatatacagataataaagaacttgataagtatcagataagatatgaggtaaaaggtaaagttttatatgaaaaaataccttttatgcttgaaatgatgcatgaaattatatattgtacaaaatttgatgattataagagacttaaagagattatttcaagaacaaagtcgagaattgaaagctcaatgacaggtatgggacatacagtagctatgctttatggaatgtcacagttatctgcatcgggatattattcaaatcttatgagaggatacggattttacctttttatccaggagattgaaaaagattttgataacagaaaagaagagattgcaggcacacttaaccagcttataaagcttatatttacaaaggaaaaccttgttgtcagctttaatgccaatgatgatggatatgataaatttaaggctgcttttggtgattttgcaggaaaattaaatacagacaattatcctgtagaaataagaaaatttaagccatgtaatgttaaaacaggttttacgtcatcatcacaggttcaatatgttgcaagatgtggcaattttgttgatgcgggatataagtatacaggtgcattaagagttttaaaagttattttcggctatgattatctttggataaatgtgcgtgttaaaggcggtgcatacggctgtatgagcggttttggcaaaaatggtgacatgtatatggtatcttaccgtgatcctaaccttaaaaagacaaatgaaatttttgatgaatcagttgattatattaagaattttgatgtgagtgacagagacatgctcaagttcataattggtacaataggagatatggatacaccaatgaatccggcagctaagggcgttcgttcatttggagcatatataagcaatgtgactattgaagattatcagagagagcgtgatgaagttttaggtgcgacaccggagaagataagagaactggcaccaattgttgaagcaggacttaaacagaatcatctgtgcgttgttggtaattataaaaatataaatgatgagtcatctatgtttgatgagattaagccattatttgtatcagcagtacaaaataacagtgaagaagaatga

SEQ ID NO: 251 - DNA, 1002 bp, Bacteroides sp.
atgaggcgtcaacgttttcagaataaagtggccacaggcaggttcatcctgcctgccgctttgttgatttccgcaatctgctggacggtaattgttacgctggtgcccggcacaggtacggaaggccccaactggccgctttggctcaaggaagcaagcaactggcttccccaaggcatcttcccgtcgttgctcggctttgttctgtacgtcctgacaacgttcttcctgatcaacctgaacaacattttcgccatcatccgtatccgaacttccattcagagttttcttttcctacttttggccaccgcagtcccgcaactctacgacgaattgcccggattactggtcgccctcagttttctcacggccttctaccagctgtttggcagttaccgccaggaaaggtcttcgggggccctattcaatacctttgcatttgcgggcatcgccagtctgttcgttccccagagcctgctgcttgtccctctgctctggatcggtgcagccagtttccagtcgctcaatctgaaaagcctgcttgcctcgatcatcggcttcatcctgccgtggtggatactgctgagctgcaccgtgctgacgggcagtacccacacattcttccaccaactgttcgacgaaacacgcctgttccgtcccgtcggttacggtctcgaatcctggatggtgtttccattcggatttctcttcctgctcttcgccgccagtgccttccactacttcttcaacggatacgaagacaaaatctgcacacggacctatctgtattttctgattctcttcggtgcctgcctttttgtcggcatcggactgcagccctatctgctgacagcgttctgccccttgttgctgattatcgtcagtatgctggcaggccatctgtttgcactcactagcaataaactttccaacgcattttttgttatttccctgattggaatttcagttatgtttgtttatcacgtatggatgcttttatag

SEQ ID NO: 252 - DNA, 1041 bp, Bacteroides sp.
atggcaaaaaaagacgaactgaattttgaaaatgaaggcgccgtaatgcccaatagcgaaaagctgaaagccttgcaggccgccatggacaagatagaaaagagtttcggcaaaggctccatcatgaagatgggcgacgacagcatcgaacaagtcgaagtcattcccactggctccatcgggctaaacgtggctttgggtgtaggtggttatccccgcggacgtatcatcgaaatctatggccctgaatcctctggtaaaaccacattggccattcatgccatcgccgaagcacagaaagctggaggtatcgccgctttcatcgacgcagagcatgccttcgatcgcttctatgcagccaagctgggcgttgacgtggacaacctcctcatctcccagcccgacaacggcgaacaggccctggagattgcagaacagctcatccgctcctcagctatcgatatcatcgttgttgactccgtagccgcccttacgccaaaggccgaaatcgaaggcgacatgggcgacaacaaggtaggcctccaggcacgcctgatgtcacaagccttgcgcaaattgacatctgccgtcagcaagacccgcacctgctgcatcttcatcaaccaattgcgcgagaagattggtgtcatgttcggcaatcccgaaacgactaccggtggtaatgccttgaagttctacgcatccgtccgcctcgacatccgtggtggtcaggccatcaagaacggcgaggacgttattggcaaacagaccaaagtgaaagttgtcaagaataaggtagctcctcccttccgtcgtgctgagttcgacatcatgttcggcgaaggcatctctcgcgcaggcgaaatcatcgacctgggtaccgaactgggtatcatcaagaagagcggctcttggttcagctacaatgacaccaaactagctcaaggccgcgatgccgctaagcaagtcattctggataatcccgaattggccgaagaactggaaggactgatattcgaagaactgaagaaagaaaaataa

SEQ ID NO: 253 - DNA, 837 bp, Bacteroides sp.
atgaaaaagaatatctttattgtagctttgctggcagcagcgctgggattgacatcgtgtggtgagtataataaactgctgaaaagtacggattatgagtacaaatatgaagctgccaagtcctattttgccaaaggacaatataaccgtgccgccactttgctgaatgagttgattgccattctgaagggaacggataaggcggaagaatcgctttatatgctgggtatgtgctattataatgagcaggattatcagactgccgcacaaacctttattcagtattatcaggtttatccgcgaggtacatataccgaactctcccgtttccatgcaggtaaggccctgttcctggatactccggaaccccgtctggatcagtcgagcacttacaaagcaattgacgagcttcagatgtttatggaatactatccgcaaagcgccaagcatcaggaagcccagcaaatgattttcgagttgcaggacaagctggttatgaaagaatacttgtcggccaaattgtattacaacttgggcaattatatgggcaataactaccagtcatgtgtcatcacggcacaaaatgccctgaaagattatccttatactaatttgcgtgaagacttgtcgatcctgattctgagagccaaatacgaactggctgtatacagcgtggaagaaagaaagcaagagcgctatcgtgaggctgtggacgaatattacgccttcaaaaatgaatttcctgaaagcaagtacctgaaggaagccgaacggatttttagcaagtctcaggcagaattgggtgaaggaagcactgaagaagaagtaactgaataa

SEQ ID NO: 254 - DNA, 558 bp, Bacteroides sp.
atgttattagtcgaacaatatggcgattatctcgttacatttgtaatgtttacaattttaaaaaaacgaacgaatatgatttcagaaaaactacaaaacgcaattaacgaacagattactgcagaaatgtggtcggccaatctgtatttggcaatgtctttctttatggagaaagaaggttataatggtatggccaattggttgaagaaacagtcttttgaggagcatgaacatgcttttgagatggcttcttatattatcaaacgtggaggtacggcaaaggtagataagattgatgttgtacctaatgattttggtaccccgcttgatgtatttgaacaggtttataagcatgactgccgagtttcaaagatgattgacgaattggtggatgttgctgcttccgaaagagataaggcaacccaagatttcttgtggggatttgtacgtgaacaagtagaagaagaagctacagcctcaagtattgtggaaatgattaaaagagcaggaaactctaatttgtattttgtagactctaagttgggagaacgtcaataa

SEQ ID NO: 255 - DNA, 1224 bp, Bacteroides sp.
atgactttagtagaacgttttttgaaatatgtcagcttcgatactcagtcgagtgaagagactggtgttactcccagtacgtcggggcagatggtttttgcccgctatttgaaggaagaactggagtctttgggacttgaagatgttacgttggacgacaatggctatttgtttgccacacttcctgctaacactgataagcctctgcctacagtaggtttcattgctcacatggatacgagtcccgatatgagcggtaaggatgtgtcaccacggattgtacagtgttatgatggtggagaaatagtgctttgtgccgacgaaaacatagttttatcaccagcacagttccccgaactgttggatcataagggggaggatttgatcgtgaccaatggcaaaacgttgttgggggctgacgacaaggctggtattgccgaaattgtttcggctattgtctatttgcaggagcatcccgaaatcaagcatggcaagatacgtattggtttcaatcctgatgaagaaatcggcttgggtgcccataagtttgatgtcgagaaattcggttgcgactgggcctatacgatggatggtggcgaggtaggcgaactggaattcgagaacttcaacgctgcttctgccaagattacgttcaagggacgcaatgtacatccgggctatgccaagcataagatgattaattctattcgcgtggccaatcgttttatggctatgctgcccagtcatgagacgcccgagcataccgaaggttacgagggcttttatcatctggtgggtatcagtggcgaagtggagcagaccgtggtatcttatatcattcgcgatcatgaccgcacccgttttgaaagccgtaagcaggagatagaacatctcgttcggaaaattaatgctgagtatggcgagggcacagctacactcgacctgcacgatcagtactataacatgcgtgagaagatagaacctgtgatgcatgtaatcgatattgccttccaggcgatgaaagatgctggtgtagaacctcgtgtgaaggccatccgtggtggcacggacggtgcacagctttcgttcaaaggattaccttgtcccaatatttttgccggtggacttaatttccatgggcgttatgaattcgtgcccatacagagcatggagaaagctatgatggtaattgtcaaaattgccggactggtagctgcacgctga

SEQ ID NO: 256 - DNA, 462 bp, Bacteroides sp.
atgaccaaagcaatctttccagggacattcgacccctttactgtcgggcactattctgtagtaagacgtgcattgacattcatcgatgaaatagttatcggtatcggtattaatgataacaaaaatacccatttccccattgccgagcgcgaagctatgatccgcgacttgtataaaaacgaaccccacgtcagcgtacaagcatacgacagcctgaccatcgactttgcccgccaagtgggggccaaccttatcatccgcggcattcgaacggtcaaggacttcgaatacgaagaaaccattgccgacatcaaccgcaaactgactggcatcgagaccatccttctcttcaccgagccagaactttcctgcgtcagctccacgatagttcgcgagctaatgggctacggaaaggatgtcagcatgttcctgcccgaaggtatgaatacatctcacgagtaa

SEQ ID NO: 257 - DNA, 516 bp, Bacteroides sp.
atgagaaaagtaagcagagaaatgagtagcgattgggcgttggaaataatgcgcaaggctccgtacattactgtaagttttataagggcggatggtacggcctatggtgtgccgctctcgctggcttgtgctagcgacaatgtgtggtattttcattgtgcgcctgaaggtgataagctcgatgcactggctgtacatccagaggtatgcctttcggctgtcacgaaatgccaacctacggttgggcctaaagatggtacttttacgcttcagtatcgttctgcaatagcctttgggaaagcggaacttgtgacagatgacgatgaaaagatacatgctctcaagctgataagtcagcgttttctgcccaagcacatggaggctttcgacgatgcagtcaagagaagtattcatcgtacagctgtggttcgcataacgctgactggccttcctactggtaagcgtaagcagtatgataaaaatggagaagaaatgaagtatggaaggatggaatga

SEQ ID NO: 258 - DNA, 465 bp, Bacteroides sp.
atggcaatgcatacatggttcgaatgcaagattcgatatgaaaaaacaatggaaaacggcatgaacaagaaggttacggagccctatctggtagatgcactcagctttaccgaagccgaagcacgtatcatcgaagagattactcctttcatcagtggtgagttcactgtagccgacatcaagcgtgccaactatagcgaacttttcccctgcgatgaagaagctgccgaccgctggttcaaatgcaagctcatttttatcacactcgatgaaaagagcggtgcagagaaaaaaacatctacgcaagtattggtacaagccgccgatttgcgcgatgccgtaaagaaactggatgaagggatgaagggcaccatggccgattatcagatagcctctgtggccgaaacgccacttatggacgtgtatccttacagcgctgagcccgacgacaagccggaagtataa

SEQ ID NO: 259 - DNA, 510 bp, Bacteroides sp.
atgaaacggattatattaatcacaggaggagcacgttccggcaaaagcagctatgcggaaaaaagagccttaaccctctctcccaacccggtttacatggcgacagcacgcatctgggacgaagagttcagacaacgtgtcctgcgccatcaggaacgaagaggccctgaatggaccaacatcgaagaggaaaaggcactgagccaacaccaactggacggacgggtagtcctgatagactgtgtgaccttatggtgtaccaacttctttttcgacctgaatgcagacgtagaccaaacgctgaaagccgtccgcgaggaatttgaccgctttacacaccagaatgccatctttctgtttgtcaccaacgaaataggctgtggagcaacctctgaaaacgaaatacaacgcaagtttactgatcttcagggttggatgaaccagtatatcgcctcacaggccgacgaagtcatccttatggtggcaggtatacccatgaaagtaaaataa

SEQ ID NO: 260 - DNA, 489 bp, Bacteroides sp.
atggataaaacagaacaagagtttgttgctctgatcaaagaatatgaacgcgtcatctataaagtgtgctatttatatgccactcccaacgcgccactcaacgatctgtatcaagaggtggtactgaacttatggaaagcctttcctaaattccgtcgtgaatgcaaactatccacatggatctaccgtatctcgctaaacacctgcatcagctttatgcgaaaagagaaaaacattcccgaaatcgtgtcgctgacacctgccgaagcagaccgcagtgaagaatgggacgagacgcaggctatgttgcgacaactgtatcgcatgatcaatcggctgggacaattggagaaatccattatcctactttatcttgaagaaaagagttacgaagaaatcagtgagattaccggactgaccgtaacgaacgtagctacaaaactgaatcgcatcaaggagaaactgagaaaaatgaagaaggaggaatga

SEQ ID NO: 261 - DNA, 960 bp, Bacteroides sp.
atgggattctttagttttttttcaaaagagaaaaaggaaacattggataaaggtttgtccaaaaccaaagaaagtttttttggaaagatagcacgtgttatagctggaaaaacgaaagtagatgacgaagtgctggataaccttgaagaaatacttatcacttcggatgttggtgtagagactacactcaaaatcattgaaaggatagagaagagggctgcatctgaaaaatacatgaatacacaggaactgaaccatatcctgcgtgatgaaatttcgatgctgcttacagaaaataatacagatgatgccaatgactttgatgcacctattgcaaagaagccatacgtaattatggtggtaggtgtaaatggagtgggaaagacgactacgatcggaaaactggcttatcagttcaagaaagccggaaaatctgtttatctaggagcagccgatacgttccgtgctgcagctgttgagcagcttgtgatatggggtgaaagggttggcgttcctgttatcaagcagaaaatgggctctgatccagcttctgtagcctttgatacattaaagtctgctatggccaatgatgctgatgtggttatcattgatactgcaggacgactgcataacaaggtgggcttaatgaatgaattgacgaagataaagaacgtcatgaagaagataaatccagatgttcccaatgaagtattgttagtattggatggctctactggtcaaaatgcttttgagcaagccaagcagtttactctggcaacagaagtgacggctatggcggtaaccaagttggacggaacagccaaaggtggagttgttattggcatatctgatcagttcaagataccggtaaaatatatcggattgggtgaaggaatggaagacttgcaagttttcaatagaagagagttcgtagattctttgtttggtgagaacagatga

SEQ ID NO: 262 - DNA, 738 bp, Bacteroides sp.
atggaggtaaggatgatggaaggcaaacaacgatgcatgacgggccaatcggttacggatgccgaactggggagtatcgtggtgcgagttaatgctcgtgcgcggcggctgatatttcgggcagtagagggcggttttgttgtgaccgtccctttgggagcaacgtggagtgatgtgactaaaggattggaaactttgcgcccccgtctgcgtgaaacgcaggcgcgacgaagcgaaaagctgatagacttgaactatcggattgaggcggagctctttaaactgaccttggtagagcgggatatccgtcagtttcaggcacgtttggagctggggatgatgcagattctgtgtccaataggtactgatttttccaattctcaacttcaagtctggttgaagaaggtgataggtgaggccttgcggaagaatgccaagctagtgttgccccctcgcctgtatgccttgtcgaagcaacatggcttgcctttccacgaggtaaagattaactccagttccggccgttggggcagttgctctacgcgcagggatatcaacttgtcctattatttgttgctcctgccgcaacaccttattgattatgtgcttttgcacgagttgacgcatacgcgcattatgaaccatggtgcggagttttgggaaatgcttgatcgcctgactgaaggtcgatgcgaggctctgaggcaggaactgaaggcgttttctgcctcgttgtga

SEQ ID NO: 263 - DNA, 1110 bp, Bacteroides sp.
atggaacaagataacaaacaactccctgttgaggagcaggaaatcgacctcctcgaactggcccgtaaagtgtgggcagaccgcaagcttgtcctgaagtggtgcggcatagccgctgtagtcggactggtcgtagctttcagcattcccaaggagtacacaaccaacgttaccatcgcccccgaaagtaccagtggcagccgctcaatgggcggactgtccgctttggcaggcatggcaggcatcaacttgaatgcaggaagcagcgccgatgcactttcacccgacctttatccggatatcgtctcttctgtcgcctttacgaccgaactgttcgacgtacccgtacgcgatgccgacggcgaactccagaccactgtctacgattatcttcaggaacatcaacgttctccctggtggagcaccgtgatatccctgccgttcaagtgcatcggttggaccgtttctctcttttctggcgacgaagaagaggctgacagcacggcgaccgtcaatcccttccagctcaccaagaaggaaaacgagattgtcaaagctctcaataaccgcattgccgtaagtgtggacaagaaatcgctcactgtatccattgctgtcaccatgcaggatccgctcatttctgccacgctcaccgatacagtcatgcagaagctgcaggattacatcactgactaccgtaccaacaaggcccgtcacgacctcgacttcacacagaagctctacgacgaagcccagcagaaatattacgaagcccagcagcgctatgccgactatgtagacaaaaaccagaacatcctgctccgcagcgtccagacccgtcaggaacgtctgcaaaacgagatgaacctggcctacaacctctacaacctgactgcccaacagctccagctcgccaaggccaaggtacaggagaacacgccggtctacaccgtagtccaggccgccaccgttcccctccgtgcctccaagccttccaaagccatgatcctcatcggtttcgtattcctggccggtgtcggttccgtaggctggattcttttcggcagagacctgctccgacagttcaaaggttccaaggaacaagcctga

SEQ ID NO: 264 - DNA, 897 bp, Bacteroides sp.
atgacgttgcgatgcaaggtgttgtgtttgttagctgtcatggggctatgccatctgcgggctcaggatgcactgcctctgcaagctgtggtagattgtgaagctgtttcttgcgatacgctgtttgcctatggacatcgtaccgataccattgattggttgccagtcgtttggccttcgtcttttcgtatgcagcaagttaatgtgttggctgacagcttgggaatccttcatcctttttgggagaaattacgtctgatgcgtgccggagatgtttccgacactgttcgggtggtgcacgttggtgacagtcatattcgaggacatatgttaacggatactgtggcttctctcctacgaaaggcgtttacaaatatgacttatcgggattttggtatcaatggggcattttgtatttcttttactcggaaagagcgtgttgaagcaattgcggctcttaggcccgatttgctcattttatcatttggcaccaatgaaagtcataattaccggtacaatacggaggtgcattaccggcagatggatgagttggtgcgtatgcttcgggaacggttgcccgatgtgcccatgatgctgactacgccgccagggtcttacgaaagcaaacgccgtggaagggggcgtcgaacgtatacaatcaatcctcgtacttcggccgtagtaaagaacatcattcgttttgctgatgcaaacggactggctgtctgggatttgtatgatattgcaggcggagtgaagagggcttgcctgaactggcaggaagccggactgatgcgccccgaccatgtccatttcatgcctgccggatatgccttgcagggtgagttgctttacgaggctatcgtgaaaacttataatgcttatgtggaatattga

SEQ ID NO: 265 - DNA, 597 bp, Bacteroides sp.
atggaaaatggagaatggaaaatgaccagcgtacggggttcattctcaattttcaattatcaattatcaactttcaattatcaactttcaattatcaactttcaattatcaattaaagaaatgattacttacagaaaaattcaaattgtgggcgagaaccatccgtgcaacggactgtggtatgcacgcccggtgattaacgagacgctggacatcgatttgctgtcccgtcacatgtcgaaacacaacacgccgttctcgccgggcgtgatcaaaggcgtcctggcagacatggtgacctgcatcaaggagctgatcctggacggcaagaacgtgaagctggacgacctggctatcttctcggtgggcatcatcagcgaccacggggccgcgagcgcagcagagttcaaggtgtcggaacacgtggcaggactgaagctgcgcgcacgtgccaccggcgaactgagcaacgcgaaaatcaacctggaggcgacgctgcgcgaacagaacgagtactacctgggcgacggcaccgcggtgactcctacccccggcggcggaggtgaggacgaggaagaaggaggaagtccgctgtaa

SEQ ID NO: 266 - DNA, 420 bp, Bacteroides sp.
atgaatcgaaatttaaaaaacgagaacatcatggacactcctcaagagggttatcgtgtacagacctatcatgtacctgtaaaaagatattgccagacacttgacttgcgtgacaatcctgaactgatagccgaatatcggaagcgccatagccgtgcggaagtgtggccggaaatattggcgggcattcgtgaagtgggtattctggaaatggaaatatatatagtgggcacacgtctttttatgatcgtagagacgccgctcgatttcgattgggatgcggcgatggcccggctggacacactgcccagacaacgcgaatgggaggcctatatgtcagtctttcagcaggctgatcctcaagccagctctgctgggaaatggaaactgatggaacggatgttccatttatatgagtaa

SEQ ID NO: 267 - DNA, 810 bp, Bacteroides sp.
ttgcatggttgtcagtcggttgtttccgacaaatgtaaggatattcttgggcttttgcaaatgccccagcaaaaagccttctttctgctcttggaaaacaaggcaacgacctgcccaaagaaagcaatgttttcgaatgaagaaaactatgttttaagacaagaaaagcaatgctttctatcagaagaaactatgtttttccacccgttaattataccgaaaaagaaaaaagaagaacgaaaaggacaaacagttcctacaaatatacgttatttttgtagtaaaacccaccttaaacaagaaaggagcaagaatatgaaaaaatcaatttacaccgccttcatagcctgcgcactggcatctgccgctcccatacaggcacagcagacggacaaagaggcacaaaaggcacgcactgaacagaccgtcaaggaggcactcgaggcccgtcgctaccgcatcgaagtaaattacatgacacccatgcgcggacggagccgtgccctgaccgacaactattcgctgaccatacatggcgattccgtcctctcctacctgccctacgtgggcgaagcctacagtgcgccttatggcggcggaaagggactgaacttcgacgcccttatccagacctacgaaacgaaggaaggcaagaaagggcgcaaggaaatccgatttacgaccacaaacgacgaagattcctacacgtaccatctgaccatctatcccgacggtaccacacaaatccgcatccaacccacgcgacgccaatccatctccttcaatggaaagatggatacggatgagtga

SEQ ID NO: 268 - DNA, 1398 bp, Bacteroides sp.
atgttgatacaccaccacacagccaaagaaaactacgagcagctgactactgcccccattgcgggtgtcatcacccgcctggccatccccaccatcatcagtatgctggtgacggctttctacaacatggccgacacgtacttcgtcggtaagattaatacgcagtccacagcggcggtaggcatcgtgttctcgctgatgtccatcatccaggctgtcggttttttcttcggccacgggtcgggtaactatatctcgcgccgtctgggcgcccgcgacgtggccaatgcggagaagatggcagccacgggctttttcatggctttcttcacgggctgtgtgttggcggtgttggggttgctattcctcacaccgctgtcgctgatgctaggctctacacccaccatcttgccttatacggaacgctacttgggtattattttgacaggtacgcctttcatggcttcatcgctggtgctgaacaatcagatacgctttcaggggaatgccgcttacgctatggtgggcatcgtgagcggggcgatcctcaacgtggtgctcgacccgctattcatcttcgtctgcgatatgggcgtggcgggtgctgcgctggccacggtcattagtcaggtgtgcagctttacgttgttgctctacatggctacgaagggggggaatatccccatccgctaccgcaacttcacgccgtcgcgggccttcatcagagagattgtcggcggcggcacgccctcgcttgcccgtcagggactggccagcctgtccaccatcctgctgaacttggccgccggagcgtatggcgacgctgccatcgcaggcatgtccatcgtgtcacgcattggtatgttcatcaattctttcctaatcggtttcgggcagggtttccagcccctctgtggcttctgctacggcgcaggtctttatagccgtgtgcgtcagggtttctggctctgtgtacgtatcggttttattttcctgacctgctgtgctgtgttgggtttcggctttgccgaagaggtggtggagctgttccgtaagggcgaccccgctgtggtggccacaggtgcttcggccctgcgctggcagcttgtcacctatccgctgggcacgttcgtcatcatcagcaacatgatgttgcagactatccgcaaatccgtgcgtgccaccatcctttcgtctgcccgtcagggcttgttctttgtgccgtttatctttatccttccccatttcttcgggcttcagggcgtggagatgtgtcaggccgtttccgacatctgcacttttctactggctcttccgctgacgtttagcgtattgctggagatgaagcggcaggagaacgggagaataaacccaaccgaccgcaaagcaggcttttga

SEQ ID NO: 269 - DNA, 477 bp, Bacteroides sp.
atggaaaaagtgattattaattcgtatgaagaattcgagaagctggtaggtcagcagattggtgtatcggactatgtgcagatcccgcaggaacgtattaacctctttgccgatgccacgttggaccaccagtggatacacgtcgacaccgaacgcgccaaagccgaaagtcccttcaaaagcaccatcgtgcacggttacctgaccctttctatgctgccctacttgtggaaccagattattgaggtgaacaatctgaagatgatgatcaactacggcatcgagaagatgaagttcggtcaggctgttttgtcgggccagagtatccgtctggtcgcttcgatgcagtcgctgaccaacttgcgtggtgtggctaaggccgaaatcaagtttgccatcgaaatcgagggtgagaagaagaaagcactagagggcgtggctgtctttctctactattttaacgtgagttcgatataa

SEQ ID NO: 270 - DNA, 588 bp, Bacteroides sp.
atgagccgaaacaagatagaactgcaagtactgagcctcacctacagccaggaacaggcaggagcttatgccctgctcctgggcgaagtgaacggtccgcgcaaactgcctgtcatcatcggctcggcagaggcgcaagccatcctgctcgagatacgcggcattacttcgccacgcccgctgacctaccagctgtttgcctctaccctcgaggcgttgggcgtacgcctgctgcgcgtactgatatatcgggcagagaacgggctgttctattcgtatctctacctgcagtcggaccactccatcatccgcatcgactcacgcacgagcgacgccgtcgtcatggccatgcacctgcactgtccgatcctcatctacgaagacgtgctggatgctgagaaaatggaactggacgccgagacactggaaacggaatcagggacgacgaacagccaagatgaccgggcagagacaataaaccgcatggaggaggctctgaaagaagccatcgaagcagaagaatacgaaaaagccgccaatctgcgcgacatgataaaccaatttaaagaatcaaaccatcaggactga

SEQ ID NO: 271 - DNA, 243 bp, Bacteroides sp.
gaagtggcggcagttgcgccacaatttcgtcggtcacgaggtggaagccccttccgtgtgagggtaatgaaaattctttctgtagaatgctcatggctgatagtgttctttttgtacgatttagtggcaaatatagccaaaacttgtttaaacgtttgcattcgtccggttaaattctttgccgtttgttgggaaaatgcgatatttgtctgctcaaaatcgaaagctgttgaacaatattaa

SEQ ID NO: 272 - DNA, 633 bp, Bacteroides sp.
atgaaccgtatctctatcttgtgcaagcgtcctttcgtgcgtctggcccgcttccgccatcggtgcggttacggagtgcactcaccttttgctttccatctgataacggggatcatctacgagactgcaccttattataagtatgcttccctgctggaaggagagaagcggcaggcaacgcagcaccccagcagctggagagaagagcccttgcgggtgaagcggcttctgttccgtctggttaactatgcgcggccggaaacgattgtcgatgcgggacctctgtccgcttcggggctctatctgaaggcgggtagggaaggggcggcttatacggcagctgcggagttggacgaactgttcctggaggcgggcgttcctgtcgattttctttatctgcacgactggcggcgtcccgactttgtagaggaagtgttccgtcagtgcgtggagcgggctcgtggctgctcggtatttgtcatcgaaggcatccgctacacgtcggccatgcgcaggctgtgggacgccatgaggcaggacgaacgctgcggcatcacgttcgacctctacgacttgggcatcatcttcttcgaccggacgaagataaaacaacattatctggtaaacttttga

SEQ ID NO: 273 - DNA, 516 bp, Bacteroides sp.
atgaaactgattttaagcgataaacgactggatatttctgtcgatccagaaaaggatattcgctattttgatttgtccaatctgaagatagccaattgcatgggttgcttcgcttgttggactcgaacgccagggcgatgcgttattcgcgacgatgccactcgaatctatccctgcattgctgccagtgatgccgtgctttacgtcagccgcctgaagtatggtggttatgataccgtgatgaagaccatgctcgaacgggccattcctgtacagcaagctttcatccgtatccattgtggcgagacacaccacgtgcagcgctctgtcgcacccaagcatgccactatcattgcctatggggccgaggacgaagaggaacgtgctattttccgtcagcttgtagagcgtaatgcccgcaacatgaacttcgagagttatgaaatccagtttacaaccgaatccatgatcgatgacatggtaaaacaagtattgcagaaatgggaaaaattctga

SEQ ID NO: 274 - DNA, 795 bp, Bacteroides sp.
atgaagagtaagcgatacatctggcacccagctaccgtattctttctgttggcatgtctggtcgtgtttttgtcatggatttcagaagtctatggcatgaacattgtgcgctcagaaacaggagaggtcattcgtgtccgaagtctgctgagtcccgaaggtttgcgctggcttttgcgccatgtcgtagagaattatgtggagttcagggcattgggaccagtcctgctggttgtggctggcgtaagtgtatgcttgcattcaggtttggcggatgcgtgtatgcgaaagtggggatggttttattgccatcggacaagcgaatgccgccaattgtcacgcaaagagcggagggctctacagaattccatcttggtagggattgtctattggatcattgtattgtttgcaaccttctctccgtgggcggtattgcgtggcattgatgggggattggttcgttccccctttgtagatggcttttcgttcttgtttgcaatgggagcagtattgatggggacgtgttatggctttatcagcggccgttatcggcgtgactatgatgtcgtgaatgggatgttgtacctgtctcgattcatggttctctatctggtcgtctgctttttcgcctctcagatgttcgcttgcttggattattctcgtttggatacttgtatcagcggatggatactggccaactgggggtggcaaggacagcagattgtgtcctttttgatacaatatatccccttattggttgtctgctggtactatttcagcagggacaaacaatga

SEQ ID NO: 275 - DNA, 669 bp, Bacteroides sp.
caagcaacaagaataagacctgtacaaattatgaaaataaaaagatttgaatttaatatgtttcctgtgaactgctacttgctgtgggatgaaaccaacgaagcggtagtcatcgatcccggctgtttctacgaagaagagaaacaagccctgaaaaacttcatccagggaaacaatctgcaagtgaaacacctgctaaacacgcatctccatctagaccatatttttggaaatccatttgtactgaaagaattcggattgaaagcagaagccaaccaggctgatgaatattggatagagaacgctcccaaacagagtcgtatgttcggcttccaatttcaggaagagcttccaccgttgggaaaatacctgtatgacggtgatattatcactttcggtcatacacaactagaatgtatccacgtaccggggcattcacctggaagcttggtatattactgtgcagcagagcactgcatgttctctggagatgtacttttccaaggaagcatcggacgggccgacttggctggaggtaatttcgacacactgatcgagcatatttgcagccgcctgtttgtccttcccaacgaaacgattgtctaccccggccatggagctccgactaccattggaatcgagaaagcagaaaatccgtttttcagataa

SEQ ID NO: 276 - DNA, 885 bp, Clostridium sp.
atgagctttatatcgtatttatttaacggattaagtctcggaagtgtttatgcaataattgccctcggttacacaatggtatatggtattgcaaaaatgcttaactttgcacatggagatgtaatcatgattggtgcttatgtttctcttctttccatgacaaatgcaggcattccggcatttccggcacttattatttcaattgttgtctgtactgttttaggtattgtcattgagagaattgcatacaaaccacttagaaatgcatcttcttcacttgcggttcttattactgcaatcggtgtcagctacttacttcagaatgttgcacttttactttttggagccaatgcacagacttttccatcaatcatcaaatgggaaggactttcattagccggaggaaaacttaacctttccggtgaaactatcattacaataatagtttgtatcatcattatgatagctttaatgttctttgtacagaaaacaaagccgggtcaggcaatgcgtgctgtatctgaagaccgtggtgccgcacttcttatgggtatcaatgtaaacggaacgattgctctcacatttgcaatcggctcaggacttgcagctatcgcaggtgtacttctctgctctgcttacccaagtcttacaccttacacaggtgccatgcccggtatcaaagcgttcgttgccgccgtatttggtggtatcggttcaatcccgggagcatttataggcggtattcttttaggtgttattgaaatatttggtaaggcctatatttcatcacagatggcagatgcaattgtttttgctgtacttattatcgtccttcttgttaaaccgacaggacttttaggcaaaaaaattcaggaaaaagtatag

SEQ ID NO: 277 - DNA, 1326 bp, Clostridium sp.
atgtacaaaagtataaggttcaggctgatatgcctaatgcttataattatggcttttgcgggggtcttgatgggatgtggaaagtcctcaaattaccaaaaaggtcagcagcagacagctgaacctatagaaacacagagcttcacaggaattattacacgcatagataaaaaactcaggcagatttcagtcagagaaattgatacggatgttgacactatcatgaactatgatgcatcttctgagattactgataagtataaagaagagattgatggggatgagcttgagctgggtcagataatggaaaccacatacagaacggatgacgcaagagttgtctccatgaaagtgccggatgatgcgtgggaatacagtgatgtagataagtttacttttgatactgaggagtgttcaatggaagttgcaggagagctttatcagtattccgaacagacatattttggctctattgatgataaaaagatagatatgctggaactcagtgataaggacaaacttacggtacgcggagtaggatacaaagtgtactctgttgtgagaacggagggacacggttatatacatttgttaaattacagtgattttttgggcggtatgataaatattgatgatgatataatattgcctgttacaaaaaatatgcttataacagtcagctgtggaacatatcgtatcacgataagcaagggtgcggcaaaagcaagtaagactgtcacggtgaaagaggacaaggagagtacgcttgattttagtgattacagaaaaagcgtgaagaatgtcggaagtgtacgtttcaatgttgacccgcagggtgcagacttgtttataaacggaacaagaattgattacagcaaaccaatttctttaaattatggaacatattctgttacggcaagtttaaatggctataatacttataccggacggcttactgttgcagaggcggacaagaccataaatataagtcttgagccgaaagaagatactgcatcggcagctacacagtctcctgagagtacagcggcagccacggcagcaccgacggcaacagcaaaaagccagacaagaaaaattgatagtaaacataccatatcagtaactgcaccggagggcgcagaggtttatctggacaatgtttataagggaattgttccctgcaagtttacaaaagttataggctcacagacgattactttgagcaagacaggttatgagacaaaaagctactcaattgatattctggatgatgataagaatgcaaaactttcattttcggatttgattgaggatgctgataaataa

SEQ ID NO: 278 - DNA, 1563 bp, Clostridium sp.
gaaaggactacgatgatgacaagaaagaaaaaaaatctaatcagctatgtggtatttgcagttgtctgcgttgccattatcatcgccggaatatgttacaaaaactattctaacgaacagaaacttaaaaaagccgagaaaaatgccattacatgtgtcgatgacataaccggtaaaaaaatcggtgttcaaatcggtacaaccggtgacatatatgcatcggattatgaaggtgacaaagaaggtactgttgttgaacgttacaataaaggtactgatgccatacaggcactcaaagatgacaaaataaactgtgttatccttgatgaacagccatcccttgcatacactgaaaaaaacactgaattaaaaattcttgaagaagaatttgcagttgaagattatgctatatgtatagataagtcaaacggcgaattaaaaagcaaaataaacgacgcattagctaagcttcaaaaagacggaactcttgcagacataaagaaaaactatacaggtaaagatgaagaaaaaggtaagtttccttataaaaagaaaaatgtctcaggcaaaaacggcactttaaaagtcggtacaaatgccgcatttaaaccttatgaatattatgacaacaatcagattacaggtcttgatatagacatgatgcaggctgtatgtgacgaacttgatatgaagcttcaagttgaagatatggaatttgattcaatcattgccgctgttacatcaggaaaagttgatgtcggatgtgccggaatgaccgtaactgaggatcgtcttaaaaatgtcgatttcacagattcatacacaacagcaaaacaggtaattatcgtaaaagactacaaagcagcaataaaagctcagtctttagcacagagatttcacgataatttcatatcagaccacagatacaactaccttgtaaaaggttttgcaaatactatagtaattacaatatttgccgttatcatgggaattatcctcggcgcaattatcgcacttataagaacaactcacgacaacaacggcacactgcctattcctaatcttatatgtaagatttatcttacagttgtccgtggaacacctgcaatggtacagcttttgattttctactatattatacttgtatcagtaaattcaaaaatacttgtcgcaattattgcattcggattaaactcagcagcatatgttgccgaagttatacgttccggtatcaattcaatagaccacggacagtttgaagccggcagaagtctcggtcttaactatagacagacaatgacttcaatcgtacttccacaggcattcaaaaatgcacttcctgcactttgcaacgagtttataagccttataaaagaaacatcaatcagtggttatattgctatcgttgacctcactaaagcaggtgacatcatacgaagcaatacatacgatgctttccttcctcttataactgtcgcagtaatctacctcgtaatagttattgcactcacatctgttgcaaatgcacttgaaaggagacttagagcaaatgagcgaaactaa

SEQ ID NO: 279 - DNA, 1824 bp, Clostridium sp.
atgaagtatattggcaaaaaactttttgtacagatgataataggtttttttataggacgaatcggaatctgcgggatgtgtgtgcttggtatatcgtattttgcggcaatatttgcggatatggatgcaaaacttttaatcgctctctgtgttatagcgggaatgttttcaaatctttctattgagatgtccttgtgtggaagtatggtaatattatcaatgcttcttatatatgatacacttgagagacaaaagatacatatacagccgttacattcggcacttattgcggcagtaacttttgttatatacggcggtataaaactatatatgtttccgtacaatgagtatgatatactgcttcttatgtttgggacaggtcttgtattgtcattgtcgaaagtgtttaatgaaatatttaattatctgacagatggcaggaaaagcaggacaaaagagtacgaggacatggttgaaaacaggcttaatgatttttcgcatgtctttgacagaatttcaaaggtcatgtcggatgatgtgcctgaaaacagacagatatgcggcagggacataagaaaaattttcagggaaatgtccgaaaatgtttgtgcaagatgtgaaaaatatgaggagtgttcgggacagacagctatatgcagacctgaaaaattcagaagtcttagcgtttcaggggatggttttataaaaattgaacagatgccgatggagtttgcaagagattgtatccatccggaacgttttttaaatgaggcaaatcaaaatcttcatattgcgagaaatataatgggttacagaaacagagtcagggagagcagaaaagctgttgcaagccagatgaaagagataagtgatgcagtaaaaaatatgcttgacagtatgcctaaaatgcagagactttcaaatgaactggaggaagtatttcaaaaagaattcaggaaaaaaagagttatatgtaaaaatatatatgcatatgaaaaacaggacggacagatagagataataatgaatgccagaaccactaagggaaggcttgtgacggcaacggaattgtcgcggataatgagcagaataatgcaaaagaaattaaaaccgtccgatgcatcaagaaaagtaatagatacagaatttggtgaatatatttttgttgaggagacaaagtataaagcaataacaggagttgcgaggatgacaaaggatgaacaggatgtttcgggagacacattttcaatggtaaatcttcagagcggggagctcttgatggcgctttcagatgggatgggaagcgggacaagcgcattggatgagagcaagaatgtcatagagcttttagaacagatgtcggaagcaggattttctcagacttcggcgataaggcttataaattcgctttatatgtcagaccaggaatttgaaagctatgcaacacttgacatttcgcttataaatctgtataagggagagtgcagctttttgaaaaacggagcggtgggaacatatatattaaatcagggaaaaatgtattgtatagagggacagtcattaccgatgggagttataggagaagctgaaccgtatatcgggaaaatgaatatatattcgggagattacataataatgatgacagatggggtggcagatatgttttctgatgaaaagtataatttagaaaaatacataggacagatagatgcagtaaatccgggagatatggctcaggcaatagtagacgaggctgtaagaagaaattccggatacatatccgatgatatgagtgttatagttgccggagtatgggagaactaa

SEQ ID NO: 280 - DNA, 1410 bp, Clostridium sp.
aggaaaaaagtgcgagttgcttttttgacattaggctgtaaggttaattcttatgagactgagaagatgaagataaattttgaaaaaaagggtcatatggttgttgcatttgaggaaaaggcggatgcatatatcataaacacatgtactgtaactaacattgccgacaggaagtcaagaaaaatgcttcatcgtgcgaagcgcttaaatcctgacgctgtcattgtcgctgccggatgttatgtcgattcggcaaaagctaaaggcgaggttgatgacagtgtagacttatttatctccaataaagataagaaaaatcttgtagaacttgttttaaacaaattatctcagaacggcagctatgacacaaaaatggatgacgtggatatggaaagtcagcagcaaaacagcagtgaaacagtgtctgaagaaaccgctcatattcatatgtcagaggcagccgttgaagaagaacatacaagagcatatataaagatacaggatgggtgcaaccagttttgtacatattgtataattccgtatgtgagaggaccgttgaaaagcaaatcaattgatgagattaccgcagaagttgaaaaactttcaagacagggatacaaagagattgttgttacaggtattcatctgtcctcgtatggcgtggatggcaaaaagtcaggtgcttttcttgaaaaagagggaaagccgttacttgaagcattggaggcaataaacagcgtcacagggattgagagaataaggcttggttcgcttgaaccaagaataataaccgatgaatttgcaaaaaggttgtcggaaatatcatcaatatgtcctcattttcacctgtctttgcagagcggaagtgacagtgttttaaagagaatgaacaggcattatacgtctgaacagtacctcgagggagtaaaaatacttgaaaaatattttgaaaatccggcaataacgacagatattattgtgggatttccgatggaaacagaagatgaatttgttgaaacgcttaaatttgtcaacgaagtgcggtttgcacaaattcatgttttcaagtattcaaggagacagggaaccgctgcagataagatggacggtcagatagctgagagtgaaaaatcagcaagaagtgaaaggctgatagaaaaagaaaaagttcttgagagtgaatttagagaacgggcattaaaaaatgaggaaaaagttttatttgaggaaattacgcagatagacgggaaaaaatatataacaggatataatgagagatatataagaattgctgtaagtgctgaaaatattgaggatgcacaaaacaaatgcaataagataatcagcgtgaaaattatcggaaaagtgaataatgaagtggttcttgcagagttaaatgacaacttttaa

SEQ ID NO: 281 - DNA, 1305 bp, Clostridium sp.
atgacagaatggaggaattttatggttacagctatcgtaggtgctaactggggagatgaaggtaagggtaagattactgatatgcttggcgaagagtcagatatcatcgtacgcttccaaggtggaagtaatgcaggtcatactatcataaatgactatggaaaatttgcattacatttacttccatcaggtgtattttatgatcatactacaagtataatcggtaatggagttgccttgaatatcccatatttatttaatgaaataaatgaattgactaaaagaggtgtgccacagccaaaaatcctcgtatctgacagagcacagattcttatgccatatcatatagcatttgatgagtatgaggaagagagacttggaaagaaatcattcggttcaactaagtcaggaatagcaccattttattcagataaatacgcaaagattggtattcaggtatcagaacttttccaggatgatgatgcacttaaagaaaagattgagagaatctgcgtacagaaaaatgttatacttaaacatttatacaacaaacctgaacttgatcaggcagaaatcttagatacacttcaccagtacagagatatggtagcaccatatgtatgtgatgtatcagcattcttaagaaaagcaatcaaagaaggaaaaaatgtacttttagagggacagcttggctctcttaaagacccggatcacggaatttatcctatggttacatcatcttcaacacttgcagcatatggagcgataggcgcaggaattcctccatatgagattaagagaatcgttactgtagttaaggcttattcaagtgctgtcggagcaggtgaatttgtaagtgagattcttgatgaggaagaggcagataagcttcgtaaacacggcggagacggtggagagtacggagcaacaacaggacgtccacgtcgtatgggatggtttgatgctgttgctacacgttacggctgtgagatacagggtgcaacagaagttgttctcactgtacttgactgtcttggataccttaaagagattccggtatgtgtaggttatgagattgacggagaagttgtaaaagatttccctgttacaacaaaacttgcaaaagcaaagcctgtatataaagttcttccaggatggaattgcgatataggcggcataaaggaatatgacaaacttcctaaagaatgcagagattatattgaatttatcgaaaaagaaataggtgttccaattaagatggtatcaaacggaccaaagagacatgatatcattcacaggaaataa

SEQ ID NO: 282 - DNA, 1446 bp, Clostridium sp.
ttggttttattgaaaaatattttatttgtagcatcagagtgtgttccttttattaaaacaggaggattagcggatgtagtagggtcactgccaaagtgttttgacaagaagaaatatgatgtaagggttatgataccaaagtatgcatgtattcctgatgaatggaaaaataagatggtttacaaaactcatttttatatagatttggcttggcgtaaacagtatgtaggtatcatggagatgcagtatgaaggtgtaaccttttatttcgtggataatgagttttactttgcaggaccaaagccatatggttatatacatgaggatatagagaaatttgcatttttctgtaaagcagcattgtcatcacttccgagtcttgattttcaccccgatgtaattcattgtcatgattggcagacgggacttattccagtgtatcttcatgatatgtttcaggagaatccattctacacaaatattaagacaatcatgactatacataatcttaaattccaaggtgtgtgggatttacagaaagtaaaagatattacaggtataaattcatcattttttacctcagataagcttgaggcttatggtgatgcgaactaccttaagggtggtatagtttatgctgatttagttactacagttagtgattcatatgccgaagagattaagatgccattttatggagaaaaacttgacggtcttatgcgtgcaagggacaattccctttttggaatagtaaacggattagattatgatgagtataatcctgagacggatcctcttatctataaaaattactcggcaaagacattcagaagagaaaaaattaaaaataaaagagcacttcagaaagagctggggcttgaggaaaacgataaaaaatttatgataggtattgtttcaagacttactgaccagaaaggtcttgatttagttgactacgtcattgaagagatatgtgccgaagatacacagcttgttgtacttggtacaggtgaagaaaaatatgagcatttattcagacattatgagtggaagtatcatgacagagtatctgccaatatttattattcaaatgaacgttctcataagatttatgcggcatgtgatgcatttcttatgccatcgctttttgagccatgtggacttagccagttgatgagtctcagatatggaacagttcctattgtaagagaaacaggagggcttaaagataccgtagaaccatacaatgaatacgagagtaagggaacaggattttcgttctgtaattataacgcacatgaaatgctgaatactattcgttatgcaaaagatgtatatttcaatcgtaagcgtgagtggaacaagataattgacagaggaatggcaaaagatttctcatggggacagtcagcactcaaatatgcagaattatatgacagattataa

SEQ ID NO: 283 - DNA, 1434 bp, Clostridium sp.
atgatatggggatttttgtttttatctttttatttatggttttatttatggaatgaggtttatatgtttaaaactttgattaaaaagctgtctactactcagattatcgcccttggttttttaggtacaattttcataggtgcttttattctatgtctgcctttttgttcttccaatggcacttttactcctttcatcgatgcgttatttacttcacctacctctgtctgcgtgacaggtcttgttgttgtcaatacagcctctcactggagtttgtttggaaaaatcataattcttatacttatacagcttggcggtcttggtattgtatctttcgtcaccggtattatgatgattgccggaagccgtattactctaagtgaccgtcttcttttggaagatgcactgaatctcagcacacttaaaggattggtgcgctttttgaaatttatttttaaaggaacatttataatagaaataaccggtgcaatatgttacagttttgtttttattccggattatgggctgataaaaggattgtggttttctctgttccattcggtgtctgctttttgtaatgcaggtattgacctgcttggcgaaaacagccttgaaatatatgcttcaaatgtatggatcaatctgattacaatgtttttaattatctccggcggaataggttttatagtatggaaagatattatggacggttttaaaaatcattttataaaaggattttcttttaaaaaatgtttgcaaaaactcaggcttcatacaaaaataacacttatcactactgctattttaatttttggcggtgcattgcttatatttcttcttgaatatacaaattcagatacaattggtaatatgagtttttcaggtaagataatcgccagtttcttccagtctgttacacttagaactgccggttttgctactttttcacaatcaggattgagacacggtaccgtccttttatgttattttcttatgattatcggcggttcctcaataggtacggcaggcggaataaaaacaacaaccgcagccaccttatttttaagtacacgggcagttgtaaaaaataaaaaccacctttttgtattcagaaaaaatataccgcaccaaactgtcactaaagctctcgcaataacaatggtcagtatatcttttctgttgctggcatcctttagcctttaccaggctgaaggtggttcaatggtcgatgttgtctacgagacaacaagtgcaatcggaactgtgggactgacaagagatttcactccaaaacttcatcttttaggaaaacttattataatcatatgtatgtacctcggtcgtataggcccgatttcaatggttatcttctttaataatgacagcaggaaagaacttgtatctttccctcacgaagacattactgttggctga

SEQ ID NO: 284 - DNA, 1560 bp, Clostridium sp.
atgaacaatacggcaaaaggaccaaagtggcttgacaatgcagttttttatgaaatctatccgcagtcatttaatgatacaaatgcagatggtataggtgacataaatggtattacggagaaactcgactacataaaagaacttggatgtaatgctatctggataaatccatgtttcaagtcgcctttcggtgatgcgggttatgatgttgaagattattacacggttgcacctagatatggtacaaatgaggatcttgcaaatcttttcagagaggcacacaagagagatatgcatattcttcttgaccttgttccgggacatacttctgtacagcatgagtggtttaagcagtcgatgaaagctgaaaagaacgaatttacggacagatatgtctggacagacaatatatgggaatcaccggagggaatgggatgcataagaggaatttcggatagagacggttcatgtgcagtcaactttttctcacaccagccggcgttgaattatggatattataaacctgagcgtccttggcagcaggcaatggatgatgagggaccgaaagcaacactcgaagcgatgaaagatgttatgcgtttctggcttcagatgggtgcagacggtttcagagtagacatggcaggttcgcttgtaaaaaatgatgaagacggaaagggaactataaaactctggcagaatgtcagagagtttcttgacagggaatttccggatgctgcgatggtttcagagtggggagagcctgacaaatcgcttcagggtggttttcatatggatttcttacttcatttcggtccatcccattacaatgatttgttccgttgtgaagaaccgttcttttcttcaagaggaaagggcgatgtgtcagcttttgtagaaaaatatcttgataattatgagaagtcagaaaagaaaggtcttatgtgtattccttcaggaaatcacgatatgggacgactttcgcagggaattaagggtgatgagcttaagatagcttttgcattcctcttatcaatgccgggtgcaccgttcatatattacggtgatgagattggaatgaaatatgttgagggattgacatctgtagagggaggatatgaaagaacaggttcaagaacacctatgcagtgggatgacagtgtaaatgcaggcttcagcagtgcaaagaaagagatgctttatgttgcacaggacagtgatgaaaatcgtccgactgttaaaaatcaggcagcagatgaaaattcactctacaatgagataaagaagcttataaaaatcagaaaagagcatgcggctcttttaagcaaaggtgaaatagaatttgtagctgcaaagaaagatacttatccgcttgcgtatgtaagaagcagtgaggatgaaaaaatacttgtagttataaatccttcagcagaagatgttacatttgattttgacggaaagttcggagaagaaatctatcgttttggtggaaacgcagagagtgacggaaaagttgttaaagtttcgggacagacagcagtatttgtaaagcttgtataa

SEQ ID NO: 285 - DNA, 1923 bp, Clostridium sp.
atggagatgagcatgagaataacagatttattggatgtaaagagtataagtcttgaccttgcacctgggtctaagtcggaagcacttgatatggctatagacctcatggtaaaaagcggcaagataaacgacagagaagcttacaaaaagcaggtttatctgagagaagaagaaagcacaacaggaattggtgagggaattgcaattccgcatggaaagtgtgatgcagttgacaagccgggacttgcggcaatggttattaagaatggagttgattttgactctcttgatggcgaaccggtaacacttcttttccttattgcggcaccaaatacagaggataatgtgcacctcgatgtgcttagcaagttatctgtgcttatgatggatgaggagttttccaaatccctcagacaggcaaaatcagttgaagaatttcttgcaattatagataaagctgatgatgagaaaccggatattgatgagaggcttgaaaaaacaaatgtgcctaatgaattgggaaagaaaattctcgcagttacatcatgcccgacaggaatagcacacacatacatggcagcagaaggaattgagaaagctgcaagtgcagcaggtgtaaatgtcaagatagagacaagaggttccggtggggcaaagaatgtacttacagacagtgatattgcacaggctgactgcattatcgttgcggcagatgcaaaagttcctatggagagatttgacggaaagaaagttattgagtgtcaggtttcagatggtataaataaagctgatgaacttataaagagagcagtagacggcgatgcacctgtctaccatgcagcaaatgcatcagagagccagagcaaagagacatcaggaggaagtatagggcataagatatatacacagcttatgaatggtgtatctcatatgcttccgtttgtagtaggcggtggtatacttatagcaatagcattcctcattgacggattgtcagttgatatatcatcactttcagttgaggatcgttcaaacttcggtacaatcacaccggcagccgcaatgtttaagagcattggcggactagcatttaactttatgcttccggttctggcaggctttatagcaatggcaatcggtgacagaccggcacttgcacttggttttgtaggcggaatgattgcatataacgggaaatcaggtttcctcggagctatggtagcaggtttcctcgcaggatatgtaattattcttcttagaaaagtatgtgagaaacttccggaagcacttgaaaaacttgcgccggtacttatttaccctgttgtaggtattcttataatgggactgggaatgaactatattgttgagcctgttatgggtgttataaacacaggacttaattcatggcttggaagcatgggcggttcaagtaagattgttctcggatttatcttgggcggaatgatggcaattgatatgggaggcccattcaataaagcagcttatgtatttggtataaattccatagcagccggaaattatgatattatggcggctgttatgattggtggtatggttccaccatgtgctatagcacttgcaacaatgttatttaaagataagtttacaaaagagcaaagagaaagcggccctacaaactttgtaatgggacttgcatttattacagaaggtgcgataccttacgcagcatcagatccgcttcatgtaataccttcatgtatcatcggttcaggtgtggcaggagcactcagcatggtatttaactgtacacttatggcaccgcatggtggaatttttgtattccctgttgttggaggttcatggttatatcttgtatcgcttgtaataggaacaatcgtttcaacagcattgctcggtgtacttaaaaagaaaatagcataa

SEQ ID NO: 286 - DNA, 2184 bp, Clostridium sp.
atgggagatgatatgattaccgaaggtatgcttgatatgttcatcttcgaaacagaacaggggcttgagaatcttgaaaacatatgtcttgaaagtaaggatgtcggcgaatttgacgaggacaatgtaaatgagatattccgtatcatgcatacgataaaaggttcgtcagccgttatgatgtttcagaatatagcaacacttgcacataaacttgaagatgtattttactttataagagaaagtcatcccgatggtgtaccacatgatgaacttgttgatgatgtgcttgaagtatctgattttataacagcagaaatggaaaagataaaggacggcggagaacctgatgaagaccccgcaggacttattgaaaaacttgataagttcctgaaaaaaattcagaataaaacagatgtcgatgccggacagattatagccgagaaacaggaaaaagccaaggaaagtgaaaaaccacacttttatatagcacctgttgcttcggacgacagtaaattttacagtatttacattacatactataaagaaactgagatggcgaacataagagcatatatggctgtaaattcattgaagggaattgcagaggacatactttatacgccgtcagacattatttcaaatccggacagtgcggatgttgtacttgagtttggtttcagaattgcccttcagacaacggaagagccacagactattacagagcttataaattcaagtgccggtattgaaaatatagaaataaaagaatgcacaagtgatgaatttcttgacttttgtgttgaggcagagagtaaacctgcatcaagtgccggtgatgtgcttacggcaccggttgaaaagccgacgatacttgtagacagtcagaagccgggcagccagagggcagaggaagaggcgcaggctgaaaggcaggatgcgacaaaaggggaaagtgggaaagaagcaccaacaaagaaaaaggctgcgaaaaagcctcgtgtaaaaaaaggtgaggcacaaagtttcatcagtgtaaacataaaaaagatggatcttcttatggatcttataggagagcttgttattgcggaagcggttgttttgcataatcctgttttaaagttaccgggtcttgaccttaccaatttccaaaaatcggccggacagctttcaaagataacatcagaacttcaggacgcaataatggcaatgcgtatgatgcctcttaaaaatacattccagaagatgaacagaatagtttacgatacatccaaaaagcttggcaaggatatagaacttgaagttataggtgaggatacggaagttgacaagaatatcattgaacatatttccgatccgcttatgcatcttatacgaaactctgtagaccatggtatagagagcaatgaggacagaaaggcacttggcaaaaaagaaaaaggaaaagttgttcttgaagccaaaaatgaaggcggtcaggtctggatttcggtttcagataatggtaaaggtcttaaaaagagtgaaattcttgagaaggcaaaagcaaacggacttcttggaaataaatctgaaaaagatttgacagagaaagagatattcaattttataactgtaccgggattttctacgaagaagaaagttacagagtattccggaagaggagtcggtatggatgttgtagtaaagaatatccagcaggtcggcggcgtgctcgacattgaaagtgtagagggtcagggctcgacaatgacaatgaagatacctcttacgttggcgataatagacggaattatcttctctgtaggagagactaattttgttacaccgactaatgcggttactgaatttatacgtgttgaaaaagacaagcttatagtagaacctgatggcgaagaatatgtgatgataaggcaggagtgttatcctcttataaggctgaacgagttttatcatcttgatggtgcagttgaagagattgaggacggaatagtgataatcttaaatcacgaagacagaaaactggctgtctttgctgacagtcttgtaggtgaacaggagattgtagttaaacctattccttcttatgtcaaggctgtaaaaggaatatcgggatgtacccagcttggtgacggaagtatcagtcttatacttgacacaggcggacttgttatgaattga

SEQ ID NO: 287 - DNA, 1737 bp, Clostridium sp.
atgcttaagtttgataaagtttcattcaggtatccgggacagtcagaaaatgcaataaccgatatatcatttgaaataaaaaagggtgagtttgttttgctctgtggtgagtcaggctgtggcaaaactactttattaaggcatacaaagaaaaatcagattcctacaggtcatggctgcggaaaaatgtattttgaaggtaaagacattgagatgcttgacgaaagggagagtgcttcatgcataggatatgtggggcagagccctgatggtcagattgtaacagacagggtatggcatgagcttgcttttggacttgaaagtcttggatacggaagagaagagatgcgcagaagaattgcagagatgtcagagtatttgggcataagcggctggtatgagaaaaagacggatgaattgtcagggggtcagaaacagatattaaatcttgcttcggtcatggtaatgcatcccagattgcttatactcgatgagcctacatcgcagttagacccggtttcttctgacagatttttgcagaatatagtgaaactaaacagggactttggagttacaattcttatttgtgagcagagggtacatgaagttattgcaagggctgacagggttatgcttatgaaagatacaaagcttatcggatttgataaagtgcacaagatagccggtcagatgaaagaaagtgcaagtaaagtttatgaggcacttccgggatacatgaaactttggctggaatatggaagtgaaggaagtctgccgctgacgataagagatgcaaaaatgtggatagacagtataaaaagcaggtttgatgttgaaacagaaggcaaaaatccggcatttgaaaaaggtgtattggcaggtgtaccgaaaaaaactcctgaaaaacataaaaaagatatattactgtcagccggacatctaagtttctcatatgataaaaataagatattaaaagatttctccatagacatatcgggaggaaatatatatgcgattatgggtggaaacggttcgggaaaaacaaccgctttaaaaatccttgcaggaatttacaaggcaaagagcggaaaaataaagaaaaaaaaagatttgagagcagtataccttacacagaatccgcagacggtatttactgagataaatgtttatgatgaacttagagaagtttttacaagtcataaggatttctttaagaatgaatatacaaaatatcaggataatggtaggaaaaatacacaaaagtatgagtgttttgttgatacaaagataaatgaaatgcttgaaaaaatggaattatcagatttgtctttgagacatccttttgatataagcgtggggcagcaacagcggcttgcaattgcaaaggtattacttttaaaaccggatgtattgctgcttgatgagcctacaaaaggtcttgacggtgagtttaagaaaaaactggcaggcatattaaaaagaatgacaataaacggcatagcggttgtgcttgtatcgcatgatattgatttctgctcggaaaatgcagatgtatgtggacttttatttgacggagagatggcaggaatgcagtctgttgatgactttttttcaaacaattatttttatacaacagatatctgcagaatgttttcagacttgtatcaaatgacagcaggaattaaaagggatttaccggtaaattacagacaggcggtggaaatgtttgagggataa

SEQ ID NO: 288 - DNA, 1194 bp, Clostridium sp.
atgatagcaaaaaagatggttaaatatgttgaaggaagttctgttatccgtgccatgtttgaggaaggaaaaaagatggcacaaaaatatggagcagagaatgtatatgattttagtctgggaaaccccagtacacttccacctaaggcagtaaaccaggcgattatagatgttgtgaacaatgaagaaccaaacagggttcatggatatatgaacaattcaggatttgaagatgtgagggatgcaattgcaaagtctttgaatgagagatttgagacagatttttcagaaaaaaatattcttatgacagtcggtgctgccgggggattgaatgttatactcaaatcaataattgaccctggggatgaggttatcacttttgcaccgtattttggtgagtacaacaattacgttgcaaattttgacggaaaagttgttgcggtttctcctaatccgcctacatttcagccgaatataaaagaattttcagagaaaattacagcaaaaacaaaggctgtcataatcaataatccaaacaatccgacgggtgttgtttactcggaagacacaataaaagaacttgcaaaggttctttgcgacaaacaggaggagtttggcacagcgatttatcttatatcagatgagccatacagggagcttgcatatgacggtgtatatgtaccgtatcttacaaaatattatgcaaacacaatagtcggatattcatacagtaagtcattatcacttccgggtgaaagaataggttatcttgtaattcctgatgttgtggacgattttgaaaatcttgttgcggcagcgaatgtggcaaacagaatacttggttttgtaaatgcaccgtcactccagcagcttgtgataaagaaatgccttgatgagagtacagatgtttcggtttacgacacaaatcgtacacttttgtatgataaacttacatcacttgggtttgaatgtgtcaaaccgcagggagcgttctatctttggatgaaagctgccgagcctgatgatactaagtttgcggcaaaggcaaaagaatttaatctgcttcttgttccgggaagttcatttatgtgtgcaggatatgtaagaatagcttattgtgttgataaaaaaatgattgaaaaatcatttgcagcgtttgaaaaacttgcagaaagttataatttaaataactag

SEQ ID NO: 289 - DNA, 2937 bp, Clostridium sp.
atggcaaaaatgaagatatatgagattgtcagcagtatgcagagacaattcccagatttacaaaataaagatgttgttacattactacaggaaaacggatttgatgtcaagggctcgcagagcgttatcgaggatgatgcgataggttttttgttaaaacacgcaaaagagcatttggctaatcttaaaaagagtgagcatgcgaagaagaaagatacaaagaaggcagaaactccaaagaaaaaggaggaaaaagctgaaaatacttctgcaagtgagaaagcggcagttaaagaaaaggcaaaaaaagaagaagttaagccggaagtaaaaaatacggttgaagaaaataaagatacaaaaagtgaaaaggggcaggaaaaaactgtagcagctgagacagaagaaaataaaatgcaggaaacagaagaaaagggaaaagaggaaactgtgaagcaagaagagaaaaaagaagtagttaaaaaagaggtaaagaaagctgagccggagaaaaaatctgaagtaaagagtgcatcagaggataaaaaggaagaaaagaagtctgacaatcagcaggaagaaaagagagacaacagaaacagtcagagtcgtgataacagggataacagaaacggctcaaaccgtgacaatagagatagagataatagaaacggtggaaacagaaataatggaaaccgcgataacagaaacggctcaaatcgtgacaatagagataatagaaacggcggaaacagagacaacagaaataatggaaaccgtgataacagagataatagaaacggtggaaacagaaataacggaaaccgcgataacagaaatggctcaaaccgtgacaatagagataatagaaacggcggaaacagagacaacagaaataatggaagccgtgataacagaaacagaaatcagggcggcggattttcaagaggcgcagctatgccaatggattcaatgaaatctgaggttaaacagtcaagacagcagagagcaaacaaggattcaaggagtgccaaacagaaatacggcaaggacagaacaagaggcatggatgatgatgaaatgtttgagcagagcagaaaaaataagaagaaagaccctaaccgcaagggagcatttatcaagcctgaacctgtagcaaaaccacaggagccggaagatggaatccgtacaatcacacttcctgaaaagatgacaataaaagagttgtctgatataatgaaagtaactccttcaacggttatcaaaaacctctttatgcgtggtcaggtagtaactcttaaccaggagataacatttgaagaggcagaagagattgcacttgaatataactgtattgcagagatggaagaaaaggttgatatgatagccgaaatcctcaaagaggatgaggaagatgagaaccttatggttaagcgtcctcctgtagtctgtgtaatgggtcacgttgaccacggtaagacatcacttcttgatgctatcagagaaacaagcgttacttcaagagaagcaggtggtattacacagcacataggtgcttatgtgacagagataaacggtgagaagattacattccttgatacaccgggtcatgaggcgtttacatcaatgcgtatgcgtggtgcacagtcaacagatattgctatccttgttgtagcggcagatgatggtgttatgccacagactattgaagctataagccatgcaaaagcagcaggtgttgagataatcgtagccgtaaataagattgataagcctagtgcaaatgttgagagagttaagcaggagcttacagaacacggacttatcgcagaggactggggtggagatacagtatttgtacctgtttctgcacatacaaaagaaggtatagaccagcttcttgaaatgataatccttactgcggaagtgcttgaacttaaagcaaatccaaacagaaaagcaagaggtgttgttatagaggcgcagcttgataagggacgcggacctgtcgcaactgtacttgtacagaaaggtacactccatgtaggagacaacatagctgtaggagcagcatatggtaagataagagccatgatggatgatcagggaaagagagttaagacagctcttccgtcaacacctgttgaaattttaggacttcatgacgtacctgatgcaggtgagatatttatggcaacagacagtgataaagaagcaagaaatatcgctgaggtatatattgagcagggaagagaaaaacttcttgatgatacaaaatcaaaacttacgcttgacggattgttttcacagatacaggcaggaaatatcaaagaacttaatcttatcgttaaggctgatgtacagggttctgttgaggcagttaagcagagtctccttaaactcagcaacgatgaggttgccgtaaggataatccatggagcagtcggagctatcaatgagtcggatgtatctttggcaagtgcatcaaatgctattattatcggtttcaatgtacgacctgacaatacagcaaaggaaattgccgacagagaaaaagttgacgtaagactttacagagtaatctacaatgctattgaagatattgagtcggctatgaaaggaatgcttgaccctgaatatgaggaaaaagtaataggtcacgcagaagtaagacagacattcaaagcttctggtgtaggtatgatagcaggttcatatgtgcttgacggaaagattgagagaaactgcaaggtgagaatcagccgtgagggagagcagatatttgaaggagaacttgcatcactcaagagatttaaggatgatgttaaggaagtggcagcaggatacgagtgtggtcttgtatttgaaggttttaatgacatcaaggttgaagatcaggtagaagcatatatcatggtagaagttcctagaacatag

SEQ ID NO: 290 - DNA, 1311 bp, Clostridium sp.
aaaatggaatacgctacacagatggatgccgcaagaaaaggcatttatacaaaagaacttcttgcagttgcggaagatgaaaaatttgataaggatgagcttataaaacttgttgcagaaggaaaagtaataattccggcaaacaaaaatcataaatgtttaaagcctagcggaatcggaacaaaactcagaacaaagataaatgtcaatcttggaacatcaagagactggactgatcttgacatggagatggaaaaagtaaaaagtgcagtagacatgggtgcagaagctatcatggacttgagttcatgcggtgacacacaggtgtttagacgcaaacttacaagtgaatgtcctgctgttatcggaactgttcctatttatgatgcagttgtatattataaaaaagcacttaaggatattactgcaaaagaatggattgatgtcgtgagaatgcacgctgaggatggtgttgactttatgactattcattgtggaataaacaaagagactgcaagaaaatttaagagaaataaaagacttatgaatattgtttcaagaggtggttcaataatctatgcatggatggagatgacaggaaatgaaaatccattctatgagtattatgacgaagtgcttgacatatgcaggcagtatgatgtgacaatgagcctcggtgacgcatgtcgtccgggatgtctcaaagatgctacagatgcagctcagattgaagaacttattgctctttcagaacttacaaacagagcatgggaaaaggacgttcaggtgatgatagaaggaccgggacatatgccgcttaaccagataaaagcaaatatggaagtacagcaggcaatgtgcaagggagcaccgttctatgtacttggaccactcgtaacggatattgcacccggatatgaccatattacagcagcgataggcggagcgatagctgcaacatatggagcgtctttcctctgctatgtaacacctgccgagcatcttagacttccggatgtaaatgacgtaaaagagggaataattgcatcaaagatagccgcacatgcagcagatatagctaaaggtgttccgggagcaagagactgggatgacaacatgggacaggcgagaaagaatcttgattgggagaagacgtttgagtattcaatcgaccctgaaaaggctagagcatatcgagcatcagcaaaaccggagaaagaggacacatgttcaatgtgtggaaacttctgtgcagtaaagaatatgaataagatacttgacggagaaatagtatctatatttgatgaataa

SEQ ID NO: 291 - DNA, 1605 bp, Clostridium sp.
gtggaggtgccggaagtgacagaagataaggaagaaaaaaattgttatacaagcagatataaggcattatttactaacgccgaagatatgatattattctttgatgctgacgggtttgtgtgcgaaaaaaacgacgccgtctgcaaaaacctcggatgtaccatggatgataaaatttatatgcaggatatttttagaacatgcatgtctttgaaagatggtaagatagaccttataggtcataaatacggcattagttttgagacagttgcatacagaacaaatgagacatgcttctctgttgttgcgtatcttgcacagcttcaggagagcacaggctgttatggtttctgcaggattcatgacattgtacagcagaaggagacaaagaaagagcttagaacagctaaaatggaagttgaggagacgcacaaagagagaaatgaaatggttgcaaatgtcacccatgaacttagaacacctgtaaacggtgttttgggactggcacaaaatctccttgataccggacttgattctgagcagcgtgagacaatagagcttataatacaatgctgcaacaatatgataaagattataaataacattttggacttttctaaaatacaggccggcaaatttactatagagtatacggaatttaacttttatcagatgatggacaaaattgtgaaagtaaacaggacacaggcagagtcaaaagggcttaagcttatctgcaatgtcggagaagatattcctgaacttatgaccggtgatgaacttcgtgtaactcaggtattaaacaatctgttatccaatgcgattaaatttacctcaatggggcaggtcacactgaatgttgtaaagagttttgagacagaagaggaacttgaactgtttttcatggttacagattcaggaataggcatttcagaagaggaaaaagacaagctgtttaaaagcttttcacaggtagatgcatcaattacaagaaagtttggaggaaccggtttaggactcagcattgtaaaaaatcttgttgaaatgatgggtggagacatcaatgttgaaagtgagaaaggaaaaggaagtacattttcattttcaataaaagttaaaaagatagtatcagaagaagacaataaaacagaagaaaagactgaaaaagctgaggaaaaaacggagtattcatttaattacagcggaggttttcagctcgatgaagaagaggaagaaaataatctttataaacttggctcagaggaaaatataaaagccatagatgaaaattgcgagaagcttgttttgtgtatagagatggaaaattggaacagggcaaacagttttgcagatacgataaagctgcttgtggcagatgatccgatgaatttaaagagaaaagctttcagacttcagatgacggtgagaaaaggtgaccatcaggcggcattagatgattatgaagtattaaaaaaagctattgaggagtttaaactacagttagaaaggcggttatttggcatgacagtaagcatgcaggtgaatgagcagccaaatatactgatagtggatgatgtatctactaatcttgttattctttctgaa

SEQ ID NO: 292 - DNA, 2388 bp, Clostridium sp.
gtgagtaaattgacattaaaacatataaagcttcaaagccttgatgattttttcattccgcttagcggacgtaatgaaaagggtgtttatttttatcgttttaataaaacatcagaaaaaatagaacagtttatttataaatattataatgaagcaagaaagtcgggggttgtaattgaggggaaaatcggaaatcccaccgaaagtaatctttcgtattatgaagaaattatgggattagattttcaaatgagtatgggatttatctctactgctttaaaaaagtggcttccaaggatgggaatgtttcagcgggagaatattgccggagcaatatatgatgtgcttgatgaactgagaaaaaaaggcaaaaatgaaaatatgcttaaaaatgcatatattaaatttatgtgctggctttattataaatttgagagcgttgtaaatcagatgaatggcgagaatatacctaagattttgtttattggggatattgtcggatatgagtttatgcttataaatattttggctgatgcagggtgtgatgttgtttttgtacagccacagggagacgatgcatatctcaaggtggatgcatcacttgaaaagtcagtcgaatatacagatacggatatggctccgtttgaaaaagatttcagcataaaaaaacttacacggaaaaatgatttaaacagacggaacagtaataatccttcagagtttaaggagcatatactaaattgtacaaatgcctggattgatggaaaaggaattgatgatttcttacggccagtatctgttagaaaaaacaagtttaatgaattaaaaaataatttgcagacaggaaatactttaggacaaaatggctttgaaaacacatctgataatcgttatgcagatgagaaaaatttgttttataactgttatatcaggataaacggtgtgtgggataaacttacatacgagaatgaactctatcagttttatctttcactccaaggaatgaaaaggaatgttgttgtcgtaagtgaaatgattcctaagcctgatacggatgagatagcgaagataaaaagaggaaattacagggacgtatatcagcttgtaaaggagctccaggtcaatattcagtttcctgaaagaccgagtgtaaggaagtttttggtcaatgcttttgctgatgttattttggatgaggctaagaggcttgaacaaaatactaatattacaaatataaataaaattttgaataaggcagtttatctgctctgttttataaacagataccagacagcgctatttaaagggctggatgatgatatggtatcatgttttatatacatgggagggtgcaatgatgaaaatgaggcattgtttatgcgtttccttgcaaggacaaagacagatgttttgatattgtgtccaaatgcaggaaaaaagtgctgtcttgaagataaaatattatacgagataaattatccggattatcttgccgtaaataagtttccgatgcaaaatgcagatatgcacattggaacggcggcatatcatgcagagagagaacttgatacccttatgtataatgatgatatgttgtttagaaatcagcagtatgacaaggcaaatgcaatatcacttaatactatggacagtgagattaaaattttgtgggatacggagctgaaatacaggccgggcttttcgacagcctccggtatcgtaaacattccggttattttttctaaattttcaggtgtgaaagacaggaacacaaaagagtattgggttacattgaaacagcttatgacacctgagacattggtgattgacagtgcaccgtatattttacctacggatgctaatccgatgaaaatgtttgctacggagttttttaaaaatggaagacttcacagaaatgttataaaaaatcacagagcatatcagtatggttttctgcgtgaagatatgcaggaacatattttggataaaattgagcttttgctgcagcaaaagtcaataaagggaacttttgaaaatgggacagaatatactatagttgcaatagctctaaatcttcctaaggaagtgacaagattgttgcaggcatttgattttacaaagaaaaatcctaagcttatttatttaaatacatcagatagtgtgatatctctggaagatacgatatatatagcgttcttaaatcttcttgggtttgatgttgctttgtttgtacctaccgggtacaatatggaaaattattttaatatgaagcttatggaagaacaccagatgggggattatatgtatgatcttcaagtaccaaattggaatagtattccgttaagtgtacacacgtcattgcgtgacagactttttagacgtggatga

SEQ ID NO: 293 - DNA, 2097 bp, Clostridium sp.
atgcaggcacagtatgttgtgcaggaatggagaataatgtatagaatgaaacatagaataaggcttagaggaaatcttaagacctatttgagatggcctctgttttttggattgttatttattttaatgacagttcagcttttttcagtgtcagttaaagccggtataatgggtgtgttttacactgttatttatttgttgatagcttttcttataaatttttccggtagaagaaagctcaagaaagatcttatagaatttgctacaaactatggtgaaatgcaaatgcggatgatgaaaacattgactgttccgtttgcaattctgagcgatgatggtcatatgctgtggggcaatgatgaatttgtatcagtcatagtcaacaaaaaagcggcaagaagaaacatttcaaacatatttgaggaaattacaatagacagtctgccggactctgatgagattaaggtgatacatgtaaaaacagaagataaatattatcgtgctgttatgaaacttattgtatcagactcaccggatgatgatgagacggtaaaaactgacataaatcagcttatggataacagcaggctcatttctgtattcctgtatgatgagactgacatgatggaacttgagcagaagagagaagcggaaaatcttgttgtgggtcttttatatattgacaattatgatgagcttatcgacagcatcgatgaaattaggcagtcgctgattatggctctgatagacagaaaaatcaataaatacatgcaggggatagatgcaatctctaaaaaactggagaaggataaatttttgtttttatttaaacagagttatcttgcggagatatgttcaaatcgttttgcaattttagaagaaataagggatataaatctcggaaatgaatcaagtgcaaccataagtattggtattggtgtgggcagagatacatttgttgagagatatgaccttgcgcgtgctgccatagatcttgcactcggaagaggtggcgaccaggctgtagtcaaatctgttgaccaggaaaaattctacggtggaaaaagtgttcagatagaaagaaatacaagggtaaaagcgagagtaaaagcacatgctttaaaagaacttatagagggcaaggaaagagttgtcgtaatgggacattctataggtgatgtcgattctttcggtgcttcaataggtatataccgcattgcaaagacgcttaacagaaaagcgaatgtcgtattaaatgaggtaaatcagtcagttaaacctataagagacagattttatacaaaagaatacgagggtgacatgattgttacaggtgacgaggcaaaagaacttgtagatgaaaatacggtacttgtaattgtagatgtaaatagagcaagttatacagaatgcccggaacttattgagcaggctcagtctgttgtagtgatagaccatcacagacaggcgggagatgcgattgataaggcggtattgttttacattgagccatatgcatcgtctgcgagtgaaatggttgctgagatttcacagtatatcggcaatggtcttaagcttaaatcagcagaagccgaggcaatgtatgccggcattatgattgatacaaattatttttcaaataaaacgggtgtcaggactttcgaggcaatggcttatctgagaagaaacggagctgatgcggttcgcataagaaaggctttcagggaggacattgacgaatataagataagagcggcggctatacaggatacggagctttacaaggatgcatttgcaatagcagaaagcaagagtgagggaatagaatcaccgactgtatttgcatccaaaattgcaaattcacttctcgacataaatggagttaaagcttcatttgtacttacaaaatatagagggaaagtgtatataagtgcacgttcaattgacgaagtcaatgtccagattatgatggagcagtttggcggcggcggtcatataaatatggcgggtgcacagcttgagaatgttgaagtggaagctgtaaaagatatgattagaaaagaaatagacaggatgatagaggaaggagaaatatag

SEQ ID NO: 294 - DNA, 1554 bp, Clostridium sp.
atgaatacagtttttatcgcagatgatgagttgataatcagacaaggtatcaaatgtatcattgattgggagcaacttggttttgaaataatcggagaagcatcaaacggtgaagatgctctcaattttattttaagtaaaaaacctgacctggttcttatggatatacgcatgccaaaaatgcttggtcttgaagttgttgaaaacgcaagaaaacgaggctttaacggaaaagttataattctcagcggttataccgattttaaatacgcacaggcagcgattaaaaacggcgttgactattatctcacaaaacctattgatgaagacgaactctacgagacagtaagtgccataagttcacagataaataaagaagccaaagaagaggaaactcttagtaattaccgtgacaaagcaaagggcatgattcttttcgacatacttacaggcgttcctacaataaacaatattgcagacatgaatattcacgctgacatatatcaggttgtcatttacgaaaaatacagtcatcatgcaactgagcttccatataaattttcagatttgcttaaagttacaaatgaatcaaacagttcatatgaaagcattgagattgaacaaaacgaagttattctgctcaaaggtgcttttacactacataaattccaagaatttttagagcattacaacagagaacaaaaaccacaggagaactctcctctcgactctctgtttattgcatacggcagagaagtcacttctattgaggatgtgcatatttcttatgaagaagcccacaaacttcttcagagaaggttcttctgtgaagataaacagcatactataggatatgatgaactaccgcgtgaggaacttgaaaacacttatgagatttccgacagccatttacaggattactgtgaaaaactcacaggatatattcaggcttcaaagagaaatcagattgccgaaactttacacgaacttgaacataatctctttaactcaacaagtgatatttcaagaataaagctttttttgactgatttatatttgtcgataaaagaaaaaatttcgcatctgtaccacaatgctaatattgctttccccggaaatgcggaaatcatcgattatataggaagcaaatattatctctatgagataatgctgtatttcaccgaacaatttgacatgattaccagaacaataggcaatcctaccagcgaaggtgttatggacgatattatacattatattgaacacaactatatggataatatcaaacttgaaaatattgcaccgctttttggttataacagttcatacctcggcaaaatcttcaacaaaaaaataggcgagggattcaatatatttgtagacaaagtaaggattaaacactctaaagagcttctccttacaacagacctcaaagtttatgagatagcagaaaaagttggctataaaaatgttgactatttccatacaaaatttaagaaatatgtcgaaatgagccctgctgaattcagaaagaaaaacaaggataccatttga

SEQ ID NO: 295 - DNA, 1188 bp, Clostridium sp.
atgaatattttagtagtaaattgtggaagttcatcacttaaatttcaacttattgattcagatacagagcaggtaagtgcatcaggaaactgcgaaagaataggtcttgacggaatgattacatataaggctcacggtgagaagtttgttacggaaacagaccttccggagcatggaattgcaatcaaaaaagttcttgaacttcttgtagataaagagagaggtgtaataagctcacttgatgagatacatgcagtaggacatcgtatggtacatggtggagagaagttctcttcttcagttatcattacagaagatgttataaaagatattgaaagctgtaacgaccttgcaccgcttcacaatccggcaaacattttaggtgttcgtgcatgtcaggaagttatgccgggtgtaaagcatgttgctgtatttgacacggcattccatcagacaatgcctgcaaaagcttatttatatgcacttccaaaagagtattatgaaaaatatggggtacgccgttatggattccatggaacaagccacagctttgtatcaaagagacttgcagaacttgcaggacttgactataacaactcaaaaatgattatctgccatatcggaagcggagcaagtatttctgcaattaagaatggcaaatcaattgatacaagtatgggtatgacaccacttgaaggacttgtaatgggaacacgttcaggagatattgatcctgcaattgttgaatttatctgccagaaagaaaatatttcagtcagtgagatgacgacaatcttaaacaagaagtcaggtgtacttggtctttcaggagtatcaaatgactttagagatttggtagatgcaagagagagcggaaataaagatgcggcaaatgcacttgatgtactcgtataccgtatcgtaaaatatatcggtgcatactatatggcacttggcggagttgatgctattgcacttacagcaggagccggagagaacaataaagaagttcgtgagatgattatggaaggaatcagtgtacttggcgtaaagattaaccaggaggcaaatcagacacgcggagaagagatacttctttcaacaaaagacagcaaggttcctgtatggatagtaccgacaaacgaagaacttgcaatcgcaagagagacagcaagacttgtaaaatag

SEQ ID NO: 296 - DNA, 1206 bp, Clostridium sp.
atgggtgtgcatggaataaataaaaagaaattcgacggcggcgatgagttaataagaaaggcatttaaaatttacagtgataaagatttggaaagttcaatggaagatttcggttttgaatatagagatgacaaggtgtttgaagataagatatataaagtcataaaaaaacttccgataaaaaatccacgttcaaaagcgcatattatatgtattgctgttatatgtatggttctggtttttggatgtattaccggatacagatatatgagaagcagaaagcaggcggggcagacaagtgtattggagagtgtgtgtaaggaggcaaaaacacgttatgatataaatcaaagcaataataatctgaatgccataataggcggagaaacaagtctgtctgatgaaaaaacgcagcttaaagattattataacagccggaatacagcggtttatgtaaatacaaagaattatgataaaagcggttatttgtacagcatgtacttattaaatgacgaggaggtaaaaaaacttacggataaagaagtagaactaaaaaaggcagacgatactgaaaagctgacaccatttttagaaaatgctccggatgacagtaagtattctgctggaaacatatattttataggtgggcgtaaaagtagaaagtttattgtatataaaaacaaatcggatgacatgtatataggaaagtgtgtgggatttgaaagtttaaaagatcatgatataataacagataaaaaagttaatgaaaagaaatcgatttctgcgggtgaatttttggaaaacataatggacataaaaaatgcagatgacatacgggaaataatgcttgaaagagtcagagcaaaatcaaaagctaatcctgataaaagaattgcagtatggacatcagacgaatcaaagagtgaactttacgaatttctcacaaaagaaagcagcattgaaatggagagtgtgggagatacatccggtcagttgtggtttggtgctgccgagcctcaaaaatgttattatcttgcagttgagaataatgcaggtgagttttgtgtgttcggtatagtttttgaagaaaaagatacaatggtctatgttgagccacagtataaaccgggaacggcattaaaattatcttacgaaaataccgcaaaacttagaaaaataatcaaagagaatgataagcagcagtga

SEQ ID NO: 297 - DNA, 1341 bp, Clostridium sp.
ttggaagaagaagtgataaagagacttccgcctaacaatgtggaagcggagaaagctgttataggagcgatgatgttagattcggatgctataatggtatgttccgagatacttacagcaggagaattttatcaacagcaatatggaattatctttgatgctcttgttgaaatgtacagagacgggataggagccgatttggtcactatccagaataagcttcgtgagaaggaagtcacacctgaactttacagtgtggaatatttaggagaacttttagcaagtgttcccacatcggcaaatgtaaaattttatgcggagattgtacatgaaaaggctgttttaagaaggcttatcaaggtaacagaacaggttacaagagagtgttacatggacagccagccgttagaggatattctcgaggacaccgaaaaaagcgtgttcgatgtaatacagcagcgtggaggaagtgagtttgagccgatcagagacgttgtgctcagaactcttgacagtatagaaaaggcggctaaacaaaaaggaaacatcacgggtcttgaaacaggctttagagatttagatgctaaaacggcaggattgcaaaaatccgaccttatacttatagcggcgagaccggcaatgggtaaaacagcatttgtgctgaatattgccgagtatgtggcacttcacagcaacagtacaatagctttgttcagtctcgagatgagtaaagaacagcttgtaaaacgtatgcttgccatgaattcaatggtagattcgcaaaagatacgaaccggtgatttggaagatgatgactgggacaaacttgtaggaagtgtacgaaaaataggaaattcaaatcttgtaatcgatgatacatcaggaattacggcatcggaactccgctcgaaatgccgtaaattaaaaatagaacagggacttgaccttgttataatcgattatcttcagcttatgacgggtgcgggcaaaagaaaaagtgacagcagacagcaggaaatatctgatatatcgcgttcgcttaaggtaatggcaagagaacttgacgttccggtaatagctttgtcacagctttcccgtgccgttgagtcaagacctgataaaagaccgatgctttcagaccttcgtgaatcgggagcgatagagcaggatgcggatattgtaatgtttatatacagagatgaatattataatccggattcggagaaaaaaggtgtggcggaagtcatagtggcaaaacagcgaagcggtccgaccggtccggttgaacttgcgtggctgtcgcaatatacgaagtttggaaatttggagtaccagaggtaa

SEQ ID NO: 298 - DNA, 2283 bp, Clostridium sp.
atggatggagaacaaagaaaggatagcgttatggatatcaaaaacattttagaacaaaaacttggtaaaagcatagctgacagcagcaagcaggaaatttatgttgcacttttaaacattgcaaaagaaatgtcagaagaaaaagtacaggaagatacgggaaagaaagtttattacatttcggcagaatttttaataggcaaacttctttcaaacaatcttataaatcttgggatttatgccgatgtaaagaaagttcttgctgacaacggtgtgagccttgcagagattgaagagattgaagcagagccttcacttggaaatggtggtcttggtcgtcttgcagcatgtttccttgattcgattgcaagtcttggtcttaacggttccggtatcggtcttaattatcatcttggattgtttaagcaggtatttgagaacaacagacagaaagaaacagcaaatccttggattgaggagaatacattccttagaaaaacagatgtaagttatcctgttcagtttaaagattttactgttcagtcaagaatgtacgagatagatgtaacaggatatgataacagaacaaacaaacttgaattatttgatcttgatacagtagatgatagtattgtaggagatggaattgattttgataaaaagaatattgcaaaaaatcttacattattcctttatccggacgacagtgacgatgatggaagaaaattaagaatttatcagcagtattttatggtaagcaatggtgcaagacttataatagatgaatgtaagaaaaagggaagtaatcttcatgacttatacaattatgcagtaatacagataaatgatacacaccctacaatggtaattccggaacttatccgtcttttgacagaagaaggaattgacatggatgaggcaattgagattgtttcaaaaacatgtgcatatacaaatcatacaattctcgcagaggcacttgaaaaatggccgatttcattccttaaagaagtcgtaccgcagcttgtacctattattgaagttcttgacgataaagtacgccgccgttttgatgacgagagtgtagtcattattgataagaatgatactgttcatatggctcatatagatattcattatggattcagtgtaaatggtgttgcagcacttcatactgaaattcttgaaaaatcggagcttaacaatttctataaaatttatcctgagaagttcaataataaaacaaacggtattacattcagaagatggcttctccattgcaatccggaacttacagaccagattactgagtggattggtgatggttacaagaaagatgcagaagaacttaaaaagcttgaaaaatatctttcagataagggagcacttgacacacttcttaagattaaaacggacaataaagcagactttgttgattatataaagagaactcagaatattacacttaatcctgactcaatatttgacattcaggttaagcgtcttcatgagtacaaacgccagcagttaaacgcattgtttgtaattcataaatatcttgagattaagaagggtaacatcccagagactcctatcacagttatatttggtgcaaaggcagctccggcttatattattgcaaaagatattattcatcttattttatgcttacaggagattatcaataatgatcctgaagtaaataaatatctcaatgttgttatggtagaaaattataatgtaacaatggcagagagacttattccggcatgtgatatttcagagcagatttctcttgcatcaaaagaagcaagtggaacaggaaacatgaaatttatgcttaacggagcaatcacacttggtacggaagatggagctaatgtggaaattcatcagtttgtaggtgatgataatatatatattttcggagcagaaagtgacgaagtaatagaacattatgcaaaagctgattatgtatcaagagattattatgagaagaatgcggcacttaaagaggctgttgactttattacaggagagcagatgctcaaagttggagacgagacacagcttaaccgccttaaaaatgaacttttaaataaagactggttcatgacattccttgactttgacagttatgttgaaacaaaggaaaaggcatatgcagactttaaggacagagaagcatgggcaaagaaaatgctcgtaaatataagtcaggcaggtttcttctcatcagacagaactatcgctcagtataatgaggatatttggaaactgtaa

SEQ ID NO: 299 - DNA, 1818 bp, Clostridium sp.
atgaaaatatttgatagagtcagaaacaaaataaagggcggattaagattacatcacaggatgatacttatatatgttgttggcgggatgattccgtttataagtgcaagcttgtatacaaatgccaaaaatcaggcaaacatgataagtctgaataaaaatacacagaaaagtgaagttgaaatcgtcaaaaatcagattagggattccatgactgtcgcactggatgtgtgtgatgaattgtatggaaattatgaagtgaacgaaattacaggaaagaaatacaaaagtatatcggaatttgaggatgactgtaatgaaaaacttggtataatagacagatatcttaattattataaaagagaaatatcagatataaaaatatttgtggataataaacctataagtgcaaacaattatttcttttatcttggggatgccgtcaagtcggaaagctggtataaacctacaatagagagggatggagaggcgtgctggaattatggaagatgcaggacaacaaagcagaatcatatgcaggttacaagggcgataaagaatgattatggaactattgtcggtatactttgtgtgcagcttcaaaatgattttatcgtgaatacaattactgagcgttcaatgcatactatacttttatttaacgatacagatacgatttacacaaatttttcaatggaggcggatacaccgtttctctcaaaaaaattgaaaaaaatgaaaaatcatgtatttgcaggaagaattaccgaggttgttgaggattatctgcttgtatataacaaaatttatccgatggttaacaggcttgaaggtgaaaattcgcctcattatacatttgcaacaattgagaggtatcaggaccttacttcgaatttatatatgaacagtctgaagagttatacggcagttatagcgggactttttgcatcggtaattctgattcttgttttctcaaaaatgtatgcaaacagaatggaacttctgagaaagcagatgcattatgttgcgataggtgaatatgataaggttactgaaatctcaggagaggatgaaattgccgagttatacaaagaattggaaaaaatgatggatgacaacaaggcgcttatgcagaaagttgttgatgagcaggttcagaaagaaaaaattcacacaaaacagcgtgaggtggaatttaagatgcttgcaagccagataaatcctcatttcttatataatacccttgaaacaataaggatgaaggcaaagataaataaagaacctgagatagaagaacttgtaaagatgcttgccaaaataatgagaagaaatattcaggtcagtgataaaaaagttacacttaaatctgaagtccagcttattgaatattatcttaaaattcaaaattacagatttggagacagaatacattcgcaggtaatcgttgatgaaaatgtcgagatggatgcgaaggtacttccgcttataatccagccgtttgttgaaaatgcatttgttcacggacttgaatcaagtgaagatgggggaaatcttacggttcatgtgagcagagatatgggcgttataattgtcaatgttgaggatgatggtgttggaatggactactatgaacttggaaaactaagatatgccataaattctggagaggcagcagaaaaaggtcatataggagtaagtaacgtaaatcagagacttaaacttcaatatggtgagcagtatggaattacggttgacagcaaaaagaacgccggaacaaagataacaattcgtatgccgttgatttttgtggatgagtag

SEQ ID NO: 300 - DNA, 1470 bp, Clostridium sp.
atgaaaaaaacgattaaaagtttatgcgttattgttatggcagtattttttttgataggatgtggcacaaaaaaaaataaccaaaagactgagggaaaagtcaaattagacccggaaaatccggttccaataagagtgtggcattactataacggcagtcagcaggcggcatttgatgagcttgtaaatgaattcaattccacaaaaggtaaagagcttggaataaatgtggagggaataagccagggaactgtttctgatttggcaaagacagtttcagattctattgacggaaaagtcggtgttgacaaacttcccaatattttttcttcatatgcagatacagcttattatgcacagcagaagggaaaacttgttgacctttcagaatatttttctaaagaggaagtggaaaaatatgttgattcatacatagaagaaggatatttaaaaaatgacaaggcattatacctgtttcctgtagcaaaatcaacagagagtcttatgataaataaaacagattgggaaccgtttgcgaaacagacaggtttatcattagacgagcttaagacagttgaaggcgttgttaaagttgcgaagcgttattatgaatggacagatgcaaaaacacctaataagccgaacgatggaaaagctttttatggcagagactctatggcaaattattttgttataggaatgaaacagcttggcaaggatatttttgaaattaaagatggcaatgtaacgtttaatgtagacaagaagcttataaaacgtctgtgggaaaattattatgtaccttatataaacggttattttacggcacttggcaaattcagatcagatgatgttaagactggtgacatacttgcatataccggctcatcaatgtcagccatgtattttccggacagagtagaagatgacgataaaagttatgacatagattatgaggtgcttcctgcaccgataatgtcaggtggagaaaattataaagttcagcagggagcggatatggctgtaacaaagtcagataaaaaacatgaatatgcatcttgtgtatttataaagtggtttacacaaaaagaacaaaatctgcagtttgtatgtgaatcggcttatatgcctgtattaaagtctgcgaacaatgttaaggcattggatgatataatagaaaagaaatcactacatataaataataagacatatgactgtctgaaaaatgtaatgggagatttcgacaatacaaaatattatacaactaaaaactttgaaaacggaagcagtgcaagagaggttttggagacaaatttatcttctaaagcacagaaggacagaaaagaaatagaaaaagcgctggcaaaaggaatgaagcgttcagaagttatcaaaaagtatacaacagaggaagcatttgacaagtggtacggggagtttagtgatgcacttagtaattcattaaaatag

SEQ ID NO: 301 - DNA, 3501 bp, Eubacterium sp.
gtgaaagaagaaattaatataataaaccaggtgaataacgatacaacgccaatcgtaagcctttccattacgaatctggatattgaggtggaagagggacgagtttacaaagattcctttttcattgagagtgagaataagattccgatagaaggatatgtatgtacaaccagcgataagatggcagtagaagtagagcggcttgagggaatccgtcaggagattcctttttattttaaaggcaagctggcgacggcggatagcggttttgaaggagacatagttctcattaccaatgggggcgaatatacgattccttactctgtcaaggtcatacataaatatatagaaacttcaaagggaagaatatctacgatggaagaattcgtagatatttatagagagaatcgaaaagaggcgatggaattatttttcctgccgaattttgaaaaagtatttctggaacatcttccagagcaaaagagcttatatcacagtctcatgaagagcagatcaagaagtcttatcttagaagaatttcttacagcggcaggatataaagaactgacgtttcttgaagtatctggtgaaaagattgtaatggaagagagcgatacgcagactactttgtcaatagcacttacttcagcagggtatgtagaaggaagaatttacagtgaaaagggacaggttcagccatctgtgagccgtttttccagtgatgattttacagaaggaacgttttcatttacgatagagaagaaacagaatcttcggaatggaagcgatgttatacgaatcgatacagttcggcaggatataaagattccggttgaatggtggacagagtcttctgctttgataaaggataaagaacagaagcttttattaaagaagaagcgggcagaacttatgcataattatctgtattttagaacaggaagtattggatttgaagattttgcggaagattctggacaggttttaaaagaattgtatcgttctactgaagagaatgaatggaagctttaccgaatgcatttcctgttaatggaagaacagcaggaagaggcgaaggcggcgatggaagctttagaagagattgcacaaaaaggcggttttaaaccgttagaagcgaattattttctttatcttaaagcaatgtattaccggactccggaggtgatcagcaaggcggtcaccggaataagagaattttacgaattatcagaatataaggcagaggcgctgtggatgctcatttatcttgatagagagtatgtgtataataagcggcttcagtatgatacaatacgacaattatttgaagatggaaataatagcagcttattatactttgaagcttgtgatattttaaatgagaatccaaattatatggaagagcttggcaagtttgaaatcagtattttccgatggggagtaagatacggctatatttcactggcactttcctatcagtttgcccggcttgctttaaagatgaagttttataataaggcagtattttatattgcacagaagctatatggtgttgaaccggatgaacagtttttacaggtaatctgttcccttcttataaaagggaatcgaacagggaaggaataccatgaatacttccgtcttgcagtggaggcaaatcttaagatcataggattgaatgaattctttatccgcagtatggactttacaacatatgatattattccgcagagagtgcttatttattttacttatagtaacagccttgattatctggaaaaggcatatctttatagtaatgtactgcgtaataaagaaagttatgaagaagtatacggtgcatattattccaaaatgcttccatttgtggaagaacagctgttaaaaggaagaattaatgaacatctggcatatctgtatacttgttttcaaaaagaagttcttgaaaagccggataactggaagtcagtatgtgatattttattttatcataagctgatctgtaataatccgcatatcagtggcgtctatgtttcctgtccggaaacagaacaggaaagatactatccactttcggcgggggtaagcaatgtagaagtatataatagcagagctgtattttattttgtagataataatgagcagagatatgtcagagatattcaatatcagttaaagccgttcttatcaacagaacagtttgaaaaagaatggattcgccgtaacctttctaataagaagattttattaatggaatcagaaaagatgaacgagggaatcaaagaagatggcatagccgttcttcagcagcttacatttaacgatgattttgtacgttggattcagacagaggcagttgagaagctgcttacctattatgagaatcatcaggaaaagcgaagcctggccagatggcttggaaagattgattactcgaatatttctgtagaatttaggaagacattaatggattattatatggaagtcggcatgatggaggaggctttctttggaatcgaattatatggatgtgatataatgggttccgcaaagattctccgtctggcatcctttggtgcacaatattatcagggaaagaaggatgaggaaacactttccttagcgtatgcggcatttattcgaaagaagtgtaacaaagatacactgacgtatctgatgaagcattttcagggtgaaacagcagtgcttttggatatttgggaaagaggcaggcgctttggccttgaaacggctgattttgagcgaaaggttcttgaacaggtcatgtttactggtaatgatacagaaggtgtatttccggtatttgaatcgttctatcagactaatgagggagatgatctgattgaccgttatctggaatatgcatcgatgaaagaattagaaagttccatggagctgaatgattttatgcatatggcaattggtcaggagattgtaaatggccgcatggaaaaccgacattccagaattcatttcctgtattattttgccggaagagaagaatggtacgataccattaaagatacggcagtatacattatagaaggctttttgcaggaaaagttttatcttccgatttaccatgcgtatgcacagtgggttcattttccaatctattacagagaattgacattcctgacatatagaggacgtgcagggcagcatgttatattgaattatcagattgatggtgaacaatattctttccgtaatctgaatttggaagaagttcttccgggaatgtatgtctgtcatatgaatttcttccagagagatcatgtaaagtatcgtctagaagcagacggaaagctagttgcggatgagaatgccctggaatttgaaacatttgaatatgaagatggagaggaaagccgtttctttacattgaattatttagatacggaagaagcatcactgccagagttaaaagaatatcttttaaaaactttttttgcagaccagtgtatgaagcttttgtag

SEQ ID NO: 302 - DNA, 7878 bp, Eubacterium sp.
gtgacagctattttatttacgaatatacagatcagtcaggctgccggtacaggtacagtaagagttaacgatttctaccagatgaaaagccaggaagaaagtacgataataaaggaagagaagagtcaggaagaaggagatcaggaaaaagattcatcggactataaggataaagaagataagaaagaagataaaaaagaagataagaaagaagataaaaaagaagacaagaaagaagataagaaagaagagaaagataaggaggatgttataaataataccgtaggaacacaggaagaaaagaatgaggtgataccagaagaacaggagatgacagagaacaaagtagaaagccggacagagaagaaagaaggcgctgaagatagttcaataaaagatgcgaaggaacccgaacaagtacaggagacgacagaaagtcagcaatcgaaggaggaagaagagagggagcaattagaaagagcaggtggatatacgcttagaactgtgcgcccagatacgaatcattcggtgactatgccggatattacaagtcattattttctgttacaaaaaaacagtaagaaggtaaatgcagcttctggaggtaatcttgcagtagttgcggatgctaatgctgcttctaaatatatttatgaaagttattctaatgggaagcaatacaattttacccctcgttttacaagtaaaactacggttactgtaggtggaggcaatggtgggggagtttcttttgcaacggtaaagaaaggacctgagaagcaatttggtgatgtatatgatgcggtaaaagatgggcgtattgtgtctaaggtatttaatcttgataaatgcagtgagaatccatatgcaatctataccaatgtaggaacttggtatgattatggttctaagagaacatatgccatagatatgaagatgactgttacaggatataaatttccaggagcagctgtcagaaagcagttagcgaataaagatttaaaagcaccttatgtaggatttggaaagtctaaaatcggaatcacagttatgggaacggattatctacagactcgtctggaattctattatagtggaacaacaacagcagtagccggcataaagggcatgattcagttttgtgatattgatgcacagcaaggagtagactttgggaatggttttgaaaagatagtcatgtttaatacatcacaatcaaaactacaatataataaaaatggtttgattgcaggttctaagggatatgtatcttctcgaataagtacagatttaaatagtaataatgaacatacaacagcaatgggaattttttcaggcagtagtgtgaactgccgctggacagtagcaaaatgtgatcagaaagatactggtggtgatgcagcctatggtgtaaaaggaggatatggaattccggcagaaagtacactcgaaaactctaattcatactattggtctaacagtacaggctttttaggagtcagagcggatgttggaattgctccattaccagaggaagtaattaagtctgtttatgtgggaaatgtgaatggtcagaattcagagaaaggaagcaggtttgcaggtctgtctgagagaaatcaggtgtttacctatgtactttccgccgttgcgccaacaccttctaatgtgaagaatgcacagtatacgatgttccagattgaagacagagtggatgcacttctaaatgtaaaatctgtgaaagtctatgcagatgaggcagtaagtaataatttccagacaatgggaattaattatagtgatatgacttcatattttcatgttataaagagagaggaggcagatcacagcacaacggttcaggtaaaagcagtggatgaaaggcttggaaagtcagctttttatgggagaacttattatatacatatagaagtggaagtaaagtcagaccaggagcttcatgcgattcatcgttcaatcgcagagtggtatcaggagaatgagacacttaagcaaaaggtaccagaggcaggaagctgcaaaggtagtgttgcagtaagtaataacggtactttatatgttaaaaatgataaagggagtactgtagagagaaaatctaatgatgtagcttctaaaattgcaatgaagttacgtgttaaaaaattagatgaggagtcaggtaaaccagtaaaaggcgttgtatttggattatttggaggttcagataagaattctgccaaggaaccgttgtatacagcaacaacggatgataacggcgttgcattgtttacatccatgccatcctacactttttacaaagaaccgtttggtaatggaccatactatataaaagagatttctattccagaaaaatataaaaatatctggaatccttcagtgaatacgaactggtattatgagataaatacattaaaaacagaggagctatttgataatacaacaagcattacagagaataaacagttaatcaataagaattatgaggcggcaaaaaatattgtaaaggtttataaaaaaagtacggataccggagcatatttatccggagcagaatttgtattatcccagtggtcagctgcaacaggtacctatcgtgaattatttgtattaacagaagggaaagatgaagaaggacatccggtttatcagaataaagagacatttaaaaatacgctggataatctgggaaaatataagattacagaaaagaaagcgccaaagggatgtatcttaacaggacaggagtggacttttgaactgtctgagaacagtaaagaagatggaagtaatattatttttgaaagtacagttacgggaaagagacagacgggagttttgatttatcgtaatccattacagaaagcaaagttaacgattacgaaaaaagatgacgagaatcagagcgtagaaggtgctgtatttacagtaaaagcagcagaagatatttatgcgccttgggatttacaggaggataaaaaaccgttgaaagaggcggaaccacttatttctaaaggaagtgttgcagacagaattgttacaggaaaagatggaaagggagcaagcactgaaggaagtgagctgtacattggaaagtatgtcgtagaagaaacaacaggagccttagatcatattaagggagatggcatttatgaagtagaacttacttatggaatcgagcagaataatccatttgtaatctatatgcttgatgcatcaaatgttttgatgcgccctgctttttccgttgcaaagattgcagataagacaacgaatgaagaaggaaaatcagtgttatttgatgaaaagactggccgttatatagaggaaaaacaagcaggaatatataaagcaggggaaatggtagattacactatccgagtaacgaatacaggaaatgttcctctttatcagattcggcttacagatgatatggatagaaaaggagaattttcagaacagacactttctaaatatgccgatatggaaacagcagcatttgttgtaccgaattcaggaattttgaaaacaagagaaggggataaagtagcagcatatttatccttagaatccgatctggtgctagtactgcagcatttaaatgtgaatgacagtgtggacattcatgtaaaggtccgattaaaggaagatgcaaaagatgcatggaaacttcgtaatgatgtgtatgcagaagcaaagtatgcagataatggaacagaagaaaaaggagatattcatttaagagatgtttcaacagataagctggtagacggagaagggaatagccttgtcacagattgggattttatcaatgttccaggaagtccgggagaagatgtcataaagacagcagataaaacgacaggaatcacaattgaaaatggagaaattacatcaggaataaaggtaccaggaatttatggtgcaagggacaaagtcagattttctgttatagtaaaaaacaatggagaagcggcattaaagaatattatggtgaaagatgctatgagtgatgaattaaaagcaatcgtaaatttagaaagtgccaagtttatttttgatgaaacgcagacaacagaggaaggcttgtatattcttactacagctcataagaagaaaatcacagctaaagtagtagataaagatacgctccttttatgcagtacaggagaagatggagatggaacagaccgactgtgggcagatgattatattgtcctatattatgaagctgatttgctgccgggcatagccaacatttataatgtttctaataaagtatgtattaatggatggtattttgatggaaacaaagatgtggaagtaccagaaaaagaagatgaagataaaatagagataccgggtgtaccggaaggaagagcggctaaacttgctgacagaacaaaaggagcagtattagaagcaggaagatataatgcagaagcaaaaatttcaggagtatatgaaaacggaacgactgttacctataagattacagtaacaaataatggaacatctaatttgtatgatttgtatttgcaggatacacttagcgaggagctggaaaaagccttagaaaaagaaagcgtatcttttgaagaaagtacatatacatcacagaatggaagaaaagttcgaactagtctagaagaaccacaaagattatggatggatttcctggcagcaggagatgccgttgatgtattcttaaaaggaaaagtccgtctagatgttggaaatctatttgaactgaaaaatatagtagaacttacagctcgttataaaaagggcaacgaagaagcatacaaagagtacaaagaaaagatggaaaaagagaaaagaagatggaaattacagtatgatgcgaacaatggttctggcgaaatagaaactgacagtgaaactccatgcagggaaggaaacaagatcactgtaaacggcaatgcctttttatatgaaggacattattttacagaatggaataccaatccggatggaagcggagaaagatggaatccagatacagtatataatatgccgggaaatgatgtaaagttgtatgcacagtggaagaaaaatccggatgaagaagaagaggaagcaagtcaagatcataataatcagagaaaatatccagtttataatctgatttatcattcaaataataaaaaagaacagatagaagcggatgaagagaattctagactggcaggtactttattaacggtaaatgaaaatcgtttttcttatctaggttttactttcaaaggatggaataccagaaaagacggaaaaggaaaacaatatactccggaagaggtagtggcaatgccagcaaggaacctgaatctgtatgcacagtgggagaaacgaccggtatatcatttacagtatgatgccaataatggaagcggaaagagaagaacagatgcagaaactccatgtgaagcaggaaacacagtccaaattgatggaaatgcctatcgctacgaagctggcagggattgttacatgtttactcaatggaacacaagaccggatggaaaaggggatgcttataaaccaggagaagaaaaagaaatcaatacagacataattttatatgcacagtgggaaaagcttcagaataatgcagaagacattgaaaagtatcatgttttttatcgcgcaaataataatacaaccgcattttctgtagattcacaaactccgaaagaggcaggaaacagcattttattgcagaataacagatttttctatgcagattatcttttcgctggatggaatacaaaagcagatggaagtggaaagcaatataattcgggagataccttcgttatcccatcaaagaatatttctttatatgcacagtggaaaaagattgagcagaagaaactcatctattcttctaatacgaaagaagaagaaaaatacatagatgcagaatgtttttctgatgatggtgaagatgaagaaaaagaagtgctaatagacggaaattcattccacaataatggaaagaagtttgtaggatggaatacaaagacagatggaagcggaaagcgttatgcaccatctgaaaagtttactttaaaagaaaacactgtattatatgcacagtggtcaaaagatgtaaaacaatataaattagtgtaccactcaaattatccatcaaaagcagaagaaacgaaagaagaacaaaaagaaatcgattcagaaacaccagcatatgcaggaacaaaaataaaaataaataaaaattatttttcatgcggcggatacaaattcacaggctggagtacgaaaaagaccggagaagcagaatatctgtcaacacagtggtatgtaatgccggaaaaagatgtagatttatatgcatgctggagcaaggcggatgaacataaaaaagaagatacgaataatccggaggataaggaagagaataaaaaagaagataaagaagaaaaaaacgaagaagataagaatgacaataataaagacgatgaaaagaaagacgaagcggaggaagatacaaagaaagatccgatggcagaagaagccaggaaagcaattgagaaagcctatgaagagattcaaaagctggcaatagaagagttaaaagaagaaagtaaaaagtatacagaaattccagttacggaattaatgaaagatgaagatactatcaatattccaggtactccagttgctaaagtttctaagcttgcagataaaacacaaggagtcactttagtaaaagggcgttacgaaggcataaaaaaagaaggcatttatgaatacggagatatgatagattatacggtaaatataagtaatgaaggaacagcggacctgtatgatttggtagtagaagatttcatggataaatcattacaggaaattataaaaccagggactgttacaattgtttcaggccagattacaacaaagcagggaaatacagtttgtgtagaacggatgccagaaaaagaagatgaagaaggaaaatacatagtacatttagataaattaaaagcagcagacagtgtagtactgcacatgaaagcagaggtacagacaggtgtacaggcaggcacacatttgaataatgctatccatatcacagcacaatatgaaacagtgaatgacaatggaaagagagaaaaaatctatataatcgaaactccggaaatgacagataacgataccgtaggaataggagtgccagacattgttgttgcgaaaaaatcagataaaacaaagaatattgttttagagaatggaaggtatacaggaaaaagaaaatatggaacatataaagccggagaagaaattaagtttacaattactgtatcgaatagtggaacagcaagtgcaagaaatataacaataaaagaagaaccgtcaaaagagttgaaaaaatatgtacaaatgaaagggtttgctcataaagcaggaagcagtatacgaagtaagaagagcaatacggttaaagtaaaagaaataaaaaacaaaaaagtctttttagataaaatagaagcgggggattctgtggaattaatttacacagcaaaggtaaagaaagatattccatcaataaaatttttgaaaaatgaagtttctttagaaggaaagaacaaggacggaagtgatattccgattacaccaaaaatggacgattatgataaagtcaatttaaaagaaaatagcaaacctatgaaaaaaaataaagatcagggaacaccaggagcgaaaacaggagataacaatacgattgcgatgtatcttttagtaggtttactttcactctccatgatttttattatcctatatttccaaaaaagaaaaaaggataatatttaa

SEQ ID NO: 303 - DNA, 1881 bp, Eubacterium sp.
acggtggagcagccagtatggagaagagaaaaagggagggttatttctaatatgaacagtcttcttaagtttattacgtgcggtagcgtagatgatggaaagtctaccttgattggacatatgctttatgatgcaaagttgctttttgcagatcagaaaagagcattagaacttgatagtaaagtaggttcccgtggtggagcaattgattattcgcttcttcttgacggtttaatggcagaaagagaacaggggattacgattgatgtcgcatatcgttattttacaacagaacatcgttcttttattgtagcagatacaccggggcatgaagaatatacaagaaatatggcagtaggagcttcttttgcagagcttgcagttattcttgtagatgctacacagggtgttcttgtacagacaagacgtcatacaagaatctgttcgttaatgggaatcgagcattttgtatttgcagtaaataagatggatttaattaattatgatgcaaatcgttttgagaagattgagcgcgagatcaagatgatggcagcagagtatgattataaatcgattaagattcttccagtttctgcaacagagggagataatgttactgtgaagtcaacaaagatgccatggtacaaaggagagtctcttctcacatatcttgaaaacattcaggtacatgatgattctcttgaaaaaggatttacgatgccggtgcagagagtgtgtcgtcctgaccgaactttccgcggattccagggtcagattgaatcaggtcagatcaaggttggagatgagattattgccctgccatctaatgagaaggcagaagtaaaaggtattcttgatgcaggtaaagaagtaacagaaagcagtcgtggacatgcagtaaccatttctcttgacagagaagttgatgtatcaagaggttgtgttcttgttcataatgcgaaaccaaagacgggtaatctgtttacagcaaagattttatggatggatgatacacatcttgttgccggtaagaactatcttttaaaacttggaacaaagatgattccggctgttgttatgaacattaagtataagattgatgttaatacagggaatgaagtacatgcagatgctatttataagaatgaaatcgcagcctgtgatattgcagtttctgataagattgtttttgagaaattcaaagacaatcatgcattaggttccatgattcttattgacagaattacgaatatgacttctgcctgtggtgttatcatgcatgccttaagacgtacagataatcttacatggcatgagatggatattacaagagaattccgcgcacagcaaaagggacagacacctaagaccatctggcttaccggtctttccggttccggcaagtctactcttgcaaatgagttagagaagcgtcttgtggctcttggtaagcatacaatgctcttagatggggacaatgtacgtatgggactgaacaagaaccttggctttaaagaggcagatcgtatcgagaatattcgtcgtattgcagaagtggctaagttgatgaatgatgccgggcttattgtaattacatcgtttatttccccatatgtacgtgacagacgtaacgcaagagagattattggagatgacagttttattgaagtatacgtaagtacaccggtagaagagtgcgaaaagcgtgatgttaagggcctttataagaaggcaagaacaggagagattccgaactttacaggcatatccagcccatatgaagtaccggaacatccggaagttacgattgatacgacaggaaagagccttgaagatagtgtggattatgttatggcacagttggaagaaaagttaggttaa

SEQ ID NO: 304 - DNA, 1998 bp, Eubacterium sp.
gtgatatttgctttgattggtaatcagaactgcggaaagacaacattatttaatcagatgactggctctaatcagcatgttggtaactttccaggtgtgacagtagatcagaagatgggaaagttttctgttggttctgcggaaggatctgttgtagatcttccgggaatttattcactccgtccgtatacaaatgaggaaattgttacgagagattttcttttaaaggaaaaaccggatggaattattaatatagtagatgctacgaatattgagagaaacctgtatcttacattacagcttattgagatgagaattccgatggtgctggcattaaatatgatggatgaagtaaggaataatggtggttctattaatgtaaaggaaatgagccgcttactgggtattccgattattccgatcagtgcgattcggaatgagggagtggaagacttgatccatacggcatgtgaagttgctgagaataagcagtatccgaaggtttacgatttttgtacaccaggtccggtgcatcgttgtattcatggtctgtatcatcagctggaagatcatgcgagcaggattggaatgaatggacgttttgcggctgtaaaagtaattgaaggggatcaggacatcatcagacagttaaagctttctgaaaatgagcttgaaatgatggaacacagtattatcgagatggagacagacaggggtcttgaccggaatgcagcaatggcagacatgcgttatagctttattgaaaatatatgtgaaaagtctgtagtaaagtgtcaggtcagcaaggaatatgaacgaagtgtacaaatagacaatatacttacaaaccgatttctggcattgccggtatttgcggcaattatggtatttattttctggatgacatttgggccgttcgggtcatttttatgtgatgcattaagtgcaggaattgactgggcttcaagagggacgagccagctgcttacaaattacggaattaatcctgttgtaaagagtcttgttattgatggaatttttactggagtcggaagtgtgctgagtttccttcctgtcattttaatattgtttttctttttatctatattagaagatacaggatatatggcaaggattgcttttgttatggacacattcctgcgtaagattggtttgtcaggaagaagctttgtaccaatgctccttggatttggctgttctgtacctgcggtaatggcaagccgaactctttcttcagaaagagacagaaatcttacgatcatgcttattccatttataagctgttcggcaaaaattccgatttatacggtatttacagccgcctttttcccacatagaggagtacttgttatgtcctgcctttattttggaggaattgcagttggaatattaatggccttaatttttaaaagagttctttttacagggaaaccgatgccatttgttatggaacttccgaattatcgttttccatcgtttaaaagtgtattgcttttgatgtgggaaaaagcaagagattttttagaaagagcttttacgattattttccttgcctcgatgatcatctggtttttacagacatttgacagcagattgaatgttgtaacagacagtgcaaatagtttgcttgcaatgcttggacatttgatcgcaccaatttttaaaccacttggttttgcagattggagaatttctacagcgcttgtaacaggaatcactgcgaaagaagcggtagtttctacacttagtgttttacttggaacgaatgcagcgcatgtatctgccgcacttggcacattatttactgttcgttctgcaacaagtttccttgtatttacattattatacacaccttgtgttgcagcgatagccgcgattaaaagagaaatgaattcgacattaaagaccataggaattgtcataatgcagtgtactatagcctggcttgcagcctggctggtatatcttattatttaa

SEQ ID NO: 305 - DNA, 3483 bp, Eubacterium sp.
atggcatttacacatttacatgtgcatacggaatacagtctgttggatggatctagtaagattaaagagcttttgccaagagcaaaagaacttggaatggatagcatcgctattacagatcatggagtcatgtatggtgtgattgatttttataaaaaagcaaaagaagtagggataaaaccgatacttggatgtgagatttatgtggcaccgggttcgagatttgatagagaacaggcaagaggagaggacagatattatcatcttgttttgcttgcagagaataatcagggctataagaatctgatgaagatcgtaaccagaggatttactgagggatattattataaaccgagggtagactatgaagtgctggagaaatatcatgaaggtattattgcattgagtgcctgccttgcaggagagattccgaataagattttaaaagaggattttgatggggcaagagccgctgccagaaaaatgcgtgatatttttggagagaataattttttccttgagctgcaagatcatggtattcgtgaacagacgcaggtaaataccagtcttatacggctttcaaaagaactggggattccgatggttgtcacaaatgatgtgcattatatcagagaagaggatgcgattccacatgatctgcttctttgtatacagaccggaaaaaaggtttcggacaaagaccgaatgcgttacgaaggtgggcaatattatctgaaatccgaagaagaaatgcagaaagtgtttccgtatgccagggaagcgatggataatacccataagattgccgggcgatgtaatgtggaaattgtttttggtgaacaaaaggtaccaaagtttgatgttccggaaggatatgatgcattttcttacttaaaggagctttgtgagacaggattggtgaaaagatatggggatccgccgccgaaagagttacaggaaagactttcctatgagcttagtacaatcaggaatatgggatatgttgattattttctaattgtatgggattttatacgttttgcaaaaagtcaggggattgctgttggaccgggacgtggaagtgcggcaggaagtattgtttcttactgccttgaaattacgaatatcgatccaatcagataccagcttatttttgagcgctttttaaatccggagcgtgtatctatgccggatattgatatcgatttttgctacgagagaagacaggaagttattgattatgtttatgaaaaatacggaaaagataaagtagtacagattgtaacttttggtacgatggctgcacgtatggcagtacgtgatgttggtcgtgtactggatattccttatgcacaggtagataatgttgctaagatgataccgatggaacttggtattacgattgaaaaagcattgaaatctaatccggaattaaggcaggcatatgagagtgatgaggtagtaaaaaatcttgttgatatgtcaatgcgtttagaaggattgccgcggcatacatcgattcatgcagcaggagtggtaatcggttctaagcctttggatgagtttgttccgttgtcaagaggagcagataatgtcataacaacacagtttacgatgacaacgattgaggagttaggtcttctgaaaatggacttcttaggcttacgtaccttaacggttattcaggatgctgcccggatgatcggacagaagctggggcaggattttagcattgatacaattgattatgatgatgccaaagtatatgagatgatcgggcagggaaagacggagggtgtgttccagttagaaagtgcaggaatgaagtctttcatgaaagaattaaaaccgacaaatctggaagatgtaattgccggtatttctttgtatcgtccgggtccgatggattttattccaaagtatatcaagggaaagcagaatcaggattctattcaatatacctgtccggaattggaagaaatccttgcaccgacttacggctgtatcgtttatcaggaacaggttatgcagattgtaatgcgccttgccggatacacgcttggacgaagcgatcttgtgcgccgagcaatgtccaaaaaaaagggtgaagttatggcaagggaacgtcaaaactttgtttacggtaatgaggaagaaggcgtcgaagggtgcatccatcgaggaattccggaagaaacagcaaataagatttttgatgaaatgattgattttgccaaatatgcatttaataaatcgcatgcggccgcctatgcggttgtttcttaccagacagcatggctacgctgttactatccggtagaatttatggcggcattgcttacttctgttattacgaacccaaagaaaatcacagaatatattaatacctgtcgtgtgatgggaatttccatcctgccaccggacatcaacgaaggggaagcaggattctctgttgccggcgattcgattcgatatgggcttgcagcgattaaaagtcttggaaaaagcgtcatcgacgtaatgacgcaggaaagaaatgaaaacggaaaatataaagatttgaaagattttatggaaagactcacttccaaagaaattaataaacgtacgatcgaaaatcttattaagtccggagcgttagacagttttggaaaaacaagaaagcagcagatgctcgtgtatccggtcgtgcttgaggaggtaaatcgggaacggaaagaatcaatcagtggacagatgtcattatttgactttttctcggaagaagagaaaaaagaatatgagatgcaatatcctgatgtcggagagtatgatgatgcacaaaaacttgcgctggaaaaagaagttcttggtatttatgtaagtgggcatccattacaaaaatatatggattctcttgaaaaacagacaacagcgaaatcaacagattttgagccagatgaagaaagtggacgtgcagtcgtgagggatggacagcattatgttgttggtggtcttattagtaacgtcactgcaaagcttacaaaaaataatcagaatatggcttttgtcacgcttgaagatttatacggtaccgtagagattattgtcttcccgacgatatatcaaaatgtaaagccatatcttattgaagatcagggtatttatgtgaaaggaagagcctctgtttctgaagaaagcggaaagctgatcgcagaatatattgttccgattgaacagattccgaaggaagtctggattcagacagagaatattgaagaattcacagaaaaacaacaaaaactatatggaattatcagaaaacatcctggaaaagatgaaattgttattttttccaaaaaagaaaaggcaataaaaagacttccatcatacgaaaatatttccgcaaaaaatgacgtatttagcgagttaaaatcactttttggtgaaaaaaatgtaaaggttcgcgagaagagtattgaaaaatctgaaaaaaagagataa

SEQ ID NO: 306 - DNA, 1716 bp, Eubacterium sp.
atgaatatgaagaataaagaagatttaaaaaaggaactgatcaaaatcgatcataaaagttacggaatgtataaaacgcttggaggtagttacagttacggaaattatattttgcatatagatcatgtacagggagatccctttgcttctccttccagacttcgttttgaagtgaagaaggaaacgcatggatttccggaagagtattatgaagaaaaacatcgcagactggcattagaagatcaggtgctgcgccgttttttaagacagcttcgtcaattagataaaggatctatgggttctggtaagagcggaagaattacgacctgtccggcaaatcagacggtgcaggaaagaatcgcggttgttttttctaaggatagaatggaacttcgttttgaaatgggatttccggcgagaggaagaacaattatggcaaaagagatgcaaaaacttgtttttgatattttgccggaactggcagaaagctgtttgttttatcgtaaatgggatacaaagagtaagagctttttggaaaaagctgttttccttgcagacgatcaaaaggaattacgccggcagctaaaagaaagaggattgacaggttttgtggcaaacggtgcaatattaccaagagaaagtggcatttccgatcgtccaatgcgggatgcagtgccatttatttcaccggaatccttacagattgaaatagagctcccacataaaggaaagatgatcggaatggggattcctaaaggaattactgttatcgtaggtggcggttatcatggaaagtctacattattaaaagcgttagaacagggagtatataatcatattgcaggagatgggagagaatatgtcgtagcagaggctacaggaatgaaaattcgggcagaagacggcagaagtattttgcatacagatatttctttgtttattaatcatcttcctgccggacaggataccgtagatttttcttcggaaaatgcaagcggaagtacttctcaggcggccaatctgatagaagccatggaagctggagcagaattgctgctcttagatgaagacacctctgcaacgaattttatgattcgggataaagtgatggcaaagttagtttctgatgaaaaagaaccaattacaaccttactctgccacatacgtggaatttataaaacgatgggaatttcttttatcattgttgtaggaagttctggagattatttatccgtagcagaccttgtgcttcagctagatcattataaagtaaaagatgttacaaaagaagcaaaggaaatctgcgaacaatgccagattgcagggcagtatgcggaaaaagaagtttgtatgccggaattttcccgtaaattaaaaccggtaaaacatgctagaagaaagttaaaatcaatgggaacagatacggtgctgatcgacagggaatccattgatgtgcgttacttagaacagctttcagaaagtggacagacaacagcacttgcctatatgatgggatggatactagatcatgtaacaaaagaagaagatattcaggaattcatagaaaatatgtataagcttatcgagagaaaaggaatggcagcggtaattcctgcaaactattctgccggacatcccgttcttccaagaaagcaggaattgtatgcctgtcttaacagatatagaagtgtcaaaatcgtaaaagaatatatgtag

SEQ ID NO: 307 - DNA, 4587 bp, Eubacterium sp.
acaactgatgaatatttactattttatagtgatgcaagaaagggtgagaccatgtatcaggacaatatgcgacagggtctatatgatccaagtttggagcatgataactgtggtattggtgctgtagtaaacatcaagggtcttaagagccatgagacagtatcgaatgccttgaaaattgttgaaaatcttgaacatagagccggcaaggacgccgagggtaaaacaggggacggagtaggtatcttagtgcagatatcccataaattcttcgaaaagacctgtagtactctcggtttttctattggcaaggaacgtgactacggtattggtatgttctttatgccacaagatgaactgcagagaaatcgtgcaaagaaaatgtttgagattattgttgagaaggaagggttaaacttccttggctggagagaagttccgattcaaccgggcattcttggaaagaaagcggcagactgtatgccatgtatcatgcaggggtttgtaaagagaccatttgatgttccaagaggacttgacttcgaccgtcgtctttatattgtaagacgagtatttgaacagtccagcgattctacttatgttgtttctttaagcagcagaacgattgtatataaaggtatgttcttagttggacagttaagattattttacaatgatcttcaggataaagattatgaatctgcaattgcattagttcattctcgtttctctaccaacaccgtaccgagttgggagaaagcacatccttatcgatacattgttcataatggtgagattaatacgattcgtggtaacgctgataaaatgttagcgcgtgaagaaaacatggaatctgattatctgaaagatgaaatgatcaagctgacaccagttgttgatccaaatggttccgactctgcaagattagataatacattagagtttcttctgatgagtggaatgccacttccgctggcaatgatgattacaattccggagccttgggaaaataacgaaggaatgagcagagagaagagagacttctatcagtattatgcaacaatgatggagccttgggatggaccggcatccattctttttacagatggagatatcatgggagcagtacttgaccgtaacggtcttcgtccttcccgttactatattacagacgatgatcagttaattctttcttctgaagtaggtgtcttagattttgacacaacacatatcgtaaagaaagaaagactgcatccaggcaagatgcttcttgtagatactgtaaaaggtgagctgatcgatgatgatattcttaaagattcttatgtaaagaaacagccttatggtgaatggttatctgataatcttgtattcttaaaagacttaaagattccgaacgttgcagtagaagagtacaactatgaagagagcaaccgcctgatgaaagcatttggttactcttatgaagaagtaaaagattctgttttaccgatggcattaaatggaagtgaagcaatcggagcgatgggtgttgatactccgttagcggtactttctaaaagacatcatccattatttgattattttaaacagctttttgcacaggtaacaaatcctcctattgatgcgattcgtgaagaaatcgttacatctacatcaatctatgttggtggagagggtaatgttttagaggaaaaagcagaaaactgtcatgtacttaagatacataatccaattttgacaaatacagatttattaaagatccgtcatgcaaaggtaaagaatatcaatgtaaaagatgtgccgattacttactataaaggaacaccgcttgataaggcaatcaatcatttatatatcgcagtagatcaggcacataaaaatggtgcaaatattgttatccttacagatagaggcgtggatgagaatcatgtggccatcccatcgttattagcagtatctgcggtacatcatcatttgatcgagacaaagaagagtacatctgtaagcattatcttagagagtggtgaaccaagagaagtacatcatttcgcaacattgttaggttacggtgcatgtgcgatcaatccatatctggcacagtttagtattaagaagctgattcaggatggcttattaaagaaagattactatgcagcagtaaatgattataataacgctgttcttcatggtatcgtaaagattgcatctaagatgggtatttccactctgcagtcttatcagggttctcagatttttgaggcagttggtatcagcaagaaagtgattgatgaatactttacgaatacagtaagccgcgtagaaggaattacattagaggatatcgcagaagacgtagatttccatcattcaaaagcatttgatatgttaggtctgaaaaacgatctgagtcttgatagtgaaggagatcataaatatagaagcggtaaagaagaacatctttataatccacttacgatccatacattacagacagcagcatggacaaataattatgacctgttcaaacagtatacttccatgattaataaagaaacttctccagtaagccttcgtggattaatggattttaattatccatccaaaggagttcctatcgaagaagttgaatctgtagattctattgtgaaacgatttaagacaggtgctatgagttacggttctatttccaaagaagcacatgagactctggcaattgcgatgaacatgattcatggtaaatcaaacactggtgaaggtggagaggatttagaacgtctgacggttggaccggatggactgaataaatgttccgcaattaagcaggtggcttctggacgtttcggtgtaacaagccgttacttagtaagcgcacaggaaatccagatcaagatggcacagggagcaaaacctggtgaaggtggacatttgccagcaggaaaagtatatccttggattgcaaagacaagacattcaacacctggtgtaggacttatttcaccaccacctcatcacgatatttacagtatcgaagatttagcacagttaatttatgacttgaaaaatgcgaacagggatgctcgtatttctgtaaaactggtatccgaagcaggtgtcggaacagtcgcagccggtgtagcaaaagctggtgcacaggtaatccttatttccggacatgatggaggtacaggtgcagcacctcgtaattcttccattcataatgccggacttccttgggagcttggacttgcggaaacacaccagaccttaattaaaaacgaccttcgtaataaagtaattatcgagacagacggtaagcttatgagtggtcgtgacgtagcaatggcggcagcgcttggagcagaagaattcggatttgcaactggtccgctgatcacaatgggctgtgttatgatgagagtttgtaacttagatacctgtccagtaggtattgcaacacagaatccagaacttagaaagcgtttcaaaggtaaaccggaatatgttgtaaactatatgaaattcatcgcacaggaaatgcgtgaatatatggctaagcttggtgttcgtacagtagatgaactggtaggacgtacagatttgttaaaggaacttccagaagcaaaagagtatcacttagatttatcagctattttgaacaatccatatatagataagaaacatccaatctgctacaacaagaagaatgaatacaacttcgaattagaaaagacattagatgaaaaagttcttcttacgaagttaaagacagcactcgataaaaagcagaagagaagtatttctatcgatgttggaaatacagacagatcctttggtacaatctttggttctgaaattacaaagaaatactatgatacattagaagacgatacatttactatacagtgtacaggcgccggcggacagagctttggagcatttattccaaatggtcttactttggagcttgtcggtgacagtaatgactattttggtaagggattatctggtggtaagctgattgtttatcctccaaaaggaatccgctttaaagcagaagaaaatatcatcgttggtaacgtagcactgtacggtgcaacaagcggtaaagtttatattaatggtgtcgcaggtgaacgtttctgtgttcgtaattctggtgcaaccgcagttgtcgaaggtgttggcgatcatggatgtgagtacatgacaggtggtaaggttctgatcatcggtaagacaggaaagaactttgcagccggaatgagtggcggtgttgcctatgttcttgatgaggataatgatctgtatttaagccttaacaaagaaatggtttcttccgaaccggttgtttctaaatatgatgttatggaaatcaaggatatgattactgcccatgtggcatatacaaactctgaaaaaggtaaagaaatcttaaataatttcagcaaatatctgccgaagtttaagaaaatcattccacacgattacaagaagatgcttcagaagatttccgaaatggaaggaaaaggtcttagcgcagaacaggcacagattgaagcattttatgaaattaaaagaggatag

SEQ ID NO: 308 - DNA, 3564 bp, Eubacterium sp.
atgtatttaaagagtattgaaattaatggatttaaatcctttgctaataagatcgtttttgaatttccacagggaattacaggcattgtaggtccaaacggaagcggtaagagtaatattggagatgctgtgcgctgggttttaggagaacagagtgcaagacagcttcgtggagcgaagatggaagatgtcattttctcaggaacacagagccgtagaccgatggggtttgcttatgtagcgattacctttgagaatgcgaatcgaatcatctcccttgattatgaagaggttacggtagcaagaagggtatatcgttccggggagagtgaatacctgattaatggaagttcttgtcgaagaaaagatatcgtagagttattttatgataccggtatcggtaaggaaggttattccatcatcggacagggtcaggttgagaaaatcttaagtggtaagatcgaagatagtcgtgagttgtttgatgaagcagcaggtatcgcaaagtataagaagaatcgtacagttacggaaaagtcgctagagcaggaacgtcagaacttagagcgtgtcacagatattttagcagagcttgaaaagcaggttggtccgttagaacaacaaagtgcaaaggcaaaagaatatttaaagcttcgtgatgaggaaaaagatattgatacacacctctttttatatgattatgagcgcctgaaaaaggaacaggaagaaaatgagaggcagtatacgattgtttctggcgatttagaagagacaaagaagacttatgaaaagattaaagaaaagaatggaaagcttcaggaacagacacaggcagtaacagatagtcttgaggcaaaagaatctgagaaagaggaacttcgtcgaaagaaagaagaaaaagataatgagattcttattctttctcataaagcagaatccaatacgcttctgattacgcattatgaggacttagagaaacaaagtctggaagaaaaagagaaaaagatcgaagaagtcggacagttaaagaaaacgatcacagaaaaaggacaagagatagaacaggggcagaaagccttagatactcttgaggaatctatcgttgtaaaaagaaaagaacaggagtcttgtgagaaaagaatttccggggagaatgaccggctcttttccattatgaacagcagctctgatacaaaagagaaactcagtcggtatgcggcaatggaggaacagcttgagattcgtaacgcagagtataacagccgttacatttcttttaattcagagttaaaagaatataatgaaacagcagaaaaactacaaaaacagcagtctgaggcagaaagagcggttaaagaacaggaagaacggtaccaagagcttgaagagaaaggaacgtctcttcagaagaaggagcagaattatcaggatgagatgggaaacttaaatcaggagtaccttcgaacaaagtcccattatgagacacttgtcaatatttcagaaagatacgatggatataatcagtcgattcgccgtattatggaacaaaagggtgtaaatccaggcataatcggtgtggttgctgatattcttgctcttccggaaaagtatgagacagcgattgagatcgctcttggaggcgctttacaaaatatcgttacggaagataacgaaacagccaaaaaaatgattcagtttttaaagaagaatcggtttggccgagcgacttttttaccgcttacgaatatccgccgaagaaacagtacgatttctccgactgttttagaggatgagggtgtaattggaattgctagcacgttagtacaggtagaagaacgattccaggcattagtagaatctttacttggaagaacggttgttgtagataccatagatcatgcactagcattatcgagaaagaataatttcagtcttcgtctggtaacacttgacggggagttacttaatcccggtggtgcgatcacaggtggagctttccggcactccggtaatctgcttgggcgaaagcgtgagatcgaagaatgtaaagagacgttaagaaaggcaaaggctgcctgggaagaaagaaagagttctcttgcagatctaaaagaacgacagcagaaactagaagaagagaagcaacggaaaaaggcaatgcttgatgaggcatctcttgttctccatgacctgaataatcagattccggatatggagaggaaaaaggaagagctgaaagaacgaattgcttcattaaaggaagaacatcgggttttaaaagaacagattgatgatattcgttctcaaaaggaagcactcttaaaagagcaggaagataacgagcagattcatgaaaagaatcattcggttcttgattcactgaaagaaaagcttgcagagataaaaaaagaagtttctgatgtagaaacagaaaagaatgaacttcgtctttctctttcaaaaaaacgtcaggagcttgcgtatctgcaaaacgatcaggaacgtattgaaaaagaaacagaaagtctccagagttctttagaagaaaataaaaaagaaacgagccgtcttacagaagaaaatatttcttatgaaaaagaacaaaagttgttgcaaacagcgttgcaggagattactatacagatggaggatatttctggtaagcttgaagagttaaaacagcagcgttctactgctatgaaaaagcagaatcagattttccaggaactagaaagcgagaatgataagctgttgattcttgagaaagaagcttcaaagttatcttccagacaggagcgcatgaaagaagatttagaaagtaagatagactatatgtgggaaagttatgagcttacttacaatcaggcgcttacattaaagcattatgaattaaaagcagaggatgcagcggagcaccgcagacagaaaaaagaactgcaaaaacagatcaaaggccttggaaatattaatatcaatgcgattgaagagtataaagaagttggcgagcgatatgaatttttaaagggacagtatgatgatatcaaagaagcggaagcaaagcttcttacgatgatcgatgaactgaatctggcaatgaaggaacagttcacaaaggaatttggaagtattcagcagatgtttactactgtatttcaggatctgttcgagggaggaacggcttctcttgaattgatggatacggaaaatattttagagtgtggtatccgcattattgcacagccaccgggaaagaaactgcaaaacattatgcttctttctggtggggagagggcattgacagcgattgccttactttttgcgattcagaatttaaaaccatcgccgttctgtcttcttgatgagattgaggcggctttggatgatgcgaatatcgttcgtttttccaaatatttaaagaagttatcgaaagatacgcagtttattgtgatcacgcatcgaagaggaacaatgaacgcggcagatgccttatatggaatcactatgcaggaaaagggtatttctacgttaatctctgtagatttgattgataaggatctgaattaa

SEQ ID NO: 309 - DNA, 2682 bp, Eubacterium sp.
atgaattataatgaaccatctataaaaaagaaaagagaagaagtattctccaaaaagaagcgaaagcaaactactgcttctgcaattatttttcggattgttttgattttgatctgcgctgtgatcgtcagtggagccggtttactatacggctcctttcgagggatcattgacagtgcaccaaaagagttttctctcgcaccgaagtattctgccaccattgtttacgatgatgacaataagcaagtgcagcagctttctgattattcttctaacagaattcctgttgcctatgaacagattcccgataatttaaagaatgcatttatctctattgaggatgaacgtttttacgagcatgatggcattgatttcaagggaatccttcgtgctttgtggacagatatccgaaacggatctacttcacagggtgctagtacccttacccagcagctcattaagaataatgtatttgaagctggcggagagactaatattatcgcaaaagtaaagagaaagattcaggaacaatatcttgctataatcgctgagaaaaagtacaacaaagaagatattctgactaattacctgaacacaattaatcttggtaagggaaatcttggagtggaagccgcttcaaagtattattttggcaagtctgtaaatgaacttacgttgtcagaatgtgctgtattagctggcatcacaaagaatccaactttcttaaaccctgttgattatccggaagataatgatgccagacgtaaactgatcttgaaaaaaatgtaccagttaaactacatttcagatacggagtaccaatctgctcttgaagataaagtatatgcaagaattgcgaataaaacagcacaaggacgaaagaattctgtatattcctattttacagatgctgtaatcactaaagtagtttctgatctacaggaacaaaaaggatatacacagtctcaggcttatcagcttgtttatcgtggaggacttcgtatttattccacgcaaaataccaagctgcaaaagattgcggattctgtaattaacaatcctgataattatccggtagatacaaagttttccctggagtataagcttcaagttacacatgaagacggtactaccagtacttatacagaatctaatgtagctgcctatttccgtaagaagaaaaaggatccaggttataaaacaatttataattccaaaaaagaaatgaaggctgccgtaaagacatttagaaagtctgtcataaaaaaaggggatgcaaagaagtcgcaatccatacactattctatggaaccgcagctttcttattctttaatcgaccagaaaaccggtcaggtaaaagttctcgtagggggacgtggtcagaaacaagatgatcttgccttaaacagggcaacttctgtaaagcgccagccaggatctacttttaagattttatcgacgtatgcccctggcattgataccggaagtatgacactcgcaaccgtatttgatgatgcaccttaccgctatgaaaatggtcagaaagttacaaactatgtacctaccagctacaagggactcacgacacttcgtgatgccattatcgattctaataacattgtggctgtaaaggcaatcacagctcttaccccacaggttggatttgactttcttcaaaagcttggatttacaacgttagtaaataatcgtgtaaatacaaatggtgcttatgaaagtgatgtgaaccagtcactctctcttggaggaatcaccgatggcgtaacgaatgttgaactgactgctgcctatgctgcaattgctaatcagggaacttataacaaacctgttctctacactacagtgaaagacagtaatggtaatgttctccttagcaataaaacttcttcccaaaaggtaatgaaaaagtctactgcatggcttcttacaaatgccatggaagatgttataaagaaaggaaccggcagggaagcgcagcttgattctgatatggcagctgctggaaagaccggtactacatctaataactacgattactggttttgcggatataccccttactacacagcttctgtgtggaccgggtacgactacaatacttcgtttgataatgataaagattatcataaagtaatctggaaaaagattatggatcgtatcatcaaagaaacgaaacagtctgtaaagagctttcctgcatgcaaaagcattaaaaaggcttctatctgtatgaaatcaggtaaaaagcctcttcctgatatatgtgcaaaggatcctcaaaaatctatggttcgtacagaatactttgcatccggcactgtaccaaaagacagttgtgatgcacatgttgctgtcaccttctgttccaaatctcatttggctgcacagaagttctgtcctgaaaagttccgatatactaagattttccgcgtaagaccaaaacattctaccggtaaaacagaggatgaaccttacttcctgaatattgatattaacaaaaataaatgcaatatccataccaatgaatggtatttaaagaagcaggaaaagaaaaagaaaaaacaagaagataaattaaaaaaacagcaggaacagcagaataacaataatatcactactccagatgatataagtaaccagattaaaaaaatacttaatcaataa

SEQ ID NO: 310 - DNA, 1341 bp, Eubacterium sp.
atgagttttattaaagaatatgcacagaagcttgttacggcagaagaagcagttaaggtagtaaaatcacatgattgggtggattatggttggacaacaggtacaccagttgccttagatgcagcattagcagccagagcagatgaattagaagatgtaaaggttcgtgggggaattttattaagagaacctgagatctttaaagtagataatgtagcagaccatttcacatggaattcctggcatatgggtggattagagagaaaagcaatcagtaaaggttttgctttttattctccattaaagtattcagagcttccacgttattacagagagaacatcagacatcttaatgttgcaatgttccaggtagcaccaatggataagcatggattttttaattttggaccgaatgcatcacatatgatggctgtttgtgaggcagcggatgttatcattgtagaggttaatgagaatatgcctcgttgcttaggtggatttgaagaaggaatccatatttcccgcgtagattacattgtagaaggtcagaatcctgctattggagaattaggagcaggtgcaccgccaacagaagtagacagagcggtagcacagcttattgtagaggagattccagacggagcatgtctccagcttggtattggcggaatgcctaatacagtaggttctatgattgcagaatctgatttaaaggatttaggtgtacatacagaaatgtacgtagatgcatttgttgatattgcaaaggcaggaaagattaacggtttaaagaagaatatcgatagaggacgtcaggtatatgcatttggagctggtacaaagaaaatgtacgattatttggatgataatccagaatgtatgagtgcgccagttgactatactaacagtgcgaaaacaattgcacagattgataactttatttctatcaataatgcagttgatattgacttatatggtcaggttaatgcagagagtgcaggtgtaaagcagattagtggagcaggtggacagcttgattttgttcagggagcatatttatctaaaggtggtaagagctttatctgctgttcttctacatttacttcaagagacggtgtaaaacacacaagaatcagacctactttggcagaaggttctacagtaacagacactcgtcctaatacacattatgtagtaacagagtttggtaaagtatgtcttaaaggaatgtctacatggcagagagcggaagcattaatcagtattgctcatcctgatttcagagacgaattaattaaagaagcagagaagatgcatatctggagaagaagtaataaataa

SEQ ID NO: 311 - DNA, 3759 bp, Eubacterium sp.
atgagtcaggtaaagagattatatgtggaaaagaaatcgtcatatgcggtaaaagcaaaagaacttgcagaagaattaaaggcatatctttccatagaggatgtcagtgatgttagagagttaattcgctatgatgtgcagaatgtctcagcagaaactatgaaaaaagcggcagttaccgtattctcagaaccgcctgtagatgatttatatgaggaagatttccctaagaaagatggagataaagtatttagcgtagaatttcttcctggacagtttgatcagagagcagattcagcagtacagtgtcttcagcttcttgatgagaaggaagaaccaatcattcgttctgcaacaacctacgttttctctggtaatatcagtgacgaagaattggagaagattaaagaatactgtatcaatccagtagattccagagaagcagacgagaagaaaccggaaacattagttatggattatgaagacccggctgatgttgcgatttttgatggatttaaagatatgccggaagaagaattgaagaagctttatgattctttaggtcttgcaatgacatttgaagatttccgttatatccagaattattatcagggagaagaaagcagaaatccttctatgacagagattcgtgtattagacacttactggtctgatcactgtcgtcatacaacattttcaacagaattaaaagatgttgcttttggtgatggatattacaagcctctctttgaaaaaacatataatgaatatcttgctgaccgtacggaagtatatggagacagaaaagataagtttatctgtctgatggatctcgcacttatgggaatgaagaagttaaaacaggacggacttcttgataacatggaagaaagtgaagagatcaatgcctgtagcattgttgttcctgtagaatttgaagataagacagaagaatggcttatcagttttaagaatgagacccataaccatccaacagaaattgaaccatttggtggtgctgctacctgtcttggaggagcaatccgcgatccattatcaggacgttcctatgtatatcaggcaatgcgtgtcacaggttgtgcagaccctactgttccgatggcagataccatgaagggcaagctgccacagagaaagctgactacaggtgcagcgaaaggatatagttcctatggtaaccagatcggacttgccacaggattagtagacgaagtatatcatccaggttatgttgcaaagcgtatggagattggcgcagttatcggtgcagctccaagaaagaatgttatcagagaaacttctgatccgggagatatcattgtacttttaggtggacgtaccggtcgtgatggttgtggtggagcaacaggttcttctaaggcacatacaacaaagtctattgatacctgcggtgcagaagtacagaaaggtaatgcccctacagaacgtaagattcagagattattccgtcgtggagaggtaagttctcttattaagaagtgtaatgactttggtgctggtggtgtatctgtagcaatcggtgagcttgcagacggacttcgcattgatcttgataaagtgccgaaaaagtatgcaggtcttgatggaacagagcttgcaatttcggaatctcaggaacgtatggcagttgtacttgataaaaaagatgtagagcagttcctttcctatgcagcagaagagaaccttgaagcaacagttgttgcagaagtaacagaagagaaacgtcttgtaatgtcctggagaggcaaagaaatcgtaaatctttcacgtgctttcttagatacgaatggtgcacatcaggagactacggttgaagtagagatgcctgacgagaaagaatgctactataaaaagcagactgaacttaaaaatgtaaaagaaatgtgggaagaaactctttctgatcttaatatatgttccaagaaaggtcttgtagaaatgtttgacagttctatcggagctggaacagttacgatgccatttggtggaaagacacagcttactccaattcagacaatgacagcaaaactgcctgttttagaaggcaaaacagagtttacaacaatgatgtcttatggatttgacccatatctgtcaagctggagtccatatcatggagcagtatatgctgttcttgaatctgttgcgaagattgtagcagccggaggaaacttccgtaagattcgtcttacattccaggaatattttgagaaacttggcacagatccaaagagatggggtaaaccatttgctgcattacttggttcttataatgcacagaaaggatttggaattccttcgatcggaggaaaagacagtatgtcaggttcctttgaagatattgatgtaccaccaacattagtatcctttgcggttgattacacaaaggcttctcatgttgtaactcctgaattgaagaaagcaggcaataatctgttacgtatcgatattccttttgatgaatatggtattcctgattataaaaaagcaggagagatttatgatacaattcataaattaatgcgtagagatgttatcgcatcagcatatgcacttggttcaggcggattaattgaagcaataagcaagatgagctttggaaatatgtatggtgtgaagtttatgaaagactttaaacttgaagaccttacaaagaaatattatggttctattcttgtagagattcctacagactggatggatgagatgtccgctcttccaaatacatttgtaggacgagttacagatgatccattcttccaggttggtgaagaagagatttcattaaaagaaatgtgtgatacatggcaggctccattagaatctgtattccctacaaaaacaaatgaaggtaaacataatgtatcacagccattatatcgcacaaatgatatttatgtatgcaagaataaagttgctgtaccaaaagtatttattccagtatttcctggaacaaactgcgaatatgactctgcaaaagccttccgtcgtgcaggagcagaagtagagaccctcgtatttaagaatcagtcagaatctgatatccttgattctgtagatgcatttgaaaaagcaatcagccaggctcagatcattatgttcccaggtggatttagtgcaggtgatgaaccagaaggttcagcgaagttctttgctactgtattcagaaatgaaaagattaaagaagccgttatgaaacttcttaatgaaagagatggtcttgcacttggtatttgtaatggtttccaggcattgatcaaactgggacttgttccttatggagaaatcgtaaaccagacagcagattcaccaacgcttacaatgaatgagattggccgtcatgtgtctactatggtatatacaaaagtagtaacaaataagtccccatggcttcgcaaagcagtacttgatcaggtttatgcaatccctgcatctcatggtgaaggtcgttttgttgccagtcaggaatggattgagaaattatttaagaatggtcaggttgcaacacagtatgttaacttaaatggcgaacctacaatggatgaccgtttcaatccaaatggttcttattatgctattgagggtattaccagtccagatggtcgtgtccttggtaagatggcacattccgaacgtatcggagaaaatatcgcaaagaatatctacgcaaaacaggatcagaagatattcgaaagcggagtagaatattttaaataa

SEQ ID NO: 312 - DNA, 2220 bp, Eubacterium sp.
atgagtatttacgatactttaaataaagaacaaagagaggcggtcttctgtacagaaggcccccttttgatgcttgcgggagcaggatcgggaaagaccagatcactaacacaccgtattgcatatttaatagaagaaaaaggaattgcaccatggaacattctggcaatcactttcacaaacaaggcggcgcaggagatgagagagcgtgtagattctctggtaggatacggttcagaagatatttggatcagcacctttcatgctacttgcagccgtattttgcgaagacatattgatttgttaggatatgacagaaattttacgatttatgatgcaagcgatcaaaagtctcttatgaaagaagttttaaaagagatgaaaatcgatacgaagcagtttccagaacgctcggttatgtcagaaatttcttctgccaagaatgaatataaatctccgctcgattatcgtaatgagtacggaagtaattatcgtaatcagagaattgcggatatttatgaatgttatcagaagcgtctaaaggagaataatgcacttgattttgacgatcttcttgtaaaaatggtagatttatttcaggcaaatccagaagttttagagcattatcaggatcgttttcggtatattatggttgacgaatatcaggatacgaatacagtacagttcctattggtaagtcttcttgcaaagaaatatcgtaatctttgtgttgtcggagatgacgaccagtctatttataaattccggggagccaatatttataatattttaaattttgagaaagtatttccggatgcacaggtaatccgtttagaacagaattatcgttccacgcagaatattcttaatgctgcaaacggagttattgcaaataataaaggaagaaaagaaaagaaattgtggaccgaaaaccagaagggagaattggttcactttaagcagtatgatacggaatatgaagaggcagaaggagttgtatccactattaatttcctctccatgcgaggggtagaatataaggatatggcaattttatatagaacgaatgcacagtctcgcatatttgaagaaaagttaaaacaaagaaatattccatatgcgatcgtacgaggaattagtttttacgatagaaaagaaattaaagatttgatgagctatctgaaagtggtagacagcggaatggatgatctctccgtaaaaagaattatcaatgttccgaaaagaggaattggtcagacaacaattaaccgtctgcaggagtttgcaatcatgaatcagatgagtttccttgatgcagtatttaatgcagatgagattccggaagttgcaagggcacttgcaaagcttcataaatttgcagatatgatagaaaattttcggaattacagtatggaacatgaaatcagtgaattgttagaatatattcttgatgtaacacaatatagagcagaattagaagcagaaggaaccgatgaatccatcagccgcttagaagatatagaggaactttttaacgatattgcatattacgaagaagaggaagaaaatccgaatcttcgagatttccttgcagaaaaagatatgtatacactaaatgcgggaattgataacttagaagaagaggataataaggtgttattgatgacacttcataatgcaaaaggtctggaatttaataatgttttccttggaggcatggaagaaggcgtatttccaggttatggtgctatgatgtcaggcgatgaatcagaaatagaagaagaacgccggctttgctatgttggaatcaccagagcaaaggaaagactgttcttaagttcagccaagagaagaatgttacgtggtcagacacaatataacaggcattctcgctttatcgatgaaatcccttccgcttatctcgatataaagaagaataattccacacatcaggaagtgaaaaagacagatcgcccggtgaagtatcaatatggagcgggagcaggaaaaccgtataatctgagtgattttaaaataaaaccagccggagaattaaattatcaggtgggagaccgcgtgaagcatatcaagtttggcgtgggaaccgtacaggaaatcacaaaaggtggaagagattatgaagtctccgtagactttgacagagtaggacgaaaaaaaatgttcgcatctttcgcaaaattaaaaaaagttactatttga

SEQ ID NO: 313 - DNA, 3234 bp, Eubacterium sp.
atgcctaagaataccagtattaaaaaagtccttgtaattggttccggtcctattgttatcggacaggctgcagagtttgactatgcgggaacacaggcatgccgttccctgaaagaagagggaattcacgttgttcttgttaactccaaccctgcaacaattatgacagataaagatatcgcagatgaagtatatattgagccgttaacaccagaagttatcaagaagctcatcttaaaagtttctccggacagtcttcttccaacattaggtggacaggcagcgttaaatatcgctatggagttagatgagtgtggtttcttaaaagagcataaagtaaagctgatcggtacaacaggtaaaacgatccgtaaggcagaggatagagaagaatttaaagaaacaatggaaaagattggtgagccgatcgcaccaagccagattgttacgaatgtagaagatggtctggaatatgcgcagaagattggatatccggttgttcttcgtcctgcatacactcttggaggaagcggtggtggaatcgcagataatgaagaagagtttgtggaaatcattcagaatggtcttcgtcttagtcgtgtaggacaggtattagtagagaaatctatcgctggctggaaggaaatcgaatacgaagtaatgcgtgatggtaacggaacatgtattacggtatgtaatatggagaaccttgacccggttggtgttcatactggagacagtatcgttgttgcaccttctcagacattaggagataaagagtaccagatgctccgtaattctgcattaaatatcattgatgaacttggtgtagaaggtggatgtaacgtacagtttgcattaaatccagatacatttgattattgtgtaattgaggttaaccctcgtgtaagccgttcttctgcattagcttctaaggcaacaggatatccgatcgccaaagttactgcaaagatcgcacttggttaccacttagatgaaatcaagaatgctgtaacaggtaagacatttgcaagttttgagccggcgcttgattactgtgtagtaaaggttccaagacttccatttgataagtttatttctgcctcccgtcatttgacaacacagatgaaggcaaccggagaggttatgagtatctgtactaactttgaaggtggtcttatgaaggctctccgttctttagagcagcatgtagacagcctgatgcatggcgattttgataagttaagtgataaagaattagaagaacatcttcatatcgtagatgaccttcgtatttactgtatcgcagaggcacttcgtcgtaaagtagacccacagaagattcatgatatcacaaagattgatctgtggttcattgataaattaaataacatcgttgagatggaagcgaaacttaaaaatgcggaagaattagatcgtgatcttttactgaaggcaaaagagatggagttcccggataaagtgatcggagagcttatcggtcagaatgaggagtatgtaaagaacttaagacgtcagatggatatcgttccggcatacaaggttgttgatacctgtgcggcagagtttgcagcagaaactccatattactattcttgttttggaagcttcaatgaagtagaagaaacttctgataagaagaagattatggtacttggttccggtccaatccgtattggacagggtattgagtttgattactgttctgtacacagtgtatgggcatttaaagagatgggttacgaaacaatcatcgtaaataataaccctgaaacagtaagtacagactttgatatcgcagataagctttattttgagcctttaacagaggaagatgtagagcatatcgtagaattagagaagccggatggagcggtagtacagttcggtggacagacagcgatcaagttaacagagaagttaaataagattggtgtaccgattcttggtacaagtgctgagaacgtagatgcagcagaagatagagagcttttcgatgagattcttgagaaatgctgtattccacgtccaaagggaggcacagtatttacaaaagaagaagctattaagacagcgaatgagattggataccctgtactgattcgtccatcttatgtacttggtggacagggtatgcagattgcgatttctgatgaagatatttccgaatttatggatgttattcagagatatgcacaggaacatccaattcttatcgataaatacctgatgggtgttgaagtcgaggttgatgcggtatgtgatggagaagagattgttattccaggtatcatgcagcatgtagagagagccggaatccattccggagacagtatttccgtatatcctgcaagagacctttctcctaagattaaaaaggtgatcggccattatacaaagttactggcaaaggctttacacgtaatcggtcttatcaacatccagtttatcgtatatcaggatgaagtatatgtaatcgaggtaaatcctcgttcttcaagaacggttccttatattagtaaggtaacaggtattcctattgttgaccttgcaacaaaggttatgacaggaatgaagttaaaagagttaggttatgagcctggacttcagccagaatctccatactgggcaatcaagatgccagtattctcttttgagaagattcgtggggcagatatcagccttggaccagaaatgaagtccacaggagaatgtcttggtatttctaagaactacgaagaagcattatttaaagcattcttaggttctggtgttgatttaccaaaacacaagaagatgatcatgactgtaaaggattctgataagttagatgcagtagaagttggtaagagatttgcagcacttggctacgaaatctatgcgacaagaaatacatgcaagacattacaggaaagcggtgtgccagcgaagagagtaaataaaatcgaagagacacatccaaacctgctggatctgatcttaggacatcagattgatcttatcatcgatacaccttcacagggtattgagagaagcaaagatggttttgttatccgtcgtcatgcagtagaaacaggtgtgaactgtctgacttctcttgatacagcaaacgccttacttaccagcttagagtcttcctgcagagaagatttatctttagtggatatcgcagaaattgataaagagattgagagcaagattaacgaggcataa

SEQ ID NO: 314 - DNA, 2979 bp, Eubacterium sp.
atgattacggacaaacaacgacagcgtgattatgagtacgaagcagattatcagtccaaaagccgctatacaactgaacaatggacaaatattttaaattcaggacagcttgatgagaacaatatctctctgctcaaacagatttactcttcttttaatcatgccgcaacacttcttcagctttcttttgaaagtaaccgcactcaggaagatcttctttcacagcttaatgctgccggacagcttcttggtgaggcaaacagcatgaatcctgaagtcgattatgaagggaatgaatattggtggtatctctttttctggggtaaaaatactaacgctaaaactttagagctgaaaatgcatccggaattaacagaagccatcggagcattatacccagaactagaagaggcatactatgcctttatgagcgatgtggaacgaagcttacagatacgttacagtcaggaagatgctgtatggattgctgctgccgttcttctttacgaaaagtattactgcaatcccggcatcagttctgatgacatcctactgatgcaatacgaagtacagacccgttctcagaaagtatatggacaggatgtcaatgcgaacaccatcactcagatttgtaacgccgatgaacgtggacatcgctttaattatttgagagatatttataaatattatcgtgtatcttttcctggagagtttgaaggagagagggaacgtcctgaccctgaagaagtggattataatgcatacatctactccattcttggctatatgaagctcacaaagttaactgactttatcgagcatgaatatgcacatcttgtcgatgaatcttatgttgaactgaccaacgcaaatgggtttgttcgtatggctgcctatttgtcaagacaaggaggaactgtattttctccggatgatacttctgacaaagcgatttctcttcgtgcagatggtgaagatgccgctgaaacatttcacaaaataagtgaagctattttaaaagaatatccaaattttatttatgcgtcaaaagctgactggtatcttccggaatccggtgtaattgctggcatacttcaggattctttatatattccatcctatgccgggcacaatgcttttatcggcattcgtactgtattagatgaggataaactgaatattgaagtttccctgaatcttccttgtgtttctgatgaagaagttatgcttgatatccatgataaatgcaatatgcttactctcatgactgcggcaccgtttcaggtaacacttgttccggcagaatcctcggatcttgctcctttcggggacaagataaaggcatctgttctctatcattatgatgactttaaaaccatgtctgaggaagatatcgtagaactcttttctacttccttagagatttttgcttcctactataccgatatctgccagaactactaccctgctatcgaaaacagtgaggatatcacagcttccgcttcctcagaagatcctcttgctgccgcacttggttcaaagctaacctatcgtcctgcctccgatgttccaggaccacaagttatttataaagagggcggaacacctgcctccaccgattttatcaccaaagcaatacagggctacggaacaacctcttcttccgatgagagaacttacgagaacgaatccactcagggtatttcttctgacattagctctgatcacgaagatgaagtttcttctttcgtaaataaggccgctttggaagccgacgatgatgaagttcctgcaagaaaaaccggcaattactctactggcactgcctctgttacaggcgccggaaccaaccgaataactgacaatagaaacagtaatgcctctgcatcttctacgtcttctggaagttctacgggtgccggaattcccatcgctgcatctgtttctatcactcctgagtctgtctggccttatccggacaacgcgattgcttccacacatccggaccgaaaagatcaaagcttccgcctttatccaaaaaacaccttaattaaggggcctgtaaaaaccggaaagttccatcaggcaattatgactgctgtaggtatcattgagggaaaagattctaatatgatgaatattgagcctgttcctgacgtactcgaacattatcagcaatatgttgatgaaggccgcattttacatatttcttatccagatatcaacagtgatggctatgatggcttcattgaacgaaaatgtggtccatttacagaagacggtatcttcaaaaaatttgctaaccagtgtgctgacgggcgatatgttattatgatggaagaagtggacttaaactggatgcatcttttcagagaaactgccgttctcttacgcgaaaaccgccgggaaggaaccagtagtgaaacagctgtaactttgcctctttccaaagaaaagtttcgtcttccttctaacctttacattgtagccacctgtgactctattgtatgtgaagatacaattaccggcgcaattgatcacgacttctttatccgtcctgtatcaccagaaccggaaattcttcatggcatgcgtattgaaggaatatcccttcagcgccttatgacaacacttaatatgcgtctttcctattttttaggtgcagactaccaattaggagaaggctttttccttcaatctccggataaagactcctttatctctctttgccggatatttagagaacagcttattccgcttttagaaaaatggtttgatggcgatattgaacgcattcgttatgtactaggcgataacggcaaatcccgcccggacactatattcttccaggaaattcctttccgggatggtttattcaaaggagatattcctgattcctttgataaggagcggcggatttatcgatgtaatgaagaagctttctacaatccaaaaagttacatagatatttacgaataa

SEQ ID NO: 315 - DNA, 3888 bp, Eubacterium sp.
atgacgaaattttttgtaaagaaaccgtattttgttctggtgacggtaatcgttgttttggttgttggttttgtcagtcttagtgagatgcagacagatcttctgccggagttagaactgccatatatggcggtgattacaacagaagtaggagcttctccggaaaaggtggagaatgatgttattaagccgatggagagtacgcttggtacgattaatggcgtagagaaactgacaagtacttctgccaataattatgggatgctgatgcttgaatttgcggaagatgccaacatggaagcggcgcttgttcgtgtatctaaggcattgaattcgctgagtctgccggagggatgtggaacaccgaatatcatggagataagtgcggatatgatggcgacaatgtatgccagtgtcagttacgaagggaaggatattaaagagctgtctaattttgcagaaaagacaatcaagccatatttagaacgtcaggatggtgtagcaagtgtgtcggctaacggtcttattgaagatcatgtagagattcgtctgaatgagaagaagattaaccagatgaatgataagattctcggacagacgaatgacaagcttcttgaggcaagtgagaagattgaagatgcaagagcttctctaaaaaagagtaaagaacagttaaaaaagcaggaaaagacgttaagcggcaagcagcaagaaacgaatcagaagcttgctgaggcgcagacaaagcttgctgaggcattatcacagaaagcagcatacgaagcagaacttaatagtctgaaggcgagccagagcgcattaaaagcagaaaaaaaggcatataaagaagcaggtcttgagaagacataccatactttgaacaatacattcaaaaatttgaatgtgacaatgggtgaagcagcaaaacagatgggaattacaattccggaatcggtgaaagaggcagtgaatcatccaaagcagtttgaagcgtttgtctcctggatggagcagatggggtatggtgaacagttttctaaactgacgatagattctttgaagcaaatgtataaggtagtggaagttcgtcttccgcagattgatacagaactttctaatttaaaaataaagattaaagtacaaaagacgattattgataagttaaaagagcagatgaaagggcttgataagcagcagtcaaaattaattgcaggcggctattctgcagcagccggatttggtgctggtcaggcacagattgcagccggaaaaacacagatagagtcagcgcagaaggaattagatgatgcagaggataagctggaagattccagaaaggctgccagagagaacgcaaacattgatgcattgctgagtctcgatactttatcaacaatgatttcagcacagaatttttcaatgccggcaggatatatcgaagacaagagtgatcatcagtggcttgtagaagtcggagataattttacaaatgaaaagcagctgaataatcttgtacttacgaagattgacggagtaggaaagattcgggtgaaagacgttgcagatgtaaccgttgtagataatcagggagaagcttattcaaaagtaaatggagagaatgcgattctgttatctgtatttaaaggaagtacatcgaatacaagtaccgtatccaaaggaattcagaatgcatttaaaaaactggagcagaaatataaaggtctttcttttgcgatcataatgaatcagggagagtatatcaatatcattataaagagtgtattgaatagtattttattaggtgcggtacttgcgatcatcgtccttgctctcttcttaaaagatatacgtccgacaatcattgttgcatttagtattccgtttagtgtattatttgcgattattatcatgtactttaccggaatcaatattaatgttatgtctctggccggactttgtcttggtatcggtatgcttgtagacaactctattgtagttatggaaaatgtatatcgattcagcaatgaaggcatgccagcgccaaaggcagcagttcggggaacagcacaggtagcggggccaatcttagcttccacacttacaacaatctgtgtatttctcccgatggtttacacatccggtatggtaagtcagttattgattccatttgcatttacgatatcgtatgcactgattgcctcactgcttgtggctcttaccgttgtcccgacaatgggttcggtaattcttcgaaaagcaaaagagataaaacagccatggtttgagaaaataaaggacatttatggaaacattttagaacttgcactgcgatttaaaatcattccgctgcttatctctattgtattgctcatcatttgtgtgatgcagagtatgcggacaggaattgttatgatggatgatatggacagtaaccagattgcagtcagcatgacattagaagatacgatcaagaaagaaaaggcataccagacagccgatgaagtaatgggaatactgacaggaatagacggaattaagaaggtggcaggtcttgatggcaatgccagtgtaacttcaagtatgatggaaaccggagcaacagataattatacaacatttacttttaatattattacagaagaaaatattaaaacaaccaaggaattccgtaaaatccgaaaagatatcgagaataagacaaagaatgtacgatgtaaaaaacttacggtatcttcctctgcaataggtgatatgtccactcttagcggcggaggactttctgtcaatgtatacggagaaaatcagcagaaattaattaagatcagcgaagatgttgtaaagatgatgaaaaacatccctggagtaaaaacagcaacaaatggtatcgaaactgccgataagatgttacatttaaaaattaatcgaaataaagcagcagaacatggtcttacgatagcacagatttatcaggaaatcgcaaaacatacaacgaccgaaaaaaatgcgattaccttaaatatggatgataaagatgtggaagtaaatctgattaatgagacagacaaactcacctatgaaaatattttagatatgaaaatcgaaaccacagaaaaaaatagtgatggcgaagatgaaaaacatacatataaactgtctgaatttgcatcagaagacgatggatacagcatggaaagtatcaccagagaaaatcaaaagccgtatctgacggtaacagcagaattggaagagaatgccaatgccaccttgttatcaagaaaacttcaagaaaagattgataaatataaagcaccagatggttacgaagtagaacttgcaggagatgcaacacagaccacagaaatgttaaaacagatgggaaaagcattagcactcggctttttgctcatctaccttatcatggtagcacagttccagagcctcttatctccgtttattgttatatttaccgtaccactggcatttacaggcggaatgatcggtcttggaattttccatttgtccatttcatcgatggcattaatgggcttcatgatcctgatgggaaccgttgtaaataatggtattgtatttgtagactacgtcaatcagctgcggatgggcggcatggcaaaaaaagaagcactgatcgaaacaggaaaaacaaggatgcgaccaatcctcatgaccgcactcacaacaatactttctatgagcgttatggtattttcacaggatgccggaaatgcaatgcagaaaggaatggcggttgtagtcgcattcggcctgttatacgcaacacttatgacattgtttatcgttccggtaatgtatgatatcctctatcgtaagcaaccaaaagagattgatatagacgatacggatctgtag

SEQ ID NO: 316 - DNA, 3909 bp, Eubacterium sp.
atgggtctgtatgcctattggaaagtaaccagaagattttacattatgattattcaaggggtgaaaacatcgatggaaaagaatagactgcgtccaacgcgaattccgggaagcaaaaacatcagaatgagctatgccagacaaaaagatgttctcgatatgccgaatcttatagaagtccagaaagattcctacaagtggttccttacagatggattgaaagaggtttttgaggacatttcgcctatcacggattacagcggacagctcagcctggagtttgtggactttcagctttgtagagaggatagaaagtattcaatcgaggagtgtaaagaacgtgatgcaacatatgcagctcctttaaaagtgaaagttcgtctccataataaggaaacagatgattttaaacagcacgacatttttatgggtgatctgccattgatgacggaaacaggtactttcgtaattaatggtgcggaacgtgttatcgtcagtcagttagttcgttctccaggtatttactatgcgatcagccacgacaagattggtaagaagttatattcttgtaccgtaattcctaaccgtggtgcatggctggaatacgagacagactccaacgatgtattttatgttcgtgttgaccgtacaagaaaggttcctgttactgtacttgtcagagctcttggcattggaaccaatgccgaaattaaggaattattcggagaagagcctaagattttaaaaactcttgagaaggatacagcaacaaactatcaggaaggtcttaagaagttatacgagaagattcgtccgggcgaacctttatctgttgacagtgcagagagtctgatcaacagtatgttcttcgatgcaagacgttatgatcttgcgaaggtaggacgttataaatttaataagaagttaatgttccgcaaccgtattgcaggacatagactggcacaggatgttcttgatccttctacaggcgagatcatttttgaggcaggtgtaagacttacaaaagaacaggctgacacgatccagaacgcagcagttccatatgtatatgtagagacagaagagaaagaagtaaaagtcctttccagcatgatggtagatatcacaagttttgttgatgttgatcctcaggaagtgggcgttactgaacttgtatattacccggcccttgaaaaaatcttagaagaatatgatgatatagatgaaattaaagcacagattcgcaagaatattaatgagttgattccaaagcatatcacaagagaggatattttagcttctattaactacaatatccatctggaatatggtgttggtaatgacgatgatattgaccacttaggtaaccgtcgtatccgtgctgttggtgagttgttacagaaccagtacagaatcggtttatcccgtctggaaagagttgtcagagagcgtatgacaacacaggatattgagtccatttctccacagacattaattaatatcaagccggttactgctgctgtaaaggaattctttggaagttctcagttatctcagttcatggatcagcataacccattatctgagcttacacataagagacgtctttctgcattaggtcctggtggtctttccagagatcgtgccggattcgaggttcgagatgtacactattcccactacggaagaatgtgtcctgtagagactcccgaaggtcctaacatcggtctgatcaactctcttgcaacttatgcaagaattaatgaatatggttttgtagaagctccttaccgtaaggtagataagagtgatccacagaatcctgtagtaacagatgaggttgtatatcttactgctgatgaagaagataactacacagtagcacaggccaacgaaccgttagatgaagaaggacatttcattcatacaaacgtttccggtcgttacagagaggaaacatctgaatttagaaagtcaagaattgacttgatggacgtatctcctaagatggtattctccgtagctacatccatgattcctttccttgagaacgatgatgcgaaccgagctctgatgggatcaaacatgcagcgtcaggccgtacctctgttaaagacagaagttcctgttgttggtactggtatggaagcaaaggctgcacgtgactcaggtgtatgtattatcgcacaccatgcaggtactgttgagtattctacaagtaaagagattattgtaaaaagagaagacggaattcgtgatacgtatcacgtaatcaagttctcccgaagcaaccagggtaactgtatgaatcagagaccaatcgtaaataagggagaccatgttgaggcaggagatatccttgcagatggtgcttctacatgtggcggcgagatggctcttggtaagaaccctctgatcggatttatgacctgggaaggttataactacgaggatgccgtactgttaagtgaacgtcttgtacagaatgatgtatatacatctgttcatatcgaagaatatgaggcagaggcaagagatacaaagcttggtcaggaagagattacaagagatcttgcaggactgagtgaagatgtattaaaagatctggatgagaatggtatcatccgtatcggtgcagaagttcatgccggagatattctggtaggtaaggttactcctaagggagagacagaacttactgcagaagaaagacttcttcgtgctattttcggtgaaaaagcaagagaagttcgtgacacttcccttcgtgttccacatggcgcttacggtgttgttatggacacaaaggtatttacaagagagaatggcgatgagcttcctccgacagttaacaagtctgtgcgtgtttacattgcacagaagcgtaagatttctgttggtgataagatggccggtcgtcatggtaacaagggtgtagtttcccgtgtacttccagtagaggatatgccattccttccgaatggtcgtccacttgatatcgtactgaacccattaggtgtaccttcccgaatgaacatcggacaggtcttagagcttcatttaagtcttgcatctaaggtgcttggatttaatgtagcaacaccagtatttaatggtgcagacgagaacgatattatggatactcttgagatggctaatgattatgccaataagacatgggaagaatttgaagaacgctggggtgacaaggttaacgatgatattatgaaatatctctgggataaccgtgaccacagagaagaatggaagggtgttccaatcgaccgtaccggtaaggttcagcttcgtgacggacgtaccggacaggaatttgattcaccagtttccatcggattcatgcattatctgaagctgcatcacttagtagatgataagattcatgcacgttctacaggtccttactcactggtaacacagcagccactgggtggtaaagcgcagtttggtggacagcgtttcggagagatggaggtttgggctcttgaggcttatggtgcttcctatactcttcaggaaatcttaactgtgaagtctgatgatgtaataggtcgtgttaagacatatgaagcgattatcaaaggtgagaatattcctgaacctggtattccggaatcctttaaggtacttcttaaagagttccagtccctcgctcttgacgttcgtgtcttaaaagaagatatgacagagattgagcttcaggaaggcagtgaaacaattaatgaatcccttacttcagtgattgagagcagtccggatgataataattataaggatgagagcaatcttggagagtatggctacaaagaaagtactctggaagaagaaaccggacaggtggatgcacagccagagtttgcaggaatgcctttcggtgattccgatttgtaa

SEQ ID NO: 317 - DNA, 2052 bp, Eubacterium sp.
atgaaacgagaaaagaatatatcaagaaaggtcgcactgaatttatggctgcctattattgtggtggtctttatattggtagcggccttaggtgtgattgaagtgaatcccggtctcggatatacgatcttagtaggagatgtcatatatcttattgcatctgttttgtgttacgaatatacagaaaagatgattaataatgaattgcttacggcagggtttgaacagagtcagatccagaagcagattcttaaagaactgccggtgccgtatgtaatgacagaccagtcaggaacgattatctggtataataaacagttttcagaaatcgcgggacaaaagatcataaagaagagtatcacacagatctttccgggcctttacaaaaaggtttttccacagaatggacagacgaaagaatactgtatcacacaggaagaacataaatatcatgtggaatgtaagagtatggtatttaaaaatctggaacgtggaaaagaggaagagattcaggatgatggggctgaaggagacgttcttcaggtattttacttttttgatgagacgcagcttcgtggatatgaggaagagtcgaagaagaagagtctggttgccggactgatctatattgataattacgaagaagttcttgaaaatatggaagaagtaaggcagtcgcttttacttgcattagtagaacgaaagattatgaagtacatgcagggacttgatgcgatcatcaaaggtttcgagaaggataagtttctctttgtatttgaggaagagaagctcgaagagctgatggaatctaaattttctattcttgatgaggttcgtctgatcaatattggtaatgagctgtccatgacattaagtattggtgttggtgtgaatggaggaagctataccgaaacatatgaaagtgcaagaatggcaatggatcttgcccttggccgaggtggagaccaggcagtagtaagagatggggatacgatttcctattacggaggcaagacacagaaagtagagaagagtacaagagtaaaggcaagagtgaaagcgcatgcactgcgtgagatcatgcttacgcatgataagatttttgtcatgggacataagaatccggatgcagactgtgtcggtgcggctcttggtatttatcgtctgtcaaagactttaggtaagagcacatatattgttatggataaggattgtccggcgatagaaccgatcgtagagggaatctacaaagagcgggcagaggaagaggaagatattttcgtaacgaatgaggaagcgctgcttcttaaagataagtcagcgatgctcattgttgtagatgtcaatcttccggcaatgacagagtgtccggagcttttaaagtctgtctcaacgattgttgttcttgatcaccacagacagaataatgaaacgataaagaacgcagttgtttcttatgtagaaccgtacgcatcgtcaacttgtgagatggtagcagagattttacagtatatcgtagataagccgaagcttaagaatatcgaggcagatgccatgtattccggtattctcgtagacaccgataattttgttataaaagcaggtgtccgtacttttgaggcggcggcttttttaagaagagcaggtgcagatgtgacccgcgtaagaaagatgtttcgtgaagatatggaacattgccggatacggacagccattattaacaaggctgagatttacatgaatgaatttgctatttccacattcgatggagcaaatgtatccggagcgactgttgttggggcgaaggcggccaatgcgttgttaaatatacagggaatccggggaagttttgttttgacatcgttacaggactgtatatatatcagtgcgcgttccattgatgagcttaatgtacaggtcatcatggagaagttcaatggcggcggtcatcttacgatggcggcggcccagttaaaagatgttacccttgaagaagcaaagcagcagttagaagatgttttgcagcagatgcgtgaagatggtgatatataa

SEQ ID NO: 318 - DNA, 3558 bp, Eubacterium sp.
atgcaacagaaaagtgcaacaaccaaaatgaaaggaggtatcatgaaaactttatctaaccctcttttaaactttgatacttatattgatatgaaaactgcaatggaaaagaaggcttatcccattgtcctgaatggttgtgttgattctcagaaagcacattttattccaaaccttggagaagatttcccatgccggattgtactgacttataaagaagataaggcgaaagaactctatcaggatttacgtttttttgattctaataccgttctatatccttcaagagatgtactgttttatagcgcggatgtacacagtaatcatatcgagaggcagcgaatggatatcttaaagaagcttatggcgggagagccgctgacgatcgttgcctgtctagatgttcttatggagaaaatgattcccctcaaagattttaaggaacactgtcttacgattgattttgaatcgatcattgatacagatgcacttaaattaaaactttcagagcttggctatgagaacagtggtctggtggaatcacccggacagtttggtatccgaggtgggattattgacattttcccacttacagaagaactgccggttcgaatagaactgtggggagatgaagtggattcactccgttcttttgatacagaaacgcagagaagtgtagaaaagctagaaaaagttcaaatatatccagcaacagaaatgattctttcaagacataagattggcgatgcagtccgtcgtatgaaggaagaatataagaaacaggaagaaatatttaaaaagcagaagcgccttacagaaaaagagcgtctccgcaagatgacgatacgaacagaagaagaacttctttcttttggaacagcagaaggaagcgaagccctgttatcttatttttatgagaaaacagtatccctgcttgaatatttaccggaaaatacattattttttctggacgaaccgcatcgtattctagaaaaaggaaagacatatgaagaagaatttttcctctgtatgcaaagccgtttagaaggtggatatgttctgccgggacaggcagatctgctgtttggctatgaagagattttatcaaaagtgatggcgaagccacttattttactaagttccgtcattcaggactatgccttttataaaccaaaaacaatctgcgatatcgaagtaaaatctattttttcatataacaatagctttgaccagttaataaaagatttagaacactggaaaaaggaaaattatcgtatccttctactttcctcctcaacaacaagagcaaaacgtcttgcagaaaacatcaaagattacggactccttgcgtattttgctgcagattttaaccggatgatcgagccgggtgagattatggtcgcaagcggccgccttgaaaacggatttgaatatccggcaatccggtttgttgttttatcagagaaagacatttttaaagaaagaaaagtaaaaaagaaaaagaaaaaaagccagtacagcgggcagaaaatcaattctctttctgaaatttccgtaggagattacgttgttcatgaaagatatggacttggtatttaccgcggaatggaaaaaatagaggccgacggaattacgaaggattacatcaatattgaatacaaagatgccagcaacctttttatccccgcttcccagcttgaactgatccagaagtactccagtctgagtgcgagaaagccaaaactcaataagttaggcggtactgaatgggaaaaaacaaagagcagagtacgctcacaggtacagattgctgctcaggatttagtgaagctctatgcagaaaggcaggcaaaagaagggtattcttacggaaaagataccgtctggcaaaaagaatttgaagaattatttccatatgaggaaacagaagatcagttaaatgcaatcgaagatacaaagcgggacatggagagccaccgcataatggaccgcctgatctgcggagatgttggttacggcaagaccgaagttgccatacgtgcggcattcaaagcagtcatggacagcaaacaagtcgtttatcttgtcccgacaactattttagcacagcagcattataattcatttaaggaaagaatggaacattatccaatcgagatcgccatgctttcccgcttctgtacgccaaaagaacagaaacgtattttagacggtctgaaaaatggaagcattgatattgtgatcggtacacataaagttctctcaaaaagcatcaaatataaaaatcttggtcttctcatcatcgatgaagaacagcgttttggtgtaaaacaaaaagaaaaaatcaaacaattaaaaaaagacgtagatgtactggcattatctgcaaccccgattccaagaaccctgcatatgagccttgccggaatccgcgacatgagtgtcctcgaagttcccccggtagaccgccgggccattcagacctatgtcatggaatataatgaagaacttgttcgagaggcaatcgagagagagcttggcagaggcggacaggtatattatgtatacaatcgagtcaacaacatagatgaagtcgcagcgcagctacaaaagctgcttcccgatgcaactgtagaatacgcacatggacagatgggagaacgtcagttagaaagtattatgaccggctttatcaacaaagaaatcgatgtactagtatcgacaacaattattgaaaccggactcgatattccaaacgttaacacaatgatcattcaggatgcccagttattcggcctctcacagctttaccagttaagaggtcgtgtcggtcgttccaaccgaaccgcctacgccttcctaatgtatcgaaggaactccgttttaaaagaagaagcagaaaaacgcttaaaagccattcgtgaattcaccgacttaggaagcggcttcaaaattgccatgcgtgaccttgaaatccgcggcgctggaaaccttcttggcgcagaacaatccggtcatatggaatctgtaggatacgacctctactgcaaaatgttaaacgaagccgtcttaacaatgaaaggcgaacaacaagaagtcgatacctttaccacatccattgatctgtccatcaatgcctatataccggaaacttacatcaaaagcgaagcagaaaaactttcctggtataaaaggattgcagccattgaaacagaagaagaatatgaggatatgatcgaagaactgaccgatcgctacggagacccgccaaaaccactactcagccttatggacgtagcactccttcgagaagaagcacatcaggcatggctcctttccatcgaacaaaaaggaagcaagattctcttcaccatgaacccacacgccaaagtccgcgtagaagaaatcgatgacttcctcaagcagtatcgcaataaaatgaaaataaaaccagaagctaacccggtatttgtatttgaatccgaaggaacactcaaaaaagaattactcgcaaaagtccgggaaattatcaacaatattcataagctagaaaaatag

SEQ ID NO: 319 - DNA, 3561 bp, Eubacterium sp.
atggaggtaaagaagttcaaaaaagtacttgtcgcaaacagaggagagatagcgattcgtgtatttcgggcattgagtgagcttggaatcggctcagtagcggtttattcaaaggaagatcggtatgcgttgtttcgaacaaaagcagatgaggcatatccgttaaatccggataaaggaccggtggatgcttatctggatattccgacaattatccgaattgcaaaggagaagaaggcagatgccattcatccgggatatggatttttgtcagaaagtccggagtttgcagaagcgtgtcggaagaatgatattgtttttatcgggccgacagttgatgcgatgaatatcatgggagataagatttctgcgaagaaggcagcagaggaaagtaaagttccgattatagatggcagtgattttattattcatgatgcagataccgcaagtaagattgcagacgagattggttatccagtcatgttaaaggcaagtaatggcggcggcggcagaggaatgcgtatcgtgaagagtccggaagagatggaggaagcttttgagaagtcaaggaatgagtcaaaacgtgtttttggcgagtcaaagctttttattgagaagtatttgatccatccaaagcatattgaagtgcagattcttggagataattacggtaatatcgttcatctttatgatagagactgttctttacaaagaaggaatcagaaggtaattgaatttgccccggcatggtcaatttctgatgagacaagaaagaagattttagattctgcaaaaagactggcaagaagagttggttatacgaatgtaggaacgatggaattccttgtagatgaggaggaaagaccttattttatcgaaatgaatccacgaatccaggtggaacatacggtgacagagatggtgacagggatcgatattgttatttcgcagattcttgttgcggagggctatccgttaaattctccgacgattcatatttattcgcaaaatgaagtgaagtgtaacggttatgctttacaggcaagagtgacgacagaagatcctgcgaatcatttccttccggatacagggaagattgatctgtatcgttccggttctggtgggggaatccgtcttgatggcggtactgcttatacaggtgcgatcattacaccgcattatgacagtttacttgtaaaagttgtttctcatgacaggacgtttgagaatgcgattcataaatcagtacgtgcattaaaagaacttcgtattcatggagtaaagacgaacattacatttctgattaatgtattgaatcatgagacatttcatcagggaaagtgttttactacatttatagaagaaacaccggaattatttgaattacattataaattagaccgtacaacaaagatattagagttccttgcaaacaagatggttaatgttaatccgggaccaaagccatttttagaagatcgaaaagtgccggttgtagatacagagagaaagctatatgggacaagagatgaatttttgcgattaggagcggaagaatttacccagaaagtttatcggagtcagaagctgtatgtgacggatacgacgatgcgtgacggacagcagtcgttacttgcgacaagaatgcggacaaaagaagtggcaggtgcggcaagagcgacaaacctgtatttaaaggatgcgtattcaattgaagcctggggaggggcaacatatgatacggagtatcgttttttaaaagaatctccatggaaacgattggatattttaagagagcgtatgccaaatgttatgatacagatgctgcttcgtgcttcaaacgtagttggatacagtacctatccggataatgttattaagaagtttattaaggtatccagtgatcatggtgtagatatttaccgtatttttgacagtatgaactggatggaaaatatgaagcttccggtagaagaagctttaaagacaggaaagattgttgagggagccatctgctacaccggagatattttaaatccaaaggaaatgaaatatacgatagattattattgtaaaaaggcaaggcagttagaaaagatgggatgccatgtgatcgcattaaaggatatgtcttctttattaaagccatatgcagcgaagaagctaattgaagctttaaaggaagaagtacgtgttccgattcatcttcatacacatgatacgacagggaatggaattgcaacatatctgatggcggcagaagcaggggtagatatcgtagactgtgcgatcggttcgatgagttcccttaccagccagccatcaatgaatgcattagtggaagcgctgcggggaacaaagcgtgatacaggaattgatccggacggattacttgttttaaatgattattacgaacatgaacgtaagatttataagccatttgagagtgatatggattctccaaatccggagatttataaatacgagattccgggtggacagtattctaattttgccgctcaggtaaaagaaatgggtgccggcaatgattttaatgatattaaacgtctttataaagaggcagatgaggttcttggaaatattattaaagtaactccgacatcaaaagttgtcggtgatatggcaatttttatgttgaaaaatgatctgacaaaagataatattttagagaaaggaaaagatttatcttatccagattccatcgtacagtatttcaagggtgcacttgggcagccggaaggaggatttccggaggaactgcaaaagattgtattaaaaggacaggaaccgattacggtacgtccgggaaccttacttccagatgtggattttgatgcaatcggagcgtacctgcgggagaattactacatggaatccatggaacagccggaagttatggagcagaaagtattaagttatgccctttatccaaaggtatatgaggactattgcgagcatttccaggcatataatgatgtatcgaagttagaaagtcatgtttatttctatggtcttcgtccgggagaggaaacaacgatccagattgaagaagggaatgatacgttgattaagtttatcggcaagtcagaaccagatgaaaaaggatatcgtattttacagtttgaagtgaatggatttttacgcgaagtgaagattcttgataagcattttgaagtaaaggcagatcgaaagttaaagactgatccgaagaatccgggtcatcttggggcgaccttaccgggaacaatctgtgatatccggattaaagaaggagaccgcgttcagaaaaatatgccgcttatggtgattgaagccatgaagatggaaacaactgtcatttcaaaagtgaatggtattgttgataagatttatgtaaaggatggagaggaagtgaatgaggatacccttctcgcatcgtttattatcgatacagatgaacagccggaagaagtgcatccagaacttcctaagatggatcttgcatccttagaagaggatgaattcaaaacagttgaagtggctgaaaaagaaaataaatga

SEQ ID NO: 320 - DNA, 1449 bp, Eubacterium sp.
atgattatttttgaagctcagacaacacagcagatggagagtgttatgggaatgataaatgaatttgatacgattgctgcgattgctactgcagtatcgaatgcagggataggaattataagaatcagtggaagcgaagccatgacgattctttcgaatatttttgaaccatataacaaaaaagtggatgtgcatcagttagagaatcatcgcatttattatggaaatattaaggatggacaggaagtaatcgatgaatgtatcgtccttattatgaagggaccacacagttatacgaaggaagatgtagttgagattgattgtcatggcggagtcactgtggtatataaagtgctgaatcttgtactaaagaatggtgcgagagcggcagaacctggagaatttacaaagagagcatttctcaatggacgaattgatctatcccaggcagaagcggttatggatctgattgattctaagaatgagatggcaagaaagaattccatgacacagttaaagggaggattatccgaccggataaagcagttaagagaagagattatctatcaggttgcgtttatagaatctgcattagatgatccggagcattacagtttagatggttttcctgaaaaacttttggaattagatagacagtggatcaagactgcaaggggcatgttggattcttatgataacggaagaatcatagcagaaggaattcgaacctgtattataggtaagccgaatgccggaaagtcctcttttttgaatgcattattaggagaagaacgagccattgttacggatattgcaggaacaacaagggatacgttagaagagtctgttacgattgatggaatcactcttaatatcgtagatactgcgggaatacgtgatacggaagataaagtagagagtattggtgttgagagagccagaaaagaaatggaaagtgcggatttaattttatttttgatggatacttccgtacagatcagtgaagaagatatagaaatacttcagaagatacgtgataaaaagaagattattttattgaataagtcagataaagttcaggaagaaggcagctttgattcttctgtattacaggagtatatttctgaagagacaccagtgatctctatttctgcaaaatatggagatggaatagataatttcataatggaattaaaaaatatgatgtttcatggtagaatagatgtgaatcaggaagtctatattacaaatgcaagacataaagatgcgcttgcaaagacatatgagagtcttgaatgtgtacaaagaagtattgaggcaggaatgccggaagatttcttcacgattgatcttatgaatgcatatgaaaaactgggattgatcattggggagtctgtagaagaagatttagtaaatgagatattttccaagttctgtacaggaaagtaa

SEQ ID NO: 321 - DNA, 2847 bp, Eubacterium sp.
atgagtgaaaagaaggagtacattcgtattcgaggggcgcgggagcacaaccttaagaatattaatatagatataccaaggaatgaatttgtagtactgacaggactttcgggttccggtaagtcatccctggcatttgatacgatttatgcggaaggacagcggcgatatatggagtccctttcttcttatgcaagacagttcttaggacagatggagaaaccggatgtagacgatattcaggggttatctcctgcgatttcaatcgatcagaagtctacaaaccggaatccacgatctacggttggtaccgtaacggaaatttatgattatttgagacttctttatgcaagagttggaattccgcactgtccaaagtgtgggaaggtcatttccaagcagacggtagaccagattgtagatattttgatgaagcttccggacagaacgaagattcagctgctggcaccgattgtaagaggaagaaagggcgagcatgtcaagattttaaaggatgcgaagaagagcggctatgtgcgtgttcgcattgacgggaatctttatgatctgtcggaagagattcagttagagaagaataagaagcataatattgaaattatcgtagaccgccttatgataaaggaaggaattgagaatcgtctgacagattcgatcgaaacagtaatgaagcttactggaggaattcttcttgttgatgtcgttgggaaagaacagctgaacttcagtcagagtttttcctgtccggactgtggaatcagtattgacgagattgaaccaagaagtttttcttttaataatccgtttggtgcctgtccggtctgtcatggacttggttttaagatggaatttgacattgatcttatgattcccgataaaaaattaagcatcgcagatggagcaatcacagtgttggggtggcagtcctgtacagatgccaagagttacacaagagcaatccttgatgcattagcaaaagaatatcattttgatttaaatacaccattttgtgatctgagtcaggaagcacaggatgtgatcattcatggaaccaatggtcatgaagtaaaggtgtattataaaggaaagcgcggagaaggtatatatgatgttgcgtttgaagggctgatccgtaacgtgcagcgccgctacagagagaatcattcagaacgccaaagagcagagtatgaaaactttatgacggtaacaccatgcgatagttgtcatgggcagcgtttaaagccagagtcattagcagtaacagtaggagagtacaacatctctgagcttacaaagctttctgtaaagcgtttgatttcttattttaatgagattcagcttaccgaaagacaacagttgatcggaaagcaggtattaagagaaatacgtggacgaatcggcttcctgaatgatgtcggtcttgactatttaagcctttcccagccaacaggaaccctttctggtggagaagcacagcgaatccgtcttgcaacccagattggttccggacttgtcggtgtagcatatattcttgatgaaccaagtatcggattacatcaaagagataatgataagcttatttcagccttaaagcgactgcgtgacctggggaattccctcattgtcgtagaacatgatgaagatacgatgcgagaagcagattgcatagtggacatcggaccgttagcaggcgagaacggtggagaggtcgttgcaatcggaacggcacaggaactgatggataatccaaactcgattaccggtgcctaccttagcgggaaaaagaagattccggttccggaagtacgcagacagccacaaggctatctcaccgtaaaaggcgcacaggaaaataatttaaagaatattgatgtgaagttcccattgggcgtatttacctgtgtcacaggagtctccggctctggaaagagttcccttgtcaatgagattctctataagaagcttgcctgtgtattaaatcgggctcggattaagccaggtaaacataaagaaatcgaaggaacagaacagttagataagattatcaatatcgatcagtctccgatcggtcgtacccctcgttctaatccggcaacctatacaggcgtgttcgatcatatccgggaattatttgccatgacaaaagatgccaaagcaagaggatacgataaaggacgcttcagcttcaataaaaagggaggccgctgtgaagcctgtgccggtgacggtattttaaagattgaaatgcagtttcttccggatgtatatgtcccttgtgaagtttgtcatggaaagcggtataacagagaaacattagaagtaaagtacaagggcaagaatatctttgaagtattagacatgaacgtcgatgaagcctgcgaattctttgagagcgtaccatcgattcgaagaaagatagaaacattacgggatgtaggactctcttacattaagttaggacagccatccacgaccctttccggtggagaagcacagcgagtaaagcttgcgacagaattaagccgtcagagcaccggcaagaccatttacgtcttagatgagccaacaacaggactgcactttgcagacgttcataaattagtagacattttacagcgtttaacagaaggcggcaataccgttgttgtcattgagcataacttagaagtaatcaaaacagcggattacatcatagatatgggaccagaaggcggcgaaggcggcggaacgatggtaacctgcggcaccccagaagaagtctcagacgaaccgagatcctatacgggaaagtacctgaggaaatatttaaatactaatttgatggactaa

SEQ ID NO: 322 - DNA, 3726 bp, Eubacterium sp.
atggatttaagtatgagggggatgaaggagatgagggaggaacttaatgcagatctattaagaagaattgcgtacctgacaaaaggacaattaatgggggagatattattttatatttttttgcttagcagtatagtttatttgatagtgggaaaagtatataaatcaatagtttgtataaaagcgttcagaaagaaaaaaagtatttggatacttccagttattttattgggaatcgcaggattagtatggaatacttacggatgtccggtaaaggcggcatcaatgctggagaacgaagatacggcagggaagcatgcgatatctgctgaaacaggaaaggagggggcggaaagtgaagagtttattacagataattcagcgccgaaattaactgttaattatgaaggtgttttgaatattatggataaagattctgcaatatggaatataaacgaaacactgcataacaatgaaggaaaagtgacgtcttcacaaaatcagattttttgtggaaaggagaatggaatttctatatgtatagaagaagataatattgtaccagaagatattgaaataaaattatatcgtatgtcatacggaagaaaaggacagtgggaacaagaagaagtatcggagtcagatataaataaaaaaataataagattaaaagaaaatcaacaatcccaaggaatctttctctatgctattaaaaatcttgaagacggacattatagagttaagatacattgtacggataaagcaggaaatgtaatggaagcagaaagaaatagtgagacagataaatgtatagatgatggatggtatgaaagtccgatatatacagtagataccgtttcaccgattataacagaggtgttttgcaatcaatatccggtaagaaaaaaagaagaccgacagtattttaaaaatgctcctgaaattattattcgtatacaggaagagaattttaataaagctaatttttcagtagatgggaagatgttttatgcagatggaaagagtatggaaaaagaatggagaacattaaaagagcaagcaggtcatctacaatggaaatcttattataaagatgggataaggataaatgaagcaaggatgaaagcagctatagaagcaaattatactatactgtttcaaagtacagatggagcggttcataagggaaatcaaaaagaactgaaaattacatatgatgcaaaaaaaccggaaattatttatacagggcagaataatcaaaaggaacagttagtttttagaccagagatacagaaagagggaaagggtttttttacatttcgcagatatccattttttcgatattttagtataaaacgcatatgtgcatctattcaggtaagagatgaagtcagtggagttgaaaacttgaattatatgtttgtaccatatggaagtgatgatggcagagaagaatggtctgttttgaagaatgaaggagaaaagcagaatctatcagagctgacaacaatcgtgttacctgcacagcaaaattttaagggctatttaaaagtttatggacaagattatagtggaaatgtcggagaaattgtaaaaagtaaaggaatggtttctgaagatgaacaattacatgaacaagtaagtaaaatctctttaaaaataccggaagcagtttttacggatgagaaagaaaagctaaattattataataaagcagttttcgttgaagcggtctttgaggatgaacagtcgggaatttgtaaaaccagtctgtgtggaaaagtaaacaataaggaaatgcatgaggatagcagcatagtggtttgggatgctgaggatacagtatatagaaaaagacagcggcttacattagaagagaaaagctttagatattcagattctgatcatccaataatgattcaaggaagtatgacagataatgcaggacatgtaagtgaggaggttttggaacagggaatcattattgacactgaaaagccggttataaaggtggaatatgatagaaataatcaaacagaatattataatacagaaagaaaagcaagagtaatagttaaagagcggaactttagacctgagttggtgaagtgggatataaagggaagtaatcaggaatatcatatgggcgaatggaaaacgacagaagatatacatacatacgagatatattttgataaagatggagaagattatgcaattaatctttctgtgacagatagggcagggaataagtcggaatggaaagacagggagtattttacgattgataaaacgcttccggaagtttctattgccatagagaataatacggattatgaaaaagaaaatcagcttttatattttaacacagataaaacagtagtattttgcataaaagataaaaattttgatgaacataaggttgaatatgatataagagcaataaaagcagcgaataagaggaaactgatcgatgcagacaatacagaatcttatgtcataaatggagaaaagcattataagtatctgactttaaaagaggaggctcactattacattcagatgcgatgtacagataaagccggaaatgaatctgaaaaaaagaaaatagagtttataatagacaagacagttccaaatattacgataaaaggagtcaagaatgaagcggtatatgaagacagagtaataatgcctgaggtaatatgtgaagataaatatttagatgcggattctgtaaaggtgtatttattaaaagcaagtggtgaaccggtttcgaaagaaggctggaattatgaaagaacagaggataaaaggaaggtacagattcaatgggagaatttaagacaaaataagtcaaaagacggtatttatcaattgtttattaaggcaaatgataaagcaggaaataaaataaaggataattataaggttgtttttcgagtaaatcgttggggtgcagattttattttgaatcataagataaaagagagtatagatggacattacttaagagaagaacccaatattatattaaaagaacgatgtgtaaaacagacaaaatcgagagtgataattttaaaagataatgaagaaagaagaactttgcaaggagaatatgtaaaagagtgtataatcgcagataaaaaatcagaaaaatacggatggtacgagaaaagttataatataaaaaaagagaattttgcagaagagggagaatatctcgttacaattcaggaagattctaaggagaagaaaatacattttgttatagataaaacaccaccagcagttcatattagtaatttagaaaaagatatttatgaggaagaagaacataactttacaatcggtataatggataattatgcctttgaaagaatggaattatatgtagagaaaagtacgatacctttgcataagaaaaaggtgcagaaatttattataaagccggaagatttagataaaaatcatatggtgaatcagaagattacagaagatacagcgtatcaaacgatacattatattgcatgggataaagcaggaaataagctggattctaatgataatggagatacaaggaagtgtcttgtaactacgaataagcctgtaaaagaatattataaaaataatcctagatcacagataataatggggatagtaatagctgctaccgtatttacaagtgggtgcatagccttttacaatagaaaaaagcatagataa

SEQ ID NO: 323 - DNA, 2553 bp, Eubacterium sp.
atgagtttcgttaagagagggaacctgccggaattacttgctccggcaggttctttggaacatttaaaggcagcggtatcagcaggagccgatgcaatctatatgggcggagagaaatttggtgccagagcctacgcacagaatttttccagagaagatatgatagaggcattgcaaattgcgcattttcatgaacgaaagttatatcttactgtgaacaccttgatgaaggaagaggaactttttgaagaattaggagagtttcttttcccttactatgagaatggattagatggagtaattgttcaggatatgggagctgctcgttttattcgtgaacattttcctgagatggagatacatggaagcacacagatgacagtaacagatattcatggagctgttgcggcaaaaagaatgggaatgaccagagttgtgcctgcaagagaactatctttagaggagataagggaaataaaagaaaagacaggactggatatagaagtttttgttcatggagcattatgctactgttattcaggacagtgtcttttaagtagtgtgtatggagacagaagcggtaatcgaggcagatgtgcacagccatgcagactgccatataaagtaaaagatcataatggcaataatctgcatacatcaaaacaggggaattatttacttagccccaaggatttatgttccctttctctattgccttcattaatggagcttccggtggattccctgaagatagaaggacgaatgaagaatgtagaatatgtagctggggttacttctatttatagaaagtatctcgatcaaatttttgctaactgggaagagagagaacattttaaaccagaagaatcagatattcatgcgctggaagaattatattgcagaggaagctttacaaccggttactggaaacagcataatgggcagaatatgatgtcagtactttctccaaagaatacgggcagacgaattggcaaagtatgttctgtttctaaaaataaagtgaggatttcctatgaagacagactacatccgaaggatattctagttataccagtatctttggatggacaggaggaacttgttcttacggtaccatctaaatgtcaggaagatggaaagaaaaagggacagattacattaaatattccaaggacacagggactgaaagaggggacgttggtatatcgaaggaagaatattgagctttcggatcatatcggaaaaaatattttaaataaagtgataaaatatccggtaagcggagatattactttaaaagttggagaaccgctgatgctccagctgttttgtcgtgaagaatatgcgtttgtagaagggcctgttgtagaattatccaagaagagacctgttacaaaagaagatattttaaggcagatgcataaaacaggaacagttccgtttgaattagagaattttgaggtgaatatggaggaagattgtttccttcctatgtctgtattaaaaactgtgcggcaaaaaggcttttctttgttagaagaaagattgaagaatacgaagagaagaagcgtattggaaaataatgaaaaggataaggaaaataataaaataaataagatcgtatgtttagagaaagaaggcttgaaagaagattttacagagaatttcacaggaaaaatatctatcgatgaaagaattgcaacagtttataatagggaacagtgtatgatatgttgcaaagattccttttttgatgggatctgtcttacttcagaatttttctcagaggaagaattactgcaatttggtcaggcagtatcagatgcaggtaagaacgtttatttagctttaccacatgtgttcagaactaatttgaatttagaaaaagtatgtgtatcctctatttggaatggaatatatgcatatactataaatgaagcagaatttttgcatgaactgaaaggacgcacagcgaagattatcgcagcagcttctctgtatcactggaattccagtgcagtttctgaaacagcggcactgtatccagagatgacagtgagggagataccaatagaattgtccggcagagaagttaatgcgatgctggaacactgttatgagaagtgtttaggacaggctgaacatataagaaatataaaagatatacagaagaaagaagcatttgaagttcttattcatggaagaattcctgtaatgcagtcaacacagtgtatgaaaaagacaaccggacattgtaataaaacttcagaagaaatatggcttgaagataaaaaaggaagaaagcttccggttacaacacattgcagggaatgttataatctgatctggcaggagaaaccatatgatcttatcggtgaagaccttacgggaagtattccttatgttacaaggcatagatttgatttattccatatgtcagaaaaggaaatcaaagagatgaaagacaggtatctgatctggcaggagaatcattttatgtgtgatcttcaaaaggatgatacagaacatcactggaactatggtatagaatag

SEQ ID NO: 324 - DNA, 1887 bp, Eubacterium sp.
atgaggattcataacagagaagagttaagcaagattcgtgagatggcagcagataaagtttcttccacgaagtgccgtattttgatttgtgcaggaacaggatgtttagccggtggttcaggtgagatttatgagaaaatgtgtgaacttacaaaggattgcaaagatgttgatgttgaatttggaccggagatcgcacatggaagtgaacatccagttgcagtgaagagaagcggctgtcatggcttttgtgagatgggaccgctgatgagaattgaaccgcttggtattctttatacgaaagtaaaactagaagactgcgaagagatttttgagagaacgataaaacatggaaatattatccatcatcttctatataaacaggatggtgttgaatatccaaagcaggaagagattccattttataagaaacagacccgtctggtacttaaaaattgtggacatattgatgcagaacatatagaagaatatattgcagttggcggataccaggcatttgcaaaggtattgtttgaacaaacaccggatgacgtaattgagacgattttagaatcaaatctgagaggtcgtggaggcggtggtttccagacaggatataagtggaaacaggttgcaagacagcaggagaaaacacgttatattgtatgtaatggtgatgaaggagatccgggagcattcatggacagaagtatcatggaaggtgaccctcataaaatgatagaaggtatgctgattgcagcttatgcagtaggggcacaggaaggatatatttatgtacgcgcagaatatcctcttgcgatcagccgtcttcgcctggcaatttcacaggcagaggaaagtggacttcttggagagaacattcttggaacagatttttctttccatttacatattaacaggggcgcaggagcttttgtatgtggtgaaggaagtgcgcttactgcatcgattgaaggtaaaagagggatgccgcgagtaaaacctccaagaacggtggaacagggcttgttcgcaaagccaaccgtattaaataatgttgagacttttgccaatgttccgatgattattgataaaggtgcagcatggtaccggagtatcggaccggaaaagagtcccggaacgaaagcatttgctcttacaggaagtgtaaaaaatacaggattgattgaggtaccgatgggaacttctttgcgggaagtaatctatgatatcggtggtggaattaaaggagatgcacattttaaagcagtccagattggaggaccatccggcggatgtcttatcacaccacatttagatgtcagtcttgattttgattccttaaagaaaatgggagcgatgattggttcaggaggtctcgtagttatggacgataaaacctgtatggtagaagttgcccgtttctttatgaattttacacagaatgaaagctgtggtaaatgtgttccatgccgagagggaacaaaacgaatgcttgaaatactggaaaagattgttgccggaaagggaacacttgaagacttaaatctgcttgatgaactggcttctatgattacggatacagcactgtgcggacttggaaagagtgcagcacttccggttatgagtacacttcgtcttttccgtaaggaatatgaagaacatgttgtcgataaaaaatgtgcagcaaagaactgtacagcattacgtcgttttgttatcagtccggagcgttgtaaaggatgttcaaaatgtgcaaggaactgtcctgttggcgcaatcagcggacagattaaaaagccgtatgttattgatgacagtatttgtattaaatgtggtgcctgtgagagtgcctgtgcattccacgcaattcatatagaagcatag

SEQ ID NO: 325 - DNA, 4227 bp, Eubacterium sp.
atgaaacacgcattaggaattgatattggttctactacagttaaggtaaccgtcattgatgagagccatactatccttttttcagattacaaacgacattttgcaaatattaaaggaacattacaaactttattatctgaagccagagcgaaacttgggaatctgacaattcatccgacggtaaccggttctggtggaatgtctatttcagagtatttacatattccattttgtcaggaagtagtctgtgtggcaaatgcattgcaggactatgagccaaaaacagatgttgcaattgaacttggcggtgaagatgccaagattatttattttaataacggaattgaacagcgtatgaatggtgtatgtgccggtggtaccggctcttttattgaccagatggccagtcttttacagacagatgctaccggtcttaatgaatatgcccgtaattacgatacgctttatccgattgctgcccgctgtggtgttttcgcaaagtctgatattcagcctttaattaatgaaggagctacaaaagagaatcttgctgcttctattttccaggcagtagtaaaccagacgatcagtggtcttgcctgtggtaagccgatcaaaggttacgttgcatttctcggcggacctcttcattttatgccggaattaaagaatgcttttatccgtactttgaatctagatgaagaacatattatagacccaccatattctcatctttttgctgcaaagggcgctgctcttaatgcaaaggaagaatgcttttttacaatggatgagcttttaaaagaattcgaatctgacataaagcttgctgtagaagttgaacgtatggagcctctttttaaagatgaacaggaatatgatgcatttattaaagagcataatcagttcaaagttaaaaaagcagatttagctacatacagcggcaaatgctatctcggtattgatgccggttccacaacaacaaaacttgctttagtcggagaggacggttctcttttataccgtttctatgataataacaacggaagtccattaaacacaacgattcgtgcgatgaaggaattaaaagaacttcttcctccttctgctaagatttccggttcctgttctaccggttacggtgaggcattgatcaaagccgcattacagcttgatcatggagaagtagaaacgatggcacactattatgccgctgctttctttgaaccagatgtagactgtatcttagatatcggcggtcaggatatgaaatgtattaagatccgcaatcacgctgtagataatgttctcttaaatgaggcctgctcttccggatgtggttctttcattgaaacttttgcgaagtccttaaattattctgttgctgattttgccaaggttgctttgtttgctccgtctccaattgacttaggttcacgctgtactgtgttcatgaattccaaagtaaagcaggcacagaaagaaggggcaagtgttggtgatatttctgccggtcttgcttattctgttatccgtaacgctttattaaaagtaattaagcttactgatccaaaacagcttggtaaaaaaatcgttgtacagggtggtacgttctataatgatgcggttcttcgcagttttgagcgtatatccggctgtcatgctgttcgtccggatattgccggtatcatgggcgcttttggtgctgctttaatcgcaagagagcgagaagatgaaacgggtgatacaaagatgctctctattgatgagatcatccatcttgaatacactacttccatgagccgctgccagggatgtaacaaccactgtattcttactattaataagtttaacaacgaccgtcaattcatttccggtaaccgttgtgaacgtggtcttggtcttgagaaaaatcacgaacatgtaccaaacctttatgaatacaaatataaacgtattttcggatataaatctttaaaaccagacgaggcaaagcgtggtgtgatcggtattccaagagtattgaacatgtatgagaattatccattctggcatacattttttacaaatctttctttccgggttatgctttctccaaagtcatccagaaagatttacgagcttggtattgaatccattcctagtgagtctgaatgttaccctgccaagatcgcgcatggtcatgttatgtggttactgcaaaagggaatccacactattttttatccttgtgttccttatgaagagaatcaaatgcagggttctaacaatcactataactgccctattgtaacttcttatgcagaaaacattaaaaataacatggaagaacttcgtgacccggatgttctctttatgaatccattcctggcacttgataacgaagaagctttaaaagtacgtttgtacgatgaattatcaaaacattttgatgtgacaaaagaagaaattaaccatgccgttgaagaagcatataaagaagcttctcaagtaagaaaagatgtacaggcaaagggagaaaaaactcttgcttaccttgctgaaaccggtaaaatgggtatcgtcctctgtggccgtccataccatatcgacccagaaattaatcatggtattccagaactgatcaactctttcggcatcgccgtattaagtgaagattctatctgccatttaggtcatgtagaacgtccgttaatcgtatctgaccagtggatgtatcattcccgtctgtatgccgctgcaaactatgcaaagaagaataaacagcttgaagttattcagcttaactctttcggttgtggtcttgatgctgtaacaacagatcaggtaaatgatattatgaccaattccggacgtatttacactgtccttaagatcgatgaggttaacaatttaggcgctgccagaatccgtatccgttctctgattgccgcggtaaagatcagaaatcgtaagcacatcgagccacatccggttccggcaaatattacaaaagtagagtttacaaaagaaatgaagaaggattacacgattctgatcccacagatgtctccaattcattttgacctgcttgctcctgccttccgccactgcggataccatgtagaaattctgccggaaatgggaaaacaggctgtagataccggcttaaaatatgtaaataacgatgcctgctatccatctcttatcgtagtcggccagatcatgactgccttaacttccggtaagtatgacctcaacaaaacggcggttattatctctcagacaggaggcggctgccgggcaacgaactatatcggcttcatccgtcgtgcattagaaaagaatgggtacggtcagattccagttatcagtttaagtgtacagggaattgaaaagaatgcaggatttaagtttacgcctgcgctcttagttcgcgcactccagggtgttatctacggagatttatttatgcgtgttctttaccgcgtccgcccatatgagaaggtaaaaggttctgcgaaccacttacacgaagtgtggaagaagcgttgtattaaatctcttgaaaaggcacgttacggtgaattcaagaaaaatattcgtggaatcatccatgactttgataaactgccaattaccgatgaaaagaaacctcgtgttggtatcgttggagaaatccttgtaaaattccttccggatgcaaacaatcatctggtagaacttttagaggaagaaggagcggaagcagtaatgcctgatttattagactttatgttctactctttctataacagtaattttaaggcagagtatcttggaaagtctgctaaggctgctaagttatgtaacatggcgatttctgcactggaggcttatcgaggcttccttcgaaaagaattagagcgaagcgaccgtttcactgcaccacctcatattaaagagcttgccgaatacgcaaaacctattgtatcgctcggtaatcagaccggagaaggatggttcttaaccggggaaatggttgaacttatcaaacaaggcgcaccaaatattgtctgtacccagccttttgcctgtctgccaaaccacgttgttggtaaaggcgttatcaaggaacttcgccgtaaatatccagaatctaacattgtagcaattgattacgatcctggagcaagtgaagtaaaccagatcaatcgaatcaaactgatgttagcaacagcacaaaaaaagttaaatactgattgctaa

SEQ ID NO: 326 - DNA, 1509 bp, Unknown
  Description of Unknown: Clostridiales sequence
atggcaaaaaaatattccgggaagacgcgccgcttcggaacggtcgcggtgcttctcacggtgctgaccgtggtgacggtgatccttttgaacggcatcgtcaccaagctggcgctccgctacggctggtatatccgcatgaccccgcagctgaccttccccgtgaccgacgcgtgctatgactacctggaccggtatgtcatggacagcgtgagcgcgggggagccgctgcgcatcatcttctgcgacgaggagcagaacatccgcagctccggcacgcaggcatacgtgctcacgacggcgaccgagcttgccgagcgctaccccggcaaggtgcgcattgagtacctcaacgtctgggagaacccctccgtagcgcgggcttacggcgtcaaggcatccacgtctgtcgtggtggcacagggggatcgctcccgtgtctgcacgctgaaggactttttccagttctcgatccgcgattccgagacgccggtcgcctacaacggcgagaaacggctggcggtcgccatgaaggcggttctgtccgccaatgcgccggtctgctacttcaccatgaaccacggtgaatccatgagcgactactcgctcatgttcgcggctaccgatgcaggctatatggtcaactatctggactcgctgtccttcgacattccggcggactgcgacctgctgatttcctacaatcccgtgcaggattttgccgcccgggacagcgtgaccggcatctcggagatcgaaaagctggatgcctacctgtcgcgcggcggaaaaatgatggtattcgtttcggcggacaccttcgcggcgggcagcttcggcaatctggagggctttctggcggattggggcgtgacctttgaccacgccaagggcgcctccggcgtggaggagtgctacagcatccgcgacaccgcccactcgctcagcaccgacggctacaccatcctcggcaaggttgccgacacaggcagagccggcgagatgatgcggcaggtcaccggcactgtccggcttgccaacgcgaccggcatctcgcccgccgacggctggagcgttgccggcaatcagtggtcgagcggggaacgcacggcgtatgccctgctccgctcctatcccggcgccgaggcgtgggcgggcggcagagccgtcgcgcgcaccgatgagggcttcaatctgatcacgctgacgcaggcgggcgagagcggctccgccggctcgctgctggtctgctcctccgtggagtatgccaaggaggctgccatgcagtccggcgtgtacgacaacgagactctgctgctggcggctgtggaggcaatgggcaagaccgatacccccatgcatctggcatcccagcccttctcggacaggagcatccacatcctgaccaccgcagccgcgcggcggatcacgattgcactggcggctgtgcccgccgggctgtcgcttgccgtcggactggtggtgctggtacggaggaaaaccgcatga

SEQ ID NO: 327 - DNA, 1479 bp, Unknown
  Description of Unknown: Clostridiales sequence
atgaagcagtacatacttgcccttgacgaggggacaaccagtgcgcgcagcatcctgtttgaccgcgaactgcgcgtggtcagcatggcacagcaccccattgcgcagaaatacccccaccccggttgggtggagcaggacccgatggagatatacgccaaccagtacgcttccatgaccgaatgcgtggcgcgatgcggcgtttcaccggaggagattgcggggatcggcatcaccaaccagcgcgagaccgcgatcctgtgggagcgggcaagcggacgtccggtctgtaatgccatcgtctggcagtgccgtcgcacggcggggctgtgcgaggagctggagcgcgccgggcatggggagtacatccgtgcggtgacaggtctgcgccccgatgcctacttcagcggcaccaagatcaagtggatgctggatcatatccccggcgcgcgggcgcgtgccgaggcgggcgaactgctgttcggcacggtggacagctggctggtctggaagctgaccggtgggcgcgtccatgtgaccgatgcgaccaatgcctcgcgcaccatgctgtacgacatcgggcgcggttgctgggacgagcagctgctggatattctggatatccccgcctgcatcctgccggaggtgcgttccagcagtgaggtctacggttacaccgacctgatgggggcaagactgcccatctgcggcatcgcaggcgatcagcaggcggcgctgttcgggcagggatgcttccgggctggggaagggaagaacacatacgggacaggctgtttcctgctgacaaacaccgggcgcgagcgcgtcacgtcctccaacggtctgctgactacggtcgcggcgacctgcctcggcgatccgaccgagtacgctctggagggctccgtgtttgtggcgggggcggtcattcagtggctgcgtgatgagctgcacctcatcaacgaggcggatgacagccaatacttcgccgaaaagctgaccgacagcggcggcgtgtacgttgttccggcgttcaccggacttggcgcaccctactgggatatgcacacgcgcggggcagtgctgggactgtcgcgcgggacgggcgcaaagcacctgatccgggcggcgctggagtcggtcgcttaccagacaaacgatgtcatacgggcaatggaggcagacatgggggcgctccgggcactccgcgtggacggcggcgcagcggcaaacgatttcctgatgcagttccaggcggacatatctgacctgcctgtgttccgtccggagtccatggaggcgaccgcacgcggtgcggcatcgctggcggggcttgcgtgcgggctgttccccgatcgggatgccgtgcaggcaaccctgcgtgccggaacttcctttacgccatccatgtccccggatcagcgggaagcgctcctgtccggctggcatcgcgccgttgaggcgtgccgcgtattctga

SEQ ID NO: 328 - DNA, 1317 bp, Unknown
  Description of Unknown: Clostridiales sequence
ttgaccataaaaacgaaggcgggcttccccgccgcggtgccggcatacgttgccgtttgcggtacccggcgggggcttgctttcattgccgccgacccgatatgccgccgggcatttttactttcgcaacttgctattgcaatttgcgctttatttttttgcaaagcggcaaaaaagaaaaaaacgagaaggaaaaagaagaaagcctgcgtatcttatacggtagcggggaaaaacgcgaaaacgggcggaaaagggggactgatggcgatggacggaaccgcaggaacagacggcgggattgccggagttgcggagtggctgacgcagcgggaggaacagctgctcggtccctacgccgcgcgcagcgcggattcacgcggacgggcgcgtccgcaggcaccgtccccgatgaggacggagtatcagcgcgaccgggaccgtatcattcactgtcaggcgttccggcgtcttatgaacaaaacgcaggtgttcctcgctccggcaggcgaccattaccgtacccggctgacgcatacgctggaggtgtcgcagattgcgcgtaccatggcacgtgccctgcggctcaatgaggatctgaccgaggcggcggcgctggggcacgatctgggacatacccccttcgggcacgcgggcgaggcggcactgcgtgcgtgctacgacagccgctttgcccattacgagcagtcactgcgcgtggtggacagactggaaaacgacggacgcgggctgaatctgacctttgaggtgcgggatgccattgtcaaccacaccggtgaacacatggcagccacgctggagggcgttctcatcaagtatgcggcccgcatcgcatacagcaaccacgacatagacgatgcctgccgcgccggattacttgaccccggcgatatacctgccgacatctgccgggtgctgggggacagccatagcagccgcatcaataccatggtgtcctcggtcgtgcgggcaagtatggatcgcgacagcatttccatggagccggaggtgcaggaggctaccgtgcagctccgggaattcctgtttgagcaggtctatctcaacccgagggcaaagggacaggaaagcaaggcgcaggagctggtcaagacgctgttcggctactatgcgacgcatcccgaccggatgccggagctgtaccgccgccttgctgccgagggggaaccggtggagcgatgcgtgtgcgatttcatctccggcatgaccgatcggtacgcgattgagacatacgaggagctgtttgttccccgcgtctggagaggactgcacgaatga

SEQ ID NO: 329 - DNA, 1398 bp, Unknown
  Description of Unknown: Clostridiales sequence
atgaaactcgtctacggaatcaaggacaagccccgcttcccccagctgcttgcgtttgccttccagcagctgcttgccattatggcggcaaccatcgcggtgcccatgatcacctctggtcactacgacaattttgacctgtcgatgagcacagccgctgcgctgatcggtgcaggcttcggcaccatcgtgtacctgctgttcaccaagttcagaagccccgtgttcctcggctcgtccttcgccttcctcggctccatggcggccgccttcggcggtgccgtgtccatgcaggttggctacctcggactgctgatcggtgcggtagctgccggtctggtgtacgtgatcattgcgctgatcgtcaagctggtcggcgtcaactggatcaacaaactgatgcccgccgttgtcatcggtcccacggttgccatcatcggtctgtcgcttgccggaaacgctgtcagcgatctgcagaccgcgcctgccggcggtcacaagctgcttgcggtgctgtgcggtctgatcacgctggctgtgaccatgctctgctccgtgtacggcaagaaaaacctcaagaccatccccttcatcatcggcatcctggcaggatatgccgttgccctggtgttcacgctgatcggcaaggcgaccgacacggcaagcctgcttatcatcaatctggattccttcaagagcctgacagcggacggcgtgtcggtcaatacctttatcaacacccacatctttgagcagatgaccttcaccaatgcgtttaagggtgtcaaggatctgagcggcgcctatgttgccaacatcctgttcgcttatgttccggttgccttcgtggtgtttgccgagcatatcgctgaccacaagaacctctcctccatcattgatcaggatctgctgacgaaccccggtctgtcccgcacactgcttggtgacggtgtcggatcggctgtcggcgccttcttcggcggttgccccaacaccacctacggcgagtcggtcggttgcgtggcaatttccggaaacgcttcgatcgtgaccatccttgcaacagctgtcatggcgatcctcgtcgcgtttgtgaatcccttcgtggtgttcctctcctccatccccaactgcgtcatgggcggtgtttgcatggctctgtacggcttcatcgcagtttccggtctgaagatggtgcagaaggtcgatctggaagacaaccggaacctgttcgtggtttccgccattctgatctccggtatcggcggtctgtccctgaccattgcgctgggtaaggggcactccattaccatcacctccattgcctgcgccctgatccttggcatcctgaccaacgtcatgctgagcagaaagaaaaaggacaagtccggcaagtaa

SEQ ID NO: 330 - DNA, 1002 bp, Unknown
  Description of Unknown: Clostridiales sequence
atgttccagaatcaagcggtatccttttctggcattcagcccagcggaaacctgacgctcggcaattatcttggtgcactgcggaatttttccgctttttccgaaaaatacaagtgcttttactgcgtagtggacgagcacgccattgcggttcggcaggtccccgctgaattgcgtcgccgcacctatgaaacgctggcactttaccttgcgtgcgggcttgaccccgaacgcaacacactgtacgtccagtcgcacgtgccggagcacgccgagctggcatggctgctcaactgcttcaccatgttcggtgagctttcccgcatgacgcaattcaaggacaagagcgcaaagcacgccgacaacatcaacgccgggctgttcacctatccggtgctgatggcggcggatatcctgctgtatcagaccgatgtcgtgccggtcggcatcgaccagaagcagcacgtcgagatatgccgcgatattgccaaccgcttcaaccagatctatcccgacacctttactgttccggaaccgatcatcgcccggcacggcatgaagatcatgtcgctggcggagccgacaaagaaaatgtccaagtcggacgagaatgagaacgccgtcgtgcgtattctggatgaccgcgacaccatcatccgcaagttccgccgtgccgtcacggattcggacgccgtcgtgcgctacgccgagggcaaggacggcatcaacaacctgatgaccatctatgccgcactgaccggaaaagatatggcagagatcgaacgcgagttcgacgggcgcggctacggtgatttcaaaaccgctgtcggagaaacctgcgccgacgtgctcgccccggtgcaggagcgcttcaagacctacattgccgacaaggcaatgctggaggcgcaaatgaaaaagggcgccgccgaggcttcctacgtcgcccgccgcacgctgtcaaaagtgcagaaaaagctgggatttgtccagttgcactga

SEQ ID NO: 331 - DNA, 852 bp, Unknown
  Description of Unknown: Clostridiales sequence
cggcgcattcctcgcgttttgccgcgcgcggatgtaggggagttctgcttacaatcagaaaaggagagacaaattatgaaaaagctgtttgcggttctgcttgcagccctggcggcgctgacgctgttcggttgccagaacacggagaaggatcccacggggagtgattctgcgactgtcggtgagacgactgccgataccgtgaaggtgatgacctacgctgagttcctcgctgccgaggcggatagcaaggtaacggttgaggcgtatgtacaggcaaagcagtcctggtggaaggacgacaagggcgttggcaaggctaccctgtacacgcaggatcaggatggcgcgtatttcatctacgaactgcctatggaggaggatcagtacaacaagctgaccaccggcaccaagattcgcgttaccggcagcaaggcggtgtgggaaggcgaaatcgagatcatgaacggtacgctggataaggtgctggagggcaattatgttgctcccgctgtcgatgtgaccgctaagctgggcaccgatgatctggctacttacatgaaccgctttgtttccttcaagggcatgactgtggctgccaagaaggatgccaacggcaacgatgttgcgttcctgtacaagtggaacggcgccggtcaggagggcgatgacctgtacttcgacgtgacgctggacggcaagacctatacctttacggttgagtcctacctgtgcggcaaggacagcgaggtctacaaggcagtcaaggcgctgaaggtcggtgacaagatcgacatggagggcttcctgtactggtacaacggagccaatccgcacatcacgtccgtgaag

SEQ ID NO: 332 - DNA, 1797 bp, Unknown
  Description of Unknown: Clostridiales sequence
atgaacacaactgcccgcgtatcctccgaccgtccggctaatctgtcgccgaattccggcgacagccgcccgtttgatattacccgcctgaccggtgccccctttcatctggacgaggcgggagtcgtttgggttgaggagaccctgcacggcatgcgcacggaggacaagctccgacagctcttctgccttgtgacctacagcgacgaccagcccgctctcgagcgtattgccggggacatccgtccgggcggcatcatgtgccgtcccatgccgctggctgcctgccgaagggtagtagatatcctgcaatcctgctcggcgatccccttgctgattgcggcaaatctggaggcaggcgggagcggggcgctgaccgacgggacacaactggggcgtcccatgcagcttgccgccgcaccgcgcggaagggcggaatgggcacggcgactcggcgcagtctgcggagcggagggagccgccgccggcatcaactgggcgttcgcgccggtcgcggacattgatacaaactggcgcaaccccatcaccaacacgcgcaccttcggatccgatcccggcaccgtcggcgaaatggcagaggcatacactgccgaggtgcagaagcacggacttgccgccgccgtcaagcacttccccggtgacgggcaggacgagcgcgaccagcatattgcaccgtccgtcaacagcctgtccgttgaggactgggacagaacctacgggcagatatatcgccgggcaatccgggcaggcgtcagatccgtcatggtcgggcacatcctgtttccggcatggagccgccggatgcatcccggaatcccggatcgggatattctgcccgcaaccgtcagctatgacatcgtgaccacacttctgcgcgaccggctcggctttgacggtctgatcgtcaccgacgcctcaaccatggcgggactggcagtctacctgccgcgccacgtgctggttccagccgccattgccgccggatgcgatatgttcctcttcaccaaggacacagaggaggatatcggctacatggagcagggtttccgggacggcatcatcacaccggaacgcctggacatggcggtcacacgcattctggcgctcaaggcgtccctgggactgcaccgggcgcaggcggctggcagctttgtgccgccggaggcgaccgcgcgttcggtggttgcctgtccggatttccggcgttgggcggcggagtgcgcggcggaatccatcacgctggtcaagcaggagcccggcgccctgccgctgacgccgcagaaatacccgcgtgtcctgttcgtgccgctggataaccggcaggacggcacctccgtctttcagaatgacgattcgcaaaatttgcgcctgcaacacgccctggaggcggagggcttttccgtgaccgtcttccaaccgccagccggatttgaaggcatgatgacgcctgtccgggaaatgaccgagcgctatgacctgatcctctatgcagcctcgctgacaacgcgctccaatcagaccgttgtgcgcatcacctggcagaacccgatgggcgtgaatgtcccggtgtacacccatacaattccgacagtcttcgtttcactcgataatccctaccacctcatagatgtgccgctcgtccgcacctatatcaactgctatgcaggcaatgagactgtcatccgcgcactcatggacaagctgaccgggcgcgcccccttcgttggtgtatcgcctgttgatcccttctgcggtcgttgggaagcaaagctgtag

SEQ ID NO: 333 - DNA, 1008 bp, Unknown
  Description of Unknown: Clostridiales sequence
atgagaaccaagcgaaacgccaaaaaccggcgcatagcgcgtgccggcatgtgcctgacgggcgcagtgctgggaacagcggcgctcacggtcgcttataccgatgcgatgacaagtattgttgcccggcgacgctccccgctggcaagccgcctgtccggactttgtaccggcaagaagcgtgaaccggagcaggcggaacaggtgcgcctggcggcggagcagttgctgaaacaaccaaccgaggaagtctcgctgatcaaccgggaagggctgacattgaaggcacactggtaccatgtggagaacccccgacgtctgctgatactggtgcacggatggcacagtgtttggaaccgggatttcggcgtgagtgctcccttttatcatgaaaatgactgtgaattgcttctgattgaacaacgaagccacggcgccagcgagggaaagctgattgcttacggtgctcgcgagcgctacgacgtgctagaatggctgacttatgcgcgcacagtgtgcccgacacttccggtatacctgtgcggactgtccatgggagctgccacggttctgctctgtgccggggaaccggtcgttgccgataccgtgacagccattgtggcggattgcggctatacggtgccggaagaagttgtctcggagcgtatgcgcacgcttctgcgtggcgcgacgggtgcaacaatggctgccgtcaatctgaattgccgtctgcgcggcggtttcacattgaaatgttgttccaccaaagaagcgcttgccaaggatacctgtgttccggtgttcttcatacacggggatgccgacgagttggttccgtgttccatgacactggaaaactatcttgcctgttccgcgccgaaggagattctcatcgtccacggtgccggacacgcgaccagttttttggttgatccggaaacatataaggcacgcgtgcttgcgttctttgccgcatgggacggcagactgcacgcggcgaacggctga

SEQ ID NO: 334 - DNA, 1359 bp, Unknown
  Description of Unknown: Clostridiales sequence
atgaaacagaaactgaactgccgtgagtatgcatatatcgccagtatgcttttcggattatttttcggagcaggcaacctgatatttcccgtacacatgggtcagatggcgggcaaaaacgtctggcttgcaatcatcggactgtgcgtgaccggcgtgggactgcccctgctcggcgttgccgcgctcggaatcagtcgcgcgaacggactttttgagctggggagccgtgtcggacgcccctactccctgttcttcacctgcctgctctacctgactatcgggccgttctttgccattccccgttgcgcgaccaccgcgtttaccgtgggattggagcaggtactgccgcagaacgggagcgcgcagatgtacctgctgctcttttccttcctgttcttcggcgcggcgctgttcttcgcgctcaagccgggcaagatactggtgtgggtaggcaagatactcaatccctgcttcctcgcgtttctcggtgtcctggtcgttgttgccatggtcaatcccggtgcctcggtcggcagtgtcgcgccggagggcgcctatgccacccagccgttctttgccggcttcctggaggggtacaacacgatggacgcgctggcaagccttgcattcggcatcgtggtggtgcaggtcatccgcgggctgggcgtcaacgagccggatgccgtggcgggcagcaccgtccgtgcaggtattttcagctgcctgctgatggctgccatttacgttctcgtgaccatcgtcggcgtacagagccgcggtctgtttgagacctctgcgaacggcggcattgccctgacgcagatcgctcagcactatctcggcaaggcgggacttatcatccttgccgtaacggtcacgctggcgtgcctcaagacatcggtcgggcttatcacgagctgtgcggagacctttgtcggactgttccccaagggacccggctaccgcctgtgggctgtcatcttcagccttgtgtccctgtttttcaccaatttcgggctgaacagcatcatcggctactcggttcccgtgctgatgttcctgtaccccctcgccatcacgctgatcctgctctcgctctgcggtcgcttcttccggtatgaccgcgcggtctttgcctggacgacgggactgaccttggtcgccgcgctctacgacctctttgtcagcctgcccaaggggatctatgacgcactgcacggcgatgccgtacaggcgtttgttaccggattcctgccgtttgcggagctgggactggggtgggtctgcccggcactgctcggctttgccatcgggctggtggttcacttcacccgtaggaagaagatcagcgcctga

SEQ ID NO: 335 - DNA, 1059 bp, Unknown
  Description of Unknown: Clostridiales sequence
atgaataatcggaccgagcgtaaacgcatcggctacgccgtgctgggactcggcatcggcatggcacacgcggacgctgcctatgcctcggacaacgcagaccttgtcgcggtctgtgacatcgacgaggcacgactgcatcaggcagagcaggcttaccccggggtcacgctgtaccgcgattttgagcagcttttgcacgatgagcgggtagatattatcagtgtatgcctgccaagcgcgatgcacgcggatttcgccgtccggtgcatggaggcggggaaagatgttctggtagagaagccgctggatataacaccggcgcgcgcggagttgattgaacaggcgcgcctgcgcaccggacgcacctgcggcgtggtgcatcagaaccgcttcaatgcagatatgccccccatccgggacgcggttgtctccggacggctggggcggctgattctcggcacctttgccgtcaaatggtatcgggagcagtcctactacgaccgcggaggctggcgcggcacgtgggagatggatggcggcggatcgctcatgaatcagtccgtccacacggtagacctgatgcagtggctgatgggcgacgtggtttccgtcacgtccaccatgagcattgccaatcataatatcgaaaccgaggatctgaccgcctccctgcttcgctttgcaaacggtgccacggcaacctttgtcagcacgacctgcgcgtaccccggtatctccaccgaaatctgcctgtacggaaccggcggtacggttgaggcagatgccgattgcctgaagacatggaagatgaaggattccgccgacgaggacgcagaggaagccgccatgctggcgcgctacggcggcgggaatctggcggcgctttccgcagagccaaaccgcctgttcggacacgcgcacgtcgtggaggacatgatcgccgccgtgcgtgacggacgggatccggaggtcatgcccgccgaggctttgaaaagtgtccggatcgtccatgcggtctatgaatccgcgcgaaccggaaagaccgtcatgctgtaa

SEQ ID NO: 336 - DNA, 1095 bp, Unknown
  Description of Unknown: Clostridiales sequence
atggctacattctctgtcaatccaaagctgaaggttggcgtggtcggtgcgaccggcatggtcggtcaacgcttcctgaccctcctggaaaatcatccgtactttgaggtcgcggcgctggcggcatcgccccgttccgccggaaagccgtatgcggaagccgtcgagggacgctggaaaatgcaggttccgatccctgagaaattcaaaaacatggtgttacatgatgccaacgacacaaaagccatgggagagctgtgttccttcgtgttctgcgccgttgatatgaagaaggacgaaatccgcgcactggaggagaagtatgcccgtgccgagatacccgtcgtgtccaacaacagtgcgcaccgttggacgcctgacgtgccgatggtcgttccggagatcaatccggagcatctggctgtcatcgagcatcagcgccgccggttgggaacgaagcgcggctttatcgcagtcaagcccaactgctccatccagtcctatgtacccgcattgacgccgcttttgtgctaccgtccgacgttggttgtcgccaccacctatcaggcaatttccggagcgggcaagacgtttcgggagtggcctgccatgatagacaatgtcatcccctacatcggcggcgaggaggaaaaatcagagcaggagccgctccgcgtctgggggcatattgaaaacggcgtgatcgtcaaagcagatgctccgctcatcacgacccagtgtatccgcgttcccgtcaccgacgggcacactgccgccgtgttcgtgaaatttgaaaaaaagccatcccgcgaggatattctccgcgcatgggcggaattccgaggactgccgcaggaactggagcttccgcacgcccccgcgcagtttgtcacgtattttgaggaggacgaccgcccgcaggcggcgctggatcgcggactgtatggcggtatgggcgtgtcggtcggacgtctgcgtgaggacagtttctttgactacaaattcgtggggttgtcgcataacaccctgcgcggcgccgccggcggcgcggtcctgatcgccgagttgctgttccggaaaggatactttgcataa

SEQ ID NO: 337 - DNA, 1539 bp, Unknown
  Description of Unknown: Clostridiales sequence
atggcgtacccgcttcgccgcccagaacagtatgtgacggaggaaaacggcatgacaatgattgtgacaggaaaaacaagaaaagcgcgcctcctcgggttggcttgctgtgccgcggtgctggcagtgctggcgttgcttgcgggctgtaacgggacggaaagcgcgacgggaacggcaaccgcctccgacagccgcccggagaccgggacggcgccggagagcgagccgactactgtgcccgccaccgacacggatcccggcacagagaccgtgaccgcaaccgagccggagaccgaagctgaaaccgagccggaaacggtttacgacatcagcaagccggagttccgtccggagctgagcgcgtcctactgcaacgtgcgggactatggcgcaacgggcgacgggcagaccgatgacaccgatgccgtgagccgctgtctgcgtgaagcctttaagaaatccggcgtggcatacttcccggcaggcacctaccgcatcacgcagacgctgactctgcctgccgacgactcccgcgtgctccgggttatcggcgcgacgggcgcagtcctgctgggcgatgaagggcttgacggcacggttctgcaggtgaacatgaagtataatttcttcctttacaacctggatattacgcacaaggggcgcggcagctgtgtggatgccctgttcattcaggcgaagtggtgccgctttaccggctccgccgcgtccggcggggcggatgttgctgtgttccacggctccaactgccgctttacggaatgctcctttgacgtcaacgacccgaatgtttacgcgctgtcctacgtcaagacgcaggacgagatatccatcaacaaccatgttgtggacaacgtgttccgcggcatcgggaagggcgtgctggtcggcaacggcggcaccgtgggtgacggacgctgtgagggactcaaaatcaacgggaactatttctacaacaccggtgcggagcaggtgcgtgtcgccgaaatcctgcacgtcagcattgcgcacaacacgctgtacggctgtaccggcagtgccattgtgctgacgcagagaggcagcggggcggacggcgtgtatatcaacgacaaccgcatccgcatgggcgacggtgcactggcgtgcatcacaaccgtggaggacacggggcattatatctcctccgtgaatatcaacaacaacacgctgagcggcgggcagtacgggctgtatgacccgctgggaatcatccgcgcacacgtccgggagaaccgcatcagcgggcagagcgaagcgggcatattcctggagcagagtgtgaacagcggaccgtacttcttctttgataacatcgtgaccgaggcggaaggcgtggattgcttccgcattccggggcgcgggagcattgcctttgcgcgcaacgtggtgaacggaaccagcacggtttcctctcctctgcggcgccggttcgagaagggctgtgtgaccgagaagggcgacaatctgacccgtcttgccgcggcggagcaggtgtaa

SEQ ID NO: 338 - DNA, 1431 bp, Unknown
  Description of Unknown: Clostridiales sequence
atgcaggaaaaacccatccggttcggtacgggcggctggcgcgccgtcatcggttccgactttattgaaagcaacatccgccgcacggcggagggcatctgcgcgctgatgtgcgaggagggcaggacggacaagccggtcatcatcggctacgaccaccgcttcctgtccgagacggcggcgcgctggattgccgaggttctggcggcacacggggtgccggtcatgttcctgcgccgttccgcgccgaccccgctgattatgcacacggttctgcggcagggactgcattacggcattgagataaccgccagccacaacccgtcctgctacaacggcgtcaagctgattgtggaggaggggcgcgacgcgccggtcgaaacgaccgcgcggctggagcagctgattgccgccgtccgcccggaggatgtccgggatatgccctttgaggatgcggagtctgccgggctgatcctctggcagaagaaccccttcaacgcctttattgatgacattctgtccgtcatggatctgcccgccatccgggagcacggcgcgcgggtgctgttcgatcccatgttcggctccggcacctacccgctgctggttattctctgcaccgcccgctgcacggtggacatgatccacaatacgcgcgatgcgcatttcggcggcaatctgcctgcgcccaccgtcaagggactgggcgagctgcgcaaccgcgtcaccacgggcggctatgagcttggcatcgcctttgacggcgacggcgaccggctcggcatcatcgaccgcaccgggcgctacctgagtgccaacgagatactggtcatgctgtactggtacctgcacgagaagaagggctggcgcggacctgtcgtgcgcaatctggcgaccacgcatatgctggacgtcatggcggcgagcttcggcgaggtctgctacgaggtgcctgtcgggttcaagtacatttcttccaagattgatgaagtggacgcggtgctgggcggcgagtcctccggcggtctgaccgtgcgcgggcacattcacggcaaggattccgtctatgccgcctccctctttgtggaaatgatttcggttgtggagaagtccccgtccgagattatggacgcgctgaccgccgcctacggcaccttccgcatggtggaggacaacatcaccttcacgccggagcagaagtcctatgtggatcgtgtgatttttgttgagcgtcgcctgccggatttcggcaagcctgtatcgcgcgtcagctacgaggacggctgcaaggtttattttgccgacaattcctttgttatctgccggttctccggcaccgagcctcttcttcgtatttttgccgaggcgtccgatgaagctaccgcgcgcggttttgtcactgctttccgcgagctgctggcgctggagtga

SEQ ID NO: 339 - DNA, 1032 bp, Unknown
  Description of Unknown: Clostridiales sequence
gtgattgactgcccgcttgcaagtgttatcctgcccgcatacaacgccgccccttacctgccccgctgtctggacagcctgctggcgcagacggcggacagcttcgagctgatcgtgattgacgacggttcaacagacgggacgggggatatttgtgatgcgtgggcggcacgcgacgcccgcatccgcgtgatccatacagagaaccggggcgtttccgccgcccgaaaccggggacttgccgaagcgaccggggagtttatcctgttctgcgatgcggacgacacggtcgcaccggactggatccgtaagctgtgcgaccggggggcatccgattcggcggacatggcggtgtgcggcgtgacgttgcgttaccctaccccgaccctgccgcgcgatgtgccgaccgactggagcggcatcgagggcggggctatgcctctgtccgccgtctggcgactgcaggagcgcggactgatgctgacgccctgcaacaagagcttccgccgcgccgttctggaagcgcacggattgcgctttgacgagtcgcttgcctactgtgaggacgagcagttcatactgcgctacctgttgcacgcagagcatgggttccgcgttgtgcgcgaggatctctacacatatgaaaaagagcacgccggcagtctgacccgccggtatgtgccggggctgtgggatacgatcgaggcgtcgcgccgcctgcgcgagcaggtattcgcccacgtacacctggacacggactcgatccgggcgtcctactgctccttcctcaactggcgcgttcagcaggcactctccaacctgtccgctccggactgtccgctgtcgcatcgggagcgggcagccgaaatgcggcgtatcctgcgcagcgacacctgccgggaggcgtttcgtgacgggcagttcggcgatacgccgggatggtatatccgggtgctgaaaacccgttcggcagtgcttctgcgcgcggtaaaccgcctgcgccggctcaggaacgggggcgtcgcgggatga

SEQ ID NO: 340 - DNA, 1872 bp, Unknown
  Description of Unknown: Clostridiales sequence
atgaatacaacgcagatagcggtgatcggcgccggtcacgccggcatcgaggcggcactggcggcggcaagaatgggcgtggaaacagtcctgtgtacaatgtcgctcgacgcagtggcaaatatgccctgtaacccatccataggaggaaccgcaaagggacacctcgtgtatgagatagacgcactcggcggagaaatgggacgtgccgcagatctcgtcaccttgcagagccgcacactcaatacgggaaagggcgccgccgtgcagtccaaacgcatccaggcggacagactgcgctaccatgccctcatgaaacataccctcgaaacacagaaaaacctgcggcttttgcaggcagaggtcgtggacatatatgaaaaaaccgttgacggaaaagcaaaaatcacaggcttccgcacaagactcggcgaggagtggtcgtgcggatgcatcatcctcgccaccggaacctacctctgcgggaaggtgttcgtcggcgatgcatcctacccctccggaccggacgggttcctgcccgcagagggactgtccgacgcgctccgccgcatgggcatccgcctgatgcgcttcaaaaccggcacgcccgcccgcatccggcggcagtccatccggctggatgagctggaggaacagcccggcgagacgcacatcgtgccctactccgcccgcaccgatcccgacgccttccacgatcttgaccagatcccctgccatatcgtctataccaacgccgaaacccaccgcattattcgggaaaatatccaccgatccgccatgtattccggcaaaatccacggcaccggaccccgttactgcccctccattgaggataaaatcgtccgctttgccgataaggagcgccaccagctgttcgtcgagccgctgggacgtgacaccgaggaaatgtacctccagggcttctccacctccctcccgaccgacgtccagcaggatatggtgcattccctgcccggcttttcggacgccgagatcatgcgctacgcctacgccatcgagtacgactgcgccgaccccctgcagctcttccctacccttgccttcaagcagcatgacggcttgtacggcgccggacagttcaacggcacctccggctacgaggaagccgcggcgcagggacttgtggctggcatcaacgcggcgctgtctgtgctcggcaaaccgcccctgatcctcccgcgctccggcagctatatcggcaccctgattgatgaccttgtcacgcgcggcaccaatgagccgtaccgcatgatgaccagccgttcggaattccgccttctcctgcgtcaggataacgccgacctgcgcctgacgccgaccggctacgcctgcggcttgatcccggaggagcgctaccgcgcctttctccgtaagcgggagcaggagcagtccgagaaggcgcgcctggaagccaccttcctctcgcccgaaaaagtcaatcccctgctgacttcctggggcatggatcccgtcgcgtccggcgtctcgctcgccgaccttctgcgtcgccccggcgtgacctatgcggctcttgccccccttgatcccgcccgcccttcccttcccctcgcggtctgccataccgtcgaaaccgacgtcaagtacgccggctatatccgccgcgaacttgccgaagtcgaccgccagaaaaaacttgaaagtaaatccctcccccccgacctcccctactcctccatccgcggcctccgccttgaagccgctcaaaaactcgccgcccataaacccctcaccgtcggacaagcctcccgcatcagcggcgtcagccccgccgacatctctgtcctccttctgtatctcgggctacgatag

SEQ ID NO: 341 - DNA, 1323 bp, Unknown
  Description of Unknown: Clostridiales sequence
ctgccgctccgccggctgggagcctcggagcaccctgcaaaaacacagacacagaaaggaaaacaagccatgagcaacctaccgtgcgaaaaaaagccatcctttcgctaccccatcggtttctggaactacccctccgttcaggtaacgccggtttcgcaggtcgaaagctggaagcgtgccggcatcacctgcaaccagacgccctttttctcctatggcagtcatgatcctgccgacatggtcgccatgctggacgaaatgcatcgggcgggcatgcgggcgttcgtctgcgtgagtgatctggattttcaccggttcctgcaggatccggaggcgttccgcccggtatttgcgcgcgcctatgccgatttcgggcggcatccggcgacctacggctttttcatcggcgatgagccgctgaacgggcaggaattttccgcctgcgtccgcgcctatcagatcatgcgcgagattgcacccgagctgaccccgctgctcaacttcaacccgtactgggaaggcatggagaatgacctgctgggcggggaggcattcgatgcgtggatcgaccgattcgtccgggaatcgggctgtcccctcatctgctacgactgttacagccagatgaaccccggcgacgagggaatcaatatgtatttccgtaacctgaaccggtatgtcggcgccgcggagcgcaatggcgtgatggtgtggaacacgctgctctcctgcgggcatttccgctaccgtgtcccggacgaggacgacatccgctggcagctgtccacaacggtggcgagcgggtgcgacggcatcctttggttcctttggtacgggcagaatctgaccaataactatcggggtgcgccgatcgacgagctgggcgaggaatccgccacctacgccgccatacggcgcgtccagctgctgttccaccgccgctacggcacgctgatgaaccgcctccgccatgaaaagacctatcacttctgcaaggcatacggcgggtatccgctgtactccacctacgacctgccccacctgcgcaaggcggtcagtgaccacggtctgccgggcatcgtcagcagttttaccgatgaggaaggcaaccgctacctcgtgctggtcaacaacagcccgcgcgagtcgggactgttctggctgatctttgacggcggcgtcaggcaggtgcaccgctactgggatcggaacggcgagatgtgtgacatggatttcattgcctcccaccacgacgcgaactatggtgacgacggcaatacggcgcggatcgggctgtggctggcgccggggcagatggaa

SEQ ID NO: 342 - DNA, 1110 bp, Unknown
  Description of Unknown: Clostridiales sequence
gtgtgcgggatccggaaggaggagcagaccgtgcgccatgagatcgaagtgagcgaattctctgccgtcatacaggagttcgccgcatataaatcagccattcagggctgttcgcaacgcacggtggaggagtacctgctcgacctgcgcacatttttccggtacctgctttgccgggaggacgccgaggtgctgaatgaccccgagcgctttgccaccgtcagtgtcctgccggtggatctggaatacctgcgcacggtcacggcggatcagatatacgccttcctgatctacgccgactcggtgcgcgaaaaccgttcctctgccaaggcacgcaagctgtcctccatcaaggcactgttcaagtatctggtcaacaagcgcggctaccttaccgtcaaccctgctgccaatatcgattcccccaaaaagaaaaaggcacttcccaagtacctgacgctggaggaatccgtcacgctgctcgaaaccgttgccgcagaccgcgattcgccccatcgggtgcgtgattatgccatcctgacactgtttctcaactgcggaatgcgtgtaggcgagctggtcagcatcaatctgcaggatattgatccgcagttgcgctcgttgcgcgtggtgggtaagggcaacaaggagcgcgtcatttacctcaacgatgcctgcgtcgccgccctgactgcccaccttgccgagcggctggatccggcaaacggaaaggtgacggacagggcgctgttcctcagcaaccggggcacgcgcttcagcgacaagggggtacagcatatggtgtacaagtacctcgccgccgcaggactgggagcgcggcggctgtcggtgcataagctgcgccataccgccgctacgctgatgtaccagtccggcgcggtggatatccgggtgctcaaggacatcctggggcacgagcaactcaacaccacgcagatatatacccacctgaccagccggagcatggaggaagccatgcggcataacccgcttgcggggatgatgccggcatcccctgcatccggcgcggcgcaacagccggacgagcccgacgcagatgccgccgatccgtccgaccgaaaggagtga

SEQ ID NO: 343 - DNA, 1545 bp, Unknown
  Description of Unknown: Clostridiales sequence
ttgcctgctaaagtatcgctgcacagaatcattctgacaaaattcaaggaatccctcttttccgtcacgccggtggttgcgctggtgtgcatcctgtacctgacgccgctggtcagtctgaccgcacgggaactgaccgttttcctgctgtcctccgtggtgctgatcatcgggatgacgctgttcaatcttggcgcggatatggcaatgactccgatgggcgagcatatcggcgcgggactgacccgctcgcgcaaaatcacggcactgctgaccgtctgcttcctcatgggcgtcttcatcacggtggcggagccggatctgcaggtgctggcatcgcagatagccggagtcgtcagcagtacgatgctgattgttacggtcggcttcggcgttgggctgttcctgctgatggcggtgctgaaaatgctgtttcataagtcgctgtcctccatgctcatgttcttctacatgacgctctttgccctgactgcgctggtggtggtcaacggcaatgtggattttcttcccatggcgtttgattccggcggtgtgacgacgggacccattacggtgccctttatcatggcactgggcgtcggtatcgccgcgacgctgggcggacgcgacgtaggggagaacagcttcggtctggtggcgctttgctccatcggtcccatcctggcggttctgcttttgggtatcacggcggacagcggtaaggtcaatatccagccgtcctacgatctggcggacgatttcggcgtggcgctggggcgctcgctcctgacgacgtcgggtgaggttttgcttgcgctggggcttatcgtgctgtttttcctgattctacaggtcacgtgcctgaagctccccgtccgtaaggtggggcagatcgggatcggtatcctgtacacctttgcaggactcgtgctgttcctgtcggtcgtaaatgtcgggtatatgccgatcgggtacaagctgggaaccgaactggcgtccagccacccggttgcgctggtcgtgttcagctttatcctcggcatggtggtcgtgctggcagagccggctgtccatgtgctgaataagcaggtcgaggacatcacagccggacacgtcagcaagagatccatgatgatcgcgctgagcgtcggtgtcgggatttccatcggtttgtccatgctgcgtatcctgctcgacttcagcattctgtactacgtcattcccggttacctcatctcgctgggactgtccttctttgttcccggtctgtataccgccatcgcctttgattcgggcggtgttgccagcggaccgctgacctccagctttattctgccttttgccgtaggcgcctgcatggtggcacaggggcagtcacatattctgagcgatgccttcggcgtggtggctatggtggctatgactccgcttatcaccattcagctgcttggcttccgctccgtcgtgacccgtcgcgtgcgggcaaagattgccatgcggcgcatcctgctggcggacgacgagcagatcattgatttcatgtaa

SEQ ID NO: 344 - DNA, 1431 bp, Unknown
  Description of Unknown: Clostridiales sequence
tccgtaaacgcgcggcgagaggaggtcacgctcatgtcattggaatccaccttgaaatactgccagctgccgccggacgcagaggaaaaaaccgagagcgagttccgcgatctgctggactcgtgccgcaccgcctacacaatccccgccgccgcatttgacagctacaaggtcaagcgcggactacgcgagccggacggaaccggcgtgaccgccggcgtgacccgcatcggcaatgcgcacggctatgtggtcaacgagggcgaaaagtgcccggttgacggcgtgctggaataccgcgggtacaatatatgcgacctgctggaaagctgcatcgcggagggacgcttcgggtttgaggagtgcgccttcctgctgttcatggggcacctgcccacgcgctgggagttgcaggaatttgccgatgtgctggcaatgctgcgccatctgccgccccgcttcaccgaggatatcatcatgaaagcgccgtcgcgttccatcatgaataagctggaggttgcagtcctgtcgctgtatgcctacgacgacaatccggacgatacctcactggaaaatatgatgcggcaatccatggagctggtggcgcgcctgcccgtcattgcagggcaggcatacgctgtctaccgcaacactttcttcaacaaatcgctgaacctgcataatccgcgcgacgggctgtccacggcggagaatttcctgcgcatcctgcgccccgacaagagctacacgccggaggaggcgcatctgctggatctgtgcctcatcatccacgccgagcacggcggtggaaacgcctccacctttgccacgcgtgtgctgtcctccaccggaaccgacacctattccgctattgcggcagggatcggcgcgctgaagggtcccctgcacggcggcgcgaacatcaaggtgcaggagatgttcgactgcgtgaaagcaaacgtccgcgacccgcacaacgacgacgagctgtccgacttcctgcttcgcatcctgaagggcaaggcaaacgacggatccgggctgatctacggcatggggcacgcggtctataccaagtccgatccccgcgctgtcatgctcaagcgttacgcgcgccagctggcacaggacaaaggctacggcgaggatttcgagctgttggaatccatagagcgtctgacgccggaggttttcaacacgtacaagggcaagcatcacgatatctgcgccaatgtcgatctctactccggtctggtataccggatgctgggcatcccgaccgagatgtacacgccgctcttcaccattgcccgcacggcaggctggtgtgcgcaccgcatggaggaaatcctgtcctccggcaagattatgcgccccggctacaagtgcatcgagcgggaacgtccctacacggagctgacccggcgctga

SEQ ID NO: 345 - DNA, 1041 bp, Unknown
  Description of Unknown: Clostridiales sequence
atgagacactacctgctccccgaaggtgggaacttctacaaggcaaacctgcatacacacagcatctactcggacggcgcccgcacggtggaggagatcaagcgcgactacatggcgcacggctactcggtcgtcgcgtttaccgaccatgatatcatgctggatcactcggatcttaacgaaccggaaaaattcctcgcactgacctcctatgaggtcgagacaaatcccgagccggacggtaagccgtggaataccatgccgacctaccacctgaatttttacgccagccgcccggatgagacctgctatccctgcggcaatcctgcgtataccttcggcaacgcgccgaagtatgtgcaggactactaccggggcgactacgtgcgccgttactcggtggaggggcagaatgaaatgatccgggaagcgctggatcacggctttctggtcagctataatcatcccgcatggtcgctccagcactacccggattacgccggactggagggcgtgaccgctgtggaagtgtacaataccgggagtattctggaaggctacttgctggacggcgatgagcaggtgctggatgatttcctgtacctcggaaaacgtgcctatcccgtcgcgggcgacgactcgcacagcattgccgactgctgcggcggttgggtgcagttccgggcacccgcactgacctacggtgatatcatgcacgcatttgccgtcggggacttttatgcctcgtggggacccgaaattacggcgctgtacatcgaggacggcatcctgcacgtagactgcacggataccgtagcggtgtacctgcgtaccgatatccgcctctccggcaacacgacggcgcctgccggtgagatgctatcccactgcacctttgacctgcgcggctggctggagcaatcgcggacgttaggctgtgaggagcgtgcctttttccgcctgacgctggtcggaccgacgggcgccaaggcgctgacgcgcggttactttgccgatgaactgtccggtatgacattctga

SEQ ID NO: 346 - DNA, 1644 bp, Unknown
  Description of Unknown: Clostridiales sequence
atgacgatcggtgaaaaaatagcaaacctgcgctctgcggcgcatatttcacaggaacagctggcagaggagctttccgtttcccgccagtcggtttccaagtgggaggtcaatcagtctcttccgcagatcgaaaacatcctgacactgtgccgcctgttccgtgtcacggcggacgctcttctgcgggatgacatttcgctgttcggcgatgtcccggggcagaaatccgccatcaacgaaacgggcgccaagaacaaatacttcggcacggacggcttccggggggaagccaacgtgaccctgaccgccgaccacgcctatcgggtagggcgttttctcggctggtactacgcctcgccgctttccggcttccatatgcccaactaccgtccccgcatcctgatcggcaaggacacgcgccggtcgagttatatgctggagtatgccatcgcggcgggcctgacggcatcgggtgccgatgcgtatatgctgcacgtgaccaccacgcccagcgtttcctacgtaacgcggacggatgaattcgactgcggcatcatgatcaccgcctcgcacaatcccttctatgacaacggaatcaagctcatcaaccgctacggcgaaaagatggacgatgccacaaccgcgctggtggaggcgtacctggacggcgacgtacagcgtctggggctggacgggaacgagcttccgctggcacgccgtgaggcagtcggcagcatcgtggactatgtggcagggcgcaaccgctacgtcggctacctgatctcgctggcatcgcactcctaccgcgagatgaaaatcggactggactgtgccaacggcgcctcgtggatgattgccaaggcggtgttcgaggcactgggcgccagaacctacgtcatgggcaccgcgcccaacgggctgaatgtcaacgacggctgcggctccacgcatattgacgcgctccggaagtttgttctggagaaccatctggacgtcggctttgcctttgacggcgacgcggaccgttgcatcgcggtggacgagcgcgggcagactgtggacggcgactgcatcctgtatattctggcaacccgtctggcagcgcgcggcgcgctgagcggtaacacggtggtctgcaccgtgatgtccaactccggtctgttcaagtctctggaggcagccggcatccgcagtgaacagaccgccgtcggggatcgttttgtctacgaatgcatgcagcagaacgggtacagtctgggcggcgagcagtccggtcacatcattctccggaagtatgccacgaccggcgacgggctcctgaccgccatcatgcttgccgaggaaatgcgtgaccgcaaagccccgctctcccagcttgccgcccccgtcctgctctatccgcagaccgtgcggagcatccgggtgaccgacaagtccgccgccatgaacgatcccatcatccgtgccgaattcgatgcggtcaaccgcgagattggcggaaacgggcgtgcgctcctgcgcgccagcggcaccgagcctgtcctgcgcatcatgttggagtgcgagaccgaagcgctctgctcctccttcacggatcgcatcgcagacgtcatccgcaagcgcggctactgctgcgaataa

SEQ ID NO: 347 - DNA, 795 bp, Unknown
  Description of Unknown: Clostridiales sequence
atgaaacaggaatctgctaccgatttgcggtacacagtggcaggaatgaaaatcaaggaggagttatacatgaacaaaaaaatacttgcaaccctggtcgccggtctggcgctggtgtccgctgtcggatgtgccaagacgccgggcggaacggaaacgggcactacgtccacatatccgaccggtcccaactattccgtggagcccgcgacgctcccccaaggtccgggcggcgacagcacggctgcccctgtcgaggaaacgctggaggcgaatcctaccttctccgacatctccatgacgctgtacgtgtatgtggcaaacgggaatatccgcagcaagacagagactgtcctgacagaaggcgccatctgcggttatgtcaaggagggcgacacgctggcggcaacgggcgagagcaaggagtggtacagggtgctgtacaacgaaaagacctgctatgtgcgcaagagcattgtctgcgacaacgccttgatcgacgctttccaggacgtccgcgacgaggtcacaatctcgcagaacgttaacgtccgctccatgcccaaagccatcaagagcagtgccaacgacctgagcatccgcggcacactgttgaagggcaccaaggtaacgcgcaccggcatcggagacggctggagccgcgtcctgttctcctacacctacaccaaggacggtgcgaaagtcacggaggatcgggaatactacatcagcaatgaatgcattgccgaagctggtaccgccaccgccaccgccaccgaagcatccaagtcctga

SEQ ID NO: 348 - DNA, 936 bp, Unknown
  Description of Unknown: Clostridiales sequence
gggatttctatctgggagccgtcgggaggagctgatatggacacgcagaagctgacggttttcacgcctgcctataacagggcacatacgctgccgcgcacctatgaatccctctgccgccagagctgcaaggatttcgtttggcttattgtggacgatgggagcagtgacgggacgcatgcactggtcgaggagtggcagacgcgggataacggttttcccatccgctatatttacaaggaaaacggcggaatgcacacggcacacaacgtggcgtatgacaatatcacaaccgagttgaatacctgtattgattccgatgatgcactggcggagggcgctgtggaggtgattctctcgctgtgggagcgcgcgggcggacccacgcacccggagattgcgggaattatcgggctggatgcggatatgaatacgggaaaagtaatcgggacagcgtttccggcggacatgacaaccacaacgctggagggtttttatgcctctggcggacggggggataaaaagctggtttaccgtaccgatgtgatgcggcagatgccgccctacccggtgttcccgggggagaagtacatctcgctgggctacaagtaccagctttgcgaccagctgtaccgtctgctgacaatcaaccgcgtgctgtgtgacgtcgagtatcagccggacggttcatcccattccatgttccggcagtatctccagaacccgcgcgggtttgcgtttatccgggtgcagaacatgaagttcaacaagtctttccgccggaacgcaagggactgcgtgcattacgtgtccagctgcctcatcgcgcgtgaaaaacacttcgtgcgaaagtctccgaagccggttctgacgtggttttccgtgccggcgggtgtgttgctgacgctgtatatccggtggcgggcaaaacgatga

SEQ ID NO: 349 - DNA, 1698 bp, Unknown
  Description of Unknown: Clostridiales sequence
atgagcaactcctggactctgcaaagagacaccgccgtccgcgttctgcgcccggaaggtgccgtgtatgagactgccgccgcacagcttctgcactatctgaacgcactctgcggcatcaccgaggcgcggagccagtccgcacccgcgatcatcctgcggactgatccttctatgccgccggacgccttccggctggttgtgcggggcagcgacctgcaccttgtcgggcagaacggacgcggggtgttgtacgccgtgttcgcccttgcagagcgtttcggctgccgcttcttcgcccatgacaccgaggtgatcccccacccggcggagctgtctctgcctgacgggttggatgtgaccgaggcatccccgtttgcctaccgcgacctgtactggatcggcaccaccgatccgctgactgccgtcaagctgcgcatcaacggaacgggactgaaatcaggtcagcacatccgccatctgacagccgaagtcggcggcggcatcggctacgccggaccgcacttcgtgcataccttcgacctgctgctcccgcccgaaaagtatttcgccgaacaccccgaatactacgcgctgatcgacagcaaacggactgcaaagcacctgtacagtcagccctgcctgtccaaccccgatgtcctgcgcattatgatcgagggcatccgctcgtggctccgtgacaatccggaggcgcggctggtgtcggtctcgcagaatgacagcttcgtcatcggctcctactgcacctgccctgcctgccgggcggtcaacgaggaggaaggcgcgccttccggctcgctgatccgcttcgtcaacgccgttgcggaggcactggagccggaattcccggaagtcaccttcgacacgctggcgtatcagtactcgacccagccgcccaagctgacacatccccggcacaatgtcgccatccggatgtgtaccggcggttgctcctcgcacccgatccccgactgcgccaacaacgccggttcggcggatgccatccgcggctggtcgcagatatgccgtcagctgtatatctgggattataccacggactttgcccaatacctcaatccgtatccgaacttccagacgttgcaggacaacatccgcttcttccgcgaccacaacgtctgcggcgtgttcgagcagggcaactataacgaaggtctgtccggcgagttcggcgagttgcgtgcctacctgcttgccaatctgctctggaatcccgaatttgacgtagagtccggcacagagtccttcctgaacgcctactacggcggcggtgcgccatatgtacggcagtatctgaccttcatccgggacaaggtacgggatgttcatttcaacctggtcatcagcgccgccgctctctggaacgatctcatttcggacgaagagcttaccatgctggatcgcctgtgggcagatgcctaccgtgccgcgcgcgaaggcggcgatgtcccggacggcatttcctccgccctgtgcgcctcccatgtggagcgcagcgggctgtgccaccgctggttcaagctggacgccaaacggggtgaattctcctatcctgcccgctttgatgccctctgcgacctcttttaccgtgactgccaccgcctcggcgtcacccgcctgaccgaaggcgcgaacgtgccgtgggttgaggcgcagtaa

SEQ ID NO: 350 - DNA, 1062 bp, Unknown
  Description of Unknown: Clostridiales sequence
atgaaggagtccaagaacaagatcaaggttgaattcgaccgcacgcccctgaaggagcgtatgaaggcgaagttcctgaatctgtacttcttccagcaggtggcatggtatatcttccggttggttctgctgatcggtatttcgtacatcgtgctgtaccccttcttcaccaaaatcgcaggctccttcatgtccccggaggacttcgtggacgtgaccgtgcgcctgattcccaagcacttcacgctggatatctacaaagcagtcctgaccgagctgaagtatgccgaggcgttccgcaacacgttcatcatctcgatgctgtgcggcgtgctgcagacctttgtctgctgcctcatcgcctacggtcttgccaagttccgcttccgcggcaacaagctgatcatgctgctggtcatcctgaccatgattgtgcctcaccagacactgcagctctccatgttcatgcagttccggtactttgatatctggggcatcctgtcgttgctgagcgggcacgcatcgaccggtatcgcgtcactggacgcggcgctggcgaatatccacgtgctcccgatgaaggatgcgggcattaccctgaccaacacctactggccgctggtgatcctgtccatgaccggactggcgttcaagaacggactgtatatcttcatgcttcgtcagttcttcaacggcgtgccggatgctctggaggagtcggcatacatcgacggttccggcaccttccggacattcctcaccatcattctgccgctttccattcccatgatggtcacggtgttcctgttcgccttctgctggcagtggacggatgacttctatacggagatgttcttcacctccagtaagattgtcctgatgccggatatcgtggatatcccgtcctcgctgaagaccgactacgccggacagaatatgtactacgccgcaatccggaatacctgcggcctgtgtatcatcctgccgctggtcatcctgtatgccttctgccagaacttcctggtgcagggcatcgagcgctccggtctgaccgccgagtaa

SEQ ID NO: 351 - DNA, 2151 bp, Ruminococcus lactaris
atgcagaaagaatacaaaaggatcacagattgtgaacaaataaaaaaggagtgcagtaaaatggcagttaagaaaggtactttatcaatcgacagcgaaaatattttcccgattattaagaaatgggtttattcggatcatgatatttttgtccgtgagctggtgtccaacggatgtgatgcgatcaccaagctgaaaaagctggatatgatgggcgagtatgaactcccggaaggttataagccaaagattgaagtcattgtcaatccggaagagaagacgatgaaatttattgataacggacttggaatgacagcggaagaagtagaagagtatattacgcagattgcattttcaggtgcaacgcagttccttgagaagtataaagacaagacgacagaggatgatatgatcggtcatttcggacttggattctactccgcatttatggtagcagatgaagttcagattgatacactttcctataaagaaggtgcaaaaccggttcactgggcaagtgaaggtggtacagagtatgagatgcaggaaggcagcagaacgaccgttggaagtgagatcactctgtatctgaatgaagacagcctggaatttgcaaatgaataccgtgcaagagaagtgcttgagagatactgctcttttatgccggtagagatcttcctttccagagcaaatgcagaaccggagtatgataccattgatgaagctgatgtactcgatacagataccgttgttgagcatatcacagaagagccaaaggaaggcgaagagggtgagccaaagcagaaggcaaagattgtaagacgcccggtttccatcagcgatatccatccgctgtggacaaaaaatccgagtgagtgtacgaaggaagaatatattgagttctaccgcaaggtatttatggactacaaagaaccattattctggatccacttaaatatggattatccatttaatttaaagggaatcctttatttcccgaagatcaatacagagtatgaatctattgaaggaaagatcaaactgtataacaaccaggtatttattgccgataatattaaagaagtgattccggagttcctgatggtactgaaaggagtcattgattgcccggatctgccgctgaatgtatcaagaagtgcattgcagaatgatggattcgtaaataaagttgcggattatatttctaagaaagtagcagataaactcaatggcatgtttaagacagaccgtgagaattatgaaaaatactgggacgatatcagtccgttcatcaagtttggatgcctgaaagatgaaaaattcggtgagaagatgaaagattccatgctttataagaatcttgagcataagtatctgacactggaagatatcatcaaagaagccaaaggcgaggctgaggtggaagaagctgcaaaagaagaggctgcaaagaatgaagagtcaaaagcaggaaatactgaggcagaagcaaagtcagaagaggcagaatccacggatgcagatgctgaaaaagagccggagaagacaaggattttctatgtaaccgatgaggtacagcagagccagtatatcaatatgttcaaggcacagggacaggatgcgatcatcctgacgcacaatattgattctgcatttatcacttatctggagcagaagcatcaggaagttcagttcttaagaattgatgcagatgtgcatgattctctgaaagatgaagtggcagaagatgagaaagaagcattccagaagacagcagaaagtctggtggagatcttcagaaaagagcttggtaatgataagctggaagtaaaagttgaaaagctgaaagatgataaggttgcatcaatggcagttctgtcagaagagaacagaagaatgcaggagatgatgaagatgtatggcatgagcggaatggatccgtctatgtttggcagtcaggcaacgctggtactgaatgcaaatcatccactggtacagttccttgtagagcataagcggagcaagaatgtaccggtcatctgcaagcagttgtatgatcttgcaatgctggcacataagccgttaagtccggaagaaatgacagcatttgttcagagaagtaatgagattatgatgttactgacaaagtaa

SEQ ID NO: 352 - DNA, 1665 bp, Ruminococcus lactaris
atgggcagaagaaccatagtaatagagacaaggggagatatttgtatgagtgatagagataatccgcgttctctcgtagagattatgaatgatgtactgagtacggtacgtgaacattatgactccgagtatgtatattatattgaaaaagaatatgaagatattgatgtgatttatgagtggtgtgccaagcatgtgccatggcagagggataagatcaagatgctgccgaaggatcaacggccacgctggatggaacaggagattacggacaccacggaggacagctacagtgtcttcaggagactggatgagaatactgtggcaattcttgcagcagtaggggttcaccgtggaggatgcgaagtggatctgctgcggagcgttctggcgtatcttccggaggccattactttacagaagcttcagaagcagcaggagtatctgagttatcatgacaagcttacgggactatacaatagaaacagttttgtttcttatacaacggatataaatcccgatgagttaaattcattaggtgcagtatcggtagatattaacggtcttaagaattttaataaggaatttggaagagattacggagatgaagtagtgatccgtgtcggggaagtgctggaagagtatttccatactgcaaatgtatatcgtatgaccggggatgagtacctggttctggtggaaaatatcacatacgaagagtttatgaagcaggtacacggcacgtatacgaagctggataatatcagtctcggacttgcttctcttggctgtgcatgggagaagatcgacattgatgtggatgcactggttttaagtgccgagaacatgatgcgtgaagagaagaaaaagtattataagaatctgcggaagggtcatcatgaaccgatcatcaagcaggatcttctggaggatattgaggaaggcagatttatcgtatgtcttgttccgaagattgatgtggcgaccggcaatgtggcaggagcagaggcagtcgtacgctaccaccacaaggatcttggaatcatggaaccgggaagatatattaatcttctggaagagacaagactgtcccattatctggatctgtatgtttttgaggaggtctgcaagaccctgcacagatgggagctggacaatctcccgatgattccggtttctgtcaattttgcaggcacgacattaagacaggacaatctaatcgaagagatggagaagcttatagatcggtatcgtgtccgttgtgaatatctcgaagtagaggtatccgaatcttatgccgacatgaatcaggagatgctggcagagaccagcagtaagatccggaaggcgaatgtccgggtgatcctggatcatttcgggtcaaaaaattccagcttttccattctttcactgatggaatttgatggattgaagctggataaaagtgtgatttcaaatttagtcggaaaccggagaagcaggcttgttgcaaaagcggtgatcgatatctgccgtcagcttggtgccgtggtcatggcatccggtgtggagacgcaggatcaggtgaatgtactggaagaactgggatgtgattatgcacagggatcattctttaataaggcgattacgatcgagacatttgaagtaagatatttaaaagagtag

SEQ ID NO: 353 - DNA, 1785 bp, Ruminococcus lactaris
tatgtggaaagagtacaatcaatcggtttgttggaaggtaggtgcgtaagtatgaggataaaagaaaaactgatgcataaatatgctctttctccgcaaggtgcatcggatatgctcaaagcctttgtgtcagttacggtatcagatctggttttgatgattccggtttcgctgctgtattttatagtgaaagattatatggaaggaacacttcagggaaaaggtggattttatattgccggcattatcgtgacacttgccctgattgcaattacaacttatatacaatataatgcaacatttttatcaacttatgtggaaagtggtgtccggagaatcacgcttgcagaaaagctgagaaagattccgttgtcgttctttggcaaaaaagatctgtcagatttgacgagtacgatcatggcggattgtgcacagatggaaactgcgtcttctcattttattccggaactggtgggagcatgcatttctacagcaatcgttgcagtgggaatgttctttttcaactggagaatggcattggcagctctttgggtgcttccagtttcatttcttattgtaggttgttcgggaaaagttcagaaaagtctgaatcagaagcagatggaattaaaaatggcatgtgcggacgggattcaggagtgcttggaaagtgcaagggatcttcatgcatataatgcagaggatgattatatgagaggtctggatgtgaagataaaagccgtagagaagcatgctgttgttacagaacttggaacagcagtttttgtgggaagtgctcagatgatcttaaagctcggaattgccacggttgcactggttgggggaactctgctggcaaaaggggagatcagtgtgcttacattctttatgtttctgctggtcgtatccaggatttatgatccaatgcaggtatctcttcaaaatcttgcggcaatcatatcttctgaagtacagagtgcaagactggatgaaatcctgtcgcatgaggtgcaggaaggttcagaaaaaatggatcataaaggatacgatattgaattttccaacgttggtttctcttatgattcaggagaaactgtattgaaagatgtttcatttgtggcaaagcagggggaagtaactgcactgatcggaccgtccggtggaggaaagacaaccgtttcacgtctggcgtcaagattctgggacgtagatcatggaaagatcacagtaggtggaatggatatttcaaaagttgacccagagacattgatgtcactttattcgatcgtatttcaggatgttatattattcaataatacaattatggaaaatatcagaatcggaaagatggatgctacagatgaagaagtgattgcagcagcgaaacttgcacattgcgatgaatttgcggaaaaactttctgacggatggaatacaatgatcggagagaatggttcggaactttcaggcggtgagcggcagaggatttctattgcacgagcatttctgaaaaatgcaccgatcatattgctggatgaagccacggcatcattggatgcagataacgaaacgatgatccaggaatcgctgtcacgtctgattaaagataagacagttatgattattgcccacaggatgagaacagtagcggatgcagataagattgttgtactgaaagatggtgttgttgcagagagtggaagtccggccgaactggaaaagaaaaatggaatttacagtaatatggtaaagacgcagcttcttgcaactggctggagtttataa

SEQ ID NO: 354 - DNA, 1395 bp, Ruminococcus lactaris
tatcaaaaatatcattaccaggaggattttactacaatggacataaaggagaaaattcattcattatcagaggatctgctcaaaaatattgaacgtcttgttgtaatcaattcgcagctcggtacaccggctgaagggatgccgttcggtccaggaccggcaaaggccttagatgaggctctcagcatcgccagagagcttggttttaaaacggttaatcttgatcattactgcggttatgccgaaatgggggaaggagatgatatcgtcggtattgccggacatctcgacattgttcctgccggaggtgactggacttatgatccatttgcccttacccgcaagggagattatgtatatggccgtggaacgaccgatgacaaaggccctgttctcgaagcactctatgccatgaaactgcttcgggattccggtatcagactcaataaaagagttcgcctgatcatgggctgcaatgaagaaactggttcaagatgtatgcagcattataataaagtagccgaagaattatcctgtggatttacaccggatgccaatttcccctgcattcacggagaaaaaggacaggtgaccatgacagctcattccaaaaatacccggatcatctctatgaatggaggattcgtctttaatgcagtatgtgatttttgcacaacggttattcctgccgaagatggattaaaggaaaaactggaagcagcattctctgaatcaggacttatacaatatcatcttcacgaatccgatggtctcatccagatcgacgcaaagggagtatctgctcatgccagtatgcctgctcttggtgtcaatgcagccggagttacctttgcctgccttgcaaaagccgggtttgaagatgattttgtcagattttataactctcatattggaactgcctgtgatggctccggacttgacctgaaattccaggatgcttatggagatctcacattatgcaatggtattgtcaagacagaaaatggagaaatttcctgcactatcgacatccgctttcctgtcacattaagcacagagcagatctgtaccatgtgtcagaacagactggaagactcggatggatacatcgaaatccagactctgactgaaccattattcttcccaagagaatctcctttggttgaagcattatacaaagcctataccgatgtaaccggagatacagcaaatgaaccactcgtcatcggtggaggaacttacgcaaaatcgctcaaaaatatcattgcattcggtcctgaaaaaccggggatggattatcatatccacggagcagatgaatttcttcttgtcccggaaatggaagaagctgttcttatttatatggaagcaatcaaaaatctgctcgccatttaa

SEQ ID NO: 355 - DNA, 1101 bp, Ruminococcus lactaris
atgccttatagtatagagtatcagattacgaaagcaggagaattggaaatgaaatttattcatatagcagaccttcatcttggtgcagagccggatgcaggcagagcatacagtcagaaccggtcacaggaattgtgggagacactacagtcggttcttgaggtttgcgaggaagagcagacagaccttctgctgatcgcaggagacatttttcacgggcagccgcttcgcagggaattaaaagagctgaattattattttgcagagctgacgcatacaaaagtagtcttgatcgctggcaaccatgattatataagaaaggattcttattacagaacgtttcagtggaatgagaatgtaatccctttattcgggcgggaactggaatatgtggagttcccggaactgaggacggcagtgtatggtctgagttattacagcagggagatcagagagcctctgtatgaatcggcgtttgcgggaggaatccaggagtatgagattcttctcgcccatggtggagatgagaagcattgtccgttccgggtgaaaaagctggaagagtcaggatttgattatattgcactgggacatatccacagaccgcaggcactgatgaaagaccggatcatttatgcgggagcgttagaacccattgaccggaatgatgtagggccgcacggctatgtaaagggagagattacggaagccggggttcatacgcagtggattccgtgtgcaatgaggtcctatattcatctggaagttccggttaatacggaagatacaatggggagcgtgcggaaaaagattctggaggccgtgaaggactatggagcagaaaatctgtataagatcattcttacaggatatcgggacccggatctgcggtttgatacagagcgaatggaccgggacgggaatcttctggaagtgatcgatgagaccgctccgcagtatgatatggaagaattgttgcaggaaaatgaaggaaatctgctgggagagtatatccgtcggtttaaagactgcgaaaaggacagcatagaatatcaggcattgtatgagggggttgaagtactccttaagaataaggggtaa

SEQ ID NO: 356 - DNA, 1461 bp, Ruminococcus lactaris
atgttgacatataattttgaaaatatagggtcagattccctgtatgaatttttgtataaatgtatcaaaaatgacataatacaggggataatcttaagtggtgagaagctgccttccaagcgggcacttgcgaaaaatctggctataagcgtgatcacggtagagaatgcctatggtcagcttcttgcagaaggatatatttattccattcctaaaagcgggtattatgtgtcggatctgagtgggattccggtacatcagacagagtatacgtcagaaacgtatgaggcggaagagcaggggacagattcacggactgcaaaagccggggacaaagtacttctgaccggaggagaaaatgcatttattgcggattttacgagcaatcagacggagcatgctgcatttcctttttcaatctggaataagaccatgcgggcagtcatgaatgattatcaggaggaaatgatgatcaatcccccctgtggaggtgtgatggaactgcggaaaagtatttccagttatcttaaagaattttgtgccatgtatgtaagaccggaacagatcattatcggagcaggaacagagtatctgtacagtattctgatccagcttcttgggagaaatgtctgttatggagtggagaatccgggctatccaaagattgcaaaaatctaccgcagtatgggtgtaaagtatgagtatattgatctggatgaagagggaacttctgcaaagaaactggaagaaaaaaaagtagatatcatgcatatttccccatctcatcatttcccgaccggaatggtgatgccgatcagcaagaggtatgaattgcttggatgggttacgagaaaaaaggaacggtatatcatagaagatgattatgacagtgagttaagacttgcggggaaaccgattccgtctctacagagtatcgatgtatcaggcaaggtgatttatattaatacatttgcgaagacactctgttctactgtccgaatcagttatatggtacttcctgaagcactggcagagaaatattacagagaactttcattttattcctgtactgtgtctaactttgaacagtatacactggcagcatttatgaatgcaggtgcatttgagaagcatatcaacaggctgagaaactattatcagcataagcgggatctgatcttaagtacatttctcagagagcctttgggaaaatatattacgatcagtgaagaggattcaggtgtgcatttcctgatgcatgtcaatacttccatgagtgagcaggaatttcttttaaagacaagggcgaaaggaatccggctggcaacgttgtcttctttttataatgcggaacagaaagacagcagatatgaaaatacgtatgttatgaattattcctttgtggactgcgaccggttggaatatgtggcacagacgctttataagatcattcatccatag

SEQ ID NO: 357 - DNA, 1695 bp, Ruminococcus lactaris
atgactgataaggagatcattatgattagtgcaaataacgtaaccctccgcgtcgggaaaaaggcgctgtttgaagacgttaatatcaaatttacagaagggaactgctatggtatgatcggtgccaatggtgcaggaaaatctactttccttaagattctttccggtcagcttgagccgactcagggagatgtcgtgatcactccgggagagcgtctttctttcctgcagcaggatcatttcaaatatgatgaatttccggttcttgataccgttatcatgggaaatgcccgcctgtacgagattatgaaagaaaaagaagaaatctatgcaaaagaagatttcactgatgaagacggaatcaaagccagtgaactggaagctgagtttgctaccatgaacggctgggaggctgaatcggatgctgccaaccttctgaacggactcggaattgataccgaacttcactacaaatacctgaaagaactgaccggatctgaaaaggtaaaggttctgcttgcccaggcattatttggaaatcccgacatcctgcttcttgacgagccaacgaaccacctggatctcgatgccattgcatggctggaagaatttcttatcaattttgataataccgtcatcgtcgtatctcatgaccgttattttctgaataaagtatgtacacagattgcagatattgattacggtaagatccagctctatgccggaaactatgatttctggtatgaatccagccagctcctcatccgtcagatgaaagaagctaataagaaaaaagaagaaaagatcaaagaacttcaggactttatttcccggttcagtgccaatgcttccaaatccaagcaggcaacatccaggaaacgtgctcttgaaaagatccagcttgatgagatcaagccatccagccgtaaatatccatacatcgacttccgtccgaaccgtgaaattggaaatgaagtcctgaccgtagaaggactttccaagaccatcgacggagaaaaaatccttgataatatcagctttactcttggacgtgaagataaagttgcttttgtcggaggcaatgaatttgcaaagtcgatcctctttaagatcctgatcggtgaaatggaaccggatgaagggacttacaaatggggcgttacaacctctcaggcttatttcccgaaagatttcggtggagaatttgataatgattataatatcacagaatggctgactcagtattctgaagagaaagatgttacttatgtccgtggtttcctcggaagaatgcttttttcaggggaagatggagtgaaaaaggttgctgtcctttccggtggcgaaaaagttcgctgcctcctctccaaaatgatgatctcaggtgcaaatgtcctgctcctcgatgagccgaccaaccacctggacatggaatccatcactgcactcaataacggactgatcaagttcccgggagtcctgctcttcacatcccgtgaccatcagatcgtacagacgaccgcaaaccgcattatggaaatcgttccgggtggtaaacttattgataagatcacgacttacgatgaatatcttgaaagcgatgagatggcaagaaagagacagcctattcagtccagacagatgatgaagattaaaatttgtagttgttggggtgatacgcttgtaaagaaaaag

SEQ ID NO: 358 - DNA, 1665 bp, Ruminococcus lactaris
atggaatatacgattgaaaaattgctggcagaggaacaatggaagcagttaaatgtgattgagggtaaagagtcctgtaaacgaaaaattgaaggcatccgcattatagaagtaccggaaatggcaagatatctgacgggaggggaactgctcctgaccagcctgtatgtatacagagattgcagtgcggaggaattttatcagtatctgatcgcttttgaggagaagcatatcagtggaatccttttgaaagaacgggaacagatcagcgaaaaagagaagaaaatcaaattactgaaaacgtattgcgaaagtaaaaagattccattgattgaaatgccaaaaaaaatcagcttttgggaaatgatcagttttgtcatgaaccggatttttacaaaagatgttgcacggcttaggtattttaaactgacgcaggataatttcaatacactttcttttggaagagatatcacatccagtaagacgcaggatattttggaacttctcagtgacatggtggataatccagttacactttattacagtaatctcaactgctatgtgaccagtggaggggatcattcgcgtctggaattacgggaagatcttgaagagtatattccatctgtcattacgaaattttcttatatgcggcaacggaaaaaggggacaggagaaatccagtacgtaatcaagatcagtgttatggaagaggtggaagcttatctggtggtgacagagaaaaatagaaagttgtcagcaatggattgcatggcgatcgagaatgcgattattacactgcagtatggttttgttacagaatttgtgcaaaatgagattgaaaagaaatatcacagagatattgtgcataatgtactgagcgggatgcttggaaaagaagaaatggaagaagcagcaaatctgctggagatccattctgaggaatattaccgggttgtgacattttatactttccaaaaagaacggggagatatgtatacaagtgaacagttgcgggaaaccggaattattgaaggggagatcatgacactttgcccgggacagcatgtataccggaatatagatcagatcgtgatgattcaaagagtggatgaaaagcagaagcgcgaggtatatctgaataaaatggaagagatgtgtgcggcattgcagaatgcgatccgttaccgccataagacagagaagatccaggtcggaatcggaaagatggtcaaagggatctataatctgaaagattcttattatgaggcaaaaagagcgatctcctatcgggatattgcgaaagttatttctggaaatgaaaatcagacagttacactgtactcagatcttggattttttaaactccttggagatattgatgatctgaacacactaatggattatatcccggaatccttgcaacggttatacagttacaataaaccgcagcggaaagatctgattctgacgctgcaaacttaccttgataataatcaaagtctgaataagactgcacaggcattatttattcattataaaactgcaacgtacagaattgacaagattggaaaaatgacaggaatggattttaagaatccaaatgaaatgttgaatgtgagaatcgggctgattctttataaaatgttggagaaagcacgttaa

SEQ ID NO: 359 - DNA, 2016 bp, Ruminococcus lactaris
atgtacagcagaaaaggatatatggatgaaacctatgaaatactgggctatcttggatcaggaagcggtggagtcatctataaagcatatcataaacgtttgcagaaggaagttgtcttaaaaaagatcaaaaggaaaagcagagatgccaggatcaacagaaatgaagtagatattctaaaaaatctgaatcatatgtatctccctcaagtggtagatttttttgaggaaaatggtgagatctatacggcgatgagctttattccaggaagatcattgaaagaacttatggaagaaagaagacaattttcccaaagacaactgatccgttgggcgatgcaattgtgcagtgcattgaattatctgcatacccagactccaccgatcattcatggagatatcaagccggcaaatatcatggtgactccgaggggagatgtctgtctgattgattttaatgtatcatttgctgtgaatggaaatacagttttagggtatacggagggatatgcatcaccggaacagtatattattgcattggattcaagagaagggcgggagctgccgcagtatcgggtgattgatgaaaaaagtgatatttatagtacgggagcgacactttttcatctgatcacagggaaaaaagcaggaacaaaccgcacaaaggcagaagagtatctgcttaaaaaatatgtaagtgaagcttttgcagcggtgatcttaaaagcaatggatcctaagtctgaaaagagatataaaaatgcaagggaaatgtttcaggctttacagaatgtatataagaaagatgccagatacagaaaactggtgatcggtcagagagtggcaatgctcgggctggtagccggaatgggactgtcgatcattgcgatcggatatggaatccataccatgaaacttgaaaaagtaaatcggtataatgaaattgtaaagcaacagacggaatatagaaaatcaggagaatacgaaaaagaggaagcacagtatcaaaaagcaattaatctgcttccggctaaagaagaaagttattatcagaatgcctgtgcattgtatgaacagaaagaatatcaggattgtattgattttattgactatgatatatttcagaatgaaaaagtagatctttcagatgaccgaattgcagatttgtattatctgaaagcggaaagctgctttgaactggaagattatggagaggcagtaaaagcatttaagaaagtattccaacatggtggacaaaaaagtgagttttaccgtgattacgccattgcacttgcttataatgatgaactggataaggcaaaagaggtgttggatcatgcagaagattatcaaatagcagatgattcgcttctttatgcgagaggagaaatagaaaagtcttctggaaatacagctaaggcagaggaagcttttagggattgcatttcaaaaagtgaaaatgaggaacttatcatgcgttcctatgtcatgctgagtgaactggcaaaagatagtggtaatctgagtgaggaacgaaatgttctgcaggaggcaaaagaagtacttcctgtatccagacagatggtgattctggaacgactgatacaggttgatattgatttagcagatgcaggaaagacaagttacagaaatgaagcgattgaattgctgcaggaagtgatcgatcagggctgggatacgtatgagacatacaataatcttgtcattctcaatgaaaagcagggcaatctaacggaggcacaaaatgcgttagatacaatgaaagaacagttcggagatgattataatattgaaaagagagcagcatttctggaaatagacaaacaggaacagaaagcaaataagaatcgtgattacactgcttttgcagaatattatgaaaaagcagaaaaaatgtattatgaacagttgaaaaataatgatacagatgcggaaatggatctgcttgagaatgtatatcagcaggtaagaagtggagggtggatagaagaatga

SEQ ID NO: 360 - DNA, 1299 bp, Ruminococcus lactaris
atggattatttagaaattgaaaaagtgattggaagagagattattgattcaagaggaaacccgacagtagaggcagaggtacatcttgcagatggaactgttggatttggtgcagcaccgagtggagcatcaacgggagaatttgaggctcttgaattgagagacggagataaagcccgttttggaggcaaaggtgtttctaaggcagtggagaacattaatacaattatcaatgatgcacttcagggaatggatgcaagtgatgtctatgcagttgacaaggccatgatccaggcagatggaacaaaggataaatcaaagctgggagcaaatgcaatccttgctgtatcgattgcaagtgcgagagcagcagccacatccctggatattccgctgtaccgtttccttggcggagtcaatggtaacagacttccggttccgatgatgaacattgtaaatggtggatgccatgcattatcttcaggactggatgttcaggagtttatgatcatgccggttggagctccttcatttaaagaatgcctgagatggtgtgcagaagtgttccatgcacttgcaggtatcctgaaagagcgtggacttgcaacgtcagtaggagatgaaggtggatttgcaccggcactgaagtctgatgaagaagcgatcgagacgattctcgaggcagtgaaaaaggcaggatacgagcctggaaaagattttaaaattgccatggatgcagcatcttctgaatggaagacaggcaaggttggcgaatataaacttccaaaagcaggaactgtgtatacatctgaacagttgatcgaacactggaagagtcttgtagagaaatatccgatcatttccatcgaggatgcactggatgaggaagactgggaaggctggaagaaactgacagcagagctgggagacaaagtacagcttgtcggtgatgacttattcgttacaaatacagagcgtcttgcaaaaggaattgagcttggatgtggtaattctatcctgatcaaattaaatcagatcggttctgtatctgagacactggaggcaattaagatggcacataaggcaggatatacagcaatcgcatcccaccgttccggtgagacagaagatacaacgatcgcagatcttgcagttgcactgaacacctgccagatcaagaccggtgcaccgagccgttccgagcgtgtagcgaaatataatcagcttttaagaattgaggaagaactcggagcaagtgcagtatatccgggaatcaaggcatttaatgtacagcagtaa

SEQ ID NO: 361 - DNA, 2715 bp, Ruminococcus lactaris
atgagcggacaggaaagaaatacaggaaaaagagtactcaatgttggcctgctggctcatgtagatgcaggaaagacgaccctttcggaaagtattctttatcaaagtggtgcaatacgaaatttaggcagggttgatcatcaggatgcttttctggatacagatgaaatggaacgggaacgtggaatcacgattttttccaagcaggcggtgcttacctggaaagatacggagatcacattgctggatacaccgggacacgttgatttttcagcggagatggagcgggtactgcaggtgctggactgtgcggtgctggtgatcagcggggcagacggtgtgcagggacatacggagactttgtggaaacttttaacaagatacggaataccggtgttcctttttgtgaataaaatggatcaggaagggacggactgtggaaaacttcttgcagaactgaaatcccggttttcagaaggatgtattgatttcggcagagtggaaaccggagcagaagaagtgatcgaagagattgcagtgtgtgatgaacagacgatggaagaatatcttgagaaaggcagtgtcgctgctgcctcgatccgccggctggtcgcagaaagaaagatttttccatgctattttggttcggcgttacatttgcagggggtggaagaactgatgaacgggatctgcacatatcagatgcagaaagaatatccggcagcattcggagcgaaggtttataagattgcgagagacggtcaggaaaatagactgacttacctgaaagtgaccggcggcacgctgaaggtgaaggatgtgatcagtgaaaatggtgataaggtgaatcagatccgtgtatattccggtgaaaagtatgagcttctttcggaggcagatgcgggaaaagtctgtgcagtgaccggtttggcggaaacatatccggggcagggacttggagcagaaaaagattctgagctgccgatccttgagccggtgctgacgtacaggatcattttgccggatgactgtaatgttcatacgatgttaagagatctgaagcttttggaggaagaagagccggaactgcatgtcgtatggatcgaaaagagtcaggagattcatgtgcaactgatgggcgatgtgcagattgaaatccttcagagaatcataaaagaacgctttggagtactggttgagttcggggaaggcagcattgtctataaagagacgatcgcggcaccggtggaaggtgttgggcattttgaaccgttacgccattatgcagaggtacatctgcggttagaaccgggagaacgcggatcaggaatgcagtttgattcagaatgcagtgaggatgtgttggatcggaactggcagcggctggtgctgacccatctggaggaaaaggaacataaaggagttctgacgggatcggttattacagatatgaagatcacattgacttcaggaaaagcccatctgaagcatacggagggaggggatttccgacaggcaacttaccgggctgtgcggcagggactgaaaaaagcagaaagcgtactgcttgaaccgtattatgagttcaggatcgaattaccttctgaaaatgtgggacgtgccatgacggatatacagaaccgtttcggaaaatttgaggcaccggaaacgttgggagaaatgactgtgctgacgggaattgcaccggtatcgactttaagcggttatcagaaagaagtcattgcatatacaggtggaagaggaagaatttctctgaccctgaaggggtatgatctctgccataatcaggaagaagttgtagcagcgagagggtatgattcagagctggatcttgcgaatcctaccggttcggtcttttgtgcccatggtgcaggatttgttgtagactgggatgaagtcgaagaatatatgcacatggaacgcacactggatcagacaggagaagaaggacttgcggaagtcacacttccgaagcggcggcattccagtattgaactgacacaggaggaactggatgcaatttatgtaagaactcctgatccggtgaagcagaatcatggtccggtgacagtctgtgcaaaggaaaaggacagagaaccgggcagtgcctatacagatccgaaatgggaaagacgcagacgggaaaaggaaggccgacaggaatatcttctggtggatggatacaatattattttctcatgggaggaactaagagagctgtccgaaaaggatattggtgcggcacgcgggaaacttgcggatatcttaagcaactatcagggatacagaaaatgtacgctgatccttgtgtatgatgcatataaagttgaaggcaatccgggtgaagtgatgaaatatcataatatttatattgtctataccaaagaggcggaaacggcagaccagtatatcgaaaagactgtaagacggatcgcaaaggatgctgctgtaactgtggcaacttcagacggactggagcaggtgatcatcttaggacagggtgcgaaccggatgtctgctccgggactgaaagaggaaattgagaggacgctggcagaagtcagaggtgagcatcttggaaagaaaggcagtgtcggaaattatctttttgattatctggatgaagagactgcagaggagatggaaaaagtccgactggggaaagcaggaaagaatggacgggataaaaaatga

SEQ ID NO: 362 - DNA, 1677 bp, Ruminococcus lactaris
atggaagagtctgtatgcagagtgaccttagggaatattacgaaagaatataagaaaggtacgacatattccgagatagccagagagttccagcctgattatgaacatcagatcgtcctggcaatggtcgatggttatcatcttcgggagttacggaagacagttgaaaaggattgcgagattcattttcttacaacggcagatcctattggaaatgacacatatcgaagaagtctgtgtttccttttcattaaagcattccatgatatttccgggcatgatctgaaacaccgggtaaggatcagggtacattttacgatgggtcccggattttattgtacggttgacaaaaaagaaaagccggatgagacatttcttgcaaaggtagaggcgaggatgcgggaacttgcaaaaatggcaatcccaatccaaaagcgttgcattgatactggagaagctgtggagctgttccataagtatggaatgtatgacaaggaaaggctttttgcgtaccggagggtttcaaaggtaaatctgtacagtatcaatgaatttgaagactacttttatggatatatggttcctgatacaggttatctgaaatattttgcattatatccatacgaggatggtgtagtgatccagatgccttccaaagaagatccggaaactgttcctccgtttgaaccatataataagttattccaggtacggcatgaagcaatacgctggggagatctgcaggagatcgatacagttggtgctttaaatgacaggattactacatcggatatgaaagaagtagtgctggtacaggaggcacatcaggagcgggagatcggagaaattgcaaagaagatcgcttcccggaagaatgtgaagtttgtcctgatcgcaggtccttcatcctcgggaaagaccacgttttctcatcggttgtcgattcagttaaaggtgaacggattaagaccacacccgattgccgtagataattattttgtggacagagagcatacgccgaaggatgcagagggaaattatgattttgaaagtctgcaggcaatcgacattgaaaagttcaatgcggatatggatgctctgctccggggagaggaagtatatcttccaatctttgattttaagaccgggaaaaggcaatacagttccagacctaaaaagttggaagagaatgatctgctggtgattgaggggattcattgcctgaatcctgaactcacaaggaatctgtgtgatgagaataaattcaagatatacatcagtgcattgactcaattgaatattgatgagcataaccggattccatcaacagatggtcgtctgatccgcagactggtgcgtgatgcgagaacgcgaggagcctcagcaacgaggacaatatccatgtggccttcagtacgtcgtggagaagaaaaaaatatcttcccttatcaggaagaggcagatgttatgttcaattcctccttaagctatgaacttgcagtccttaagcaatatgtagaaccgcttctttttgcagtagataaaaattcggaggaatatctggaagcaaagcgactgctgaaattttttgattattttgtgggaatcggaagcgaatgtgtaccgactaattccctgctgagggaatttatcgggggcggatgctttcaggtgtaa

SEQ ID NO: 363 - DNA, 1407 bp, Ruminococcus lactaris
aggagttttaatggtatggaactgacaacaattcgtgagttatttaagaacagagaagaatatctggacaagcaggtgacagttgggggctggatccgaagtattcgtgattctaagacatttggatttatcgtgttaaatgatggatcttattttgagacgcttcaggtagtatatcacgataagatggagaattttgcagagatctccaaattaaatgtaggttcagcagtagttgtaaagggaacgctcgtagcgacaccgcaggcaaagcagccgttcgagatccaggcagatgaagttgtagtggagggtgcaagtgccccggattatccgcttcagaagaagcgtcatagttttgagtatctgagaacgatctcccatctgcgtccgcgaacgaatacatttcaggctgtattcagagtccgctcactcgcagcgtatgcgatccataagtttttccaggagagaggctttgtatatgtgcatactccgctgatcacaggaagtgactgtgaaggtgcgggagagatgttccgtgtgaccacgatggatatggagaatcttccgaagaatgaagatggaacagtagactatacacaggatttctttggaaaagagacaagccttactgtaagtggacagctcaatggcgagacttatgcacaggcattccgcagcatctatacatttggaccgacattccgtgccgaaaattccaatacgacaagacatgcggctgagttctggatgatcgagccggagattgcatttgcagatctggaagatgatatggagctggcagaggccatgctgaaatatgtcatcaactatgtgcttgagaatgcaccggaagagatgaacttctttaattcctttgtagataaaggacttttggacagacttcataatgtagtaaattctgactttgcacgtgtgacttatacagaagcaatcgagattcttgagaaaaataatgacaagtttgactataaggtttcatggggatgcgatcttcagacagagcatgagcgttatctgacggaagagatttataagaagccggtctttgtaacggattatccgaaggagattaaagcgttctatatgaaactgaatggggacggaaagacggttgccgctgttgactgtcttgttccgggaatcggtgagatcattggaggaagtcagagagaggatgactatgaaaagcttcttgcaagaatgcaggagctgggtctgaaagaggaagattatggtttctaccttgatctcagaaaatatggttctacaagacatgcaggtttcggacttggatttgagcgttgcgtaatgtatctgacaggaatgtcgaatatccgtgacgtgatcccgttcccgagaactgtaaataactgtgaactgtaa

SEQ ID NO: 364 - DNA, 1293 bp, Ruminococcus lactaris
atgcggacaaatgaactgatgctgtataagaacatggaatatggtgagattctgaaagatattacctttctgatcgaccattatgaaagtgagtattacaacagggaagacttaagagcattgttatttgattgtatcaatgaactgctggaactgtcagtaagtcatggatttgagggaaatctctggcatacttatcttacctttcttcttgccagtgatgagaatgcatacagcacatcctgtgagattgtgggagaagtaaaaggaagtatcaatgagattgcattgcatgattttaaaatatttaaggaattatttgactatgatttcagtgcgatggaaaaaagtctggatgcagaatgtctgcaggtcattctggattatcagaaatgtaatgtcggtgggaaggtttttaaccgcaggatacgggatcggatctgcactttgagctgcgaccttggtacagcacaggatgaaaaagagtttaaagtgatcctgacacagttctacaaagaatttggtgtaggtaaactgggtctgcacaaggcattccgggtggagcatccggagcatgaagaagttcagatcgtgccgatcacgaatattgcacatgtgcatctggatgatcttgttggatatgaaaatgcaaaaaagaagctgatcgataatacaaaagcatttgtggaagggaaaaaagcaaataactgtcttttgttcggagatgcgggaacaggaaagtcctcttcaattaaggcaatcctgaaccagtattatgatcagggactgcgtatgatcgaagtgtataagcatcagtttcaggatctgaatgatgttattgctcagatcaagaacagaaactacaagtttattatttatatggatgacctttcttttgaggagtttgagattgaatataaatatctgaaagctgtgatcgagggaggccttgaaaaaaagccggaaaatgtactgatctatgcgacttccaaccgtcgtcatctgattcgcgagacatttaaagacaagcaggatcgggatgaagacatgcatacaaatgatacggtacaggaaaagctgtcactggtagcaagattcggagtaacgatttatttcggttcaccggataaaaaagcatttcaggagattgtaaggacgctcgccattaaaaatggaatcagtctgccggaagaggaacttcttctggaagcaaataaatgggagttatctcatggaggactttcaggaagaacagctcagcagtttattgattatctgtccggacaggagtga

SEQ ID NO: 365 - DNA, 2013 bp, Ruminococcus lactaris
atgaaatataaggagtgtacgactatggaaaactggaaaaaatacgaaaagacttattttatgccgccagagccatgttatgactgggtaaaaaaagattctattgataaagcaccgatctggtgcagtgtggatctgcgggatggaaaccaggcactgatcgaaccaatgagcctggatgaaaaactggagtttttccagctcctcgtagatgttggatttaaaatgatcgaggtaggatttcctgcagcatctgagacagagtatcagtttcttagaacattgatcgagcagaatatgattcctgatgacgttacgattcaggttctgactcaggcaagagaacatatcatcaaaaaaacttttgaagctgtaaagggtgctccacatgcgatcatccatgtatacaattcaacttctgtagcacagcgtgaacaggtattccgcaaagataaagagcaaattaagcagattgccattgatggagctacattattaaagaagcttgccgaggaaacagaaggaaacttcactttccagtacagtccggaaagtttccagggaacagaagttgactatgcattggatgtctgcaacgctgtccttgatatatggcagccaactgctgacaacaaagcgatcatcaatcttcctacaacggtagaaaatgcaatgccgcatgtatttgccagtcaggtagagtatttcaacaaacatttattacaccgcgaaaacgtaatcctttcccttcatccacataatgacagaggatcaggtgtatcagatgcagaacttggaatccttgccggagcagataagattgagggaacattgtttggaaacggtgagagaaccggaaacgtagatatcattactcttgccatgaacatgttctcacagggagtaaatccaaatcttgatttttccaatatgagtgagatctgcgaagtatatgagcgtgttacaagaatgaaagtttctcctcgtcagccatatgcaggtgaccttgtatttactgcgttctcaggttcccatcaggatgcgattgcaaagggcatggcatggagagaagaacatgactgcaagacatggacagttccatatcttccgattgacccacaggatgttggaagaagatatgattcggatgttatccgtatcaacagccagtcaggaaaaggtggcgtaaactatattctgaagcagagctttggtatcagcctgccggagaagatgagagaagaagtcggatacatggtaaaagatgtttctgacaaggctcatcaggaactgacaccggatgttgtatatcgtatttttgaggatcattatatcagtgcaaaaccaatcttcagtgtggacgaatgccactttaagcaggaagatggtatcgtagcagaagcaacgatccatcagaatgacaataaccacaagatcacaggtgttggaaacggacgcctggatgcagtaagcaatgcgatcaagcattactttggcatcagttacgaacttgctttttatgaagaacattctcttacaaaaggatcttcttcccgtgcagttgcttacgttggtgttatctgtaataaaaagaaatactggggagtcggaattgatgccgacattattaaagcatccatccaggctctggtagtcgccgtaaataaattgccggaaattgccgaatcccagtcctgcaaagatgaaagacttttagaaatcaccaactacatctacgcaaattataaagatgtgactttggatgacctttcagaaaagtttttcctttccaaaccgtatctctctaaatatattaaagagaaatccggactgactttcggggatattcttaagcaggtcagaatgaaaaaggcacgtgcaatgctcaagagcagcagtgctactgtagaaagcatcgcagaatctgtcggatatcagaatgtagaacattttaaccggatctttaagaagatgtacaatatcacgccggttcagtatcggaacagacattaa

SEQ ID NO: 366 - DNA, 1056 bp, Ruminococcus lactaris
atgaagcttaagacaaaactcgttatcgtatttatggtggtcatggtatttccgatgctttttaccggagtgatgacaagggcatttgtaccggaaaaggcaacggagatccagcagatgtatctgatcgtcgtatccatcacggcagcattgttgatcatatggatttatcgtgcggtatcagtgccgctgcaaaaattacagaaagcggcaaggaatatcaaagaaggaaatctggattttgagattaaagcagaaaatgatgatgagatcgggcagctttgcagggattttgaggaaatgcgtcttcggttgaaggtgcaggcagaggaaaaggttgcgtttgaccgggaaaataaggaactgatcagtaatatttcacatgatctgaagactccgatcacagcgatcaaaggttatgtggaaggaattatggatggtgtggcagatacaccggaaaagatggacagatacatcagaaccatttataataaggctaatgagatgaatcttctgatcaatgagctgaccctttactccaagatcgatacgaacaggattccatataatttcacaacgatctctgcaaaaggttattttggagactgtgcagaagatctgagtgtggagctggagtcaaaaggggcagagtttacataccgaaactttatggatgatgactgtaaagtgatcgtagatccggaacagttaagaagagtcatcaataatatcgtatcaaattcgctgaagtatacagataaaccgaaagtggagattacgatggatgtaaaggacgtgggagattttatccagatagagctgggagataatggaagagggattgcggcaaaggatctgccgtttatctttgaccggttctatcgtgcggatgcttcaagaaattcttcaaaaggaggaagtggtatcggactttcgatcgtgaagaagatcgtggaggagcatggcggaaatatctgggctaccagcgaagagggcgttggtactacgatgtattttgtaataaggaagtatcaggaggtaccggtgaatgagtaa

SEQ ID NO: 367 - DNA, 3156 bp, Ruminococcus lactaris
atgtataagaaagtttcaacagacatgaattttgttgagcgtgaaaaagaagttgaaaaattctgggatgacgaaaatatcttccagaagagtatggatgaaaaagaaggatgcccggattatattttctatgacggacctccgacagccaatggcaagccgcatatcggacacgttctgacccgtgttatcaaggatatgattccgagataccgcacaatgaaaggttatatggttccgagaaaggcaggatgggatacgcatggtcttccggtagagctggaagttgagaagatgctcggactggacggaaaggatcagatcgagaaatacggtcttgaaccattcatcaagaaatgtaaagaaagtgtatggaaatacaaaggaatgtgggaagacttctccggcacagttggattctgggctgatatggagcatccatatgtaacgtatgacaacaatttcatcgagtctgagtggtgggctttgaagaaaatttgggataaaggactcctttacaaaggattcaagattgttccttactgccctcgttgtggaacacctctttctgcacaggaagttgcacagggatataaggatgtcaaggagcgttctgcaatcgtccgctttaaagtcaaagatgaggatgcgtatattcttgcatggacaacaacaccatggacacttccatccaaccttgcactctgcgtaaatccaaaagaggattatgcaaaggtaaaggcagcagacggaagagtttattatatggcatgtgcattgcttgataccgttcttggaagacttgcagaagaaggaaaagacgcttacgaagtacttgcaacgtataagggaacagaactggagggcaaagaatacgagccactgtaccagtgtgcggcagatgaggctgcaaagcagcgtaagaaagcattttacgttgtatgtgatgagtatgtaactctgacagatggtaccggagttgttcatatcgcaccggcatttggtgaagacgatgccaacgtaggaagaaagtatgatcttccatttgtacagcttgtagatgaaaagggtaacatggcagagtctacaccgtttgcaggactgttcgtaaagaaagcagacccggaagtattaaaagatctggatgcaaggggacttctctacgatgcaccgaagtttgagcatagctatcctcactgctggagatgtgatactccgctgatttattatgcacgtgagtcctggttcatcaagatgacagcagttcgtgatgacctgattgcaaataataatacaattaactggattccggagagtatcggtaagggacgtttcggtgactggattgagaacgttcaggactggggaatcagtcgtaaccgttactggggaactccgctgaatatctggcagtgtgagtgtggatgtatgcattctgtcggaagtattgaagaactgaaatctatgtccgataactgcccggatgatattgagctgcaccgcccatacattgacgcagtaacaatcaactgcccggattgtggtaaagaaatgcacagagtgccggaagttatcgactgctggtttgacagtggatctatgccgtttgcacagcaccattatccgtttgaaaatcaggagctgttcgagaagcagttcccggcagactttatttccgaggctgttgaccagacaagaggatggttctactccctgcttgccatctcaacgctgctgttcaataaagcaccgtataagaatgttatcgtgcttggacacgtacaggatgagaatggacagaagatgagtaagtccaaaggaaatgcggttgatccgtttgatgcactggagaaatacggagcagatgcgatccgctggtacttctacatcaacagtgcaccgtggctgccgaaccgtttccacggaaaagcagtacaggaaggacagcgtaagttcatgggaactctgtggaatacttatgcattctttgtactgtatgcaaatatcgacaattttgatgctacaaagtatacactggaatatgataaacttccggttatggataaatggattctttccaagatgaataccatggtaaaagatgtggacaacaaccttggtaattacagaatcccggaggcagcacgtgtgcttcaggatttcgtagatgatttaagtaactggtatgtaagaagaagccgcgagcgtttctgggcaaagggaatggagcaggataagatcaatgcttacatgactctgtatacagcccttgttacggtatcaaaggcagcagctccgatgattccgttcatgacagagcagatctatcagaacctggttcgcagcattgacaaggatgctccggagagtatccacctgtgtagttttccggaagttcatgaagagcagattgacaaagagcttgagaataatatggaacacgtacttgaccttgtagtaatgggacgtgcatgccgtaacgcatccaatatcaagaaccgtcagccgatcggtcagatgtttgtaaaagcagactttgagctttctgaattttatcaggaaatcgtagcagacgagctgaatgttaagaatattaaatttacagatgatgtaagagactttacttcttatagttttaaaccacagttgaagacagttggaccaaagtatggtaaaatgttaggtggtatcaaagcagcactcaatgacatcgatggaaatgcagcaatggatgagctgaatactactggcgtactcaaactggatgtaaatggtcaggagatcgaacttttcaaagaagaccttctgattgatacagctcagattgaaggatatgaatctgtcaatgataatggaatcacagttgtactggatacgaatcttacaccggaacttctggaagaaggatttgtaagagagatcatcagcaagatccagacgatgagaaaagaagctgatttcgaggtgatggacaagatccgtgttacgtacgaaggcagtgaaaaagcagaagctgtttttgaaaagaacagcaccctgatcggtggagaagtacttgccacagaagttgtaaaggcagagcctgcaggccatgtaaaagagtggaagatcaacggtgaagcagttacgatgggtgtcgagaaaaaaggagaataa

SEQ ID NO: 368 - DNA, 1377 bp, Ruminococcus lactaris
atgtataagatcaattttcaaaaaccgatccacattcattttatcggcattggcggtatcagcatgagcgggctggcagagattcttcttgaagaaggcttcactgtatcaggatccgatgcaaaagaatcacctctgacgaaaaagctggaatctgaaggtgcagtgattcattatggacagtgtgccgaaaatattacagatgatattaattgcgtcgtttatacagcagcgatcaacaagagtaacccggaactgatggaagctgtcggcaagaagattccgatgctgacccgtgcggagcttttagggcagcttatgaaaaattacgatactccgattgccgtatccggtactcacggaaagaccacaactacttccatgatctccgaggtacttcttgcagcagatatggacccgaccatttctgtaggcggcatcctgaagacgatcggtggaaatatccgggtaggaaagtccgggaattttatcacagaagcctgcgaatatacgaacagtttccttcatttttatccgaagatcagtgtcatccttaatattgaagaggatcatcttgatttcttcaaggatctggaggatatccgtcattcgttccaccagttcagtgccttacttccttctgatggaactctgatcatcaacggagacatcaaggattaccaggagatctatgaaggactggactgcaatgttatcacttacggttcttctgcagaatttgattacagtgcaactgagatccagtatgatgaaaaaggatttgtttcctttgagttattaaagcacaatacttcctgcggacgcgttcagctttccgtgaccggtgaccataatgtatccaatgccctggctgccattgcaacagcagagctgctcggtattccgatggatacgatcagaaaaggacttttatccttcagcggaacagaccgcagatttgaatacaagggaacttttaacggtgtgaccgttgtggacgattatgcacatcatccgacggagattgctgctaccctcaaggctgcacagcattatccacacaacgaaatatggtgcgtattccagccgcatacttacactcgtaccaaggctttcttccatgaatttgcagaagccctctctcataccgaccatctggtcctcgcagatatctatgctgcccgtgagacggatacccttggtatttcctcttccgaccttgccaaagaagccgcaaaactcggaacggacacacactactatccaagctttgcagagatcgaggcatttctgaaagagaactgcaagtccggtgatctgctgatcaccatgggtgccggagatgtagtgaagattggtgaagacatcttaaaataa

SEQ ID NO: 369 - DNA, 2007 bp, Ruminococcus lactaris
gcaggcaggagagaaaagatggagcaggaaaaaaataaaatggagcagggaaaaagtaagcagcagcggatgcgggaactggtagaacttctgaaccgggcgagaaaggcatacgagcaggacaatacagagatcatgagtaactatgaatatgacaggctctatgatgaactggaagaactggaaaaagaactgggaacaaagatggcgaacagtccgacggtcaatgtcggttatgaggtggtcagtggactgccgaaagaacgccatgagcggccgatgctgtcactggataagacaaaggaagtagagcggctgaaagaatttcttggcacgaagaaagcgatgatttcctggaaactggacggactgaccattgttctcacgtatcagggcggagaactggtcaaagcggtcacaagaggaaatggaatcgagggagaggtcatcacgaacaatgcaaaggtttttcagaatgtgccgctgcatattccgtaccagggtgagctggttctgcgtggagaggcagtgatttcctataaagattttgaggcgatcaatgaaaagatcgaagatgtcgatgcaaaatataaaaatccgcgaaatctgtgcagtggctctgtgaggcagttgaataatgagatcaccgcaaaaagaaatgtgaagtttttcgcatttacgctggtgcgtgcggaagaggtagattttcataattcaagaatgtatcagatgcagtggctgaaggagcagggatttgatgtggtggaacatcatcctgtgacggcagaaacaatcgaagaggaagtagcatggtttgcaaaggcaatcgggaaaaatgaaatcccgtctgacggactggtactggtctatgatgatattgcctatggacagtcactgggaacgaccgcaaagtttccgagagattcttttgcatttaaatgggcagatgagattcgggagacaacgcttcttgagattgagtggagtccgtcaagaacgggactgatcaatccggttgcggtttttgaaccagtagaactggaaggaacgacggtcagccgtgccagtgtgcataatatcagtattatggaagagctggaactgggagtcggtgatacgatccaggtgtataaggccaacatgatcattccgcagatcgcagagaatctgacacggagcggtgtaaaagatattccgacagtctgtccggtctgtggtggtacgacaaagatttccatggaaaatgagacaaagacgttattctgcacgaacccggaatgtcaggcgaagcacgtaaaagcgttcagcctgttcgtaagcagggatgcgatgaatatcgaaggactttcagaggcgacactggaaaaattcattctgcatgggtatgtgaaagattttacggatctgttccatctggaccggtatgaggaagaaattaagagcatggatggatttggagagaaatcttatcagaagctgctcagaaatattgaaaacgcaaggaagacaacgctggcacgactgatctacagtcttggaatcccgaatatcggaagtgccaatgcgaaggtcatctgtaaagcattcggagatgatccaaagcgtgcggaagaggcaaccgaagaagaactggtagagattcagggcattggcgggatcatggcaaagacctatgtagaatattttgctgatccgaagcatcgggagatctaccgcagactgctggacgaggtagagctgcagaaggaggttgtgacagaggacagtcagaaattctcggggatcaatttcgtgatcacaggaagtgtggaacattttgccaatcgggcagaggtaaaagcggaaatagagaagcgtggaggaaaggtaaccggcagtgtgacatcaaagaccggttatctgattaataatgatgtaaattcaacttcttcaaagaacaaaaaggcgagagaacttggagtgccgatcatttcggaagagacgttgatcgggatgctggaacagtag

SEQ ID NO: 370 - DNA, 1449 bp, Ruminococcus lactaris
gaccccgacatctatcataaaggaaagacagaggacaaaatcatgacaaatgagaaaaaagaaactcccgttgctgctgtcagcacggaaaatatttatcgtctgaacggacgtgttccactggggaaagcaattccttttggtcttcagcacgtactggcaatgttcgtctccaatcttgcaccggttctgatcgtatgcagtgccgcactggtacgtggatccggtgagccactgacaggtgctgagatcacccagcttctccagtgtgctatgtttgctgccggaatcggtacatgtatgcagttgtatccgatctggaagattggatcaagacttcctattgtaatgggggtcagttttacatttctcggaagtcttctgatgatctgtactaatcccgaactcggatatgaaggaatgatcggggcagtcatccttggcggtatttttgaaggcctggttggtttaagtgccaaatactggaaacgttttcttactcctgtggtatcagcctgcgtggtcatcgccatcggttactccctgctgtccgtcggaatggattcctggggcggtggtaatggtgcagaagacttcggttcctggtatcatttactgatcggactgatcacactggttgtatgtctggtttcccgttatctcctgaaaggtgtctataagaacctgaacattctggtcggactgatcgtcggatatatcatttctgcactttttacagttacaggggtcgcaaaaatgatcaacttctccagcatcggaacaaccatccaccaggttggatatttcagtcttccgaaactggtcttcttcacggatcacaaaccggtctttgatcttggggcttttctcacgattgcgatcgtattccttgtatctgccgcagagacaaccggtgctacaacggctgttgcaaccggtgctctccaccgtgatctgaaaatggaagaactgcagggttctcttgctgtagacggcttttccagtgccatttccggctgcttcggatgccttccgctgacttctttcagtcagaatgtaggactggtgaccatgaccggtgtaatcaaccgatttacgatcctgatgggagcattaatcctgattcttgcctctcttttcccgccgctgggagcattcttcaactctctcccacaggctgttcttggaggctgtactgttatgatgttcggatcgatcatgtatgagggaatcaagatgctgaaagaatgtaaattcgatgaccggacaatgatcatcgtttccctttcttttgcaatcggtgtcggactgacccagacttccggaaactttttctccgccttcccatctgaagtcggtgatattttcaacggaaatgcagttgcaggagtttttgttgtctccctgctcttaagtctgatcctgccaaagcacaaagaagaagcttaa

SEQ ID NO: 371 - DNA, 2298 bp, Ruminococcus lactaris
aataatctatcagatgaaaggagaattactatggtaatacagccaatttataatatattatttcttcccgatgtcacctatcacttcaaaaaagagttttttactgaaaatgcatccgagcagcttgaagtcggcagtgagctgctttttgctttcttaagaaatgaagatgacgctgaagaactggacgctgaccatatctgtccggtcggcatttccgccagagtagaggctttcggagacgatgacagtgttcagatccgcacgctggaacgtgttgatctttcagatgtcgaggtggaaaatggtcagattctcgcagacgcatctattcgtgcagaggttgatgactatacggcagaagaagagaaggctcaatttctccgtttacgtgccgcacttttgaaatttgtccagggataccagtggggaatgtgggcaagaagtttcattttacagcggaaaaatatgtatgatctcggatctgccctttcggaatatctgaatatcagccccgaagaaaaatatgccattgttgaaacggattcccgccgggaacgctgtacgctgatcgaagctgccatcaacgaatttatggaggttgccaaagtttccaccgaagcaaaggaagctcagaaagatgatcaggagcagctttatcgcgaggcagccatcaagaagcagatcagttatcttcagaaagaactggacgaacttcaccctgaaaatatttccgatacccggaaatttgagaaaaagattgaagaatccggcatgaatgacgaagcccgtaaagaagctgaaaaagtgctgaaccgcatgaagcaggaaggcaaggacagccatgagtacggtcttctgtatgattaccttgactttatgaccagcctggactggaaagcaccgcagtttaccccgatcgatcttgaccgggcggagcagattcttgatgaagatcactatggtctgaaaaaagtcaaagaacgcatcatccagcaactcgccgttatggctctcaaccggaagcaatatggctcgatccttttatttgtcggtgctcctggaaccgggaagaccagtatcggacaaagtattgcacgggctctcggaagagaatatgtaaggatcagtcttggtggtatccgtgatgaggcggaaatccgtggccacagacgtacttatatcggtgctatgcccggacggatcatggaaggaatcaagcgaagcggtgtctccaatccggtcattgtactggatgaggttgacaaacttgccaaagattacggcggagaccctgccagtgcccttctggaggttcttgatcctgaacagaacagcactttcactgaccactatatgaatgtgccttacgatctgtccaatgtactttttgtctgcactgcaaactcactggatacgattcctgaaccactgctcaaccgtatggaggttattaatttctccggttacactgcagtagaaaaatatcagattgcccgcagacatcttcttccaaaggctctcgatgccatgggaattaagaaaaatgcattgaaagtaaccgacggagcgattcgcaggattattgatgaatacacaatggagtccggtgtccgtgacctgaaaaaactgatcaatactctttgccggacggctgccgtccaacttgttaaaaatgagggaacaacactgacagtcactaagacaaatctcgaaaaatatcttgggaaaaagcagctccaccatgagcggaaactctcttcccctgaaccgggagttgtcaccggacttgcatggaccagagcgggcggagaaattttatttatagaaagtaaactgattccgggcaaaggcaagatgattattaccggtcagcttggagatgtaatgaaggagtccattcagattgcactgagtcttgtaaaatcactttatccaaaggaaagcaaagtgcttgatgaccacgacctccatatccatgttcctgccggtgcggttccaaaagacggtccatcagccggaatcacgctgacaacagcacttgcatcacttctcacggggaagaaagtcagcccggaatatgccatgaccggagaagtttccctgcgtggcggtgtcatgccgatcggcggacttcctgaaaagcttatggccgcccagcgtgcaggaatcacaaaggttctgattcctgctgacaatgaacaggatctcgatgacgttgccgatgaggttaaaaataagctggaaatcattccggtgaaaaaagtgactgaggtactgaaactggtgttgaaataa

SEQ ID NO: 372 - DNA, 1368 bp, Ruminococcus lactaris
atgaagcaacaaaataaactggatccgtataaacgtctgatccgattcctgactgtgatggttcttgtacttgtgctgacagggatgttcatcgttgtctggaaaagatatcataactggggaattgtatttccattttatcataaaggatattggctgatgggagcattttacgctttcttctactttatctttatgtatcttatgggaggaatgaatgtggggtccctgcggatgagtaatctgtgcctttcccatggactggcagcagcggcggccaatgtatgtatttatctggagacagtgcttctttcggcaagatttgtaagtgtcctgccattgacatgtctgacgtgtatggatatgctggtgatcctgctgtgggtgatcttttcggcaaagctgttccggcgtctgttcccggcgagaattgtacttttgctgtatcaggagtatgacccgatgccgttccgcaggaaagtgcggatgagaagtgaccgttatatcattaaagaatcatttaatgtggatgaggagtgggacatggtcgtaaagaagattgatgattatgataccgtctttctctgcgatattcatgcaccacttcgcaaccggcttttaaaatattgttacgcacatggaatcagaacgtatatcacaccaaagatttccgatatcattatcagaagttcggaaaataaccatatgtttgatacaccgttattgctggcaaaaaatgaaggactgacgtttgaccagcggctggcaaagagagtactggatctggttgtatcgattattgcactggtcattacttcaccggtcatgctggtgatcgcgattgccattaaggcatatgatggcggcccagtattttttgtccaggatcgttgtacgatcaacggaaaggtatttaagatccataagttcagaagtatgatcgaaaatgcagaaaaggacggagaagtaatcccggcgacagatgatgatgcaaggattactccggttggaaagataatccgcaagacgaggctggatgaacttcctcagttctttgatattctgattggaaatatgagcgtggtcggtccaagaccggaacgtgtggaacatgtagaaaaatacgtggaggaagtaccggaatttacctacagaatgaaagtgaaaggtggactgacagggtatgcacagatttatggaaaatacaatacttcagcttatgacaagctgaagctggatctgatgtatattcagaattattcaatcctgctggatctgcggctgatcctgatgacggtaaagatcatgtttatcaaggacagtacagaagggtttgaggagataaagccttcagagaaaaaagactga

SEQ ID NO: 373 - DNA, 2310 bp, Ruminococcus lactaris
atggaaaagaatgtaaaagtacactgccttaccaatccggttacgatgcaaagtgtggcgaatgtacttctggctgcaggtggaagtgcagtcatggcacaggatgaacaggaagtggaagagatcacggcgatctgtcaggccactttactgaataccggtgtgccggacgaaagaaagatcagatcctgtattcttgccggaaaatgtgcgaacagactggggcatccggtagtgctggatccggtcggtgcaggggccagcaaattccggagaaagaagatcggacagcttctgcaatcggtcgttccttctattataagatgcaatcaggaagaagcgtctgcattattgcgtgcagaggatgaaaaggaatttctggttttaggaactgaaaggcagaaaatagaaggaacggcagaaagctgtcagcaggatggtgatgcagtattttcaggaatccagagtggtggagtagaaagctcactggaactggagctggaaaaagcccggaggctggcagtcagactggcaaaaaaatatcgttgtacggtttgtatgaccggggagcaggatgtgatctctgatggagaacgagtgaaagttatctcaggaggggatggacgaatctgcagaattaccggaagcggctgtatgctttccgcattatgtgcattaaaatgcggagacggaacagactcttttgaggccgcggctgaagcggctgaaacatggcggcactgtgcggaaagagccggggagactgtggatgaaaaagaggaaggaataggaagttttcagataaggctgctggatgctttgtcattgaagatggaaatggagcgaggcaggagaatggaggtgcagagcaggatgaaacagaacaaaaaaagatatatttcaccggagcagctcaggctttatgcggtgacagacagaaaatggctcgcggaaggcgagacactggagacagtagtggagacactggtgcgttcaggcgtgacgtgtgtacagctccgggagaaacacgcttcggatgaagaaattatttcagaaggaaagaaattaaatgagatctgtagaaagcaccatgtgccattgattgtaaatgaccggccggatcttgccaaaaagatcggtgcagccggagttcatgtggggctgtctgatatgggaattgaaaaggcgagagaactgctgggagaagattttattatcgggggcagtgcccataatgtagaagaagctctgcaggcacaaaaggcaggtgcagactacattggatgcggtgcagtctttggaagtcagaccaagtcagatgtgacgactcttgcgaaaaaggaactgtgtgcaatctgcgaggcagtggagatcccggttgtagccatcggcggaatcaccgcagaaaatataaaagaactgactggaacaggcattgacggagtagctgtagtgagtggattatttgcagcaaaagacaagccggagatggtgcgatgttttttgaaagcatttgaaatgaaaaaggtgcttaccatcgcaggaagtgactgcagtggaggagcaggaatccaggcagatcttaagacaatggcagccaatggtgtgtatggaatgagtgctgtcatggcattgacggcacagaataccaccggagtacagggaatcatggaagtgacaccggagtttgccgggcagcagatagacagtatttttacagatattcgcccggatgctgtgaagatcggaatgctttcttccggggaaatcattcatgttgtggcagaaaagctgaaagaatatcaggcagagcatatcgttcttgatccggtgatggtatcaaccagtggtcatcggctgatacagaaagatgcggagcaatctctgaagaaagagctttttccgctggcggagctgatcacaccgaatatcccggaggcagaggtgcttagcggaaggaagattaaaaatgcacaggatatggagtcagcagcggaaaagattgtagaggagtatggctgtgcagttttattgaaaggtggtcatcggatcaacgatgcaaatgatttcctctgtacgggggagaaaaaagtctggatctgtggtgagcgggtggaaaatcccaatacccacggaaccggctgtactctttccagtgcgatcgcctcgaatcttgcaaaaggtgcaggaatggaagaggcggtgcagaaggcaaaagaatatctgacggaggcattaaaagaacaactggatttaggagcaggttcgggaccgatggatcatacactgggaaaaataatttttgaataa

SEQ ID NO: 374 - DNA, 2151 bp, Ruminococcus lactaris
atggatattaatcagaaagtgacagaagaacttggggtgaaaaggtggcaggtggatgccgcggtaaatctcattgacgaaggatataccattccgtttatttcacgatacagaaaagaagtgaccggttctctgaatgatgagcagctcagaaagctgtatgagcgtttgatttatttgagaaatctggaagaaaagaaagagcaggtgctttccagtatagaggaacaggggaagctgacggaagaattaaagcagcagattcttgctgcagagacactggtttccgtggaggatctgtaccggccataccgaccgaagcgtcgtaccagggcgaccatcgcaaaggaaaaggggttagaatcactggcagcagttattatgttgcagaaaagtatggaaccattggaaaagatcgcagaagcgtatatttctcaggagaagagtgttgtatcagcgtcagaggctgttgcaggggcgagagatatcattgccgagtccatctcagataacgcagattaccggagctggatcagaaagattacgatgaataaaggaaaagttatttctacagcaaaagatcctgaggcagagtcagtttatgaaatgtattatgaatttgaagaacctgcggaaaagctggcagggcatcggattcttgcattaaaccgaggagaaaaggagaaatttctgacagtaaaagtgcaggcaccggaagaagaaatcctgcgttatctggaaaagaaagtgatcgtgaacgaaaatacatatacaacggaagtattaaaagagacggtagctgacagttataaccgtctgatcgctccggccattgagcgtgagatacgaagcgaattgacagaacgtgcggagaatggagcgattgaagtatttggaaaaaatctgcaccagcttctgatgcagccaccgatcgcaggaaaagtggtacttggatgggatcccgcattccgtacaggatgtaagctggctgttgttgatgagaccggaaaggtgatcggaacgacggttatttatccgacggctcctacaacaccgaagaaaatccaggcgagtaaggatcttctgaaaaagattattccaaagtaccatatttctctgatttctcttggaaatggaacggcttcaagagagtcagaagaatttattgtagaattattgaaagaaattcctgaaaaggtacagtatgtgatcgtaaatgaggcgggggcctccgtttattcagcaagtaagctggcaagtgaggaatttccgaagtttgatgtaggacagagaagtgctgcatcgatcgcaagaagactgcaggatccgctggctgaactggtgaagattgatccgaaagcaatcggagtaggtcagtatcagcatgatatgaatcagaagaagctcggtgaatcattaaatggtgtggttgaggattgtgtgaataaagtaggcgtggatctgaatacggcttctgcaccgttgcttgcatatatttcaggaatcagcagtgcaatcgcaaaaaatattgttgcttaccgggaagaaaatggaaagtttgccgacagacgggaacttttaaaagtaccgaagctggggccaaaagcctatgagcagtgtgcgggattcatgaggatccagggtggaaaaaatccgctggatgcgacagcagttcatcctgaatcttatgaagcggcagaaaagctcctgaagaagcagggatacaaagcagaggatatcacaaaccataaattaacagggttatcattgacgatcagagattataaaaagctggcagaagaactggagatcggagagatcacgttgcgagatattgtaaaagagctggaaaaaccggcacgtgatccacgtgatgaaatgccaaagccgattcttcgtaccgatgtacttgaaatgaaagatctgaaagagggaatggttctgaaaggaacagtaagaaatgtcattgatttcggtgcatttgtggatatcggagtccatcaggacggactggtgcatatttcccagattacggataagtttataaaacatccactggaggctgtcagcgtgggtgatattgtggatgtaaaggtaatgagtgtggatatgaagaaaaaaaggattcagttgacgatgcggggaatataa

SEQ ID NO: 375 - DNA, 3354 bp, Ruminococcus lactaris
atgctggcttttttggaaccgttggaagaactggcggattatcaggaaatagttcgaaagaggggaaaggcagaaggaattcttcagattgcgggctgcgtcagttcgcagaagacgcatctgatgtatgcattgggcgatggctttgagtacagagtcatcgttttttccagtgaggaaaaagcaaagcaggcgtatgaagaatacaaaatgctggaggagaatacctttctgtatcctgcaaaggatcttttattttatcatgcggatatcaagggtgctgccctgaccggaaaaagaatggaagttctgaaaaaactgacagaaaagaagaaccgggagccggttacggtgatcactacggcagatgcttttttagatggacttccgtcaaaagaaaaattgtgggaaagccgtattgaaatagaagcgggggctgtcattgattttcagaaactgcaggaagagctggtccatcttgggtatgagcgggaaagccagatcgagggaccaggacagtttgcagtcagaggagggatcctggatgtctatccgctgacagaagagattccggtcaggatcgaactgtggggggatgaaattgattccatcagaagctttgatgtggaaagccagagatccgtggaaaatatggagcagatcgtcatttatccggcaacggagaatgtggaaaaagaagagcaggcagtttcattttcagagtattttccaaaagaaaaaagtctgttcttctttgatgaaccggtcagattgcaggagacgctggaggcggtagaaaaagaatatttccacagccttgagagcaggaaaaatgcagggatgacggaagaggcagatgagatccgggtctttcagacgaaggagattatagaaaaatttaataccagatacgggatcggtcttaccacgctggagacaagatgtggtgattttaaagtgcgtgatgtctacagtattcaggcagccggcgtcaatccttataataacagttttgaaatgctcacgcaggatctgaaaaagctgaagcggcagggctaccgggtaatcctcgtttcaggatccaggacgagagcgaagcgtcttgcggaggatctgagagattatgacctgagcagtttttacagtgaagatatggtacggacggtcagaccgggagagatcatggtcgtttatggatgcgtggcagagggatatgagtatcccatgttgaaatttatggtgatctcagagtcggacatttttgggaaacgaaagaaaaaaagacgcaggaaagtttacgaaggacagaaaatccaggaatttgcagaactgaagccgggagactacgtggtgcatgagaaccatggacttggagtctatcagggaattgaaaaagtagaagtagacaaagtgacccgggattatatgaaaatttcctatgcagacggaggaatcctttatattcttgcaacgcagatggatctgatccagaaatatgccggggcagatgcgaaaccgccaaagctgaataaacttggaacacctcagtggaataagacgaagagccaggtaaaaaaggcagtgcaggtgattgcacaggatctggtggaactgtatgcagtgagacagcagaccgaaggatttgtatacagtccggatacagtatggcagaaagagtttgaggaaatgttcccgtttgaagagactgaggatcagctccgggcgattgaagataccaaaaaggatatggaaagcacaaaggtgatggatcgcctgatctgtggagatgtagggtatggaaagacggaagtagcaatccgggctgcctttaaagcggttcaggatggaaagcaggtcgtttatcttgtcccgactacgatccttgcacagcagcattataatacctttatccagcgtctgaaagatttcccggtcaggatcgatctgttgtgcagattccgtacaccggcacaacagaagaagacgattgaagatctgaaaaagggactggtggatattgtgatcgggacgcaccgggttttgtcaaaggatgtaacttataaagaccttggtctgctgatcatagatgaggagcagcgtttcggtgtgacgcataaagaaaaaattaaaaaaatgcgtgaaaatatcgatgtgctgacgttgacagccaccccgatcccacggacgctgcatatgagcctgatcgggatcagggatatgagcgtactggaagaagctccgatggatcgtatgccgatccagacttatgtaatggaatttaatgatgaaatgatccgtgaagcaatcgagagagagctttcccggggcgggcaggtttattatgtatataaccgggtggaagatattgcggatgtagccggaagggttcagaagcttgttccgggagcaagtgtatcttttgcacatgggcagatgagtgaacgggaactggaagatatcatgtatgattttattaatggggagatcgatgtacttgtatccactacgatcatagaaaccggactggacattgcaaatgcaaatacgatgatcatccaggatgcagaccggttcggactgtcccagttataccagttgcgtggccgggtaggaagatcaagccgtatggcatatgcattccttttgtaccgcagagataagcttctgaaagaagttgcagaaaaaaggctggctgcgatccgggagtttacggatcttggttcggggatcaagatcgcaatgagagatcttgagatccgaggagcggggaatttgcttggtgaggcacagagcggtcatatggcggcagtcggatatgatctgtactgcaagatgcttaatgaagcggtaaaagaactgaaaggtgagaaggaagaagatcagttcacgacaacaatggatctgaatattgatgcatttattcctgaatcttatattaaaaatgaatatcagaaactggatatttataagaggatcgctgcgatcacaactgaagaagaaatggatgatatgacagaggaactgatcgaccggtttggagatattccgaaaaaggttcagcagcttcttcatattgcagcattaaagagtctggcacattcagcttatgtaactgctgtggagcagaaaggcagtgattttaagtttactttatatgaaaaggcaaaattagatcctcagaagataccgggactgcttcagcggtatggaaataaattagtgttcagagcagaagagccaccttactttttctatcagaaaaaaggacgaagcggaaaagagaccggggaagatacgatccggatcctgagaagacttcttgaggatatccgggaattgcggattgtgttgtga

SEQ ID NO: 376 - DNA, 690 bp, Unknown
  Description of Unknown: Clostridiales sequence
atgggcaagaggcgtttgataggaaagatagttatattgatgctgggcttggcagcggtggtgatattggcggcaaacagcgatactatacccgtcagcaccccaaaaaagggatatagggtagttatcgatccgggtcacggtggcagcgactgcggcgcggtgggagtatcgggagtaaaagaggcggggctgaaccttgccgtaagcctgtacctgaaggaggagctggaggcgctgggaatggaggccatactcacccgcagcgacgaaagggcgctggcagagggcaagaaggcggacatggccgccaggggcaaaataatgaacggagaaggggtggatctggtggtgagcgtccacatgaacaagttcaccgacccatcggtacacgggccaatggctttctacatgaagggcagcgccgagggggagaagcttgcaaagaccgttatagacagcataacagacgaactgggggcgccgaggcgcatagccaatcccggcgactattatgtgatacgggagagcatgccggtatccgtgctggtggagtgcggtttcctctcaaacagcggtgatgaggcgcttttgcagcaggagcagcatcaaaagaagctcgcccacgccatagcgcgagggattttcagctattttgagggggatttggggcgtaagccgctggactaa

SEQ ID NO: 377 - DNA, 618 bp, Unknown
  Description of Unknown: Clostridiales sequence
atggataacgataaaaaaggacttttgtttgtgatttccggcccttccggcgtaggaaagggcactatctgcaaaaagctgctggagaggcggaaggagcttaagctttccgtatcggtgaccacccgtgcgccgcgtcccggcgagatagaaggcgtgaactactttttccgctcagaagaacagtttcaggatatgatagagcgtgacgagtttctggagtacatgtgcgtgttcggcaagaaccactacggcacacccaaagcttacgttgcagagcagagggctcagggcaacgacgtaatattggagatagacgtcaatggcgcgctgaacgtcaaaaagcgctgccctgacgcagtcatgatattcatagcgccccccagcatggagacgctgaaaaagcgtctcgtaggccgcggaacggaaacggaagaggcggtagagcgccgctttgccgaggccgtgaaggagctggccgcagcgggcgagtacgactatatagtagttaacgacagcctggataaggctgtgaacgatacggagagcatacttgtatccgaaaggctgcacgtatcaaacaatcccaagctgatcaacattcttaaaggagaataa

SEQ ID NO: 378 - DNA, 762 bp, Unknown
  Description of Unknown: Clostridiales sequence
agaactataacggcaccggactctttacagggcgggcagcccggaaaaggaggaaaagcattgaacatcatagacgcggtatcaatatgtatactggtgttattcgtgctcttcggcatatacaagggatttatttccacgcttcttaacataggcgcgtactttgtttcggtggtgctgagctttctgctcaagccccttggggccagcgccataaagcacagcgacaggatattcaacatgatgctgtactacaccgagggcagcgagtttatcgccaatccggaatacgttcgaatggaaatatcctccctctccacggccgagataaacgacataatcgcctcctccaatctgccctttcccatgggcagggagatagccaaaaacatcgcccgggaggccttcgcggatcagggcatagtgacgctgggggactacttcaaccagaccatagtgggcgtattcataaacatactgatgttcctcgtatgtttccttataatacgcgcgatactctcgctggtgataaacggggcggactatgccgatcccttccccatgctcaagagccatgacggcatattcggcggcgcgctgggcctgttgcgggggatgctggcgttgctgctggtattcatgctggtacccatagtgctgacgatgctgggccagttcgatcttataaccaacatggtggacgactcagccatggcccgggtgttctataagcttaatctgcttatcagcatcgcggcgtaa

SEQ ID NO: 379 - DNA, 1182 bp, Unknown
  Description of Unknown: Clostridiales sequence
atgttaaacaaaaagagcctgcgggctcttttttgtgtaccgaaacgtgggatatcatggcaaaaagtgcttttaatgggggatggtttaatatataattacaaatatacggcatcggtcaaacgcatacatataaaccgaatctatcgaacagctacggaaggggataaaatcatgggcaatatcattggcatgctggcgggcgagcttatgtccggcagctcggtaaagcaggtggcaaaggctgctggcgtgaacgaaaagcaggcggagaacctgatgggcaacgccataccgctgctggtgcaggccatgtcggacaatgccggcacaaaggtaggcgcggagtcgctgtatgaggcgctgggacagcatagcaacggcctttctgccgccgagcagctggacagagcagaccttgaggacggcgacaggataatcggaaaaatattgggcgacaacaagcagggcgtgaccgaggcattggcgaagcaggccggcattacaaagggcaacagcgcgaagatactggcgctgctggctcccgtaatactttcccttataagcaccgagacgaatacaaacaatacctcctccggcggactgtcatcactgctgtccctctttacggacgacgacacaggccacagcaacacgcagactacctccagctctggcctcggagatatcggaacggcacttctcatgggggcgctgcttggaaacaacaataacggcaatagcggttctgcaggaggcaacctgcttacctccctccttggcggcggacagcagcaggtgcagccccagcagcagtccggaggacttcttgaatcattgttcgggggcggcatgagcggtcagactatacagtccggcggcagtggcctcgacggagcgctgctcaacaataacaccaatcccaacagcataaaccagggcagcatgctgtccagcctgcttggcggcagcaataacgatacctccaatatgctgggctctctggcaggatcgctgcttgcagacgctttcaagggcatgccgcagcagaaggcggctccaagaaagacagcggcaaagaaaaccacgacagcaaagcccgccgcgaagaagaccgcagctgtgtccaagaagactacgtctgcgaaaaagacgacggcaaaaaaaccggcggataagtaa

SEQ ID NO: 380 - DNA, 1047 bp, Unknown
  Description of Unknown: Clostridiales sequence
atgtctattcaaattaagactatcgccgtaaccggcgaaaaacagaccgagataatgaacctgaccaccccggatcttcgcaacggcgaagcattgataaaggtacatgccgtagcgctctgcacccttgagcagcgcatattcaggggtgaagtaaagatgcctctgccatgcaccggcggccacgaggtatcaggcgagatagttgctctgggcgatggcgtgaacaagaaaatgtgggcgccaggagaccgcgttgccgtacgtctgctttacaactgcggcgagtgctattactgccgtaccggacatgctaatctctgcgaaagggcgcagaaaaagcccgtacgcgagggactgcttataggacccggcggcctttgcgattacgttatagtaaataccggttatctctttaagatacccgacactctgagctatgaagaagccagcctgaccgagcctcttgcatgtgtggtgcatagcgtcaccaaggctaacattcagctgggtgaagacgtggtagtaataggcggcggcataatgggtcagtatcacgtaatgctggcgaagcgcaggggtgcaagggtcataatgagcgaggtagacgagagccgccgcactctggcccggaagctgggagccgacattactttcaaccccatggagaaggatcctgttgagtatgtaaagagcctcaccgagggccgtggtgcagacgtggtgttcaacactaccgccataccttccgtggtacctcaggctatcgccatgacaggcaaggccggccgcatgatacagtacagttccatgcatcccgatgccccggcgccggtaagcccccagatgctgcatggcaatgagcccatactcaccggctccatcagccccgacgtgcacgacttttttaccgctaaccgtctgctttccggcggcataatagactgcaagccgcttattgcaaagaagttccccttcgagcaggcacagcaggcctttgaggcggcgattgtgcccggcaccttcagggtaataataacagactga

SEQ ID NO: 381 - DNA, 663 bp, Unknown
  Description of Unknown: Clostridiales sequence
atgtgcccgccatgcgggcacctttatgtatgggagaaaaacaccttgataatagacactcaccttcacgaacgcacattttccggcgacagccgaatgaacctgcttgagcttgtttcggaagcaaggcgcaagggtctcgacggcatatgtattaccgatcatgaccagatgggacttacacaatatgccgcaaaaatagctgaacaggaaaattaccctatatttgttggcgtggagtaccttgcctgcgaaggggatatcgtggccttcggcattgaccggcttccagagccccaccttatggcgcaggaattcatagattacgtcaccgcacgcggcggcatatgcatatccgcccacccttaccgggccaacagccgcggccttggggatatgctgttcacgctaaaaggcatgacaggcgtagaagtgctcaacggcagcaccacgccccttgagaaccgtaaggctctggatacctgcataaagacaggcctcaagcagttcggcgccagcgatgcccacagcacggtgcaggtcggcatttacgccactgaaatacaaggatatttcaccaccgtacccgaacttgtggaggccataaagacccgggaatgccgggccgtatacctctccggttttaaacctcttgaagtatga

SEQ ID NO: 382 - DNA, 966 bp, Unknown
  Description of Unknown: Clostridiales sequence
atgaataacccttataaggtacttggagtaaacgagggtgcttcgcaggaggagataaggtctgcataccttaaactcgtcaagaagtaccacccggacaagtataccgattccgatctgaaggagcttgcaaacgaaaagctggtggaggtcaacgaagcctatgagatgctgacaaagaaaaacggtcagagctcaagctacgccaacaggaacggcaatggcacctatgactcctacagcggcggatataccggctccggaagctcatattccggcccgaatgctcaggaattcaacagggcgagggctttcatcaaccagaataaccttcaggccgccaaggcggtgctggacgccatatccacccgcaacgccgaatggtactatctctacggcataatatacctgcgccagggctggtacgataaggcccgggaatacctgacgatagcctatcagcaggagccccacaacccggagtacgccgcggcgtacagctcgataaaaaacagcggcggcgcctataccagaagcacaggcaactacggctcctacaattgcagcccctgcccgctctgcgccagtatgctgtgctgtagctcaatgggcggtatgccctatattttctgctgcttacatataaataagaaaaacttaatatttttacgccgatttggattttattcttctgccgctctggcgatactaatgtcaggaatacgatggagggataaggaaaatgaggttcagaggattaaagatactgctgctggccgttactgccgcggcagttttgtttttgctttgcggcgcggtcaagacccttggtatggacaggtgggtggatttcgacgtgtacagaataacaggctgcgacaggacctcgataatatacgatgggcaaagcgatgtggttacccgcttacacggagttcaggacaggacatgggtgagcatcagtga

SEQ ID NO: 383 - DNA, 2097 bp, Unknown
  Description of Unknown: Clostridiales sequence
gtgtcaaaaaagtggctgaacgccacttttttgagttttacgggttttgcctctcgcattcgctcccgggcggcaaaacccgcaaagaacgaaaacctctgggttttcatccgttctgacgcacatgtcgtcagagccggattaaacataaggggctgcggccccttatcaaccccggggtttttcgacaggctgatatttcgtgggatcatatatggtgcatacagggcaaaaaaatgtgacaatgttgcgaagtgcggtactaacgaaatattttatgctaaaattttaattatgatgaaattcgaccagcgatacgagaaatacaaagccccctttggcgcggtggaaacgggcagctcggtgcgcttctttatggaaaccgacagggacgacagtaaaataacactcaggctctgggtagacggccgggaggagctgatttcaggcgcccgggaagagggcggcgtaagctttacctataccccggcccacagcggtatcgtatggtactattttctgattgacggtccggaaggcaggcggtattacagcggtacagagggcgagggaagtatatacacagagcagccggattcctaccagctgacggtctacgacccctatgaaacgccggactggtttaaaaatactatcgtttaccagatatttccggacaggtttagaaggccaggtgaaatactcggtatagaggagcataagtcgctgttcggggcgccaaggattcatgggaactggagcgacagcccggactacctgccgttaaacgggcaaaggtactatgtgccggaggactttttcggcggcaacctgtacggcgtaaaggaaaagctgccctatttaaaatcactgggcgtggggtgcatatacctcaaccccatattcctttcctccaccaaccaccgctacaacacggcggattacatgacggtggatcccatgcttgggggagacagtgcgttagccgagcttgcggcggccgctaaggaatacggcatacggctcatgctggacggtgtgttctcacataccggcagcgaaagcgtttatttcaaggaggctcagagcaatccccattccccctgccgggactggtacgattttaccgagtaccctgacaaataccgctgctggtggggctttgagacgctgcccgaggtgaaggagcttaccccttcatacatggaattcataggcggcgtcatggaaaaatatgccaaaatgggaataacctcatggcggctggacgttgcggacgagctgccggacggatttatagaattcctgcgcaaaaggctcaagagcatagatcccgatggggtgctcttaggcgaggtgtgggaggaggccaccaataagcacagtatgggcggccggcgtaaatatgtggacggccatgagctggacagcgtgatggattacccattccgcaggctgcttatggatttcttcctcggaaggatcgacggcgaagggctggcaagggggctgctccggcttatggagaactacccgccgcagttttacgaaagccttctcaatctcatgggcagccacgatgtcgtcagggccataaccgcgcttgcgggggcgcctgacagggattcccttacgagagagcagcaggcggcgtattcccccactatagagcagctgaaggcgggcagaaagcgcttcatggcggcggccgcggtacagtatatgatgcccggcgccccctgcctctactacggcgacgaggcggggcttacaggcatggcggaccccttcaaccggggcacatacccatggggtcaagaggatacagagctcatcgcatatttccaaaagctgggagagctgcataaacgcgccaaaggcggctgcgccttcgcggggcgcggcgatgtattcgcgctgtaccggccggaggtcatatgcgtggtaaacaggagctgcgagccggtaacggcctgctttgcggataaggatttttgcggcaatatcagggccgagctggaaaacggctgtatagaaagggaactgcccccatacggcgcggcgatacttataaaaggacaagaggagcgggcataa

SEQ ID NO: 384 - DNA, 747 bp, Unknown
  Description of Unknown: Clostridiales sequence
cagcttataatgccgcccataccggaggaaaacattttgagtattaacattaaaacctacggctcctttgtaaagctgccggtaaaccatcttgcggggcataccgtaatttccatagacgtgctgcgctcgtccagctgcatagtatggggccttgtgaacggcgcaagcaagataatccctgtagacgacctgggcagcgccgtatccatagccagccgcatgggagactgcgtattggccggcgagcggggtgcggtgctcattcccggctttgacataggcaattcccctgcggagtacaccgaggcaagggtgggcggcaaggccgtcgtcatatcaaccaccaacggcaccggagccatctgcaaatccgagtccgcctccaatgtgctcataggctccatgctaaactgcaccgccgtagcaaagcgcgcggtagaattgggaaacgatgtcatactcatgtgtgcaggtacaggcggggagttctccgcagacgacatatacgcagccggcgccattgcctccgccatacagacactgaccgacgcggagctctgtgaccttacccgcgtctcctgtctggtatacgatcgctggaaggaggaccggaccgagctttcaaagacaaagcactataagcggctggtatccctgggtctggagagcgacataaatttctgcctcacccgggatcttacggatatagttccggagtacaaaaacggcgtgatagagctttaa

SEQ ID NO: 385 - DNA, 963 bp, Unknown
  Description of Unknown: Clostridiales sequence
atgaagcgcataaccgcactgtccaccattgctgttgccgtgatagcacttattataggccgcacattctcggcaagcgtaatgagcaacgaccgcgtcatggcggacgtgcgtcagagttatcgcagcgcctcactggtggtgtcgggtgaatgcatacaaaagataaattccggcgacaatgcccagagccgcattctcatagatgaggtaatagccggaaacgcccgggaaggctccaagatacttgtaaagggcagttataccgtaggcgaaaagtatctgctctatcttacggagggcaacgaggtgcagtatgccgaggacgaggcagactattgctccacctccgcggataactttgtgatccgggacggaaatgtggaatacggcggctcgcggataaagatcagcgagttcaaaaaggaaatggacgcaatctcaaaggtcatcactgcgccttcaaagaactactactacaatgatatcagatcgcttgtaaacgcctcggagaatatattcataggccgtgtaaacagcgcgtctcatatgcgcagcaccaaattccgcacccaggacggcggaagcacagtcgaaaagaaggcgccatccgcaaatcttaccatcagtgtatacggaaacataaaaggcgatataggctacggtcaggaaataaatctggtatatgttccttcagccagcgaaaacatgacggatgccggcaccctccagcccaagccggtgagcgccgacaaagcggtaaagctttccgagggcgatacctacctgttcttccttgcggaggatcctgaccccaagcaggatcactgcttcccggtaaactccatacagggttggataaaggtggaaaatgataagctgaccgtgtccgatgagaacggcgtggcgaggggatacacagacctctctcagctggtagccgatataaacaaggtaaaataa

SEQ ID NO: 386 - DNA, 792 bp, Unknown
  Description of Unknown: Clostridiales sequence
atgaacgaattaaggaacaaaaagggttttatatgcgatatggacggcgtgatttaccacggtaacaagctgctgcccggcgtaaaggagttcgttgactggctgtacagggaaaacaagaacttcctcttcctcaccaactcctccgagcgctcacccaaggagcttcagcaaaagctcaagcgcatggggcttgatgtggacgagagccatttctatacaagtgcgttggcgaccgcacgcttcataagctcccagtcgccggaaagcagcgcctacgtaataggcggcgcaggcctcataatggctctgcacgacgaaggcatcaccatgaacgacgttgacccggattacgttataatcggcgagggtaatacctacaactacgagaacatcctgaaggcggtacacctggtgatgaagggcgcaaagctcatcggcaccaacagcgaccttacaggcccttctgagaacgggataatccccgcatgccgggcaatgatcgcccctatcgaaatggccaccggccagaacgcctatttcataggcaaacccaaccctcttatgatgcggacaggccttaggatactgggcgtacactcagaggacgcggtaatgataggcgaccgcatggataccgacatgatcgcgggaatcgagactggccttgacacctgcctcgtgctctccggtgtgaccgaccgcgccgacatcaataagttcccctaccgtccgcggctggtgttaaacggtgtaggcgatatacctgacaagccaaatgaaatagtgtga

SEQ ID NO: 387 - DNA, 1017 bp, Unknown
  Description of Unknown: Clostridiales sequence
atggagtacactaatctcggcagcaccggcttgaaggtttcccgcctcggcttcggcggcataccgatccagcgcatcacacaggaagaggccactgccctcatacacaagctcccggagtacggcgtcaactacatagacaccgcccgcggctataccgtaagcgaggaatacctcggcatagccatggaaggtatccgcgataagttcgttctcgccaccaagagcatggcccgcacaagggaagccatggaaaaggatatagagaccagccttaaaaacctccgcaccgaccatatcgacctgtatcaggtacataacgcaccccctgcccagatggatatagtcaccggcgaaggcggcgcgctggaggccctgctggaagcaaaggcggcgggcaagataggccatataggcgtcaccgcccatgaggtagccacctttgagatggcccttgatatggactgggtggagaccataatgttcccctacaacttcgtagagcttcaggcggctgacctaatcaaaaagtgcgccgaaaagggcaagggctttatctgtatgaagcctctggccggcggcgccatagagaacgcgcctctcgccatgcgctttatagcctccaataaggacataaccgtcaatatacccggcatggcaagcgaggacgagcttaagcagaacgctgccgcagcctgcgatcccacccccatctcggaggaggagctcagggaagtgcagaacatacgcgacaccctgggcaaccagttctgccgccgctgcaattactgccagccctgcaccatgggcataaacatctccttctgctttactatcaacggctatctcacccgttacggcctgaaggactgggccataggccgctataagggaatggccgtagagcctaacgcctgcattgaatgcggaatgtgcgagagccgctgcccctaccacctccccataatcgaaatgctcaaggacgtatacagcaacttccagaaggaaatgaagtaa

SEQ ID NO: 388 - DNA, 615 bp, Unknown
  Description of Unknown: Clostridiales sequence
atgatgacgggaaaatgcggcataatatccggcggagagcgggataccctaagcggcatagaggactgcgggctcatcatcgcctgcgataggggatacgaatacgcaagggctgcagacgtgcgccccgggctgctggtaggcgatttcgactcatataccggcccattgcctgaggatatcccccggctggaactgcccgcagaaaaagacgatacggacaccatggcggcggtacggtacgccatagctcagggctatggcgagataaggatatactgcgcccttggcggcagggcggatcacctgttgggcaacatacaggcactctccttctgcgcggagcggggcgtaagggcctccatagtgggaggctgctgccgcatagacgtgataaaaaattctgttatttcccttgaagaacaaaatgggtatttttccgtaatatccctgagcgacgtcagcaccgtcaccatagagaacgcaaaatatgagctctctgacgcccgcctgaccaactccttccccataggcgtgagcaaccggtggaagaatggcgaagcacgggtgaaggttaaggacggaactgcggcggtgatcagggtaaaagaatag

SEQ ID NO: 389 - DNA, 1611 bp, Unknown
  Description of Unknown: Clostridiales sequence
atgactaaatacatcttcgttaccggcggcgtggtatccggccttggtaagggcatcaccgcggcatctctcggcaggctgctcaaaaaccgcggtctcaaggtagcggcgcaaaagctggatccatatataaacgtggatccaggaaccatgagcccttatcagcacggcgaggtatatgtaacggcggacggcgccgaaacagaccttgatctgggtcactacgagcgttttatcgatgaagatctgaataagtattccaatcttaccaccggtaaggtatactggaacgtgttgaataaggagcgccgcggagaattccttggttccacagtgcaggtcataccccacataaccaacgaaataaaggatttcgtataccgtgtgggcaagcagacagacgccgatgtggtcataaccgaaataggcggcaccataggcgatatagagtcccagccctttatagaggctgtgcgggagatatccctggaggtaggcagggagaacagcctgttcatacacgttaccctcgtccccttcctccgcggctccgatgagcacaagtccaagcccacccagcattccgtaaaggaacttcagggcatgggcataaaccccaatataatagtcctccgctgcgacgagcctctcgaggattccatattcaaaaagatatccctcttctgcaacgtaaagctggactgcgtcatagaaaacatcactctcccctgcctttacgaagcgccgctgatgctggagcagtcccacttttccgacgtcgtctgccgggagcttggcatagacgcgcccgcgcccgaccttgcggaatgggagaacatggtgcggcgcataaaatcccgcgagaaggaagtacgcataggcctcgtaggcaagtatgtacagctccacgacgcatacctttccgttgcggaggccttgcgccacgcgggctatgccctcaatacacatatccgcatacgctggatagactcggagacgctcaccgaagccagctgtaatgagatgctggacgatctggacgggataatcgtccccggcggctttgggggccgcggcatagacggaatgatacttgcggcaaggtatgcgagggagaacggcatcccctatttcggcatatgcctcggcatgcagatagccgtaatagagtacgcaagacacgttgcaggcattgcagatgcaaattccggagaatttgatgagctttgcagacacaaggtcatagactttatgcccggacagagcgaaaatatagataagggcggcacgctgcgccttggggagtatccctgcgaaatagcccccggcaccaccatggagcgctgctacggtacaagccgtatatccgagcgccaccgccacagatatgagttcaacaatgactatcgggatgtccttaccagggcggggcttaccctttccggtatgtccccggacggcaggctggtagagacggttgagcttaccggcaggcccttcttcgtgggcgtgcagtaccacccggagttcaaatcccgccccaacaaagcccatccgctgttcagggggttcatcgcggcggctctggacagagcggagcataagcggtaa

SEQ ID NO: 390 - DNA, 942 bp, Unknown
  Description of Unknown: Clostridiales sequence
atgagcaaaatatacgatgtaatagtgttgggagctggccccgcagggcttaccgccggcctgtacgccggccgcagcagactgtccacccttataatagagaagggtcaggacggcggccagatcgccatcaccaacgagatcgagaactaccccggccagcagcttgagggcgaatccggccccagcctcatcgcgaggatgaccgagcaggccaagaagttcggctgcgagagagtgagcgacaccataaagtccgtggacttctccggcaagaccaagaagatggtgggcaccaagggcgaatatgaggccaggaccgtcatcatcgccaccggcgcacatccccgccccataggctgcaagaacgaagagaagttcgtaggcaagggcatttccttctgcgctacctgcgacgccgccttcttcgaggatttcgaggtgtatgtggtcggcggaggcgacgctgccgttgaggaggccatgtaccttaccaagttcgcacgcaaggtgaccattatacatagaagaaacgagcttcgcgctgccaagtccattcaggaaaaggcattcaagaacgaaaagcttcatttcatgtgggatcacgtcgttgaagaagtggacggcgacggaatgctgagcaagatgatcgtaaagaacaccaagaccggggaactgaccactatcgaggcggacgaggacgacggcatattcggcctgttcggcttcattggcctactgcccaacagtgatctgttccagggcgtcatagatatggagaataactacatcctgaccgacgacaacatgcacaccaacattgagggcgtgttcgccgcaggggatatccgcaagaagtccctccgtcaggtagtcaccgcagctgccgacggcgcaatagctgcgatgcaggctgaaaagtacatagctgatttaaactaa

SEQ ID NO: 391 - DNA, 1215 bp, Unknown
  Description of Unknown: Clostridiales sequence
atgactaaaagggcttattacgaaaacggcgcgctggagtgcgaggctacagtgcttaggtgcagagccgtggagaacggctttgagatacttaccgatgttacctctatttttccggaaagcggaggacagctgtcagatacgggctttattgggaattcccgcgtgacccacgcccgcgaggagggcagcgaggtatggcatctctgcgataaggccgtagaagcgggtgcaaaggtaaagatagccgccgatgccgggccccgcctggaccacacacagcagcacagcggagaacatatactttccggcatggcaagtaagctgttcggagccaagaacgtaggcttccacatggcggaggactatgctaccatagacctcgacacacagctcacccatgagcagataaaggaacttcagcgagaggctaaccgcgcggtgcagcgcaatgttcccgttacatatgagacggttcagggcgaggagcttgagaatatcacgctacgcaagcaggccaagggcctcaagggagatatccgcatagtatattttgacgggggagaggtagattcctgcacctgctgcggcacacatgtagctttttccggcgaggtaggatacataaagataaccgcccatataaaatacaagggaggcacccgcatatggttcgcctgcggcatgcgcgccgtcgaggattcgctgaataatcaggatatcgtggattctcttgcagttcgcttcagcgcaaagcaggaggacgtgctcaatgcagttctgcgtcagggggacgagctcactgccgcaagacatcagctcaaggagcgcaccgagaagctaaacgaattcatagcggcggaattgctcggtaaggcggaggtgataggtgccacaaaacttataatagatatgcagaagggcagctccatgaacgagctgaagaaccttggcgatatgctcataagggacgaaaacgtcctcgcgatgctctttggcgagaacggggacagcctcgtatatcagctggcacgcggcaggaacgtcaagatcagcatgagggagcttataaaggcggtgaacgcagcggcaggcggcaagggcggtggaagagacgagtacgctcagggcagcgctaagataactagcgcaacggatgccgagggcagcatagaaagcctcagaggttattgcaggagcatgctgaaggcataa

SEQ ID NO: 392 - DNA, 696 bp, Unknown
  Description of Unknown: Clostridiales sequence
atgtatggtatagtaaatatatctttgttttgccgttatctggcggcgtttcaggaggaaaaaatgcagaatctcaccgtagatcttctcaagcgcatagccgctgccatagccgcacagttcggcaacaactgcgaggtcgtaatatacgacctcacctgcgaaaacccggaggatatgatactttacatagaaaacggccacgtttcaaggcgcagcgccaatgccggccccagccatgtagttcttgaggccatgcgggacggacgcaaggatatccccgaccactacaactaccttaccaagacccacgacggccgcattctccgctccagcacggtatacataaaggacgaaaaagacaaggtcacaggcatattcgccataaactacgacatgactgagcttatgatgacgcagtccgtcataaacgccatagtgcaaaacaacccgggaggggaaccggagcgcatacccaccaacgtgaacgagctgctggacgatctcctcgagcagtcggtacagctcataggccgcccggttgccatgatgaacaaggacgacaaggttaaggccatacgcttcctcaacgatgcgggcgccatgctcataaccaagagcggcgacaagatagccaagtacttcggcatcagcaagtacaccctatactcctatctggatatcgccaaccagtga

SEQ ID NO: 393 - DNA, 1155 bp, Unknown
  Description of Unknown: Clostridiales sequence
atggaggaattaaaacttccagaacgctttgaggaatactcagaaggacggaaagccggcttccttaagatgaaggcggcaaaggaaagcggacgtaaggtagcaggctacttctgcacctataccccgctggaggtgctggatgctgcgggcatgctttcggtgagcctttgcggcatgagcaacgaaactatcccggcagcggagacggttcttcccaaaaacttatgcccccttatcaaatccagctatggttttgccattacggacaagtgcccgtatacctattggtccgacctgatcgttggcgaaaccacctgcgacgggaaaaagaaaatgtacgacctgctcgggcagcgcaagaaaatgtacgtgcttcagataccccaggggatagaccgcacatattcccgccagctttggatcagtgaggttcgtcgctttatcgattttataagcagagaagccggcgttgaaataaccaacgagatgctgcgcaaagccgctgacaggcgaaatgagctgcgccgcgcccgatcggagcttatggagcttcagcgcctttcccctgtgcccatctccggacagaagctttataaattcttggaagggcttaattataattttgaccttgaagatgccatagcttccacccgcgcccttacagctgaaatacgcaaggcatatgaggaagctgacgatataagaaaagaagaaaggcggatactgattaccggatgccccatcgggggagtgttggaaaaagtcgtgggcgccgtggaacgcagcggcggcgccgtcgtctgctatgaaaactgcagcggcattaaggccgcccgctgtttcgtggatacggaacgggaggatatggcggaggccattgccgacgcgtatcttaatatcggctgctccgtaatgtcgcctaacaccagacgcatggaaaacctgcctgagttgatccgggaattcggcgcggagggcgtaattgacgtaacccttcagacctgcaccacttacatgatagaaacacgggccatccgcaagctgtgcgaaggactgaacataccctacatgtcgctggagactgactattctcaggaggatgcggggcaaatcgacacgcgcatatcggcgttcattgagacgctatgctga

SEQ ID NO: 394 - DNA, 1026 bp, Unknown
  Description of Unknown: Clostridiales sequence
atggacgacagacttataacctcttccatgacaatggaggacgagcagatagaatacagcctgcgccccaggtttcttaacgagtacataggtcagcataacgtcaaggaacacatgcgcatatacatagaggcggccaagcacagaggggagcccctggaccatgcccttttctatggcccgccgggtctcggcaagaccacgcttgcggccatagtcgcaaacgagatgggtggcaacctgcgggtaacgtcaggcccagcaatatcccatgcaggtgaccttgcggccatacttacaaatctcgcccccggcgacgtgctgttcatagatgagatacacaggctgaattccagcgttgaggaagtactgtatcctgccatggaggattattccatagacataataataggcaagggtccatccgcccactctatacgtctggatcttccaaagtttaccctcataggcgcaacgacgcgtatgggcatgctcacatctcccctcagggacaggttcggcataaaggagcagcttgagctgtacaacccggaggagctgaaggaaataatcgagcgcagcgcggatatactcaacgttaagatagacacagagggtgcccttgagatagcctcgcgctcccggggtacaccgcgaatagttaaccgcctgctaaaaagggtgcgtgattacgcacaggtgcggggcaatggcgagatagatcttgagacagcccgggctggcctggatatgctggccatagatgagatgggccttgacgctgtggacaggcgcatgctcgccaccatgatagaaaagttcggcggcaggcctgtaggccttgataccatagccgcggccacaggcgacgacgccaccaccatcgaggatgtgtacgagccatatctcatacagctgggcttcatcgcgagaacgccccggggccgcgtggtgatgccgctgggataccggcatatgggttacgcgccgccggctgatgtgggccaacagaagatgaatttttga

SEQ ID NO: 395 - DNA, 1128 bp, Unknown
  Description of Unknown: Clostridiales sequence
atgggaaacaacgacgtattcggccttatatacacgggcgaatccagtatgcagctccgcgatctgacctactcaaggtcggttgccgcggtgccctttgcgggcagataccgctgcatagactttataatgagcaaccttgtgaacacgggcatttccaacgttggcataattgcccagaagaactaccactcgctgatggatcatctgggctccggcaaggaatgggagctgcacaggaagcgggacggcctgttcatactgcctcccttcgtgaccagagacaataccggcatataccggggtaccatagacgcataccattccgtgatgggctacatacggcgcagctcccagaagtacataataatctccggcagccacaccgtattcaataccaccttccacgacatgatagcccagcacatacgcaccggggccgacataaccttcatgtacaatgaagtcggcatacatcacccggacgaccagttcaacgagctgcgcttcaatctggcggaggacggcagggtgaccggcatacagctcaacccaaaccagcccgcaacgccccattcctcctgcgacgtggtcatgatggaaaagacgacgtttgaatacctcatcgaggacgcatacagcaggggggataccgactttctcagggatgtgctccttcgcaaggtaggagagcttaagatgtacggctggaggtacgacggctacgtgggctgtataagctcgctgcccggctacttcaaccacaatatcaacgtgctcaaaagcgaggtgagacgggatcttttcaatcccgagcaccccatatacaccaaggtaaaggacgaggtacccgcccgatataagggggactccagggcccgcaactgcctggttgcagacggctgcgtgatagagggagaggtggaaaactgcgtgctgttccgcggcgtgcatataggcaagggaacaaagataagcaactgcgtagtgctgcaggcctgcgacatacaggaagactgcgagctatcgtatgtaatactggataagggctgcaccgtccgccagggacgccgtcttgcgggctacgacagcttccccataataatcagaaagggcagtacggtttaa

SEQ ID NO: 396 - DNA, 909 bp, Unknown
  Description of Unknown: Clostridiales sequence
gtgcggcaaaggaagaacgtcttgaaatgcgccggcatttgggggataataaaactaaaaaataaaggagctggccccatgagcatcgcagacaggatattcatagaaaattgcagggatataatatcaaacggcgtatgggataccgataggccggtgcgcccgaggtgggaggacggctcccccgcacataccgtaaagctcttcggcgtggtgaaccgctatgatctgtcactggagttccctattatgaccctgcgcaagacaggcttcaggaacgcaatagacgagcttctatggatatggcagaaaaagtcaaataacatacacgacctgcacagccacatctgggacgcctgggcggacggcagcggcagcataggcaaggcctatggctaccagctgggggtaaagcaccactatcccgaaggggatatggatcaggtggacaggatactttacgacctgaagcacaatcccggctcccgcaggataatatccaacatatacaatcacgccgatctttccgaaatgcggctgtatccctgcgcttacagtatgaccttcaatgtatctggcaatcggttgaacgccatattgaatcagcgctcccaggatatgctggtagccaacaactggaacgtatgccagtatgcggtattggtttacatgatggcacaggtgagcggcctcgaggcgggaatgcttatgcacgtgatagcagacgcacatatttacgacaggcatgtgccgctggtggaggagctcatctcccgtgagcccctggacgcgccgaggttcattatcgataagagcatagacgacttttacaagttcaccgtggacagcttttcccttgaagggtatgagtctcacggcagtataggtaagataccggtggcggtgtag

SEQ ID NO: 397 - DNA, 909 bp, Unknown
  Description of Unknown: Clostridiales sequence
attaaggggctgcggccccttaataaccccgtggcttttcgatatatcgaaaaacaggaaataggagaattaagaatgtcctttgaatttacccttcgtccccggactacagaaagccagcgcaggctgctggagatacccgttgaaaagatagtgccaaaccccaaccagcccagggtcacattcgacgacgatactatagccgagcttgcccagagcataagccaggtaggcctcatacagccgctggtggtgagaaggagcggctccggatatgagctggtagccggcgaacgccgcctgcgcgcctgcaagtctctgggaatggagaccgtcacctgcatagtagaggactcaatgcaggaggaatcctccgccatggtggcactcatagaaaaccttcagcgggaggacctgcactacatggaggaggcacagtgctactacgccctgctcaacaactacaacctcacccaggaggagcttgcaaaacgacttggcaggagccagtcctccatagcaaacaagctgcggcttttgcggctctcgcccgatgtggtgtccgccattcgtgagaacggcctttcagagcgccatgcccgggcggtgctcaagctaaaggacgaggaggtacagctggccgtcataaagcgcacggcggaaaagaacctctccgtcaaggacaccgagcggctggtggagaagaccctggataagatgtacgacgaaaagcgccccggcgcggccccccgccctgccataatacgccaggtgcgggactaccggctgtttatgaacaccgtcaattcggctatcgccgtgctgcgggaatccggcatgaacgtggaggtggagcaggaggatcttcaaaacggcgtggatatacacataaggataactaacgaataa

SEQ ID NO: 398 - DNA, 948 bp, Unknown
  Description of Unknown: Clostridiales sequence
gagacaagagctaatatgtccttttcatctcagacaaaagatgagcttgtggaaagctgcaagctgggaagcacagaagagaaacgctccctgctttgcggaataacccatgcggccggctccatgacgctggggcgtggcggcataggcctgcaatatataaccgaaaacagcagcgtcgcggcgcttacggtacgcctcggccgggagctttacagcgtcaccgccgaaacctccataagtgaaaaggagaggctcaatgcggtgagcaacgtagtgaagttcacgggcgatggcgtgaggaatcttctgaacgacgcgggatacggggtagacggcgacgaggattttgagctgggatacataccgccgcgacttaccgatgacgaaagcaaggcaaaggcgtttttgagaggtgtgtttctgggcgcaggctcggtgagcgatcctaataagggataccatttggagctcgtgtgcagatacgaaaagtttgcagcgacactgtgcgacataatggcgggccttggcataagcgcaaagttcttgccgagaaaatccagctatatagtatatctcaaggatggggagctggtttccgacttcataaccctaataggcgccatgaacagcaccatggcctttgaggaggcgcgggtaatgcgcagcgtaagcaaccatataaaccgccaacagaactttgaggacgccaatatgaacaaggcggcagcggcagcggcgcagcagcttttggatattgagttcatacggctcaatgccggcctggacagcctgccgccaaagctcaggggagcggcagagcttcgcataaacaacccggaggccacattatccgaccttgcggaaatggccgagataagcaaatccggccttaaccacaggttagccaagctttcaaccatagcgcaggagctcaaggacaaatag

SEQ ID NO: 399 - DNA, 930 bp, Unknown
  Description of Unknown: Clostridiales sequence
tcggagttttataatgagtttgtatatagcggccgtgggaagtttttcccgaggcgtaacgataaggagcaggtaatgcacgatttttttcgcagcaagggctttttgataatactgataataatagctgtgctgtctatattcatagcggccacataccgggacagggcaaaggtgtcctttattgaggatacggtaaactctgtggtcaagccggtacagagcttttccgttaaggcgtccaattccataatacacttttttgagagggttttcagctctacggatcttgataaggaaaacgagcagcttagggtaaagctggctcagtacgagataatcgaaagcgagctggagacgctgcgggaggaaaactcgcgcctcaaggatcttttgaattacactgatattaccgataactacagctatataacctctaccgtaataggcaaaagtcagggtatatggttcagtgaatttacggtaaatgccggccgtaaggacggcgttgaggaaaatatggcggtagtaaactcgcaggggctggtcggccgcgtaaacagcgtcagcgcaaatacctgcaaggtgaccgccataatcgacagcacctctgatataagcgccatggtggagcgcacacgcgactacggctttgcgcggggtatacttaataccgacgaaaaggagacgctggagctttactatctgccaagcggctatgacctggttcccggcgataccatagttacctcgggcataggcggcacctttccaaagggcatagccataggtacggtgaccgaagtatcccgctccagtgatgacgcggaggaaaggaacgccataatcgagccggcggtggattttctcaggctcgaggaggtaatgatagtaaaggtcgataccaaagaggaggaaacgacagagtaa

SEQ ID NO: 400 - DNA, 690 bp, Unknown
  Description of Unknown: Clostridiales sequence
tcagtaaataatcgcgattataatctaaatcaaggaggggccctcatgcgagaggatcttacccaaaggcgtttcatcgaggagacctaccgtataatatcgaccgaaggccgtgaagccttgagcattcgccgccttgcgcgggacatgcgctgcaacagcgccaacatctaccgatacttcaaggatcttgacgagctggtgacgtacgcctcactgcgctaccttaccgcgtatctgggcgacgttgcggtgtgttacgccaaatccgaaactacataccagacccacgtagcggtatgggattgcttctcccaccacgccttcgcaaacggcccaatcttcgataacctgtttttcggccgccacagccgcatgctgaacgatattatcaagaactattacgccatgttccccgaggatctttccggtctctccccctccatcgccaacatattcagcgaaggcagcttcaacaacagggactatctcatgatatcccgctgcgtagacgagggatggttcacggaggaagacgcaaagtttctcaacagcttctccatacacctttttctcggatacctcaaggagctattgcagaaggaaccttcggagaagctttcaaagagttaccatgacgatttcatggctactcttgtcaagatcatggattatttccggctgaaatag

SEQ ID NO: 401 - DNA, 2403 bp, Unknown
  Description of Unknown: Firmicutes bacterium sequence
ttgactgaaaccatttttgcagggaaaatgcccatccttgctttgcggggactgtgcgttttccccgaacagaccgttcattttgaagttggccgcagcaagtccgtaaaggcgctggaagcggccatgcagggcgaccagacgctgctgttgatccctcagaaggatttgctggtggacgacccgacgctgaaagacctgtatggcgtcggctgtattgccaaggtcaagcaggtgctgaaaacgcagggagagaatctgcggattctggtcaccggcatcagccggggcaagatcaccgagctgtctcagagcgagccgtacctttccggcattgtggaatcggcgagtgtggaggaaccggcggacaccattcgcgcccgcgcgctgcgccgggaggccaattccctgtatggcgtgtatctggagctgtgcgagcatcctgcccagaccgttcagctgcggatgctggccagcgagagcagcggctttattgccgactctatcgcccagaattccggcattgacttcccggacaaggcgaaaatgctctgccagctgaacagcgtccgccgtctggaaactgccgtccagcttctgcgccgggaggtggagatgctccggctggaaggggatattcaggagaagacccgcgccgccatcgaccagaaccagaaggactacttcctgcgcgagcagatgaaggccatccgtgaggagcttggggaagaggacgacgaggacgaatttgatacctacgcccagagcattcagaatctccatctggaagaggaaacggagaagaagctcctgaaggacgtggagcggctgaaaaagcagcccttcggttcttctgaaggagcggtgctgcggaattatctggacactgtgctggagctgccgtggaacgtcaagaccaaggagcgggtggacgtggccgctgcccggaagattctggagcatgaccatttcggactggaaaaggtgaaggagcgaatcttagaaaccatcgccgtccgggaaatggcgccccagatgccgccacagatcctgtgtctggtaggccctcccggcgtgggcaagacctccatttcctattccatcgcccggagcctgaaccggaaaatggcgagaatttctcttggcggcattcacgacgaggcggacatccggggacaccggaagacctacgtcggcgcaatgcccggccgtatcatgaccgccatgacgcaggcgggtagctgcaatccggtgctgctgctggacgagatcgacaaattgggttccgactaccgcggcgatcccagtgctgctctgctggaagtgctggacgcggaacagaaccacgactaccgtgaccattatctggaaattccctttgacctgtccgacgtgctgtttatcaccacggcgaatacgctggacaccgtgccccggccgctgctggaccgcatggagatcatcgagcttggctcttatacggatgaagaaaagttcatgatcgccaaggatcacctgatccccaagcagctgaaaaagcacggcctgaaaaaggcacagctccgcatcacggacgacgccatccgggagacgatttcctgctacacacgggaatccggcgtgcggaatctggagcgctgcttcggcgagatctgccgaaaggcggatatggagattctttctcaggaaacgccgaagaagatcaccgtcaccggcggcaatctggaaaactatctgggcgtgcgcaaattcctgcccgaccgcctgccctgcaccgatcaggtggggctggtcacgggacttgcatggacgagcgtcggcggcgaaacgctggaggtggaggtcaacgtcatggacggttccggcaagctggagctgaccggcaatttgggtgacgtgatgaaggaatccgcccacgcggcgctgagctatatccgcgccaacgcccagaagctgggcgtcgcaccggacttctacaagaccaaggacattcacgtccatttcccggagggcgcagtccccaaagacggcccctcggcgggcgttaccgtctgcacggccattgtctccgccctgacgggggtcagcgtgcggcgggatatcgccatgaccggtgaaatttcccttcggggacgggtcatgcgcatcggcggtctgcgggagaagaccatggcggcacttcgccacggcgtgcgcaccgtcatcattcccaaggacaacgagcgggatttggaggaaattgaccagaccgtccggcgtcagctgaattttatcagcgcccagactatggacactgtgctttccgccgcgctgaaccggccttcggaggccagccccaccattctgacggagcttcccggggacgtgcgtaccagagtgcaaaagcccggcctgcgccagtaa

SEQ ID NO: 402 - DNA, 1695 bp, Unknown
  Description of Unknown: Firmicutes bacterium sequence
atgatttcatcattttatttaagccgtttcacggcagaccgcctgggcggcggtaagaaatgtattgacttcgtttttttgcggcaatggccgccggccgcaatcctgcggcctaataaaacgcttttcagcgttttattaaaaactcgtataaaaggaggccgcgccggaatgaaagaccgaagctatattgccatcgacttgaaatccttctacgcctccgtggagtgcatccagcgtgggttagaccccatgatcaccaatctggtggtcgccgaccccagccgcaccgacaaaaccatctgccttgcggtctccccttctctgaaatccttcggcattcccggcaggccgcggctgtttgaggtcgtacagaaaatcggacaggtcaacgcgctgcgccggaattccgccccgggacgcacttttaccggcaaatcccacgactacaccgaactgcgcggtcacccggagctggaggtggactacatcgtcgcgcccccgcagatggcgttttatatggagaccagcgcggccatttacaatatttatctcaaatacgtcgccccggaggacatccacccctactccatcgacgaggtgttcatcgacgccacaaattacctgaatctctaccgcctgactccggaaaagctcgccatgaagatcattctggacattctggaaaataccggcattacggccaccgccggaatcgggacgaatctgtatcttgccaaagtagccatggacattgtggcgaagcacattcccgcagacaaaaacggcgtgcgcatcgcccagctggacgagctgcgctaccggcaggagctgtggtctcaccgtcccctgacggatttctggcgggtcggccccggctacgcgaagaagctggaaaaggtggggctgcgcaccatgggcgacgtcgcccggtgttccgtgggcaagcctacggaattttacaacgaagacctgctgtataagctgttcggcgtcaacgcccagctgctgatcgaccacgcctgggggtgggagccgtgcaccatcgcggacatcaaggcatacaagccggagtccagcagcatcagccccggtcaggtgctgcaatgcccctataccgctgaaaaggcccggctggtcgtcagggaaatggcggatgatctttccttggacttagtagacaaaggacttgtcaccgaccagatcgtcctgacggtgggctacgatattgaaaatctcaccgacccggaacgaagccgcgcctatcagggccccgtcaccgttgaccgctacggccgcagaattcccaagcacgcccacggcaccgtgaatctgggcgggcataccgcttcctccaaggccatcgtcagtgctgttgcagaactttacgaccgcatcgtgaactctgctcttctggtcaggcggctgtatctgtccgccaaccacatcgtcccggagaactccctgccccgccatgaaagcactgagcagctggactttttctccgatttcgcttctcaggagaagcgccgcgccgaagaagcagccgctcgtgagcgggaaaagcgccgccagcaggcggtgctggccatcaaaaagaagtacggaaaaaacgccattctgaaaggcatggacttggaggaaggcgcaaccgccagagaccggaacggtcagataggaggacacaaagcataa

SEQ ID NO: 403 - DNA, 1251 bp, Unknown
  Description of Unknown: Firmicutes bacterium sequence
atgtttctcgcattccaattatcggacatcataaccgtgccgtttgggtggctgctgtcagtcctgtatgaaacgacccacaactacggcgtcgccatgatcctgttcgccgtcatcgtgcagctgatcctgctgcccctgaacgcgaagtccaagaagagcatgatgaagatgtcccgtctgacgcccaagatgcaggccatccagcagaaatacgcggatgacccccagcgtcagaatcaggccattcaggaacttcagaaatccgagggcgtttccatgggcggcggctgcctgtggagcttcattcccattctgattctgttccccctgttcgccgttatccgccagcccatcacctacatcctgatgcagtccgccgacacggcgaagcagatcgtggaggtcattaagacggctgcgccggatatgttcacttccaatgctgcctacgagcaggtcgtcgctgcgcagctgattcctcagtatgcatctgagctgcgcgccgccatccccgacatcagcgaggtcgttctcgccggtatcaatttcgattttctgggcattaacctgggcgctgtgccccagttcaatgtcttctccgccagctgggtgtgggactgggcgcacatcggtgcgttcctcatcgccctgacctctgccgcctgtcagctgctgcagatggtcatcagccagaagaccaacgactccgtcatcaccgacgagaagggcgttcaggacaaagagaccgccaagaattcccagcagaaccagtccatgaaggtcatgatgtggatgatgcccctgatgtctctgtggatcggcttcaccgtttccgccggactgtccctgtactggttcatcggcggcgtggtgagaatgatctccgaccccattatgaccagccactaccgcaagatctatgacgcggaggatgccgtgcgcctgcagaaggcgctggagcaggagcgcatcgaagccgagaaggagcgcgtccgcgccgagcgccgtgcctccaatcccgacggcatcaccgccaacaccagcaagaagaagctggaaaagcagcagcgggatcaggagcaggccgccaaggccgcggctgccaaggagtacgccgcccggaagggcattgtggaggaagccgcgagggaagaaaacgcgcctctgtccggtgtctccgaccgtcccttctgcaagggccgcaactatgaccctgaccgctacgcgcccaagtctatggaggaataa

SEQ ID NO: 404 - DNA, 1818 bp, Unknown
  Description of Unknown: Firmicutes bacterium sequence
atgtgtggaatcgtaggatttacaggcacgcagaacgccgcgccggtactgcttgacggactttcaaagctggaataccggggctatgattccgccggaattgctgtggtgcaggggaaccgaatcgccatcagcaaggtcacgggacgcattcagaacctccgggaaaagacggacgacgggcggctggttcccggtaccaccgggatcggccacacccgctgggcgactcacggcgcgcccaacgatataaacgcccatccccatgccagcaatgacggaaaattcgccgtcgttcacaacggcattatcgaaaactacatggagcttcgggaagaactgctccggaagggctatcgtttcgagagcgagacggacaccgaggtcatcgtccatctgattgaaatgtactatgccggcgatttccggaaagccgtcatgaaagcttcttcccggctggttggctcctacgctctgggaattgtctgcacggacacgccggatacggttctcgccgtccgggaggcaagccctttgattctcggcgtgggcatcggagagaatttctttgcctccgacgtcaccgcgctggtggcgcacacccggaacgtcatctatctggaggacggcgagcttgcggagctgacgcccgactccattcaggtctacgattgctcaggccaccccatcaccaagaaggccagccgcatcacatgggacatccaggcggcggaaaagggcggctacgaccacttcatgctcaaggagatcatggagcagccccgggcggtggaagcgaccatcacccccagaatccgaaatggggagatcgttctggacgacctgaacatcgatctttcccaaatccataaaatcgtcattacggcctgcggctcggcctattatgccgggtgcgcggggaaatataccatcgagaagctgtgccgtatccccgtgactacggagctggcaagtgagcttcgctacgcagaccccctgattgacgggcatacgctgctcatcgtcctgtcccagtccggcgagacagcggataccattgccgccatgaaggaatgccagcgccggggcgcaaaggcgcttgccatcgtgaacgtggtgggcagtaccattgcgaaaatcgccgactacaccctgtacacatgggcaggcccggagattgccgtggccaccaccaagggctacaccacccagctgacggtgctgtacctgtttgccctgtacgcggccaaatctctggggactgtcgaggggaaggagtacaagcggctgctcacggcgctgcgctccctgcccaagcagatgcagacggcgctggacatgaaccctgccattcctactctggcaaagaaataccacagtagcccctccatgttcttcatcggaagaaacaccgactacgccgtcgctctggaaggggcgttgaagatgaaggagatctcctacatccacgcggaatcctacgcggcgggcgagttgaaacacggcaccatcgccctgatttacgaggggcagccggtgatcgccctgtgctgcaacgacgcggtcatggagaagaccatgagcaacatcgtggaggtcaaggcgcggggcgcggaggtgctcgcggtggccttcaaggggaacgggaagatcgtttctctggccgacgacatgatctttgtgccgaaaatcgatccgctgctgtgcgcagtggcagaaatcgtcccgttacagctgctggcctattacgtggccaaggaaaacggctgtgatatcgacaaaccgaaaaatctggcaaaatccgttacagtagagtaa

SEQ ID NO: 405 - DNA, 2355 bp, Unknown
  Description of Unknown: Firmicutes bacterium sequence
atggaaaagagcaatatccacgagaaaatcaaacttctgacgggaagcggcatgtggcacacgcaggaggtggagggcttgccctccgtccatctgtccgacgggccgcacggcctgcgcaagcaggaggaaaaggagcgccagaacaacgtcagtctggtgtccacctgctatcccacggccagcgccttagcctgttcgtgggatgtgaccgccgccgagcggctgggaagggcggttgcgaaggaagcatggaacgcggacgttgccgtgctgctggggccgggcatcaacatgaagcgttcccccctgtgcggcaggaattttgagtatttcagcgaagacccctttctggccggacggctgggcgcggcctatgtcagcgccgcccagggcgaagacgtggcggtctccctcaagcatttcgcggccaacaaccaggagaccaaccgacagaccgccaacagccagatcgacgaacgcgccctgcgggagatttatctcagtgcctttgaatacgtggtgaaaacggcacgccccgccacggtcatggcgtcctacaaccgcctgaacgggtattatgcctgtgaaaaccgtcacctgctcacggaaattctccgggaggaatggggctttgacggggtggtcatttccgactggggcgcctgcgcggacttggcgaaagccgtgaaggcgggcatggacctggaaatgccggacagccacggaatccatgcccggaagctgaaagcggcgctcaaggcgggggaaatctcagaggaagatatcgccaaggccgccggaagaatcgaaaaactggtgaaaaagtacgcgccggacaacagagcgaaaaaggatacgtcggacgcccacgagattgcaaagcagcttgcctgcgaaagcgccgtcctgctgaaaaacgacgggatactcccgatttctcaggatgcggacgtggtggtcatcggcgctctggcggagcagatgcgttttcagggcggcggcagcagccatatcaacacggccagcttccccaatgcgctggacgcgctgcggaagctgggggtgacggtcacttacgcgcccggatattctctgaaagacgaggaaaaccgggaattggaggaacaggcgctggctctggccgcaggtcagaaaacggttctgtttttcggcggcctgaccgaccagtacgagggggagggctacgaccgggaaagccttgccatgcccgcaaaccagctgcatctgctgaacaaaatctgcgaagtgagtcccaatgtggcggtggtgtccttcagcggcgcaccctatgacatggcctttgagaacagggtgcggggcattttacagatgtacctcggcggcgaggccgtgggggaagcctgcggcgagctgctgacgggtcgggtgaatcccagcggaaagctggcggaatcatggccttacgcggtggaggacacgccatgccatggattttttgccaccggcagcgacgacatcgaataccgggagagcatctacgtggggtaccggtactatgacagctttgggattccggtgcggttccccttcggcttcgggctgagctacacgacctttgcttacggcaatccggaactgagcagcgaaatctacgagggcggaaagctgcaagtttctctggacgtgaccaacaccggcagcgtggctggggcggagatcgtggagctgtacgtggaaaacccgcccgccgattatctgcgggcaaagaaggagctgaaaggcttccaaaaggtcatgctggcgcccggcgagacgaagcgggtcacgatggagctggacgaaagaagcttctccatcttcgacgaaggccggttccggatgatcggcggtacataccgggtgcttatcggaagctctgtgcaggatatccgtctggcgcagacggtaacggtgcagggcgaagcctgtacgcgcaatgaccgggagagactttccgactacttccagaaagatctgcacggcgtgacccggcagcagttcgcggcgctttacggaaagcccctcagccactttgacgaccggaagccgggggaatacagcctgtatgactccctgaaccagctggcggaagcgtcccccattgcgagaatggtacgcaaagcggcgcggccgctggtgtattccatgttcaagggcatcccccacgatgatccgcaggtcgttatggtcctgatgggcatggaaaacggcatgatcgacagcgtggtgtgccagagcggcggaatgctgcccatgcgggtggcggaagccatggttttgcaggcgaacggccatcgcggcaaggcgctccggaagctcataggggggtaa

SEQ ID NO: 406 - DNA, 2226 bp, Unknown
  Description of Unknown: Firmicutes bacterium sequence
ttccgccgtttccgatacctcgattggacgaaaaatctcgcgctcacagctcttgccgatttgttcagaggttcccttgacattccgtgttataatagcgttgaatccaaccttccctcagaaaaggagcagcctatgtctaaaggcaaattttccaccccccggccataccgggaagaagaacgtgaaatcgaaaagagcttccgccagctgaccggtcaggagaagcccgcgaagccggatgaccccatcttctccgaagcctccgtccctgatctggacaccaccgacccggaggccgccgaccttatcaccgaggccgacagcctgtttcccgaagagaacagtctgttttccggagaagacagcccggttcccgacgaggaactggacttttcactggacgagaaggagaaccccccgaagcgcggcactccgtccttccttgataaggctctttcctttgtggacaacaaccagaagcccgtgatggtggctctgtgcgccgccgcgctggttctgatcatttccctgattgccattttcgtcgtcaacgtctccggcgacccctacggcaaaaaaattctgaacaatgtcaccgttgccggtgtgaacgtgggcgggatgagcaagtccgatgccatcaccgccgttcgcgctgttaccgaccagacctacacgaagcaggccatggtggtgactttgggcgataccaccttacagctgtcccccagcgataccggcgcgaagctggacgtaaaggccgccgtcaacgccgcctatgcctacggcagaaccggcaccaaggccgagcgtcaggaagcctatcaggcgtccctcaggagcaaccacatcatcgggctgctgccctacctgaacctgaagcaggattatatcaagggcgttctggaggactacgccgggactgccggcagtctgctgacccagaccacctacgccctggaaggcgacgtccccgatcttgcgacggacaaatttgacgaagaacacgcccctcagctgacgctggtcatcacaatgggaactcccggcgtaaatttcaacgtagatgatgtgttcaaccagattctggacgcctacagcatgaacgttttcaccgtaaaggcggagggcgcgcaggccgagggcgaaccggatgccgttgatttgcagaaaatttacgacgatgtctgcgtagagcccgtggacgccaccgtcaatatgcagaccttcaaggccatccccggctcctacggctacgtgttcgacatggtgcaggcgcagaagcaggtcagtgcggcgcagtacggcgaggtcgtccgcattcccatggaatatgtcgccccggaaattctggacgacgacgtgttcttccgggatgttctgggcagcaccagcacgccccacagtaacaacgccaaccgcaccgccaatctggagctggcatgtaaggcgctgaacggcgtcgtgctgaaccccggcgagaccttctccttcaacgacactttgggcgaacgcaccaccgcaaagggctacaagtccgccccggcatattccggcgacgatctggtgaatcaggttggcggcggcatctgtcaggtctcctccacgctgtattgcagcaccctgctggccgatctggaaattgtctcccgcaccaaccacggtttccccgtgaactatatcaattacggcatggacgccaccgtcagctggcgctctcccgacttcaagttccgcaacaacaccaattaccccattaaaattgaggcaagcgtcagcggcggctatgtcaatgtgcagatcctcggcaccgacgagaaggactattacgttgaaatgagctatgtcgtctccgagacctacaagcccgagacggagtacaaggacttcaagcccgacaaccctgagggctacaagaacggagacgtgattgaggaaggcaccaccggctatctggtcaagacgtacaagagcaagtacgacaaggccaccggcgtgctgatctccaaggattttgtcgccaattcccggtacaagacagtgaacaaggtggtcgcgcgggtcgaagagccgacagaacctacgaccgtacccacaacgccgtccaccgccccctctaccgaacctgccaccacacccacggcgccgtctaccacaccgcctaccacgccatccacttccgagccttccactaccgaagcctcggagaacggcggtgaatga

SEQ ID NO: 407 - DNA, 945 bp, Unknown
  Description of Unknown: Firmicutes bacterium sequence
cctatgacccccatcgaaaaggaaatcgaaggcattgtggatggcgttctggaggattaccgccacggccgggacatcgacaagcttgaccccttccagcacccggacaaagctgtggtcattgacatgatcggcaagcttctgcgcattgtctaccccggctcctcccgggacaaagcctaccgcatctacaacaccaagcacaacctctccatgctcattgaggacgtgatgtacaatctgaacaagcagatcgctatcgccctgcgggtcgacaggacggagcgggaagcgcaggaaacggcgcaggagctgagtttgcagttcttccgggcaattcccggcatccgggcggtggcccagacagacgtggaggccttttacgacggcgaccccgccgccttcagcacggacgagatcatcttctgctaccccggactgtttgccatcacggtgtaccggctggcgcacgtgctgtatatgctgaaagtccccatgctcccccggatcatgacggagcacgcccacagcgtcacgggcatcgacatcaaccccggcgccaccatcggccggtatttctttattgaccacggcaccggcattgtggtgggcgagaccacggtcatcggcgaccatgtgaaggtctatcagggcgtgacgcttggcgcgctgaccacccggggcggacagagcctgcggggaaagaagcgccaccccaccatcgaggacaatgtgaccatttacgccggcgcgtctatccttggtggcggcacggtgatcggccgggacagcgtcatcggctccaacgtctttatcacccattccatccccccctgcaccacagtgagcgtcaagagtcaggagctgcagttcaagccccggaactgcgaaggaaactgcgcctcatgcaccaagccggaacccttctgggaagggcagaaataa

SEQ ID NO: 408 - DNA, 1077 bp, Unknown
  Description of Unknown: Firmicutes bacterium sequence
atgactgtgcgggaagaactggaatggcaggagcataagcgactgaatcctctggcggccttcgccgaccagagcaggggacgtctgaggtttgaagaaccccgggcggaggacgtgcgtacctgttaccagagggacattgaccgcattgtccattccaagtccttccgccgcctgatgcacaagacgcaggtgtttttgcagcctgagggcgaccactaccgcacccggatgacccacacattggaggtcagccgcattgctggaaccatcacacgggcgctggggctgaacgaagatctggcggaagccattgccatggggcatgacctgggacacactcccttcggccacgccggggaggacgttctgagccagtgccttggcaagcctttccgccacaatgagcagagtctgcgagtggtggacattctggaaaaggacggtcaggggctgaacctgacctatgaagtccgcatgggcattctgggtcacaccggggattactggccggagacgctggaggggcaggccgtgcgtcgctccgaccaaatcgcctacgttaatcacgacattgacgacgccatccgggcgggcatcctcaccgacgacgacattcccatcgaaatcaccgacgtgctgggccacagtcaccgggacaggatcaacacactggtctgcgatgccatccgcacctcccgggaattcgggaaagtctgcctgtctcccgacgtggacagggcgctcaaggagctgcgctcgttcatgtttaccaatgtctaccgcaatccggtggccaagggcgaggagagcaaggcaaaggatatgctgaagcggctgtttgaatactacatcgcccatccggaagcgctgcccgaggattttcagccccagctgagcttcgacggcatggagcgcacggtgtgcgactacatagcgggaatgacggacaattacgccgtcgaaaagttccgggagatcttcatccccatggggtggcaggttcacggtagagaatacgtaaagaagtttgacgaaaggaggggagaccatgccatttccaccggcatttattga

SEQ ID NO: 409 - DNA, 2388 bp, Unknown
  Description of Unknown: Firmicutes bacterium sequence
atgaaactcaacagaaaatggctgaacgaggaattcgtagacctgtctaacgtctccgataaggagttcgtggaaaccctgaccgtttttggtcagaaggtggaaacctgggagcggctggacgcggagatcaaaaacgtggtcgtgggcaaggttgtgtccatggtgcgccatcccaactccgatcatatgtggatctgtcaggtggacgtgggcggcgacgcccccgtgcagatcgtcaccggcgcacagaacgtccacgagggcgatctggttcccgcggcactgcataactcctggctccccggcggcgttcacatcaccaagggcaagctccggggcgaagtgtcgggcggtatgctctgctccttcgccgagcttggtctgacccagaacgacctgcccggcgtgttcgccgacggcatctggatcctcaatgacgaggactgcacggttggcgaggacatcaacctcgtcatcggcaacgacgacaccgttgtggattttgagatcaccaacaaccgccccgactgctacagcatcatcggccttgcccgggaagctgccgccgccttcggcaagcccatgcgtcaccacgagcctgcggtgcacggctccgacgccggggatatttacgaccatctggacgtggacgtccccgcaacgaagctgtgcaaccgctacacctcccggatggttgccaacgtaaagatcgccccctcccccaagtggctgcgccgccgcctgcgcgccaacggcgtgcgtcccatcaacaacatcgtggacatcaccaactacgtcatgctggaatacggccagcccatgcacgcctttgattaccgctacgtttcctccggcaagatcgtggtgcgggaagccgaggacggcgagaccctgaccacgctggacggcagcgtgcgcaatctgaaggccggtatgctggtcatcgccgacgaaaataagcccatcggctttgcgggtatcatgggcggcgaaaactccgaaatcaaggacgataccgccatggtagtcttcgagtccgccaacttcgacggcacctccatccgccagaccgctctggcgctgggtatgcgcaccgaagcctccggcaaatttgaaaagcgccttgacccaatgatgaccgtccctgccgtgcagcgtgcctgcgagcttgtggaaatgctgggctgcggcgatgtgctgaacggcaccatcgacgtcatcaactatgtccctgaggaaaagacgctgcctctggagccggagaagatcaaccggctgctgggcaccgacatttccaaggaagatatggtcaagtacctgaaccggctggaaattcccgtggagggcgacaccattctcgttccctccttccgtcccgacctgaacctgatggcggatatcgccgaagaagtaggccgttcctacggctacaacgagattcccaccaccgccttcaagacctccacgcagggcggctattcccccgtgatgaagctggaagccaaggccggaaccctgtgccgcgccatggggtacagtgagatcatcacctattccttcgtctcccccaccgttttcgatcagatccggctgcccgccgattcccccctgcgcaacgctctgcgcatccagaatcctctgggcgaggacacctccatcatgcgcaccatcgccctgccctccatgctggaaatcctctcccggaacaacgcctaccataacaaggccgtgaagctctacgagctggcaaagatctacctgcccgtggagggacagccgctgcccgaggagccgaagatgctggttctcggcacctacggcgcaggcgagaccttcttcaccctgaagggcgaactggaagccatcttcaccggtctgcggctgaaaaaggcagagtacaccgccgtgaaggacaaccccagctaccatcccggccgctgcgccaaggtgagcatcgacggcgtggacgtgggcgtgatgggtcaggtgcatcctctggcggccgcgaactatggcatcgacaccgacgtctactgcgccgagatcgacttcaccaagctgtttgagatgcagctgcccgacgccacctatacccccctgcccaagtatcccaccgtgtcccgtgacctgagccttgtctgctctgaggatgtcaccgtcgcgcaggcggaagccgtcatcaccgccgctgccggaaagctgctgcgggatgtgaagctgttcgacatctaccgcggccccggcgttcccgagggcaagaagagcatggccttctctctggaactgcgggcggacgaccgtaccctcaccgatacggactccgaagccgtcgtgaccatggttctggccgcgctgaaggaaaagctggacgctgctctgcgataa

SEQ ID NO: 410 - DNA, 2331 bp, Unknown
  Description of Unknown: Firmicutes bacterium sequence
atggggaggaagaagcgggaatataaccgtctgcggctggacagcggccagcacaggcgcatcatgctggtatccgcactgctgggggcgctggccttcctgccggttgggctgcggctgtacagcctgatggtgacgaattacgattactattcctctctcgctctgcgcaaccagacccgcacgacgacggtgaccgccgatcggggggacatcttcgaccggaatatgaatattctggcgacctccgtcagcgtggagaatgtgtaccttgacccccacgagctgaagcagtccagggcggacattcccgaaattgcccggacgctgggagaaattctggggaaagaccccgcgtggatcgaggaacaggcggcggacatcaaacgtcgctacaagcaggtcggtacccgcgttgacgaggagaccgccggaatgatccgggattacatcaatgaaaagggcatttccggcatccatctggaacccacgtcccagcgggtctacccctatgaaacgctggcggcgcaggtcgtcggcttcaccaacgcatccaacgagggctgtgaaggggtggaggccgcctacaacagcttcctcgcgggcagcacgggcagagtcattacaaccaagggcaataacgaaatggatatgcccttttcctatgaaaactacgtttcctcccggcagggggacagcgtgatcttaacgctggacgccacggtgcaggcgtgcctggaaaagcagctttccgccgccatcgcccgctatgacgtccagaacggcgccttcgggctggtgatgaactgcaagacgggagaaatcctcgccatggccacgctgggcagctatgaccccaacaactatctggaaatcgccgacgagggaacggcggcgcagctggaagaaatgaaacgggtctacctcgccgagccggaggggagcgaagcctacgaggctgggaagacggcctacggggaagccctctccgccgcccgattgaagcagtggcgcaaccgggtgatctccgacggctatgagccgggttctaccttcaaggttctgaccatgtcagcggcgctggactgcggcgcgatcgacctgaatacccctttccactgctccggttctgagcagattccgggacgtgcccagcggctccactgctggcgctccacgggacacggggcggaaaaaacgcctcaggcgctgcaaaattcctgcaacatcgccttcgcccacatcgccctgaagctgggcggggagcggttttatgaatacgtcaaaaactttggggtgctggaaaaaaccggcattgacctcgcgggagagagcaagggcgtctttttcgacaaggcgctggtcacggacacggacaaatggggcacggcgtccctgacctccggttctttcggccagacttttaagatcacacccctgcagctggtgcgggcgatttcgtccgtggtcaacggcgggcagctgatggagccgtacatcgtctcggagattctggacgccgacggcaatacggtgatgaaggcggagccgacggtggtgcgcagaaccatttcgggggagacttctgacaccatgcgcaccctcattgagtccgtcgttacggagggaacggcaaaaaatgccaaagttgccgggttttccatcggcggaaagaccggaaccagtgaaaaaattgacgtttttgacgagaatggccagcgcgtgcaggataaaatcgtatcttttgtggggattgcgcctatggacgatccggagtatattatacttgccgcattggatacaccgtcccggacaacgggaatttacatttccggcggcgtcatggcggcacccaccgtgggcgcggtgatggcggacgtgctgccatacttaggcgtgaagcagtccttttccgaggacgatatcgcgggaaagcagatcgtcatggaagacctgaccggcatgacggcgaaggatgcccagacgcttctgaaaaaagaagggctgacggcggcaatttccggcagcggcgaaacggtgacggggcagatcccgtctcccggacagaccgttcccgggggaagccaggtgcttctgtttctggggcagaccccggagccggaaacggtgaaggtccccgatttttacggcatgaaccgtcagcaggccagcgacgccgcgggcgcgctggggctgtacattctggtgacggggaacgatgaaatttccaccggcgtgaccgtgacggcgcagaacgtggccaaggataccgaggttcccgcgggaacgacgatcacgctggcattcgcggataccgcggccagagactga

SEQ ID NO: 411 - DNA, 1731 bp, Unknown
  Description of Unknown: Firmicutes bacterium sequence
ttggaatggagcagttttatgaagaagtttatccgcgttctggtgccgctcctgcttgcggtgctgatcatcgccagcatcggctggtacctgtttacctatgaccgggggttcacccgggatttcctgctgacccaggctcgatacaatgacctccacggcaattcccgcctgtcctcatggttctatgaccttgcctacaacttctccaaccacgacgagaacgtggccatcgagctggcgaacctgtataaggccgacgacaactacacgaaagccgagtacaccctgaccaatgccatcaactccgaacccagcgccgagctgttcaccgccctgtgcaagacctacgtggagcaggacaaactgctggacgccgtctctctgctggacaagatcacgaacccggacatcaaggccgagatcgaggcgcagcggcctgacgcccccatcagcaactacgagccgggctactacagccagtatatcgacgtcaccctgtacgccgccgggaagctctactacaccaccaacggtgaatacccctccgtgaaggaccccgtttacgaaagccccattaccctccccgccggtgagacgaccatttacgccatcgccgtgggcgataacggccttgtcagtcccctgacggttctgggctacactgtgaccggcgtcattgaggaagtcaaattcgccgacccggccgtggaagcggctctgcgggagctgaccggcacaagagacggcgacagcgtctacaccagccagctatggcagatcacggaattcaccgtccccgaggacacgaaggtctacaccgacctgacgttcatgccctatctggaaaagctgaccatcgccaatcaggacatcgacagtcttgagagcctgtcttctctgaccaagcttacgtctcttgacctcagcggcagccggttcagcccggacgatctgaccgtcattgcgggacttcccgccctgaccgagctgagcatggtagaatgcggcctgagcaccatcgaaaagctgtccggcgcaaagagccttacctatctgaatctgggcgagaacaccatccggaatctggacgtactgtcctccatgaccacgctgaccgagctgaatctccagcacaacgccgtgaccagtctcgacgcattggacggtctgagcaatctgcaaacgctggacgtttcctacaacgccctgactaccctcgcccccgtttccagctgcgcccgactgacgacgctggtagctgacaacaaccagatcacaagtctggacggcgtgagcagcttacaggtgctgacccgtctgtccgtgaaccacaacgcgctgacggatgtctctcccatttccgtctgcacgacgctggttgaactggatatctccaacaacaccctgacggacatctccgccctctccacgctggtcaatctggagcggttcagctttgcctccaatcaggtcacggcgctccccgaatggccggagggctgcaagcttcagaccattgacggctcttacaatgcgttgaccagtctggacaatctgagcaagatggaagccctgacctatatctatatggattacaaccagatcagcaacattgattccctcgccgacagctattgtctggtgcaggtgaacgtgttcggcaatcccatttccgacgtcgcgtccctgagagaacacgacatcatcgtcaactacgacccgacctga

SEQ ID NO: 412 - DNA, 1098 bp, Unknown
  Description of Unknown: Firmicutes bacterium sequence
atgaaagtaacgctgcaaaatctgacgaaaaagttccccagccgcaacaaaaagcagcccgccgacgtgatcgccgtgaacgacttcacctttgagatccccgatggcgtgctgctgggtctgctcggcccttcgggctgcggcaagtccaccacgctgaacctgctctccggactgcagaagcctacctccggccgtatcttcttcggcgacgacgatgtcaccgacctgcctgcggagaaccggggcgtggggctggtgttccagaattacgccctgtatccccatctgacggtacggcagaatattactttccctctggaaaaccggacgggcaaggacaagctcacccaccagcagatggccgacatggcgctggaagcggcgaagctggtgcagattgaagaactgatggaccgcaagccaaaagagctgtccggtggccagcagcagcgcgtggccattgcccgggcgctggtgaaaatgccgagaattctgctgctggacgagcccctttccaatctggacgcccgcctgcggctccagacccgggaggagatccgccgcatccagaaggccaccggcatcaccaccgtattcgtcacccacgatcaggaggaagccatgtccatctccgacctgatcgtggtcatgaaggacggcgtggtacagcaaatcggcaagcctcaggcggtttacgattctcccgtgaatctttttgtggcaaaatttctgggcacgccgcccatcaacgtctttgacggtgaggtgaaggacgggcatctgtacatcggcgaggaagccgtgctggccgtccccggtgtggccaaccagagcgtcaccgccgccatccgtcccgagggctttaccctgtcggagaccggcgcgttgagctgcgatctgtcccgggtggaggtcatggggcgggatatcagtgtcgtctccacccatcccaagtcccagaacgtgaccatccgctccatcatcagtgcggaaaacgccgtcaacacagcgtcccaaaaggtgcgctttgacctgaagcccaataaggtattcctgttccagaaagaatccggcacgcggatcgatttcggctaa

SEQ ID NO: 413 - DNA, 4308 bp, Unknown
  Description of Unknown: Firmicutes bacterium sequence
atggaagaacaaattttctttctgaatatgtttccggactatgagccgcctgaggagctgtatgcagccctttctcaggcggctatcgccgctgcggatattgaccccgaaatccgaagcgtccacgtggcgctgcattccgagcgctacatcccccaacggctgctggaacaggttcgcaaggacatttgtggcctgtacggcctgcaaaagctggagctgaccgcgactcacccggaatcggagctgcaaaaaatcgaaccggaagagctgatgtggctgtttgtcagccgcaactccatggcgcggggttccctcgccggggcaaagtgggaatggaacgaacagaatctcacggtaaagctcgccgccaacggaaaagaaacccttctggagcacatcccgtctgtggaaaaggtactgcgggagcggttcgccgccccggtgcatatcaccgtggaggctggcaacacgctggagggaaaagcgctgtttgccgccacagagtccatgcgggaatcggagattcaaaagcttcccgccgtctccgccgctcagccgaagaaggaggacaagtccgccgcccccagcgaaactttctatggcaagcccttcaagggcacgcccgttcccatgaaggagctgagtctggacatgggaaccgtcatcgtggagggcaaagtcttcgccgtggaccacaaggagctgaaaaagcgcaacgcctatgttgtgaaattcgacatgacggacaacaccaactccgtccgcgtcagccgctttatggaggccggagaggccaaacccattctggaaaacgttcaggtcggctccgtcctgcgggtgcagggcaagctgggtgaagatcgatacgagggcgaaatggttctcaagccctacgccatgcagcccggctccatgcccaagcggcaggacaccgccccgggagaaaagcgggtggagctgcatctgcataccaccatgtccaacatggacgctctgacggataccgccgccgccgtgaagcaggcggccgcatggggtcacaaggccatcgccatcaccgaccacggcgtcgcccagtccttccccgacgccatgaaggccgcctccaaggccaaggtggccggaaccgaccagaatatcaagattctctacggctgtgaggggtattatgtaaacgacgtagacgaccgcattgtagtccacggcgagcaggatatcaccttcgatcaggaattcgtcgccttcgatctggaaactaccggcctgtcctcccgcagcgaccgcatcatcgagatcggcgctgttgtgctgaaaaacggtgaggaagtggaccgtttccagaccttcgttgacccggagcgcccgctggaacggaaaatcgtggagctgaccggcatcaccgacgaaatgcttgtcggcgcaccaaaaatcgaggaaatcctgcccaaatttctggacttcatcggcgaccgggttctggtcgctcacaattccgacttcgacaccggctttatccgcgccgagtgccagcgccttggctacgattatcattacaccgcggcggataccctgattctgtctcagaatcttctgccccagctgaacaaattcaagctgaacatcgtctccaatgccctgagcctgcccgacttcaaccatcaccgggcggcggacgacgccatgacctgcggcttaattatggcaaagctcatgtccaaactggaagaggagcatgacatccacaacttgcaggccatcaaccctgccatgacccatctgcgttccggcggccgcatcaccgaccgtcaggcgcggcacatcatcatttttgccaagaaccagatcggtctgcgcaacctgtaccatctgatctccgactccaacctccaatacttccgccgggtgccccggatgcccaagtccgacattcttaagctgcgggaggggctgatcatcggttctgcctgcgaagcgggcgagctgtttcaggccattctcgaccggaaaagcgacgacgagctgaaacgcattgcgtccttttacgactttctggaaatccagcctctggcgaacaaccgctttatgctggcaaatgaaaaatacgaggccaaaaccgacgaagacctccgggagtacaaccggaaaatcgtccggctgggcgaggaactgggcaagccggtggtcgccaccggagacgttcacttcctgaaccccgaggacgagattttccgtcacattctgctggcgaccaagggcttcgacgacgcggataaggatatgcccctgtatttccgcactacggatgatatgctgcgggaattctcctatctcggggaggaaaaagcctacgaggtggtcatcaccaaccccaaccgcatcgccgacatgtgcgagtccctgcgccccgtcccccacaatctgttcgcccccaaaatcgaaaactccgtggaagacctgaaaaatcttgtctacaccaaattccaccgtctttacggggacaatcccccggagctgatggtaaagcgcgtggagacggagctgcacgacatcatcaactgccactacgacgtgatctacatgtctgcccagaagctggtgcagaattcgctggagcatggctatctggtcggctcccgtggctctgtcggctcgtccatcgtggcctacatgtccggcatcaccgaggtcaactccttcccgccccactaccgctgccccaacccggagtgcaagtacaccaccttcgacgttcccaagggctacggctgcggcgcggatttgccggacgccgtctgccccaagtgcggcacgaaattcgagaaagacggcttcaacattccctttgagaccttcctcggcttcggcggcgacaaggttcccgatatcgacctgaacttttccggcgaataccagtcaaaagcccacgcttactgtatcgaaatgttcggaaaatcccatgtttttcgggcaggcaccatcggcaccgtggcagagaaaaccgccttcggctacgtaaaaaaatacctgtccgagcggggcaaaaccgcctcccgggcggaggaagcccgcctcgcggcggggtgtgtcggcgttcgccgcaccaccggccagcaccccggcggtctggtggtcatcccacaggaaaacgagatttgggacttctgcccggtgcagcacccggcggacgaccctcaggccgaccagatcaccacccattttgaataccactccatggaggaaaaccttctgaagctggacatgctgggtcacgatgaccccaccatgatccgcatgatggaggacatgaccggtatcgacgccaagaccatcccgctggacgacaaggacaccatgtccattttcatctcctccaaggtgctgggctacgaggacgacaagattctcggccccaccggcgccgtcgccattccggagttcaacacccgctttacccgcgggatgctgatggacaccatgcccacccggtttgatacgcttctgcgtctgtccggcttctcccacggcaccgacgtgtggctgggcaacgccaaagacctgattacctccaaaaccgccaccgttgatcaggccatcggctgccgtgacgacatcatgctttatctgatctcctgcggaatgccggaaaagcgctccttcaagatcatggaggccgtgcgaaaaggcagaggtctgcccgaaggcgcggaggaggaaatgaaggccgcaggcgtgccggaatggtacatcggttcctgcaaaaagatcaagtatctgttccccaaggcccacgccgtggcctatgttatgatggctttccgtatcgcatggttcaaggtacatcatccgctggccttctactccgcctatttctaccgccgcagtcagaagggcggcttcgacgcggtgctgatgacccacggcaaggatgcggtggtcgccaacatcgacgccatcgagaacaacgaaaacgccacggacaaagacgaagacctgctgaccacgctggaagtggcctacgaatactacatccggggctttgaattcctgcccatcagcatttacgacagccatgccacgaaattcatcatcaaggacggcaagctgctgccccccttcgttgcgatctccggcctcggtgaaaacgcggcatgggacttgatgcggggtcgtgagggcaaaaccttcctgtccgtggaggaagtcgccgccgcctgccccaaggtgtccaagacccacattcagatgctcagagaggccggtgctttcggcgacctgcccgataccagtcaggtcagcttcttctga

SEQ ID NO: 414 - DNA, 1218 bp, Unknown
  Description of Unknown: Firmicutes bacterium sequence
atgcgatatgacggtatcgtgatcggcggcggcgcggcgggcatgtttgcggccattacggcggcaaaacgggggcagaatgtgctgcttctggaaaaaaacgaccgtttgggcagaaaactgctgatcaccggcaagggccgctgcaacgtgaccaataactgcaccgggcaggaggttttgcagaacgtcccccggaacgggcggtttctctacagcgccatgacggcgttcccgccggaaaagacgatggccttttttgaggaacgtggctgccgcctgaaaaccgagcggggaaaccgggtattcccggtgacggacaaatcccagtccgttctggactgcctgcaatcggagctgcacaggcagaaaatcaccgtgaaaactgcccgtgtcagggatattctcacccaagacgggcatgttaccggggtgaggacgcaaaatgaggaaattgccgcaaattgggtgattctcgcgaccggcggcgcttcctaccccgccacaggctccaccggcgacggctacagcatcgccgccgctctgggacacacgatcatccccccggagggaagtctggtgccgctggagacggcgggaaacgactgtcaggaaatgcaggggctgagcctgcggaacgtgggggtcaagctgctgaacgccaagggaaaggtgctgtacaaggactttggcgagctgctgtttacccactttggcatttccggccccacggtgctgtcggcgagctgccacctgaaaggagacggctgccgtctggtgctggatttgaagcccgcgctggaaggtgaaaagctggaagcccgtatcctgcgggatttggagcagtatcagaaccggagcatggaaaacgctctggtggacttgctgccccggagcatgatccccgtggtgctgcgcagattggatatttccccggaaatgcaggccaattccctgacgaagcagaagcgccgcgcactggtggagctgctgaaagccttccccattgacatcaccggcaagcgccccgtgtctgaagcaatcatcaccagcggcggcgtgaaggtatcggaaatcgaccccaaaacaatggaatccaagcttgtggccgggctgcatttcgccggggaggtcattgactgcgacgcttacaccggcggcttcaacctgcagatcgcatgggcgacggcctatgccgcagggatggcggttgggtaa

SEQ ID NO: 415 - DNA, 1884 bp, Unknown
  Description of Unknown: Firmicutes bacterium sequence
atgcgattaaatggagagaatatggttgatatacaagtcaggaatctgacaaaattctttgtaatcggagaaaatctgctggacaacctgagctttgaaattcaggaaggggagcgggtggcgatccttggccgaaacggctgcggaaaaaccacacttttcaacatccttaccggccagatggactatgacagcggcgaggtctacgtcaatcctaacaagcgtctggggctgatttcccagatccccaagttcccggcgggttacaccgtggaggacgtgctgcgcaccgcctacgccggcctcatgaagctgaaatccagaatggagcggctggaagcggacatggcggggggcgcaacggcggagcagctgcgggagtacgacagcctgtccaaccgcttccagtccgggggcggctacgagatggatgtggacgtggacaaggtctgcaacggtctgggcatcccggcggagcagcgcgcccaggaattcgacagcctttccggcggcgaaaagaccagagcgaatctcgcccgccttctgctggaaaagacggacatcctgcttctggacgagccgaccaaccatctggatttgagaagcgtggagtggctggaagggtatattcagaatttccgggggacggtgcttgccatttcccacgaccgttatttcatcgatcagattgcccagcgggtgatcgagatcgcggacggccacgcggaattctactccggcaactactcgttctacatggacgaaaagcaggcgcggtttgacctgcaaatgaagcagtacgagcaggaacaggcgaagctgaagcagctgggctacacggtggagcggatgaagggctggggcatcaacaaccgcaccctctaccgccgggccatgtccatccagcaccggatggatcgcatccgcaagacggaacgacccaaagcggaaagaacgatgaaggccagcttcggggagcgggatttttccggagacgtggtgttcaagatgaagaacgtgtcgaaatccttcggcgaccggacgctgttctccgacgtgaatctgctggtagagggcggcgagcgcattgccttgctgggggacaatggcaccggaaaatccacctttatcaagtgcctgctgggtgaggaggactgtcaggggaaaatccagttcggccccacggtgaaatggggatatctgccccagatcatccactttgaccacccggagcggagcctctatgacaccatgctctatgagaaaaactgcacgcctcagatggcgagagaccgtctcggcgcattcctgttccagggggaggacgtgttcaagaccgtgggcaacctgtccggcggcgagcagtcccgcctgcggctgtgtatgctgatggacgagaaaatcaacctcctgattctggacgagccgacgaaccatctggacattgcgtcccgggagtgggtggaggctgccatcgaggagttcgagggcgtgctgctgttcgtctcccacgaccggtattttatcgaaaagtttgccgaacgcatctggctgctggaggacgggaaaatccgggatttcccctgcggctatcagaaataccgctccattctggagcatgaagccgccgcaaaaccggccgtttccgctgcgccgaagccgaaaaaggagcgggcaaagggcggaaccaaagacgcggacaagctggtgcggcggctggagcgggagatcgagaagcaggagcaggtcgtcgccgactttgaccggaagatcgaagcggcctccgccgactatcaggagctgacccgtctgcttggcgaaaaggaagaagccgaagcggcgctcatggacctgatggagcagtgggaacaggtgcagacgtga

SEQ ID NO: 416 - DNA, 2022 bp, Unknown
  Description of Unknown: Firmicutes bacterium sequence
atgtatcgtattttggatttgaatccccagcttgagcctttcgccggggatattgatttgcggatgcacctgtaccggtcggcaaaaaaacgtattctgtccgaggggcagagcctgaatgattttgccaacgctcacatgtactttggcttccatcacgtggatggcggctggtactaccgggagtgggcgcccagcgcctaccagctgtatctggagggcgaattcaacggctggaaccagacctcccacccgctgaccaatctgggcaacggcaactgggagctgtatctccccggcgacgacgccctgtgggacggctgcaaggtcaaaaccgtggtggacgccaacctgacccgcacggagcacatccccctgtatgcccgccgggtggtgcagaacaagcagaacatcaccttcgagtgcgaggtggtggatgaccgtaaggcattcccgtggacggacaagggctttaccggtgaggacgagctgtatatctatgaggcccacattggcatggcgcaggaggagggcaaggtcggttcctaccgggagtttgccgacaacatcctgccgagaatccacaaggcggggtacaataccctccagctcatggccattatggagcatccctattacggctccttcggctatcaggtgagcagtttcttcgccgcttcctcatggttcggaaagccggaagacctgaaatatctggtgaacaaggcgcacgccatgggcatccgggtgctgctggacgtggtgcattcccacgccgtcaagaataccgccgagggcatcaacatgttcgacggcaccacatggcagttcttccacgacggccccaagggcgaccatcctgcgtggggaacaaagtgctttgactacggcaagaccggcgttatccacttcctgctgtccaacttgaaattctggatgacggagtaccattttgacggcttccgctttgacggcgtgacctccatgctgtaccatgaccacgccctcggtacggacttcacctccgacggcaagtatttctcctacaacaccgacaccgaggcggtgacgtatttgcagcttgccaatgagctgatccgtcaggtgaaccccaaggccatcaccatcgccgaggacatgtccggtatgcccggcatgtgcctgcccattgcggacggcggcatcggctttgactaccggctgggtatgggattgccggatatgtggatcaaggcggtgaaggggcaggacgaattctgggacatcaatcagatgtggggcagtatgtgcctgcgccgtcccggagagaagaccgtggcctatgtggagtcccacgaccaggcgctggtgggcgaccagacgatgatcttccgcctggccggggcgaacatgtacacggacatgaacaaggactgccacaaccctgtgatcgaccgcgccattgccctgcacaagatgattcgtctgttcactctgtccggcggcggagaagcgtacctcaacttcatgggcaacgagttcggccaccccgaatggatcgacttcccccgggagggcaacggctggagcttccattactgccgccgccagtggagcctgaaggataacggaatgctcaaataccagtggctgggcgactttgacgaggatatggttcacctgaccaaggagaaccggattttcgaccagcggatggcagacctgctgctgatgaaagcgccggagcagacccttgcctactaccgccacgggctggtgttcgtgttcaacttccacttcggtaattccctgaataacgttcttgtcccggttcgccagccgggcgagtacacggtggttctgtctaccgacgacgaaaagtacggcggctttggaaacgtggcaaaaaagacctacgctaccaagcgttttgacggcagggactacattgaactgtacatccccgcgagaaccagcttcgtgctgaaggaaaaggtgatccttcccgaaacgcccgcagccccgaaaaaagcagcgaaataa

SEQ ID NO: 417 - DNA, 1803 bp, Unknown
  Description of Unknown: Firmicutes bacterium sequence
atggagattttaagtgccatcgtgcagcttctgggcggacttgccctgttcctgtacggcatcgagctgatgggcgacggcctgaaaaacagctccggcgccgcactgaaacgcgtgctggaaaaggtcaccggaaatgttgtgatgggcgttctcacgggcgcgctggtcaccgctgtgatccaaagctccaccgctaccatcgttctgacggtcgccctgattggcgcgggcgtgctgaatctgaggcaggccgtgtccatcgtcatgggcgccaatatcggcaccaccgtcacggcacagatcatccgtctcggctccattcagtccgacggaagctggctgctgtggctgttcgacacggacacgcttgcgcctatcgctcttatcatcggcattgtgctgctgatgttcattaagtccaagcgctccaataccatcggcgatatctgcatcggcttcggcatcctgtttgtaggtttgaacctgatgaccagcggcgtggagcctctggtgggtacggatgcgtttattgcctttgtgcggttcctgaataatcccttgttcggcattctctttggccttgtcctgacggtcattgtccaaagctcgtcggcgacggttggtatgctccagacggtggcgtctgtgccgggggcggggattactttcgccatggcctatccggtcatcatgggtatcaatctgggcacctgcgtcaccacggccatggtctgctccatcggctcgtccaaggacgccaagcggacgggcgtcgtccacatcgcgttcaataccatcggaacgattctgttcctgcttctgatgactgttctgcggaagctgtctgtgttctcggcggaattctgggtgcgcagtgtggacagcggaaatatcgcgaatttccagacgattttcaatctggtcactgccgttgtgctggttccctttgcggatcagctggtgaagctgtccatggtcatcgtcaaggatgacaagcagaaacagctgcgccatcccgagcttcatacgctggatgaaaagctttataattctcccgcccttgccgtgtccgtcgccatcaaggctgtgtcggatgtgggtacgctggcaaaggagaattttgaaaagggctgccggatgctggaaaagtacgaccccgccgttgccagcgagatcgacgtggacgaggactgcatcgacgagttcacggacagggcagaccggttcttcattggcctgtccaaggcggtggaaacggagtgggacgaccgtcagctggatatgctgatgcagacggtgcccaacttcgagcgtatcggcgactacgccaccaatctggtggagctgtcccagcgactggttgcggacaacgcgaccttctccgacatggcgcagcgggaattgaagctgatttttgatgccgtcaatgaaatcctgaccattaccgtagacgcctttgccaagggcgacaacgaagccgccaagcgcatcgagccgctggaggaaaccatcgacgacatggtgatgatcctccgggatcgccacaccaagcgtttgaagagcggcgcctgttccgtgggcagcggtctggtgttcatggagacgctgacctatctggagcgtgcttccgaccagtgttcctccatcgccgtgatgatgctggcgcggaataacgagaatatcctgcaaaaccattacgattatctccgggagattcacgcgggcaacgacgccgcctacagtgcggagaaggaacgccgccgcgagcagtatatcaagcctttgaaagagaccaactga

SEQ ID NO: 418 - DNA, 2424 bp, Unknown
  Description of Unknown: Firmicutes bacterium sequence
atgaattacgattacgcaaaaattgaggccaagtggcacaagtactggcaggagcataataccttctacaccgacgtgtgggatttctccaagcccaaatactatgtgctggatatgttcccgtatccctccggcgtcggcctgcacgcgggtcatcccgagggctacacggcgacggatatcgtctcccgcatgaagcggatgcagggctacaacgtgctgcaccccatgggctatgactccttcggcctgccggcggagcagtacgccgtgaataccggccatcatcccaacggatttacccagaagaacatcgagaccttctccgctcagctgaaggagcttggcttcgattacgactggtcgaagatgatcgccacgtccgacccgtccttctataagtggacgcagtggatcttcaagaagctctacgaggcgggctacgccaagcgcattgagatgcccgtgaactggtgcgaggagctgggcaccgtgctcagcaacgacgaggtcatcgacggcaagtccgagcggggcggctatcccgtggtcaagaagaacatgatgcagtgggtcatcgaccagcccgcctttgcggagaagctgctggaaggtctcaacgagatcgactggccggaatccaccaatgagatccagcgcaactggatcggcaaatccaccggtgtggaggtggatttccagctggtgggcggcggtgaattctccatctacaccacctgcatcgagacaatttacggcattaccttcatggtgcttgcccccgacggcaagatcgtgcagagcctgatggaccgggtgcagaacaaggaagcggttaaggcgtacatcgacgagtctgtgaagaagagcgacatggaccgcacggagctgaacaaaaccaagtccggctgccgtctggagggcgtctacgccatcaaccccgtcaacggcaagcaggtgccagtgttcatcggcgacttcgttctggcgagctacggcaccggcgcggtcatggccgtgcccagtcacgaccagcgtgatttcgagtacgctcaggtgcataacatccccatgattcaggtcattgacggcgcggacgtgtccgagcacgcctttgagaagcaggattatctgggcaagggctgcaggctcatcaactccgaagagtttaccggcctgacggtggaggaggccaaggaggccatcacctgcaagctggaaaaggccggcgtggccagaagaaaggtcaactaccatttccgggagtggatcttcgcccgtcagagatactggggcgagccggttccctgcgtgtacaccgacgacgggaaaacctacttcctgcccgacgacgagctgcccctgatcctgccggagctggaggattacaagggacgcaacggtcaggcgccgctggaaaacgccaccgagtggaagaaatatgaccgtaacggcattcacggcgtccgggagacttccaccatgcccggcagcgccggttcctcctggtattatttccgctatatcgaccccaagaacgacaaggtgttctgcgaccccgagcttgcgaagcactggatgcccgttgacctgtatgttggcggcccggagcacgccgtgggtcacctgatgtattcgaggatctggaaccgcttcctgtacgatcaggggctgtctcccgtgaaggagccgttcaagaagctggtgcatcagggcatgatcttgggtgagaacggcatcaagatgggcaagcgcttcccggaattcgtggtgaatcccagcgacgtggtgcgggagtacggcgcggataccctgcggctgtacgagatgttcatggggccgctggaagtgtccaagccctggagcaccaccggcgtggtgggcgcaaagaagttcatcaaccgcgtctggaacttcttcaccgaggagaagaacatcaccgataccgacgacggcaagctcaccaagatctatcaccagacggtgaagaaggtcacctccgactttgaggcgctgggcttcaacacggccattgcccaaatgatggtgttcgtcaacgaggtctataagaacggcagctgccccaaggcctatgccgagggctttatcaagatgctttcctgcatcacgcctcacgtgggcgaggagatctggcagctgctgggacatgacgataccattgcctacgaaagctggccgacctattccgaggaaaagtgcaaggatgccgaggtgaacatcgcggtgcaggtcaacggcaagatgcgcggcaccgtgctgatggacgccgatctttccaacgaggaagtggtggcaaacgccgtggcggacgaaaagattgccaagttcctgcagaagcagggcggccagatcgtgaagaccattgtggtaaagaacaagctggtcaacctgatcgtcaagtga

SEQ ID NO: 419 - DNA, 1395 bp, Unknown
  Description of Unknown: Firmicutes bacterium sequence
atgatttttgatttggagagaattatgactgcagctactttacaggaaaacaaaatgggcgtcatgcccgtcgggaagctgatcgccaacatggcgctgcccatggtcatatccatgctggtgcaggcgctttacaacgtggtggacagcatctacgtctctcaggtgtcggagagcgcggtgacggcgctgtcgctggccttccccatccagaacctgctgatcggcttcgccgtgggcatcggcgtgggcgtcaactccctgctttccaagagtctgggtgagaaaaatcaggaggccgccaaccgcgccgccggaaacggcatcgtgctgatggccattgccatggtgctgttcgtgctgttcggtctgttcggcgtgcgcccctatttcgccattcagtccgacaacccggagaccgtggagggcggcattgtctacaccagcatctgctgcgtgttcagcgtcggctgcttcgcatccattctgggcgagcggctgctgcaatccaccggccggacggtgcataccatgatcacccagtccatcggcgcgatcatcaacatcattctcgaccccattctcatccacggatggttcggtttgcccgccatgggcattgccggcgcggccattgccacggtgatcggccagtgggtgtccggcatcatggtcatcattttcaacctgaaattcaacccggaggtacagctgcacaagaagtatcttccgctggagggcaagaccgtggccgccattctgacggtcggcattccctccatcgttatgaacggcattggctccgtgatgaatttcggcatcaaccagattttgcagggcttcgccgagacggcgaccggcgtgttcggcgtgtatttcaagctccagagcttcttcttcatgcctttgttcggcctgaacaacgccaccatttccatcatcgcctataactacggcgcccgcaagccccagcggatcaccaagacgctgaaaatttcctgcaccgcggcgctgtgtctcatgacggtgggtctgttggtgttccagttcttcccggatgtgctgctggggatgttcaacccctcccaggcgtttctggagatcggccgggtcgctctgcgcaccatcagctggagcttccccattgcggccatctgcattgcgctgggcgccagctttcaggcgctgggcaacggcatttattccactattgtttccctgtgccgtcagctggtggtactgctcccggtggcctatctgctgagcctgacaggggaggtgcagagggtctggctggccttccccatcgcggaaatcgtcagcggcacggtgacgtttatctgcttcaccagaatctaccgccagaagataaagccgctgtttgagcaggcatga

SEQ ID NO: 420 - DNA, 1137 bp, Unknown
  Description of Unknown: Firmicutes bacterium sequence
atgataccacattttggccagtttgcaatcattatgtgcacctccatatttgcatttcttacgcaaaaacccgcaaatcagccccgccgcaaggaaatcttaaggcgcttcggtcctctccgacttgtttttttaagaaaaaacgagtacaatggggaaaaaatagcttatgaaagaggtggttggatgccatccaaagacaattccgttgcgagctgcgcccagcagatccttacgcaggtgaaaaccgtggtcgtgggaaaggaccccgtgctgctgtgggtgctggcggcaattcttgcccggggacatatcctgctggaggacatccccggcgtggggaagaccaccatggcgctggccttttcccgtgtgctgagcctgagctgcagccgcgtgcagtttaccccggacgttctgccctccgacgtgacgggctattccgtgcccgactctgccgggggaatgcgctatcagcccggtgcggtgctgtgcaatctgttcctcgccgacgagctgaaccgcgccacttcccgcacccagtctgcccttctggaggccatggaggaaggacaggtcacggtggacggggtgagccaccccctgccaaagccctttacggtcatcgccacccagaaccctaccggtgcggcgggcacccagctgctccccgacagccagatggacaggtttatggtgcggctgtccatgggctaccccagccctaaggacgaagccgccatggtgctgaaccggcagggcggcaaccccctgcacgacctgattcccctgatgacccgggaggacttgaccgccatacaggacacggtggaggaaacctacctcagcgacagcgtggtcaattatattgtatccctcatcggcgctacccggagcagccccgacatccttcggggcgcaagcccccgtgcgacgctggctgtcaccgccatggcgaaatccgtcgcccggcttcggggacgggattacgtgaccccggcggacgtgaaggaggtcttcgcccacaccatcgcccaccgcctgattttatcccccaaagcggaagcacagggaaagcagccgcaggcggtattgcaggacatccttgccgccgtccccgccccccggcttcgctga

SEQ ID NO: 421 - DNA, 2823 bp, Unknown
  Description of Unknown: Firmicutes bacterium sequence
atgaacgacaagatcatcattcagggcgcgcgggagaacaatctgaaaaacgtgaacctgaccatccccagagacaagctggtggttttcaccggactttccggttccggcaagtccagtctggccttcgataccatttacgccgagggacagagacggtatgtggagagcttaagctcttacgcccgccagttccttgggcagatggacaagccggacgtggactccatcgacggcctgtccccggccatttccattgaccagaagaccacctcgaaaaacccccgctccaccgtgggaacggtgacggaaatctacgattatctccgcctcctgtgggcgcgggtgggtgttccccactgcccgaagtgcggcagggagatccgccgccagaccattgaccagatcgtggaccgggtggaagcgctgggagaggggacgcgctttatcgtcctgtccccggtcatccgggggaaaaagggcgagcacaagaaggtgttcgaggacgcccggaagtccggcttcgcccgggtgcgggtggacggcattctctatgatttaaccgaggacatcccctgcgagaagaacaagaagcacaccatcgaactggtggttgaccggctggtgctgaaggacggcctgcgccgccgcctgacggactccattgagacggcgtgcagccactccggcggccttgtgaccatcgagctgcccgccaccggggaggagctgagcttttcccagaactacgcctgcgaggactgcggcatcagcctgacggaactggagccgcgaatgttctccttcaacaacccggcgggtgcctgccccagctgcaccggtctgggcttccagctcatcgccgacgccgatctggtgattccggacaagaacaagtccattttcgacggcgcgattcaggcgtccggctggcagagcgcccggacggattccatcttccgtatgtattttgaggcgttggcgcaaaaatatcatttttccctgacggaaccggtgaagaacctgcccgaggacgtgatggacgtgatcctctatggcaccaagggggaaaagttgcgcatgagctacaaccggggcaacggtatgggcgtgctggagcagccctttgagggcattctcaacaacatttcccgccgcttccgggaaacccagtccgacgccgcccggaaggagctggaggagtgcatggccaccgcgccctgcccccagtgccacggcgaccgcttatcggagatcgcccgggcggtgacggtgggcggcatcggcattatggacttttgccgcatgagcgtccgggacgagctggaatttatgaaaaacctccgtctggagggcaatatggccatggtggccgagcagatcgtcaaggagatcaagtcccgcctgcaattcctgacggatgtgggactgagctatctgacgctctcccgctcggcgggaaccctttccggcggcgagagccagcgtatccggctggccacccagatcggttcgtccctgatgggcgtgctgtatattctggacgagccgtccatcggtctgcaccagcgggacaacgataagctgctggggacgctgaagcacctgcgggatttgggcaacaccctgatcgttgtcgagcacgacgaggacaccatgcgcgccgccgattttattgtagatgtcggtcccggcgcgggcagtcacggcggcgagatcgtggcggcgggaacgctggaggatatcataaactgcccccgttccgtaacgggacagtacctctccggcgtgaagaaaatccccgttcccaccacccggcgggcggggaacggcaagtccctgcgcattcgcggcgcacgggaaaacaacctgaaaaatgtggatgtggacattcccctgggaaccttcgtctgcgtcaccggcgtatccggttcgggaaaatccagtctggtcaatgaaattctgaacaagaccctgcttgccacgctgaaccatgcccgtacccgtcccggcctctgtgacggcattgacggcatggagtatctggacaaggtcatcgacatcgaccagagccccatcggcagaaccccccgaagcaaccccgccacctacacggggctgttcaacgacatccgggatttgttcgcgtccaccaacgaggcgaaaatccggggctatgggccgggacggttcagcttcaacgtcaagggcggccggtgcgaagcctgctgcggcgacggccttgtgaagatcgaaatgcactttctggcggacgtttacgtcccctgtgaggtctgtcacggcgcgcggtacaaccgggagacgctggaagtccactacaaggggaaaaacatcgctcaggtgctggacatgaccgcggaggaagcggtggatttcttcgagaatctgccgaagatccgcagaaaagcccagactctggtggaggtcggccttggctatgtgaagctggggcagtccagcacgaccctctccggcggcgaagcccagcgggtgaagctggcgacggagctggcgcgggtctccacgggaaagaccatctatattctggacgagccgaccaccggccttcacgccgccgacgtgcataagctcattgaggttttgcagcggctggtggaggcggggaacaccgttctggtcattgagcacaatctggacgtgatcaagacggcggactatctgatcgacctcggccccgagggcggcgacgccggcggaacgctggtcgcgtccggcacgccggaggaagtggcgcagattcccgaaagctatacgggacagtatctgaagtcttatctgtaa

SEQ ID NO: 422 - DNA, 1203 bp, Unknown
  Description of Unknown: Firmicutes bacterium sequence
gtgcctgttaaaattggtgcgctggggaaaaattggtgcggaattggtgcggaaacaatcccttatgtcaaaaacaatctagagaataaaggagattttgaaaatatgaaattaggtattgtgggacttcccaatgtgggcaaatccaccctgttcaacgcgatcacaaacgcgggcgtccctgcggacaattacgcgttctgcaccatcgaccccaatgtgggcgttgtgtccgttccggacgagcggctggactggctctcccagctccataagcccaagaaaaccacccctgccgtgatcgagttcgtggatatcgccggtctggtcaagggtgcctccaagggcgagggcctgggcaacaagttcctcagcaatatccgcaccaccgacgccatcgtccatgttgtccgctgctttgaggacagcaacatcaaccacgtggaaggctccacagacccgctgcgggatatcgacatcatcaatctggagctggtcatgtcggacatcgaaatggtggagcgccgcatcgacaaggcgcagaaggccatgaagggcggcgacaagaagttcgcccatgaggtggaggtcttcaccgagctgctggagcacctgaacaagggcaagctggccagaaccttcgacgtttccgacgaagaccgggccctgatcgccacctccgacctgctgacgctgaaaaagaccatttatgtcgccaatatgtcggaaaacgaggtcaacgagccggaaagcagccgccactacatggcggtcaagacgcttgccgacagcgagggcagtcaggtaatccccatctgcgctaagctggaagcggacatcgccgagctggacgaccctgaggaaaaggccatgttcatggaggagctgggcgtcgccgaaagcggcctgcacaagctcatcaaggccagctacaccctgctgggtctgatctccttcctcaccgccggcagcgacgaatgccgggcatggaccatcaagaaaggcaccaaggcacctcaggctgccggtaagatccacaccgactttgagcggggcttcatccgtgccgaggtcatcgccttcgacgacatgaaagcctgcggcaccatggccgcggccaaggccaagggtctggtgcgaagcgagggtaaggaatacgttatgaaagacggagacatcgtcaatttcctgttcaatgtgtaa

SEQ ID NO: 423 - DNA, 1293 bp, Unknown
  Description of Unknown: Firmicutes bacterium sequence
ttggcaagatatgaaattaacggcggtcatcccctgaacggtaccgtcacgatcagcggcgcgaagaacgcggccgtggcgatcctgcccgcggctctgctggtcagcggcaagtgccggatcgagaatgttcccaatatttccgatgtccgaattctgatgagtattctcgacgggatgggtgcgaagatcgttaccccggaacccggcgtagtggagattgactgcacggacattcattgcagcgagccggatcagcagctcgtccgcagaatgcgtgccagctattatctgatgggtgcgctgctggggcggttcggcagagctcatgtggcgctgcccggcggctgcaattttgcctcccgccccattgaccagcatatcaaaggctttctggcgctgggcgcagacgttgacgagacggaagaatatgtcgctctgacccccggtcaggagggactgcatggcggacggatcagtctggatatggcgtccgtgggcgcgaccgtaaatatcatgctggcggcgactctgctgcccggtcagaccatcatcgaaaacgcggcgaaggagccgcacatcgtggacctggccaacttcctgaacaccatgggcgcgcggatcaccggcgcgggcacggataccgtcaagatccggggcgtcaatgccctgcggggcggcacctacgccatcatccccgaccagatcgaggcgggaacctacctggcagcggtcacggcggtgggtggcaacgtgctggtgcagaacgtgatccccaagcacatggagtgcatcaccagcaagcttcaggaaatgggcgcgaaggtcatcaattatgacgattccatccgcatcatgcgcacgggaaaactgcggcagaccacggtcaagacccgtccctaccccggcttccccacggatatgcaggcgcaggtctgcgtgtgtatggcgctggcgggaggaaccagccgcctgacggaaagcgtgtatgagacccggttcttcggctactgcaccgagctggaaagtatgggcgcgagcattcgcatcagcggaaagacggcgacggtcaccggtgtcgatcatctcacgggcagcaccgtttttgcccacgatctgcgggcaggcgcggcgctggtcattgcgggtctggcggccagaggcaccacctttgtcgagcacattcatttcattgaacggggctacgagaatctggtggagaagctccgggcgctgggcgcggacatctgccgcgtggaggatgaatcttgggaaacccttaggcggctctga

SEQ ID NO: 424 - DNA, 1866 bp, Unknown
  Description of Unknown: Firmicutes bacterium sequence
gtgcgtaagggaagcggcaagagaaaccggggaaaatcgaccggtttcattggagcttttattgagagaggagaaggaattttcttgattttcggcaagcatatcaacgtctattaccgcaagtacgcgctggctctgctaacggggctgctggcgttgtttaccgtggactacttgcagctgaaggtgcctgaaatttatcagttggtcatcaatggactgaatcaaggatacattgtggaaaacggcgtacaggtgccctttgatatggcgttcctgctggacaggatctgcatgcccatggtcggcatcatccttgccatcgtcttcggccgtttcctgtggcgggtaacgatcttcggcgcggctactaaggtggagacggacctgcgggataagatgttccgccacgcagaagacctgagccgggagtattatcaggtgaacaaggtgggcaatctgatgagcctgttcaccaacgatctggacactgttcaggagtgctacggctggggcttcatgcagttctttgaccccatcattctgtgttctctggccattaccagaatgtggcgcatggatcacctgctcaccgtcctgtccctgatccccatggggctgctgttcgccagcgccgcggtggtgggcaagaacatgacccggaagtgggactaccggcagaagtgcttctccgatctgtccgacttcgctcaggagagcttttccggaattgccgtcatcaaggcctttgtgaaggaggccaaggagctgatggcctttgaaaagctgaaccgggacagcgaggattccaacatcgcttttacaaaaacctccgtactgatgcggattctggtgaccaccttcgtggagagcgtcatctgcgtgattctgggctacggcggctatctggtctacaagggtcagttcaacgccggtcagcttatggagttcatcggctatttcaacgccgtggtctggcccattatggctgtggccgatctgatcgacatgacctcccggggcaaggcgtccctgaagcggatcagtgagctgctggacgcgcccaaaaatgtttttgaccgccccggcgttcaggagctgacggatcccaagggcgagatcgaattccgcgacctcagctttacctaccccgacggggatatccccgcgttggagcatgtgtcttttaccatccgccccggcgagagcatcggtctggtgggcaagaccggctccggcaagaccactctggtagacctgatcctgcgcacttacaatgtaaacgacgggcagctgttcctggacggcagggatgtgaacgacctctccatccgctccgtccgtgacgcctgcgcctatgtgcctcaggacaacttcctgttctcggacaccattgagaacaacatcgccttcggcaagtccgaaaccgtctctgaggagatccgccgggcagccaagctggcggatattgacggcaatatctccgaattccagatgggctatcagacggtactgggcgaacggggcgttaccgtctccggcggccagaagcagcgtatctccatcgcccgggcgctgatgaaggatgcgcccattctgattctggacgattccgtgtccgccgtggataccaaaacggaaaaggctattctggacaatctgcgcgccacccgggcgggcaagaccaccattctcattgcccaccgtatttccaccatcgagcagatggacaagatcctgttcatcgaggacggccgtcttgcgggctttgatacccatgacaagctgtacacggaaaaccccgcctaccgcaaaatggtggatctgcagcggctggaggaagaaggaggtgcggtcaatgcgtga

SEQ ID NO: 425 - DNA, 1875 bp, Unknown
  Description of Unknown: Firmicutes bacterium sequence
atggacagacgagtttatcatgaggagaccgccatgagaatcctttacgacagcaagcagccccagttcaagacccccttcggcaccctgacgccggggcaggtctgcaccctgcatatccatattcccacctccgtcctgacgacgaaggtcacctgcgtctttaatcatgaggacggctcatgggcgcagaacgccgttctggcattccagatgaaaaagggcgcgtatgacgtttttgaggggcagttttccatcccctgccccggcctgtttttctactatttcgtcatcgatacacagggcggcagcttccgcctgttcaagcagggggacgacaccaacatggaagccggggatctctggcagctgagctgcatccccgccgacttcaccaccccggactgggcgaagggcgcaaccatctatcaggttttccccgaccgtttttacgccagcggaagggccgatgtgaccgggaagctgaagccctacaccatccacaaaaactggtacgacgaagtggactggaagcccacccccgatgggcaggtgctgaacaacgactttttcggcggcaatttccggggcatcactgagaaaatggactatattgccggtctcggtgttaccattctctacctgaaccccatttccaagagcttttccagccaccgctacgacaccggcgactacaagacccccgacccccttcttggcaccgaggcggattttgccgccctctgcgacgcggcccacgcccggggcatccgggtcattctggacggcgtgtattcccacaccggctccaacagcctgtatttcaaccgggagggcgcgttcccatccgtgggcgcgtacaattccaaggagtccccctattacagctggtacaccttctacaactggccgaacgtctatcattcctggtgggactttgacactctgcccacggtgaacaaaatggaccccgctttcgtccgctacatcatcacggacgaagatagcgtcctcgcccattggctgcggctgggggcggatggctaccggctggatgtggcggacgagctgcctgacgaattcatcaagcttctccgcaaccgcatcaaggaactgaatcccgacgccctgcttctgggcgaggtgtgggaggacgcgtccaacaaatgcgcctacggcaagcgccgcacctactttaccggcggcgaactggacagcgtgatgaattaccccttccgcacggccattgtgaacttcgtcaagaatctggacggcggccggggctttaaggaaaccgtgatgtccattatggaaaactacccgccccaagtggcggcctgcaacatgaatctgctgggcacccacgacaccccccgcattctcaccgcgctggtggacgattttgacggttcccgggaagaaaaggccaagcgccatctgtcccggaacctgctgccggtggccgtggagcggctgcagatggcctccttcctgcaatacaccctgccgggcagccccagcctgtactacgccgacgaagccgggatggagggctaccgcgaccccttcaaccgccgcacctacccatgggggcgggaggacccggagcttctggcccatttccgccgtctggggcagctgcggaaaacctgtgacgccctgcgtctgggggacattcagttctttcaggcggaagatcgccggattggcttcacccggcgctatggcggcaacgtgctgaaaatctactgcaaccgctgcggcgacccgtgggacatccccgcggggaaaattctcatgggtcacaacctgcaaaccgtagccccggactggctgacgctggcgcccaagggcttctgcatcgtggagggataa

SEQ ID NO: 426 - DNA, 1611 bp, Unknown
  Description of Unknown: Firmicutes bacterium sequence
gtgaagagcacaaaaaaattactgtcaataactaacctcaagaaatacttccctgtagcaaagtcctccattttccagcgcgagcagttctatgtccgtgcaaacgaggatatttcgctcgacatttacgagggagagacgatcggcattgtcggcgagtccggctgcggaaagtccactctcggacgcgtcctgcttcagctttacccgcagacagccggatcgaccgtttattacggttcgacccttgacgatatgactccgctctatgtgcaggatactcttaagcattacggaaagtactgcaagaagcttgcaaaagccgatgcaaaagctaaggagcttgaaaaaaagctcgaatccgtcggaggtgaggaaaaggcagacttcctgcttctccagagtctcaatcttgcgcagtgcgagagacagacctgtcagtcgaacatagtcaagatcctcggcggcttccacggatatgatcccgaaggcaggggaagagcgcttcttcttgaccgctacaaaatcaatgttgagcgcaacaggatcgcggcaaagaagaaggatgttgatatagttattgaccatcttatttccgcagaaaatgcggcaaagacagtgaaaaagcaggctttgcttacaagaaagagcgaggttctcggcagacagcttgacgcgctgaattcgaagatggctgaccatgacaggcagcttgacgccctccgcgcgtcatatgccgggaacgccggattcgatatgtacgagccgatgcgcgacaacggaatcgaccttgcgcgcctgaagtacagagaaatgcgcattctgcgtaaggatcttcagatcatcttccaggatccgtattccagcctgaacccccgcttcacgatcggacagatcatcgaagagggactgatcactcacaaattctaccgtcagggctcccagaaaatgcgtgatcacgttgtcaacaccatgaaggagtgcggacttcaggagtatatgctcttcaggtatccgcatcagttctccggaggacagcgtcagcgtatttccattgcccgcgcgcttgcggtgcagccgaaattcgtcgtatgcgatgagtgtgtatcggcgcttgacgtttcgatccagtctcagataatcaacctgcttcaggagcttcgcgagaaggaaaacctgacttatatgttcatatcgcatgacctttcggtcgtaagattcatctccgaccgcatctgcgtcatgtatctcggaaacgtagtcgagcttgcctcggctcagacggtgttcgaggatccgcgtcatccgtacacggttgcgcttctgtcttcgatccctacgaccgatcccgagagccttacaaaggaacgtatcattcttgagggcaatatacccagcccgataaagcctccggcaggatgcaaattccacacacgctgctacatggcctgcgataagtgcaagcgcgttccgccgcctcttaccgagatcgagccgggacactttgttgcctgccacttcccggaaagaaaaattgatgagaacggcaactatctctttgagcttcccaagaccgagcgcaaatccaaccgtcaggcgacagccgaatga

SEQ ID NO: 427 - DNA, 3114 bp, Unknown
  Description of Unknown: Firmicutes bacterium sequence
atgaaaataacaaaatttctgaaaaaggtccgggtatcaccggtgcttgcggctgcggtattatcagcatcgcttgcactcgcgacagtgacgggagccgcggtcatctccggttcctgcggtgcgtcggctgaatattcgttaagcgactccggcgtgcttgaaatcaccggaaccggcaatataaacagttattccgtcagcgacgttccgtggacagaatacgcatcgcagataaaatccctgaagattccttccggcataaccggaataggggtaaacgcctttctcagtcttgatgtcagtccggtttcggttccgaaatcggtgatttcaatcgaggctcacgctctcggatatacatatgacagcggttccaaagaattcaggcgcatctccggctttgtcataaccggagccggaggttccgaggcagagaggtatgccgatgtcaacggctttaccttccgttcggaggacagcgcattttccggcgcctgcggcgacaacctgacatggacgctcggcagtgacggggtgcttaccgtttccggaagcggaagcatgatggatttcaagtcggcagggacggctccgtggtcgaagtactcatcgaaaaccgacggggttgtcattacctcggtaatcatttcgtccggtgtcacatcggtggggaattatgccttctcggggtgcagacagcttgactcggtctcgcttccgtccgggcttgcatcgatcggtgcctgctcattcgaggactgctcttcgctgaattccgccgtcattcccggaacggtgaaaaatgtcggagaagcggcgttttacggctgttcgtcacttgagtcactgacggttcagaacggcgtggcttcaatcgggaactcggctttttctctcacggcagtaagagatgtcacactgccgtcatcggtaacggctctcggcgaaaaagcgttttactcctgtgaatcgctgaccggaatatccatgacgggtgtcactgtcataggtcagaaggcatttgccgactgccgcaatctgaaaaccgtatcaacaggcgcagccctcaccggtatcggtgaatcggcttttgaatcgtgcggttctcttgtcagcatagctttcggtcagtcgctttcgatgatcggcagcagagctttttacgaatgcgcatcacttacggcggttacactgcctgacagcctttccgagcttggaagctttgcgttccgggactgcacggggataaagtcggtcagcctcggcggcgggataacgaccgttccgacaggcgcgtttgagggctgcagcaatctctcgtctgttaccttcggcggtgctgtctcaacggtcgaagagcgcgcatttacaagctgtcccgagcttcgcgcggtaacgataccggtttcggtcagacacattgccgacaattccatcggatattactattttgaagcgccggaaagcagtgtcagcggcgcatatactaaatataccggctttactccggaaataatctcatactatccctccgctgccgaaaagtatgccgcggcaaacaatttcaccttcacaagtctcggtcttgtccccactgacggcggtatgctcaccgacagagcagagtggacgttcaacacatcgaccggtattctgactgtcagcggaaacggtgcggtaccgggatatctgatgtttgaggaagccccgtggtctgtgttcgagggctatatcacctccgtcgtatacgcgccggggatcacaaacgtcggctctgcaagctttgcggactgcgcgtctgtcacatcggtaacccttgccggaaccgtcacggagatcggagatgaggcgttttcaggaacggggatcacctccgtatcgcttccgaagggacttaaaacgataaatgacagtgcgttttccgcctgcaccgagctttcgaacgtttcactttccgacacggttacaagcatcgggcagtttgttttccgcgggccgaaccggctgacatcgctctatatcccggaaagcgtcggattcatcggctccttttcggtgggctatgacgaggagaacaagcctgtaaagggtttctgcatcaagggagtcaggggaagcattgcctacaattatgcagagataaacaacatcgacttcaaggagaacggctatacggaaatttccgatccggaatccggctgttccgtcagcgtcatcggctcggattcctccgattaccggctttcgtttgtcatgaaaagcgatacgcttgcgccgaacgtattccttgccgacggggaaaaaggctttctgtatgagatcattcttatgaaaggcaacgtaacggcggagatcgagggaactgcgacaatttcgttcccggttcccgacaacgtcagccctctcgggataagaatatacggcatggctgacaacggcgcattcagcgagattgattttaccgtcgagtccggcagaataaccttctcgtacggttctctcggaaattttgtcataaccgatgccgacctgtcgaagctgtatcttataaccgcgtattaccgctttgccgacggctcggaggctcttgcgccaaagacattccgcgcgactcccggtgcggcttttgagatcggatattccttcatcgagggatatctgccggatgtgaaaaacatctccggaaagataaacgactctgataccgaaatcgtttttacctatcatcccggtgccgtctcctctgacagcgcggagacctcagacggaacagacgataagccgggaaaaaaatcaggcgcggcaaagacggttctgcttattgtcgagataatccttgtcctcggaattattgcggcggttaccgtgctcatcattctgagccgcaggaaaaagaacgaggggagcagaagcggaaagacgatagccggtgccgcaaaagccaacgataagtttgccgacacgattgttgttcccgacgcaccgacaagagagcttgacatccagtcgctctttgccgatgagccggaagaggacaaaaccgcctcatccgacctgagagattcacagaagacccagaacagaaacaataacggcggcagaaagcagtaa

SEQ ID NO: 428 - DNA, 3546 bp, Unknown
  Description of Unknown: Firmicutes bacterium sequence
atgaacattatctgcagacagatcgaaaacgaaagagaataccgtgagctgcgggaatcggtaagagaacggatgtcgggacatctgccgcgcccggcaaggatcatcggactttgcgaaggagcaagaaacgcaatgatatccgcgcttgcctccgacaccgcagacagcggctgcccgatgctgcttatcgttccggatgagaaggaagctatgcggtgcttcacgtctctttccgagatggggcatacgccggcggtattcagcttccgtgactatatattttataacataacagcctcccatgagtatgagcatgagaggctcggcgtgcttacggcgatacttgacggcacctgcgacattgttatcgctacaccggatgccgcgcttcagtataccattccgaaagagcgtcttgccgcctcggtcatgacggtgaacgaatccgacagcattgatatggactcgctgaaggcttttcttgtcggaaacggttacagcgcggttgaaacggtcgatgccgccgggcagtactctgtcaggggcggtatcatagatatttatcctcccggatacgaatacccggtcaggcttgagcttttcggcgacgatatcgacagcatgagttatttcgatatcatatcccaaaggcgcacggagccggcacagtcgctgaggatcaccccggcaagggaaattctcaccgacagcgaaacggcgtcaaagctgcggaagatcatcaccgcacagctgaaacgcacggcgaacgaccacacgatcgaccagctttctgccgagcttgaagccatcgacggcggaaccgaactgcggttcatcgacaagtatataagcaccgtttacccggagaaggagtgtctgcttgactattttctgaaaaatgcggtcgttgtctgcgaggaatttgcggcgctttccgaaaggatcaagtcatatgaatggcaccagaagcaggcggtaacctcacttcttgaagaaggggcaatcgcggcgtccggagcagaatacggcaagtggagggatgattttctttactttgtcggcggtcatgccggtgtcatcaccgattccttcatgagcagtgttcctgagataaagatcacgtcggaatacagccttgtcacaaagcagacggtttcctacagcgaaaatcttgagcttctctccgatgaccttgcctcttaccgcaagagcggcttcagggtcgttatcctctgcgagaacgagataatggcaaagaacctgcgcgggattcttgaagagaaatccggagcttttccggtaattaaaccgggtgaggacatccctgacggaaccgatacggtaattacctatgggatcaacatcgcgggttttgaactgacggcgtcaagatttgccgttatgtcaacatatcctgccggaagctcatattcgcgcacacaggtggctttgagaaagcgcagaacaaaaaagaaatctgcgcaggaaaaaatcatgtcctatgccgacctgtcggcgggggattatgtcgttcacgtcaatcacggaatcggaatgtttctcgggatcgagagcgtgacggtcgagggtgtgacgcgcgactatatcaagataaaatacgccggaaccgatatgctgtttcttccgtgcgaccagcttgagaacatttcaaaatacatcggcgcaaaaggtgaggacggcacacttaagctctcccgtctcggcggtgccgagtggggaaaggcaaagagccaggtcaaagcggcggcgaaggaaatggcaaaggagcttataaagctgtatgccgaacgtcagagacgccccggatttgcctttgctcccgacgacgatatgcagagggatttcgaggagtcgttccagtacgtcgaaaccgacggtcagcttcaggcgataaaggaagtcaagcaggacatggaacagccccgcccgatggacagactgctttgcggagacgtcggcttcggtaagacagaggtcgcgatgcgcgccgcgttcaaggcggttgaatcggggaaacaggcggcgattcttgtgcccacgacgattcttgcgcttcagcactatcagacactgcttgcccggctgcgcggattcccggtaagggcggatatgctctcgcgcttcaggtctccgaaacagcagcaggaaaccctccgccgtctcaggcgcggcgaggtggatatcatagtcggaacgcacaggatggtatcaaaggatgttgtcttcaaggatctcggacttgtcattgtcgatgaggaacagagattcggagtcgcggcaaaggagaagctgaaacagcttgcctccggtgtcgatacactgacgcttaccgcgacgcctattccgagaacgctgaacatggcaatgagcggtattcgcgatatgtcggttcttgaagaggcgccgaacgacagagttccggttcagacatacgtgcttgaattcgacgatgttatcatcggggaggcgataaaaaaagagcttcgccgcggcggtcaggttttctaccttcataaccgtgtcgaatcaatgcccgaaattcttgcaaaggtatcccagatggctccggaggcacgcattgctgttgctcacggcaagatggataaggaagagctgtcggatatatggcgctccatgctgacgggtgagatcgacattctcataagcacaaccataattgaggcgggcgttgatgttccgaatgcgaatacgctgataattgaggattccgaccgtctcggtctttcacagctgcatcagatacggggcagggtagggcgctcgtcaagaagggcgtatgcctatttcacgtacagaaagggcgcggttctctcggacattgcttcaaagcgtctcggcgcgatacgggagtataccgagttcggctccggcttcaaggttgctctccgtgaccttgagatacgcggtgccggaaaccttctcggttcggagcagcacggtcacatggacactgtcggttacgatatgtatatgcgcctgctgaacgaagcgatccttgaagaaaaaggtgaggctccggcgaaaaagaccgagtgcaccgtcgatatgaacataagcgcctatattccggaaagctatatcaaaagccccgtacagcgcattgacgtttacaagaaaatatcgcttgttgagaacgtcgaggacactgtcgatattgtcgatgagcttcttgaccgctacggtgagcttccgaagccggtcgcggctctgcttgacgtatcgcttctgcgctctctcggttcggaatgctcgctgacgaagattcagaagaagggaagctccgtcatattctggccggagaagatcgatatcagaatatggacgctgctcgcctccgaacggcgcgggacactgcttatgagccttgatcttaagccttatgtgacgctgaagctgaaaaccggtcaggatcccgccgacgcggttaccgatgtactcaacgcatacattcgtataaagaaaaattcagccggagagggaacggctgaagtgaaaggatga

SEQ ID NO: 429 - DNA, 1926 bp, Unknown
  Description of Unknown: Firmicutes bacterium sequence
atggggcgtgacgtcatgtttgccgacagggagaatctctggcagtatgaggggcatataaatgatgttttcggcttcgtgaacgagcggcagatctgtcgtccggagctttgggagaggtttgtgcttcagttccgcacacatcccgattccgacggcggctggagaggcgaattctggggcaagatgatgcgcggagcctgctttgtttaccgcgcgacaaagaacaaagagctttactccgtgcttgaaaagaccgtctgcgacatgatggacagcgcggatgagaacggcaggataagctcgtattctgttgagcgcgagttccggtcgtgggatatgtggtgccggaagtacgtcatgctcggcatggagtatttttatgagatctgcgatgatgaggctctccgcggcaggattttgtcctctctctgcggtcagcttgactatataatctcaaaggtcgggagaaaagaggacggaaagaccccgatatgcgagacgagcgactactggcgcgggctgaattcctcgtctgtgcttgagccggtaatgaagctctacaacatgaccggagaaaaaagataccttgatttcggcggttatatcgcggagtgcggcggaacgtcggtcgagaacctctttgaccttgcgctgaacgacaaaatgatgccgtatcagtaccctgttacaaaggcttacgaaatgatctcctgcttcgagggtgtgcttgagtattaccgtgtgaccggcgacgaaaagtaccgcaccgccgttgtcaacatcggaaagcgtgtgcttgagaccgatttcacggtcatcggaagcggcggatgcaccggggagcagtttgaccattctttcgtgcggcaggcgaacaccacaaacagccgcgtcaagcaggagacctgcgtgacggtcacatacatgaaattcttccttcagcttctgcttgtgaccggcgacccggtttacgctgacgcttttgaaagagcatattacaacgcctacgagggcgctctcaacaccgggtgggcattcgatgccgacgacacgagaatatacgacacgtgggtgaaggagcccgtcccgtttgacagctacagtccgctcaccgccggaaagcgcggaaacaacgtcggcggacttatgaacatctgcggagacaggtattacggctgctgcgcctgcataggctctgccggaatcggtcttgtgccggagatgcaggtgctgacatatgaaaacgggcttgcgctgaaccttttcctgccgggagaggtcacgacccgcacgccgtccggaaacagggtgcgcattgtcacagagaccggctatccggtgtcagggaaggtgaagctcacgctttatcccggagcggcggagaaatttgagctgtcggtgagaaatcccggctggagcaggaacacgtgtgtgttgctgaacggcgaaagcaccgatgccgcttccggctacatccgcatttcccgcgaatggaagtccggagacaccgttgagcttgaccttgatatgaggataagaaccgagcgcccgacgccctacggtcatcagatacttatgaccaaggtcgattggggtcacaattacattcttccggtatacgacgaggaagacccggcggcaaagtatcacatcgcgcttctccgcggtccggtcgtgcttgcgcaggacagccgcctcggaagcgagatcgacggcgcggttcagatcgccgttgacagcgagggctatgcggaagggagacttaccgcggacatcccgttcccgcacgccgtcggtgcagagatcctgctctccgacggaagctatatgaaaaccgtcgattacggctccgcaggaaaactgtggacaaacaagagccgtgttgcggcatggatcctgacaaaggactgcgcgggagaataa

SEQ ID NO: 430 - DNA, 2178 bp, Unknown
  Description of Unknown: Firmicutes bacterium sequence
atgataaaactgacagaccacggagtttacctcataaacggaaccaccccgaaggacacctgcaatgtcccggcggaggaggcgagaaagggtaccattgcttactcgatcctcacctcccacaatacgtcgggaaacgacagcgggctgaagatccgctttgatgctctggcatcgcacgacataacctacgtcgggataatccagacagcaagggcaagcgggcttgagagcttcccgataccatatgtccttacaaactgccacaacagcctctgcgccgtcggcggaacgataaacgaggacgaccaccttttcgggctctccgcggcgaagaaatacggcggaatatacgtcccggcgcatcaggcggtgatccactccttcatgcgcgagaacatggctgcctgcggaaggatgatcttaggctccgacagccacacgagatacggcgctctcggcacgatggcgataggcgagggcggaccggagcttgtgaagcagcttctctgccgcacgtatgacatcccgatgccggagatcatcgcggtcaatcttgtcggtgctccgaaaccgggcgtcggacctcacgacgttgcaatcgcgctcatcggagcagtgtttgagtcgggatttgtcaggaacaaggtgcttgagttcgtcggcgagggcgtgaagaaccttccgatagagttccgcaacggcatcgacgtcatgacaaccgagaccacctgcctctcgtcggtatgggtcaccgacagcgaaacggaaaaatactacatgatccacaaccgcccggacgattacagggagcttaagcccgccgacgttgcgtattacgacggaatggtgactgttgacctgtcaaaggtcgagccgatgatcgcgctccccttccaccccggaaacgcggtcacaataagcgagctgaaaaaagaccctcacggcgtttttgcgcgcttcgggctgaatttcgacgataagatcgacaaaaacggcaacatccacgtcgatcagggcgttatcgcgggctgcgccggcggtatttatgacaatatcgtggcggtgaacgacattctctccggcggctcggtcggaaacggcgatttttcgctctcggtttatcccgcaagccagccggtgcttacccagcttgtaaaggacggcactgctgccgggcttcttgacgcgggagcggtcatcaggactgcattttgcggtccctgcttcggcgcgggcgacgttccggggaacggctgtctcagcatccgccactccacaagaaactttcccaaccgcgagggttcaaagcccggaagcggtcagcaggcatatgtcgcgcttatggacgcgaggtcgatagccgcaaccgccgcaaacggaggcatcctcaccgcggcgaccgagcttgacgtcgattacaccgagccggaatacgtttacgacgattccgcatacagaaaccgcgtttattacggcttcggaaaggcagatccgacggcagagctccgcttcggtccgaacatcgccgactggccggcaatggagcctctcggcgacgacatcataatgaaggtctgctcatacatcaccgacccggtgacgacgacagacgagcttatcccgtcgggagagacctcgtcctaccgctccaatccgctgaagctggcggaatttgcgctgtcaagaaaagatcccgactatgttgcaagggcaaaggagacagtcactgagactcttcccgaagcggtaaggactgttgtttcggctcttgccggagaagactccgctccgcagatcggaagcgttatctacgcaagaaagcccggcgacggttcggcaagagagcaggcggcttcctgtcagcgcgtcctcggcggaagcgcgaatattgccctcgaatacgcgacaaagcgctatcgcagcaaccttatcaactggggcatgatcccctttacaacaccgtccgagccggatttcgcggtcggagactacatacttgtccgcggaataagaaaagccgtaacatctgccgcagagcagatcacggcggaggtgataaagcccgacggtacacactctcccctcaccctttccatccccgcaatgaccgcggaggagaggcagataatccttgacggctgtcttatcaaccactaccggaacgagatgaagtaa

SEQ ID NO: 431 - DNA, 2004 bp, Unknown
  Description of Unknown: Firmicutes bacterium sequence
atggcatcaaaaaaagcagaaaacgaatacggaaatcagagcatcgtatccctcaagggtgcggacagagtcagaaagcgtcccgctgtcatattcggctcggacgggcttgagggctgcgagcactcggcttttgaaatactctcaaactctgttgacgaggcgcgtgagggctacggtgacaggataaatatgacggtatactccgaccactcgatcgaggtcgaggattttggtcgcggagtgccgcttgactggaacgagaaggaacagcggtacaactgggagcttgtctactgcgagctttacgccggcggcaagtacaacaacaacagcgactcttcgtcgtacaaatattcccttggacttaacggtctcggcgcgtgcgcaacgcagtacagctcggaatacatggacgtccgctcttacaaggacggaaaggtttatgagatatccttcagaaagggcgagccggcaggcgacatgactgtcaccgagctaccgaagaaggaacgccgcaccggaacgatccacagatggcgtcccgatcttgaggtctttaccgacattgcgattccgctcgactactatcttgatatgctgaaaaagcagtcggtggtcaatccggggataaaatttcatctgagatggcagacggatgaggggtttgaggaatacgacttcgtttacgaaaacggcatcatcgactatgtcaccgagcttgccgggggaacctccctcaccgcgccggtcatgtggtcgaccgaggcaaaggggcgcgacagagaggacaaggaggactacaccctcaaggcggatgtgtcgttctgcttctcgaacgtgacgagcgttatcgaatattatcacaactccagctttcttgagcacggaggctcgccggaaaaggcggtgcgttcggcatttgtttcggagatcgacaaatatctgaaatcgaccggaaaatatctcaaaaacgagtcgaagatcagctttgccgacattgaggactgtctcatccttgtctcgaacagcttctcgacgcagacatcatatgagaaccagacgaaaaagtccataaccaacacattcatcgcagaggcgatgacatctttcctgcgccacaatcttgaaatatattttgccgaaaaaccgcttgaggccgacaagatcgccggacaggtgcttgtcaacaaaagaagccgcgaaaaggcggaatccacgcggcttgacataaagaaaaagctgagcggctcaatggacgttgccagccgggtcgaaaagttcgtcaactgccgctccaaggatcctgaggttcgggagctttacatcgttgagggaaattcggctctcggctcctgcaagctgggcagagcggcggaatttcaggcgataatcccggtacgcggaaagacgctcaactgcctcaaggcgccgtatgacaagatattcaagagtgagataatcaccgatctgctccgcgttatcggctgcggcgtggagataaagggcaaggtcaagggagacattgttcccttctcgccggagtcgctgagatggaacaagataatcatctgtaccgatgccgataaggacgggttccagataaggacgcttattctgacgatgttttaccgtctgctgccgtcgctgataaagatggggcggatttatattgccgaatcaccgctttacgagataacctcaaaggacaagacgtattttgcctacaacgaaagcgaaaaggtaaagatacttaccgatatcggagacgcaaaatattccatccagcggtcaaagggactcggtgagaacgagcctgacatgatgtggcagaccacgatgaaccccgcgacgcggcggcttatccgcgttaccgagaccgacgcgatacggactgcgtacattttcgacacactcctcggcgacgaccttcaggcacgcaaggagtttataaccgaaaacggaagcagatacctgtctgacattgatatcgacgacgactga

SEQ ID NO: 432 - DNA, 2529 bp, Unknown
  Description of Unknown: Firmicutes bacterium sequence
atgagcagtaaaagagaagaagaaaaaaattacgaatatcccgaccagaggataatagacgttcatatggagaaggaggtcaagacctcgtttatccagtatgccatgagcgttatcatatcgcgtgcgcttcccgatgtgcgcgacggtatgaagccgggacagaggcgtattctttacgcaatgtatgaggaccatctcactcacgacaacgagttccggaaatccgctatgacggtcggtgccgttctcggacattatcatcctcacggagactctgccgtttacggcacgatggtcagaatggcgcaggatttttcctaccgctatccgcttatagagggcaaaggaaacttcggttcggttgacggcgacccgcctgcggcttaccgttacaccgaggcaagactggcgcgtctttccgacgagatgatgcgcgaccttgaaaagaacgttgtcaaaatggacaggaacttcgacaacacgcgtgaggagccttcggtgctgccgtcgcggtttccgaactttcttgtcaacggcgcggtcggaattgccgtcggtatggcgacaaacgttcctccgcacaacctcggcgaggtagttgacgcgacggttttccgcatggacaatccggaatgcacggttccgcagcttatggactacataaagggtcccgatttcccgacaagaggcacaatttacggtgtgaacggcataatcgaggcttacaccaccgggcgcgggcggctgagggtgcgctcaagggcgaccatcgatgaggataagcaccagataatcatcaccgagataccgtacatggcgaacaagagcgcgcttatcgagtcggttgccaaccttgtcaaggaaaagaagatctacgggatcatcgatgtccgcgatctttcaaaccaggggacgataaagatagtattcgactaccgacgcgacgcgaacggcgaggtcatactcaatcagctctacaaatactctcagctggaggacacctgctccatcaatatgcttgccatcgtgaacggcgagccgaaggtgctttcgctcccgcaggtgcttgatcactatattgcgcatcaggagagcgtcatcaagaaccgcacgatatttgaccttgcaaaggcaaaggcgcgcgcacacattcttgagggatatctgacagccatcgacaacatcgacgagatcgttgagataatgaagacttccccgtccatcccggaggcaaaggcaacgctttgcgagaggttcgggctttccgacgagcaggcgcaggcaattgttgacatgaccctcggcaagctgacgggtcttgagcgtcagaagacggaggacgagctgaacaggctgcttgcgcttatcagcgatcttgaggacatccttgccaacgagtggaggatcaaggagataatcaagaacgatctgcttgagataaagagaaaatatgccgacgagaggcgcacggagatagttgcctctgcgaacgagatcgtttacgaggatcttatcgagcgacacacctgcgtaatcacgctgacgaaggacggatacatcaagcgtctgccctccgacatatattcggcgcaaaagcgcggcggaaagggcgtcatcggcatggcgacgaaggaagaggacgttgtggatcaggtcgtcgcggtcaattcccactccttcctgctgatgttcacgaacaccggaaaggtacatgtcaagaaggcatacctgataccggaaagctcccgcacggcaaagggcacggcggcggtcaacgttattgatatcgagaagggcgagaagatcacggcgcttatatcgcttgacgatttcgagggcgacgggtgcctgaccatggtgacgaacaacggcatcgtgaagcgcacggcaatttccgagtttgcttatcagaggaagggcggaaagcgtgccatcactcttgacgagggtgacgagcttatctatgtccgttcgaccgggcaggaggatgagctgcttatcgcgacgggcgaaggaaacgcggtcaggttcccgatatcctccgtcactccgaccggaagaaattcgcgcggcgtcataggcatccgtcccggagagggcgaccatgttgccggggtctgcgtcgttgatgagagcaaaaagctgcttaccgttaccgaaaagggcttcggaaagcgctgcgaattctctgactttgccgctcacaaccgcggaggcaagggcatgaggtgtcaggcggtcagcgacaggacgggaaggcttgccgctatcgcagcggtctctgagaccgacgacatcctgataatcaccgatcagggaacggtcatccgcacacgcgttgaggagataccggtatactcacgctccgcatccggcgttatcgtaatgcgtccggaggaaggaagcgttgtgtcaaacttcaccgttgtcgaaaaggaagaagaggacactgaggctgtggcggtcacggatgaggctgaggtttccggaaatcccgcagattccggggacgggacggctgagtga

SEQ ID NO: 433 - DNA, 1101 bp, Unknown
  Description of Unknown: Firmicutes bacterium sequence
atgaaacggatcgcaattctgctggcagctgtgcttgtcctgccgtgtctgcttttctcctgctccggtgaaaagtacgaaacggtcatggaatacaacggtgtaaagctgaccgagaatatgtattactactggatgtcaaccttcaagaggaacatactcagctcatactcggacgccaaggacgacgcctctttctggcaggcaaaatacgatgaaaatcagaccgttgaggagtattttaccgaaataatcaatcagcggataatgaactatctcatcgcgcagagcattttcagggaacagaagctgaccctgtcctccgacgagaaaaaagcgataaagaacgatattaaagaaaaaatcgaatactacggaagccggggagagctgaacgaagaactgaagaatctgatgctcaatatcgactcgcttgagacgatctatacgtgggaaaaacggcatgacgcggtatacgactatttttacggcaaaaacggaaccgaaacggtcagtgacagccagataatcgactactatgaaaaaaattactcaaggatcaagtatatcgtcttctataccacgaagataaagaccgatgacaaggggaactatgtttactacagcgacggacagcttgtcacggaggagatgaccgaggaagaacttgctgcgacaaaaaagaaaattgaggaatgcaacgaaaagctgaacaacggcgcatcatttgatgacatgataaaggaatacagcgactacaacaagataaaggaatatccgaatggcttctatgtctcggcaaacgagatatcgacatggggaagcggtatcgtctccggcgccgttaccgcaaaaccgggtgatgttttcagagttgacgaagaagcggcggtctatcttgtactgaagtgcgagcttacgccgtttgacagcctttcggataccgattccgaccagttaaagaatctggcaagctacgcgacgaccggactgtacagagaaaagttttccgcgctttcagaaaaagtgaaagtttcgggtgagattctttcaaaatacagactttccgaaattaaagcaaatccgtattattccttctga

SEQ ID NO: 434 - DNA, 2163 bp, Unknown
  Description of Unknown: Firmicutes bacterium sequence
atgtacatagaatcggtttatgcggtcagcttcggcagtcttaagaatgtctctctcgacctgacctccgggatgaacatcgtcgagggtcggaacgagtcggggaaaagcacattcggcgagcttatccgtttcatattttacggtttttccgggaaagctgaccgcgagaatcatctgagcttttcgaccgggatcgccgagggaagtgccataatcaactgcggcggcaagcggtatcgcattgagagacgctgtgtcggcgcgaaggacagcctttccgtcatcgaccttgacgacgggagcagctgttttgccggaaaggtgccgggagaggtgttcttccgtctgccggcgaagctgtttacaagcacggtttttgtcggtcagacggcggggagacggatcgacgggagggagacctccgaggcggttgaaaaccttctgttttccgccgacgagtcggtcagcgcgaaaaagtcgctccagatacttgacaagggaagggtgtcgctcctgcacaagaacggcaagggcggcaggctttacaccgttgacggtgagatcggggagcttaaggaagattttgaggcggcttcaaggtcgaacggggagatgatctctctcaggggaagcacggcggagctttcggaacggcttgagaccgaacagcggcagtcggagacgataaacaaaaatcttgccgggcacaggatgcttgagatacgggcgcgccggaagcggcttgaggatgcggagcgggattatcgggagatcgttgccgaggctgacgctttcagaaaagaaaacacgcgcaacggctttttccccgacagggagtatgcaagacagcttgaggaatgcgccggcgcgattgcaaatgccgagattcgcagaaaagaagcggatagcttgctgaaaaagcttgagcgcgagagggatgccgctgtcgccgaccgggattccgccgagaaaaagcggaatgccgaaaagagtgcgctcagcgcgaagaaagccaccgcgatcgccgcggcgggagtctgcatactgttctttattattgcggcagcggcgacggtgcttatgttcctcggaaaaagtgagctttggatccttctggcggcggtttcgctgctctcatttgccggaatggtgacgggatttgtgttctccgggcgcatttccggacggctaaaggagcttgccggggtcggaagcgatccggtcgggatgttctcggcgcagcttgagcttatccgtccgcagtttgaccgagcaacggaagagagggacaaataccgcgggacgcttgacacgctgtgccggaaatggggaatgcagaccacttcgacggcgcttaacgagctgagagaggttctgaaacgtgatgaggagctgactgcagagaccgaaaaacgccgggtggcatatgtcggactcaagaccgaggacgaggagctgagccggggagagccggaggacgacggctctgagataacccttcctgccgggtttgatttcaaggatgcgatgcgcaaggcgaagtttcttgatgcgaagctgaaaatggatgccgaagcgctgaaaagaaatgagctgaggcttgccgctcttgaggcttcggtcagggagccggcggagatcgcggagcgtctgactgcgcttgagtatgagcgtgaggcacttgaggagcagtatcgggcttatgttcttgcttttgacagtctgaacagtgcgagcgaaaaaatgcgcggagagatagcgccccggctgaccgaaatgtccgggaaggtgatgggagcggtgacgcacggaaaatacgatgagctgggcgttgacagcggattttcgctttccttccgtccggagaccggaaacggcgggcggataacgaagggtgaggaattcatgagcgccggaacgtcggatgcggcttatgtaagtctgaggcttgcgcttgcgatgcttatctgcggggaggacaggcttccgcctatgttctttgacgagagcttttcgaggatcgacgacacgaggcttgcggcgatgctgaagatactttcggcaagcggggcgcagaccgttatattcacctcgcttgacagggagaaggagattgcagaccgggagagcattgactgcgggtatgtgaggctcggttga

SEQ ID NO: 435 - DNA, 1500 bp, Unknown
  Description of Unknown: Firmicutes bacterium sequence
gtgacggtgaaattcagcctgcttcagaaaaaagaagacagaccggcggtctgcgaggtcatttatgacctgtcggttgaccgcgcggttcataatattatcgaggacacacggcgtgccgattatttcgtgtcggttctttcaaagccgctgaccgacagggacaatatcatattcagacagcagatcttcggcgattttcagaacattcccggtctttttgactccctcagactgctcttcgcacggtatgacagaataaagagcgactggcaggagatgaaactcggcaccgcgaccggaagaggcgcggaaataaaccccgaggcacttctcgagtacaccttttcgtcgctcaaggtcaccgcgatattcccgtcaacgatagcgtctttcttttcctcgataggcgataccctctccgggtacccgataacggcggaggggcttgtcgcaatgcgcgactggtgccgcggaatggcggacaatgccgcacttgatgagatcgttgaaatatcccagcttttcaggtatcagacgcccgactgctttgacttcaccgttgcggcaaagctcgacggcgcactccggctctgtctctgcgacatatcggggatttcagagcataaaccggagggcggcgcgctcagccgcatcttctcaaagaaaaaagccgacgacggattcagagccgtcactgcggaaatatcggaggcgggggaagacccgtattccgattcggtgttcatgcttaacgaggcgctttgcaggatagattcagcgcttacgcaggtgactgacgaggtctacggcgcgtttttcggaatgtcgaatgaaatgatgttctatgaagccgcgcttgcctatgcagacgttgcaaaagagagcggcgtcccgctgacaatgccggatatccttcccgcagaagccgactgcatgaacgcaaaggggctgcgagaacttgtgcttttgtcaaacggtgccggcgcaaagaccgtgccgaacgatgtttcgctgaccgcgtcggaatcaggtcttctcgtaaaaggactgaccgacagcggaaagaccgtctatctacgcgcgataggctcggcacagctgttcgcgcaggcggggcttcccgtccttgccgagtcggcatgcatgagcataaggcacggtttcttctcgcacttctcgtcagccgaggaggaatttctctccggcgatgcggcggggcgcttcgatcaggaggcaaaggagatcgcgcggataataagcgggcttaccccgcactccctcctgctcctcaacgagaccttccagaccacctcataccgcgagggcaccgagagtatgtacaacatcctccgcttcatgcccggtctcggaacgaaatatatcttcgtcactcacctcacccgcctcttcggatatatgcagaacgaaaacgctgtccttgcaaacacctccgacgacccggcgaaaaagtataagatagaaataccggagcgttga

SEQ ID NO: 436 - DNA, 2397 bp, Unknown
  Description of Unknown: Firmicutes bacterium sequence
gtgtacaacgtaaagaaacgcaacggaaaaatcgtaaagttcgaacttgtcaaaatcgcagaggcgataaagctcgcctttgaagctcaggaaaagcagtacaatcaggacatcatcgactttcttgccctcaaggtcacagcagatttcgagcccaaaataaaagacggtcttatcgctgtcgaggacattcaggacagcgttgaaaacgtgctcgtccagtccggatattccgacgtcgccaaggcgtacattctttacagacgtcagcacgaaaagatccgcaatatgaagaacacgatccttgactacaaagagatcgttaacgactacctcggaaacaacgactggcgcgtcaaggaaaacgcaaccgtcacctactccgtcggcggacttatcctctcaaacagcggcgcgattaccgcgaattactggctctccgaggtttatgacgacgagatcgcaaacgctcacagaaatgccgacatacacatccacgacctttccatgctcaccggctactgcgccggatggtcgctgaagcagctgataaaggaagggctcggcggtgtccccggaaagatcacctcggctcccgcaagccaccttgcaaccctctgcaaccagatggtcaacttcctcggcatcatgcagaacgagtgggcgggcgcacaggcattctcttccttcgacacataccttgccccgttcgtgaaggtcgacaacctcacgtacgatcaggtcaaaaagagccttgaatcctttatcttcggtgtcaacaccccgtcgcgctggggcactcaggctcccttctccaacattaccctcgactgggtagtccccgctgaccttgcggagcagaaagccatcgtcggcggcaaagagcttgacttcacgtacaaggactgcaagcgcgagatggacatgatcaacaaggcgttcatcgagataatgatagagggcgacgcaaacggcagagggttccagtacccgatccccacatattcgatcacccgcgatttcgactggtcggataccgagaacaaccgcctccttttcgagatgacctccaaatacggcacgccctacttctcaaactacgtcaacagcgacatggagccctccgatgtccgttcgatgtgctgccgtctgcgccttgatctgcgcgagctgagaaagaaatccggcggcttcttcggaagcggagaatcaaccggatcggtcggtgtcgtcaccatcaaccttccgagaatcgcgtacctctcggctgacgagggcgagttcttcaaccgcctgaaccgcatgatggacatttccgcccgctccctcaaggtaaaacgcacggtcataacaagacttctcaacgaggggctttacccttataccagacgctacctcggaacctttgccaaccacttctcaacgatcggtcttgtcggaatgaacgaggtcggactcaacgcaaagtggctcggaaaagatcttacgcacagggaaactcaggaattcgccaaaaaggttctcaatcacatgagagagcgcctctccgactatcaggagaagtacggcgacctctacaatcttgaagctaccccggctgaatccaccgcctaccgccttgcaaagcacgacgtaaagcgttatcccgacataaagaccgccgccgtcaaggaaggcgataccccctactacacaaacagctcccacctccccgtctggtacaccgacgacatcttctcggcacttgacattcaggacgagcttcagacgctttacacctcggggaccgtgttccacgcattcctcggcgaaaagctccccgactggcgtgcagccgcatcgatcgtgcgcaagatcgcagagaactaccgtctgccctattataccctttccccgacatattccgtctgccgcagacacggatacatctccggcgagcatttcaactgcccggaatgcggcgaaacgaccgaggtgtacagccgcatcaccggctactaccgccctgtccagaacttcaacgtcggtaaggctcaggagtacagggacagaaaggaatacaacatagggacatctgttcttgatccggcaaagcacccggcggcaggctgctgcggagagactatggagcaggcttctctcggcgacgctcccgactatgacgacaaatactatcttttcgcaacgaaaacctgcccgaactgcaaggtggcggcagcaatgcttgaaaaagcaggcattccctatgagaagctctatgtcgacgaaaatgaagcgagagcaaaggagctcggtcttaagcaggctcccacgcttgtcatcgtaaacggagacacaaacataaagtttgccggtgttcctgcgataagaaagtaccttgactcgacagcaaagtaa

SEQ ID NO: 437 - DNA, 2226 bp, Unknown
  Description of Unknown: Firmicutes bacterium sequence
atggaggaaaaaaacatgaaaaagtttgcagcacttgtgcttgccgctcttatgactgtttcgctctttgcctgcacgacaaagccgaacaatccttccggtacttccggcggcgacagcacaacgattcccggcggtattcctgatgttgataacggtgatatcaattattacaacttcgacggcaagaaatacggcgaggacggcgactacatttccgtttatgacaagtacggaaaagacgtaaccattgctgacgtcaagaagaacagcgaaggcgattactacatcaccaaggacggcaaggattatgtcctcggacttgacttcctcagcatggctatggtttataactgcggaaccggctctgaggctgaacagaagcaggcatatgcaaagtggtggcagtactacatcgagagatggaacaagctgcttcccgaaatgcccctttactccaacgagtattacgatgttttcagcactaagctcgaaggtgtcaaggatcatcccaccaacccgctttggggcgttgccaatgcgataatcgactggtcttccaagaaggacgacaagagcgccattatcggtaactccaccgagctttccggcacgttccgttactctgctttcggtgcttccaaccccggcgcagccgaccttgatgttcagaatctcatcaccggttacggcactgtggttgcgaacaaggaaggcgactatgtctgggacgaaaggaccgttgtgaagagccacaaggaaaccctcaacgaggacggctccaagaccttcgagatcgagatcaaagagggacttacctacagcgacggcactcccatcacggctaaggactatcttgtccactcgctcgtattctctactcccgttgccgcagaggcagcaaagaaggaccaccgttccgctatgacgattgtcggctatgaggatttctcttccggcaagaccaaggagctgaagggtctgcgtctcctcggagattacaagttctccgttaccatcgacaaggagtacatcccgtacttctacgacatcacctatgcgggcttcagccctgtatatccggctgtatggcttgacgatgccgacatcaaggatgacggcaacggctgctacatcaccgataacttctatgcaaaagacggcgacagctatgtcaaggcggctcatatccttaagtccgccaaggaaatgacatcctatcccttctccggtccgtacgttgtcagcgagtacaatgcgtccgacaagaccgcggtcctcgttaagaacgaaaagtatgccggaaacttcgagggcgtaaagcctcagatcgaaaagatcacctacaagaagctcgttacaaagacccagcttcaggacctcgagtccggcggcgttgacattctctccggcgtgaccggcggcgatgccacaaaggaagcgctcgctcttatcgataagaagaagggcgaattcgattccgtcaactacagccgcgcaggctacggtaagctcggctaccgctgcgacttcggacctgctcagttcgcaaatgtccgcgcagccatcgcatactgcgttgaccgcgagagctttgcaaagacctttaccggcggttacggcaccgtttctcacggcccgtactacaccggctcatggatgtacaaggcttgccagaaggatatcaagctcaatgcctacaccgtcaacaaggataaggctataagctgccttgaagaagacggctggaactatgacaaggacggaaatgcctacacttccggcgtccgctacaagaagatagctgccaacctcatcaaggaggctgacaagacctacgcttccaaggacggcacttacaagactgttaaggtcggcgacttctactatatgccgcttgttatcaactggttcggtacagttgaaaatgacttcaccgatcagcttgtcaatgcattcgagcagaactctctgctgaaagagatcggcatggtcgttcagaagacgaccggcgacttctacccgatgctcgcagagcttatccagggtgagtacggctccggcaaatacggcggaatcccggtttacagcgcattcaacttcgctaccggattcaccagcgctgtttatgactactcttgggtaaacacggtcgatccctccctgtacgatagctatcagagctactacatcagagatctcgctgacgttatctggctcaagtaa

SEQ ID NO: 438 - DNA, 1464 bp, Unknown
  Description of Unknown: Firmicutes bacterium sequence
atgagcgaaaataaaccgagaacatactgcaatccgatctcccttcccgatattcccctcgggtctgacggctggggagtcatgagatttacgaacgagaagcaaagagattaccgctccgtcagcgacccctcggtgctttatctcgacgggaaatggtacctgtatccgagctacgggatggcattcgtttcggaggatttcgtgacgtggaagcacgtccggacaaagccctatgacatgaaatacagcccgacggtcgtgccgttccgcgggaagtaccttatgacctcacattcgcacgggctttatatctccgactcgcctctcggggattttgagtatctcggcgacttcataaagcccgacgggacggaattccgaccggttgaccccgcgctgttcgttgacgacgacggaaggctttacctctactgcttcatgatgcggggcggagagcacaagaggacattcgtcagcggttccttcggcgccgagcttgacggagacgacccgagaagactggtcaccgaccctgtaatgctgaacacctttgacagaaacaacgtctgggagcggttcggagagtacaatcaggacacgctctgcggctggatagaggggcagtggatgctgaagaagaacgggaggtactatctcgtttacgcttcctccggaacggaattcagcaattactgcatggcggcatactattcggacaagggaccgcttgagggctttgtgctccagaagaacaacccggtcacgatcagccgcagcagacttatgaccggagcgggacacgggtgcataaccgagggaccgggcggaacactgtgggcgttctatacgacggctgtcgcctgcgtacacctttatgaaagagtcatcggcatggatcttgtcgcgattaattccgacggggagctttacgcgccgcacggagtgacggagataccgcagcttgcgccgggtgttgccgaagatcccgtaaaggacaactcctccgggatgctgccgctcaccgtcaggcagagagccggggtgatcgcttcgtcggcgaccgagggaagggatgcgttttatgctcttgacgggacgcttcttacctactggcgtccgcgggaggacgacccgcacccgacgctgacggttgacatgatggcgccttatatcgtcggcggggtgaggataatctggcgcgacatcgggcttgacgaaaagaacggcgcgctccggggaccgtaccgctggatacttgagggtcgtccggacaacgaccgggatgagtgggtaatgctccttgacgcgggcggcaacgacaccgatcttcttgtcgattaccgcgagcttccgccggtttcctgcgagagcgtcaggctcaccgtatgcggtcatcccgacagggtgtttccggcggtcatcgacttcacggttttcggaaaacgggacgagagcatataa

SEQ ID NO: 439 - DNA, 1908 bp, Unknown
  Description of Unknown: Firmicutes bacterium sequence
atgaagatatttgaatatgacgtaattatcatcggtaccggtgctgcgggctacaatgccgcgtgccggataaaggaggacggaaggctttcctgcgcgattgttaccgagggggttgactgcggaacgtcgcgcaataccggcagcgacaagcagacatactataagctcggtctcggcggcgacagccccgacagcgtgagaaaaatggcttccgatctgtttgcaggaggaagtgtggacggcgacaacgcgctgtgcgaggcggctctgtcggtcaggtgcttcatgaacctgtgcgagctgggtgtgaaattcccggtgaaccgttacggggaatatgtcggctacaagaccgaccatgacccgtatgcaagggcgacctctgccggacctctcacctcaagggacatgacggaggcgcttcagaagaacgcggaaaggctcggagtgccggtttacgacgggtatcttgtcgttgaggtgatgaagaacggaaaccgcgtctgcggcatcatgtgcatcggaaaggcgaccggtgaggctgtctgcttcagatgtgcggacgtgatcgccgccgtcggaggtcctgccggaatatatgccgacagcgcgtatccggagtgccataccggaagcaccggggtatttcttgaagccggtgccgcggctcagaatcttaccgaatggcagtacgggcttgcgtcggtgtctccgagatggaacgtttccgggacatatatgcaggtccttccgcggttcgtatctgttgatcccgacgggacggagcacgaattcctcgacgattatttctccgaccgttacggggcgctgtcagccgttttcctgaaggggtatcagtggccgtttgacagccggaaggtgcttgacggctcgtcggtaatcgatctgcttgtttaccgtgaaaaggttctgaatcaccggcgggtatatctggatttcacgaaaaatcccttcgggcttgaggagatagattaccggaagctgtcgggcgaggcgcgggagtatcttgaaaaggcgggagcctgtttcggcagaccgatcgaccggcttcttaagatgaatccccctgcggtcagcctgtacctcggaaagggcagggatatatctgcggaatatcttgagatatcgctctgcgcacagcactgcaacggagggatatccgtcgatatgtggtggcagacctcggtgcgggggctttttgccgcgggagagtgcgcgggaactcacggagttacccgtccgggcggctcggcgctgaatgccgggcaggtcggttcgctgcgcgcggcgctttacatatgcagctatccgaacgaaaagacttccgatgcggaatttctgccgatacttaaaaaatgcgcggaaaagcaccgcatgatcgcggaaagtgttatcggcggcgaggagaataccggaaagctcatctctgacgcacagagaaggatgagcgacagcggagcggctatcaggcggcgtgacgggttgtcaaatcttcttgaaattaccggggaagagcttgccgggatatccgacaaggcttctgtctcgtcggcagacaggctttataccttctataagctccgcgatattctgttgacgcagtgcgcggtgcttacagcgatgatcggttattccgacacggcgggggagacgcgcggttcgtcgctctgttatgatccttccggaaaactccgtgacgggttctctgaaccgttccgctttgccccggagagccgcggagaaacaaggaaaagtattcaggaggtttatctttccgacggagccttcagctgccgcacacgcgatgtcagaccgattccggaggacgactcgtttttcgagaatgtctggagaatataccgcgaaaacggcggaatttattga

SEQ ID NO: 440 - DNA, 2655 bp, Unknown
  Description of Unknown: Firmicutes bacterium sequence
atggcttacagagttaaaacaggaaaatttgactcctccgagtggatatgcggcgaaaactcatatcttgaaactgcagagaagataaaaagcatccccggcgccgaatggatatggccgcagacatatgcccgggtattcatccggaaatacttcaccgccgggaagaacgagaaggtcagagcggaattcgtctgcgacaatgaatttgagctgtacataaacggcatgaaggtctgcggcggcgtgacaggctttgagggcgatatcacagagtacgtcagggagggcaaaaaccgcctgaacatccgcgcgtaccagaccgccgattacagctttttcacctccgcgatatgcggagtgataaaggtcggggagaagagcatcttcaccgacggaagctggcagtcataccttgccgcgtcgttctgggagaacagcgaaccggacttctggcaggagcttgaccccggatacaatatgacaaaagcctgtcccatccaccctcgccttttcaagcggtcgctgtacatgagaaagcggttcaccgtaaacgggcaggtcataagagcggtgctttgtaccacctcgcgtggactgtcggagatgtacctgaacggcataaggactgattcggagctgttttcgcagggaatttccgagaagtaccgcgaataccacacggccgatgtcacgtcaataatccgtcagggcgacaatatgctcggcgcgatcaccgcaaacggctggtacaacagcgaatcgcacagtcaggtgttcatgaataagccctgcctgcgcgcggagcttgagattacctgccgcgacggcaggaaggagcgtacctgggtcatcggcaccgacggaagctggctgtgccgcttctctccgtataccgacaacgatattcagttcggcgagagatacgacgcacgtcttgaggcccccggctggtgtcatcccggatcatccgacacgggctggcacaactgcgtcacggttcctgacagcgatccggaattcacgctgagaagctatccgccggtcgtcgttaaacgccgtattcggccccgcagcgaatcggaataccgaggacagcccctgttcgatttcggcgaaaactgcgccggaaggtactgtatcgctctcagaagcacatatcccggtcagaaaataaggatcagcttctgcgaaagtctcgacggggacgggaaaatgatcaccggggcatacactcccgtgttcttcaaccgtgacgcggacgaaaacggaagatctcccgcgtgcatgagaaataccgatgtatatatctgccgcggcggaaacgagacatatgaaccgcgcttcaccttttccggcttcagatacctgaccgtctcggggcttgaatcccgcgatcagctggtctatgttgaaatgacggtaatgcacaacaacctccccgacaccggacggctcgaaagctcatacccccttgtcggaaagctgttcgacgcgacaagacgcacatggcttgccaatatcataaacggtccgatggactgcccgacccgcgaaaagaactattggaccggcgattcccagctgttctgccagaccgcctgctgtctgtccgactgctcggattttctcgcccgctggactgacgggggacgcaagatgtgcccgaatgtcagcggctggggcgacgaggtgtatatcattccctacaccctctaccgcttctacggcgacagggaaattctgagggtgcgttatcccgacatcctgaaatacgcggaggaacgcctcaccgaccttgaaaacggacttccgaggtggctgaattctcccttcaacgaccacctgtctccgtggcttgtaaacgtcggcggcgaattcttcggctgtgcgtatttctgctatatgctgaaaatgacggctgagatcgccgggatcctcggagataccggaacggtgaagcgtttcacttcactctccgaagccgccgaccggggcttcaacgaaaaattctatctcccggacgaggagaagtacacccccgcgggacagtcgggctacgtcctgccgcttgccttcggaattgttccgcaggagcgccgcgcgcttatggctgaaaagctgaaccgtgcagtgcttgaaaagggaagccttgacaccggatacgccggaacgcgttatatcatgaacgtactctgcgattacggctatgagaaaaccgcgttcatgctccttgacagaaaggaattcccgtcgtggagctatatgctgtcgcagggcggcaacaccataaccgagacatggcgcggcatcggggatatgtcggaggaaaagagcctgagcatgaatcacttcaccctcggctccgtcaccggctggatgttcagcgacctctgcggaataaggtgggacgaatcggcgcccggcttctccgagatcgtcctccgtccggtattcatcccggaaatgggcgacataagcgcggagcttgacaccgattacgggaagataaaagccggctggcgtgtatcggacggaacagcgtactattcgtttgacgtgccgcgaagcacaacgctcatccttcccgacggaaaaaaagaaaaatatcccgccggaaatcacaccgcggaatataagctgaataacatataa

SEQ ID NO: 441 - DNA, 1149 bp, Unknown
  Description of Unknown: Firmicutes bacterium sequence
atgaaattcacagccgaaaaaaacgcgatacttgaggtaacgctcccgacctccggttttgcatcaggaaaaagcactattgcaacaacagagggtatcctcttccgtacgaccggggacgggtcctgcgatatcgttgcatatgaccttgaaaaaggaataaagacctctcttgaatgcacggttgaagaggagggctgcgccgttatcaatgccacgcggtttatccagatagtaaggacaatgcctgacgggcagataacggttgccgttgatgagagaaacaaccgcacgatgatctcgtcgggaaatgcaaagtttgagcttcaggcgctttccggaaaggactttcccgacctgccggagctacgcggcgacagagggttcacgataaagcactgcgatctgaagaatcttattgcaaaaacacagtttgcgatagccgtgaataatccgaggccggagcttaacggacttgaccttgacgtgaagggcaacaggatcaccgcggtatcctgcgacggaaaccggcttgccgtttacggaatggactgcgagatagagaacgtcggtgttacagccgagctgaatttcaacataattcttcccggaaagacggtcaccgagcttatgcgctttgtgaacgattccgaggagctgatgaagataaacgttgcgcggaagcacattatgttcttcatcgggaaattcattgtttttacccgtctgatagatgcggtttacgtcgattacgaccggtttatcccgaaagcgccgaaaatttttgcgacggtcgggacaaaggagcttgagggtgcgctgggacgcgcgcttctcgtcacggaggagcgtcagcaggggcaggtcaagagcccggtcatctgcgacatcaccgacggctgtatgactgtttcgtcgtcgtcggtcaccggaagggtcaacgacgagatcacggtggagcatgagggcgagaatatcgagatcggtttcaactgccgcctgcttcacgatgccgtcagcgtctgcgacagcgagtcggtgaagatatcgctcacttccccgcttatgggcatgaccattgagccggcggaaaaggaagaggggaagaaattcctgatgcttgttttgccggtgaggttgaataagtaa

SEQ ID NO: 442 - DNA, 1800 bp, Unknown
  Description of Unknown: Firmicutes bacterium sequence
atgtcaactgtcagaacaccgtggctcaacaattacggcgacattcccgcaaagctggaatacaagaccggcactatgtgggaagccgttgccgacgttgccgccgaatatccggactatgtcgcctatgccttcatggggaggcagactacatatcagaaattcgcaagggacgttgccgcctgcgcaaagtcgcttaagaagatagggataaatcccggtgacagggtcacgatatgtatgccgaactgccctcagaccgttatcatgttctacgcggtgaacgtcgtcggcgctgtcgccaacatggttcaccctctttcgagcgagaacgagatcgcgttctatctcaatgagtcaaaaagcatcgcggcgatcactcttgaccagttttacggcaagtttgcggcgatcagaagcagggtcaatcttgccaacctgataatcgccgatgtgaaggacgcactttcgccgctgatgaagatcggttacagcctgaccgccggcagaaagataccgaaggtacctgatgatgctccggtcatcagatggaacgatttcatcaggatgggcagaagctataccggcgaatataaggtgaagagagataagctcgaccccgcggtcattctttacagcggcggcacgaccggaattacaaaaggaatactcctttcgaacctcaatttcaacgcccttgccgcgcagataatcgctacaaacccggtattccgtccgggagactcgatgcttgccgtcatgccgatgttccacggcttcggactcggtgtcagcattcattcgatgcttgcaaacggcggcagatgcattcttgtcccgcgctttaccgcggaaagctatgccagattgataataaagtaccgctgcaacttcattgcgggcgttccgacgctctatgaggctcttctgcgtcagtcggtcatggacggcgccgatctctcctgccttaagggcgtgttcagcggcggagactctctttcggttgagcttaaaaagcgctttgacaggttccttgccgaccacaatgcctccgtaaagatcagagagggctacggaacgacagagtgcgtcaccgcaagctgtctcaccccgcttcaccttgcaaaggagggaagcataggccagcccttcccggacacctattacaagatagttgcccccggtaccgaggatgaggtcccttacggcacggagggtgagatatgtctctccggtcctaccgtcatgatggagtacgtcaatcaccccgaagagacggcaaaaacgctcagaactcattccgacggacttaagtggatacacaccggcgacctcggctgtatggatgaggacggtttcatatatttccggcagaggatcaagagaatgatcgtgacaagcggctacaacgtttacccgtctcagcttgagaatatcctcgacgcgcatgagctggttcagatgagctgcgttatcggggttcccgatccgctgaagatccagaaggtcaaggcattcatcgtcctgaagcccggatatcagccgaccgacgaaaaccgggagatcatccgcgagtactgcaggaagaatattgcaaggtacgcaatgccgtatgatatcgaattccgcgagagcctgcccaagacccttgtcggaaaggttgcataccgcgtgcttgaagaagaggaagcggcaaagagagcggcaaatgcagcggcgaaaccggcagaaacggtttccgccgacgaaaagccggaagtcagcgaaacagacgcaaccgcccccgcgactgtcagataa

SEQ ID NO: 443 - DNA, 1977 bp, Unknown
  Description of Unknown: Firmicutes bacterium sequence
atggataaattattgcaaaaaatcgaagagctgagaaaatcgcttgaatatcacgcaaggcgttattacgttgaggattcgccggaaatttcggactatgaatacgacatgatgttcaaagagcttaaaaaactcgaggaggagcatccggagtacgacagcccgaattctcccactcaccgggtcggaggaaaggcgcttgacaaattcgaaaaggtgacacataccgtccctctcggcagtcttacagatgttttcagctttgatgagctcagggcttatcttgactcgacaggctctgatgatgaattttccgttgaggcaaagattgacgggttgtctgtggctctgcgctatgagaacggtgttttcgtcagaggcgcgacacgcggagacggtgttgtgggagagaacgtgacagagaacctgaaaaccgtcagaagcattccgcttgcaattccgtacaaaggtacgcttgaagtccgcggggaggtttatatgccgaggagcagctttgaaaagctgaaccgggcaagagaagagcgcggggagcagtgctttgccaatccgagaaatgcggcggcaggctctctgcgccagcttgattcaaagatcacggcatcgaggggacttgatattttcgtattcaatcttcaggtgtgcgaccgggaattcacaaggcacgacgagactatcgcgttcctgcgggaacagggctttcatgtcataccactgataaagactgtgagaggttatgatgccatcaccgcgcagatagaggaaatagggcgcctgcgcgacgggctgccttatgatatcgacggtgcggttataaaggaaaacctgctctcccggcggcgtgagctcggagagacggcaaacactccgaaatgggctgtcgccttcaagtatcctccggaaaagaaggcgacgaagctgaccgatatcgtcattcaggtcgggagaaccggggtgcttactccgaacgcggtgcttgatccgattcgtcttgccgggacgacggtcagccgcgcgacgctccacaatgcggactatataagagagaaggacataaggatcggcgacacggtgtttgtccagaaggcgggcgacataattccggagatagtttcggtcgatacaaaggcgcgtgacggaagcgaaaaggtatactctatgcccgacaggtgtccgtcgtgcggagagccggtttatttttcgccggatgaggcggcgttgaggtgcacgaactctgcctgcccggctcagcttataagaaatatcacatattttgcctcaagaggcgcaatgaatattgacggacttggggaaggtgtggtaaaattactctgcgaaagcggacttgtgaagaactgcgccgacctgtataagctgactgtcgaaaaacttgccggacttgaacggatgggggagaagtcggcttcaaatcttgttgccgcaattgacgggtcaaaggaacgcgggcttgaaaggctgctctgcgccttcggaataagacaggtgggagaaaaggcggcaaaatcgatagcgtcgcatttcgggtcgatagacgcgctttcatcggctgctgttgaagaacttacggcagtgccggatgtcggcggggtgacggctgaaaatgtcgtgaatttcttctcgcatccgcagacggcggcaatggttgatgagctgaagagtctcggcgttaaaaccgatgcggcatcggtcagggtgagcgggggaaagcttgacggtctgacgttcgttctcacgggaacgcttccgactatgagccgcgacgaggcttcggcgcttatcgaaaagaacggcggaaagacttcgtcatcggtatcgaaaaagacttcatatgtgcttgcgggtgccgaagccggttcaaagctggcaaaagccgaaaagctcggcgtgacggtcattgaggaaaaagatctgcttgcgatgattgccgggggacaatga

SEQ ID NO: 444 - DNA, 2859 bp, Unknown
  Description of Unknown: Firmicutes bacterium sequence
gtgaacgaattaaaaagaaggaacaaaaccggcaatatgtcactcagcagtataatcgtaaagggcgcaagagtccacaacctgaaaaatatagatgtcaccgttccgagagacaggttcgtcgtctttaccggactttccggctcgggaaaatcgtcactggcattcgatacgatctatgcggaggggcacagaagattcgtggaatctctgtcgtcctacgcaagaatgtttctcggacagctggataagcccgatgttgaccttatcgagggtctatcccccgccatttccatcgaccagaaaacaacgtcaaagaacccgcgctcgactgtcggaacagtcaccgaaatatacgactatctgcgccttatgtacgcgcggataggcattccgcactgcccggtctgcggaaaagagataagacagcagagcatcgaccagataatagatgacatatgctccctgcccgcgggaacgaaattcatgatccttgcccccgtcgtatccggcaaaaagggtatgcatgaaaaggtattcgaggacgcaaagaaaaacggctacgtaagggtgcgtgttgacggtgaaatgtacgacgtgaacgacattccggagcttgagaaaaacaaaaagcacacggtggatatcgtcgttgaccgacttgtgatgaaggaggggataagaggcaggcttaccgactcggcagaaaccgcgctgaaccttgcaaagggcaaccttcacatcgtcaccgtcggagatacgccggaggaataccggtattcgcagaattatgcctgcgaggagcacggcttcagcatgggagagctttcgccgagaatgttctcgttcaacaacccctacggtgcctgcgaacgctgtgccggcatcggagagctgagaaccgtatcgtttgacctcatctgcccggaccgttctctgtcgcttgccgacggtgcggttgcggtaaacggcttcaaatcgcttgacgacagcacatggacggcgccgctttacgaggcggtcggagagagacacggcttcacgcttgatatgccgataaaggattactccaaagccgcacttgacgctctcctgaacggcaccggagacgaaatatatgagatagaccgttccttcgacggcaggcacgcgcatcagagggtgaaattcgaggggatcctcagcataatcgagcagcggtattcaatgagccagaacgagtactacgagcagttctttgagttcatcccctgcccgaaatgcaaggggcgccgcctccgcgacgaggtgcttgccgtaaccgtcggcgggctttctgtcgatgcgctctgctcgctctcgatagacagcgcgcttgactttgtaaatgcactgaagctcacccaaaccgaagaagctattgcccgcgacatcgtgaaggagctccgctcgcgcctcggattcctgaaaaacgtcggcctcggctatctgaccctgtcaagaaaggcaggtactctgtccggcggtgaatcccagagaatcaggctggcaacgcagatcggctcgtcgctcatgggagtgctctatatccttgacgagccgagcatcggacttcatcagcgcgacaaccaccggctgatagaggcactcaaagccctccgcgacatcggaaacagtcttatagtcgtcgagcatgacgaggaaaccatgatggaggcggattacatcgtcgatataggacccggtgccggaataaacggcgggcaggtcgtcgccgtcggcaccccgcaggaaataatcgacaaccccgcctcgataaccggagactatctcagcggcagaaggaaaattgccgttccggaaaagcgccgtgagggcagcggaaaattccttcagatcatcggtgcaaggcagaacaacctgaaaaacatcgacgtcgcgatcccgctcggaatgctcgtctgcgtcaccggtgtgtccggctccggcaaatcgtcgcttataaattccatcctctaccctgttcttgcaaagcagctcaaccgcgctgtaacccatcccggaaagcatgacagaatcgagggcatcgacaatcttgataaggtcatagcgatagaccagagcccgataggacggactccgcgctcaaatcccgcgacatataccggactgttcaacgacatccgcgagctttttgcctcgacaaacgacgcaaagatcaggggctacaaagccggcaggttctccttcaacatcaagggcggcagatgcgaagcctgcgagggcgacggtgtgaaatgcatcgaaatgcacttcctcccggacgtctatgtcacctgcgacgtctgcaagggaaagcgctataaccgcgacacgcttgaggtgaagtacaagggcaaaaacatcttcgacgtgcttgatatgacggtcgatgaggggcttgccttctttgagaacatccctaagataagccgcaggctgaaaacccttgccgacgtcggacttggatatataaagatcgggcagtcgtcgacaacgctgtccggcggtgaggcgcagagggtcaagctggcaaccgagctgtcaaagcacagcacaggaaggactgcctatatccttgacgaaccgacgaccggacttcattccgccgacgttgaccggctgatatcgatactccagaggctgaccgatcagggcaacaccgtcattgtcattgagcacaaccttgatctgataaaaaccgccgattatatcatcgacatggggccggagggcggcgacatgggcggaacggtcatagcctgcggcactccggagcaggtggctgaagtcaaaggctcctataccggatactacctgaaaaatatccttgcccgctga

SEQ ID NO: 445 - DNA, 1446 bp, Unknown
  Description of Unknown: Firmicutes bacterium sequence
atgcttacaccaatatatgaaaaactgcacatcacgtcgtcggtttcggcaataatcatctcgcttgcgcttatgctgatcggcggattcctcatgacgcgcataaccaagcgtcttaagctgccgaatgttacggcatatattcttgcggggatcattctcggtccgttctgcctgaatctggtgccggggaaggtcattggcggcatgagcttcattgccgacattgcgcttgccttcatcgctttctcgaccggggaattttttaagctctccgcgctgaaaaagaacggcgcaaagactgttgtcatcacggtgcttgaggcgttccttgcctctgttcttgttttctgcgtgtgctttctgctgctgcggcttgaattcaatttttcgatagttctcgccgcgcttgccgccgcgacagcacctgcgtcaaccgtgatgacaatacgtcagaccggtgcaaagggagattttgtcgacacactccttcaggtcgtggcgcttgacgatgttgtcgggcttgttgcttacagcattgctgtctcggtggcggttgcctcttcgaccgggacatttgagcttctgtcggtcataaagccccttcttctgaacctgcttgttttcgctctcggcggaggattcgggtttgttctgaaatggatgcttttcaaacgttcgaccgacaaccggcttattgtagccgttgcgctgcttttctccttctgcgggatatgcgcccttcttgatgtttcgccgcttctgggatgcatggcaatggggatggtatacataaacgcaaccgacgacgagcggctgttcaagcagctcaactacttctctccgccgatactgcttctgttttttgttcgttccggtctgaatttcgatctgagcgctcttgtaaacacctcggacatcatcggcggggtgccgctgatccttatcggcgtggtgtatttcatcgtccgtatcgcagggaaatatgccggggcatatatcggctgtctgataacgaaaaaggacaggtcggtgcgcaattatctggggcttgcgcttatccctcaggcgggggtcgcgataggacttgcggcgatgggggcgcgggctctcggaggaggtgccgggacggcgcttgaaacgataattctcgcctcaagcgtgctgtatgagcttatcggtcctgcctgcgcaaagctgtcgctctacctctctcattcctattcggataagcttgaggacataaccgatacaccggaaaccgatgagaacgggaacaaaaagagcgaggtcgagctgcttatcgagcggatacaggcgattcagaaagagcttccggagcacaaagacccgtattacgaggacgagaaggcgttttccgatgccgcagaggagcattacgcaatgctgaaccgttcgctttcgaacacaaggaggaaaagataa

SEQ ID NO: 446 - DNA, 2127 bp, Unknown
  Description of Unknown: Firmicutes bacterium sequence
ttgaccgatgagattccgattacgggaaggagatacgatatgtcatacaactacatcaattacagaggcagctgcgcacgtttcgatgaagaaaaaaggacacttgatatcgggggagagcagggggcaatactgtccggtctcggcatcacggtacacacccgcgacctgaaccatgtttatcaggcaattacccctgccgattattcctccgtgtactgcgcgcatgaaaaacaccttgcgtcaaacgggctctccgtctgcttttgcgggggaccggaggctcttccgttcttcatcctcagagtgatactgtctgccgacggcgcggacatctcgcttgaagcggagcgcgacagcgactacttctatgatattcacggtcacgccgtgtggggagcaaaccccgaaagcgacacctttgcaatgtattccgtaaaccccggaaacggtcttcgctgtgcgataggtcccgccgcggcaaggggatgcgattcgctttttgaccgtctgaccgacaggcttcttgttttatcacccgcacccgcataccggtatgactatgacgtggggtgctacggctttaccgagaggctgggttgcggtaatatgtcgttttctctccgtacggtgaaggatttcatgaaaaaccgcttcggaatgaattaccgcccgatgaacaacaacactgtttttacccgccctccggtcggctggatgacatggtatgcggtcagattcggcgcgtgcgagagtgccgtgcttgaaaactcagccgtccagaaggaaaagctcgcggcttacggtgccgatgcaatatgggtcgactgggaatggtaccataaggatttcggtgattacaacggcgatttcgatagcttcaccccggatgccgggaaatatccgcacggaatgaaatatgtttccgaccggataaaagaggacggctttgtgccgtgtatatggatcggtgcgtctcacgacgtccgcgaaaaccgctttctgaaggagcatccggaatcactgcttgtaaaacgtccgtcgtggtgcggcgattattggttcgacccgacaaatccggattatctgaattcctttattccggaggtgttcagtcagcttaccgaaaaatggggatacggtgcaattaaatgggatgctctgccgagggcgcttgactacttcgatcagtatcacgacaggttcttcgacacctccgtcacctcggagcaggcaatgcgcaatgtcgtgaagaaggcgcgggaaaccgtcggcgacagagtatatatgctgtcatgtcacggcgagggcgagcgcgatatcatgctgtattccgatgtatttgatgccgcaaggatcggagcggatattttcagctgggataatttcatcgaatcgggcgtcagacgtcttctcggtttttattttctccacaacatcgccgaatactgtgacccggacaaccttgtcgtaagggaagaattcaacacctgcgatcaggcggtatcgagagcgtctcttttctcgctcctcggcaccccgataactctcggcgatgacctgcgtgagctgtctgacgggcggatcgggatcatacggcgcgcaattcctccgatgaatacacatccgatgatcccggacaggtgcgctctccctgacgaatgccttgttgtcgggtgctttgtcaggacacgcagcgacgaataccagatcgcggacattttcaatatgcgcgaaagaccggtcacataccgtcttgacttttccgggctcgaccttgaaccggaggcggaataccttgtttacgatttctggaaccgcagatttctgggtaagctccggcacggtgtgacagtcagtctgcccgcctgcggctccgcggttctttcggtaaggcgcgttaccggcatcccgcagcttgtcgcgacaagccgtcatatcacacagggcgcttttgacgtgctgtactgcggctgggatcccgatacgcgtaccttctcgggcagatcgcggacggtgccgggagacgaatacactgtcacggtgtacgatcccctcgcagacaggactgcggaggtgacgcttacaccggacggaaccgagacggactggagcattacgctctga

SEQ ID NO: 447 - DNA, 2700 bp, Unknown
  Description of Unknown: Firmicutes bacterium sequence
atggctgataagtacaacaatgacatatccgctgacgaactgcttgccaagctgaaggcaaacatggaggacggcggaacaaagtccggtgacggcaaaaagagataccggttcaggaaaaccgaaaaaaccgcttctcccgtcaccgaggaagagataaagcgcgaaatgccggagtcggacaccggatttgtcagtcccgtgccgaaatcggagatagccgacctcgatatcgacgcgcttatgaagaaatatcttccgcaggacgagtacgaaaagttctccgggaaaagcatttccgggatgaaggaggacgaattcgtcgattcgctgtcctctgccgcagaagatgaaaaccccgtgcccgacggttcaggtgcttatgccgcgccggataccgagctgttctcgacactcagcgagggagggaaggtctgcgatattcccggcgaaggcgacaccgccgaaatgcccggaagcaccggagatacggcggaggtttctgactctgccggggcgggcgataccgtcatgtttgacaccgaatccggaaacgagtccgcacccgaagccgccgaaggacagtccgcaccctccgctccggaaaaaaccggaaacgagaccgtggtgtttagcctgaacgatgttccggaacagcccgcaccgtcggagctgccggcaccggaagaggaaaatgtgccggagcttcccggaaacgaagccggcgaatccggagagatcatcgggaaccccgaaaaccttcccggcgaagcaattgccgcggcctccgaggaaaacggcgccgccgatcccgacggatttgacgagactgatgccaacctcatgcttgccttcggcatggaggacgagcttgaaaaggcaatgggcaaggaaaatgccgacagactccgctcggatatggaaaaatccatacctgaggatcagataaagaagaaaaaggtcagagaagagaagcccggtgagcttcgtgagttcatcactccggtcgaggcaaagggaatttttgaaaattacaagacggctttcggcaaaaacgcgctttcgctgtttgcgatggcggcggtcgttatcgtgctgttcttctatgaaaatatcatcactctcggcggtcatctgccggacgcgctgaatccggtgtattatccggtcgtaaatgtgatggtcggacttcagttcctgttcataggcgcgggaatcgcctaccgcagcctgataaagggcatccgcggtcttatcgacaggaagcctgtgccggagagctttataccgctgattttgcttgtcagcgtgatatttgcggtctgcgtctgcttcttcagcccggacgtcactccggtcaccttcaattttccggcatcgctttgcctgctctttgccgttctgaacgagagaatggatctgcgcagggagataatgagcttcaacatcatatcgtccaagagaacgaaattcgcgcttgaaaagctggagctcggtgacgccgagcttgagacgaaggcattcgacaagttccttccgaagcagcctgcggtattcaagatcaacaagaccggctttatcgacggatatttcagaaggacaaaggcgtatccgtcaaccaagctggtgctcaaggcatttattcctgcgtcggctgccattgcagcggcttcgcttgtcatgggtgcgatcctcctgcgtgactggcagagcgcggtcatgcttgcctacactgcgttcttcttctcgctcccggcaacggtgttcatagcgttcggacttccggcgttccgggcatcaaagctggcatttgccgagaacagcgccttcgtcggcgaatcggcacttgacgagtacacaacggcgggctcgatttcctttgacgacagggaggtcttcccgacagccggcgtaaagctccgcagtgtcaaggtgttcggctccgggcgcattgacacggtcatatacaacgtcgcaagcatttattcggttctcggcggaccgctttccgatgttctgaatgttgccaccgccgatctcggacgctcggaggacaccgaaatactgtcggtcgataacgagggcgttgaggcactggttgacggaaagcatctctatgcaggaaaggcagactatctccgcaaaaacggctatgtccccgtctcggatcccgacgacgaggagatcgtctcgggcggagagataagcatcatgtatcttgtctgcgacgacgaggtcatcgccaagctgtatatcagataccgcatcgatccgggcttcgaggtcaccgtaaagcggctctacaaatccggcatctgcgtcgggataaagactgttgacccgaatatcaacgacgaaatgctgagcacaaagatcaagctggcaaaatacccggtgcgtgtcctgaaatacagcgacatcagcggaagtcggcgcggcagcgacagaaccgacagcggcattgtttccaaaaagtcggcaaaggcactgctttcggtctttaccctctgcgacaggataaagcacgtcacaaaaaccaacatcgcagtggatataatcacgatgattaccggacttgccgtctgcattgcgactgccgtcatcggaagtgttgtgtcggtgccgtcgctgtatgtggcgctgttccagctcttctggctgataccggtatatctgatgtcgaaattcatgcttctgtaa

SEQ ID NO: 448 - DNA, 4338 bp, Unknown
  Description of Unknown: Firmicutes bacterium sequence
atgagattcctgccctctgccgaaggagaaaaaccaatggaaaaaccgatttcgcgactgaaacgcatcgcggcaatgcttgttgccgccgcacttcttacagcagtgtttccgcatatccccgcaatggcgaacgacgacagctatgacctgccgtggctctggccggtgccggggagcttcatgataaactgccttgattactactattccggagggatacacaatcaggggcagtgcatcgacatcggcgcgaacggatataccggcgacgagcggcttgacgttgtctcggcaacgacgggaaccgttctttacatacagtcgaaatacaacgagaccacaaaccgcggctccggctggggcaactatgtccttgtcagaagcgggaacataaacatcgtctatgcgcatctcagaaccgtatccgtaggctacggcgagataaaggcgggcgaggttatcggaaagatgggcaacaccggaaactcaaccggcgtccaccttcatcttcaggcatatccggtcggaggcaactcctcaagcaccgagataatggcgttcgagcagtaccgcacgaatccgctgtattatgagcagttccggtttctcaccgggcttgcggaaatgagcgtaaaatacggcggatggataaagacatactacaagaccgcggcgggagcttactataaatattccggcgggcttgacatcgggttcgacacagtcccggcgcaggcgaccgtcagcgtgataaacacctccggcgcgccggtgcgctcgctcccggtcccggacaactcttatataaccgacacggtttctttcgggaagaaagcggggataaagggctatctctttgatgcctacggcacgctctggcttgagctttccgacggttcgggatggataaagggcgaggacgtcggattctacgactatctcttctcggttgagaccgaaaacgcggtgtatcccgacggggaatacggctcgtcaagagagcttcccttcggcggcacggtgagctcgctcaatattataacctcctgcacggtaacggtgaagcagggcggcagcaccgttgcggcggtgacgaaagaggtcggggacagcagtttcctgctttcggatataaaagcgcttatgaccgatctgtcgcttcccgacggggagtacggtctgtctgtcacctgcctgctaacggcaacctatcccggagccgacccgatgacagagaccgaggagatcatatcctcccggttcacgataaattccgagatatccgacaaggtgcctccggtgcttgagaggatcgatgttacctctcttgatccgtccggcatgaccgtgaagtgcatcgcaggcgacaacaaagcaatgttccgggttgttgtcgccgtcacaggctcggacggcagggtcgtgaaggaatacatctgtacagaggacaacggcgcatggcactgcgttattcccgcatcggagatcggcggaggcggaagctataccctcaccgcaacggcatatgacgcatacggcaacaccgattccgtgacgagaaccgtgacggttccggcatccgggctgagcgaggtgtggaaggctcttgatgcgctgaagatcaggagaggccccgatgtaacctacgagcatataggtgccatcaaaaaaggcgagagcttcacgataaccgccgcgcaggcagacgacagcaagtcgtatttctgggctgagcattcaaagggctggtcgcccctcggcacttgcggcggcagtatgtatgcaaaatatgtgagcggccatctttatacggtcaccttcgacataaacggcggcaccggcgaggctccggcggcgataaacaagcggtggaacgaggatgtgacgctcccctccgatattccggtgagggagggctacaccttcctcggctgggcgcactcgacagaggcgaaagcccccgattacaggccgggcgacacctataaggaaaatacgtctgacgctctctttgccgtgtgggaggacaagatcccgccggtgatatcgtctgccgatgtttcgacgaccggatggacgaacaagccggtcaccgtcaccgtcgccgcctccgacaacggcggaagggtgttttactccttcgacggcggcaaaacatggcgtccggagggaaagcttgaggttccggagaacaccgttatccccgcgggagcgatcattgtccgcgatcagtccggaaacacggcggtctgggataaggaaataaagatcggaaacatcgacctcaccccgcccgatatggggagcgcgaaagccgagataaagacgtcggggaagagcgtcaccttcaccttctacggcatcaccgacagtgacagcgggatcgcctcccatgagatagtatattcgcaaaaccgcgatatgtccgacccgaaaacgcttgcggttacctcgggaaccgccgtcacgcttgataacggcgtctattactggctcctccgcgtgaccgacaaggcgggaaatgtgtcggaaaaatcattcgaccgcttccgcgtcggcgagacggaaaggctgaccgcacctgcggggctgaggatcgactcgacaagctccgtctccacagccgtttcgtgggaagccgtgccgggagctgattcctaccgcataagcgtcagcgaagatcccgcatttgcctccgatatcacggcggtctcggaagagaatacgcatatcatcaccgaccttaccgcaggaaagacatattatgtaagggttgctgcgctttccgacgacgggatatatctcccgtcagcatactgcgcggcggtgtcgtttgtgacgctgagcaacgactgcacgcttcacggctttgtctcaatgtccggtgcggcgataaataatgaagaaaagaccgcgtcatgggtcgcgccgtatgccgcagagacggtcgatctgacggcgtcggtacatcccggagcaacggtcgtctattcgtcgtcagccgacctttcggtagagctgaacggcacttcggcttatcccttcacctccgcgtcggcgaccgtttatatcggcatcacggctgagaacggagatacggctgtctataccgtgacaattaatcgtgctgcggaaaaagcggctcttccgacggtggatttcatcgcggaggataccgagataaatatcggagacgacgcgccggagtttgcgctgacggcagtttcccctgacggcggagtcatttcggtaacgtggttcatgacggtgaacggcggctcccccgtgaagatcggagagggcttcagtgtcactccggagctcccggtcgccggagactatgccgtctatgccgttgtcaccaacaccaacgacaagtgcgcggaaacggttgcggccttcaccaccgaccgggtaagcgtcacggtgaaaaagctggtctctccgataaccgtgacctgctccggttatacctacaacggaaatacgccctcccccgccgtatccggttatacgggagacggaaggatcaccttccggtatttcagcgacagcgcgtgcacgaaggagatcccggctccgaccgatgccggaacatattacgtccgtgcggaggcggcggagacggttatgtacgccccggtcgtcagcactcccgtgtccttcaccgtggaaagggcggagaataaggcgatgccggaatataccgtaaagcagccgaccgtccgcgatacgaacggatatgtcacgataacctcggcaggcaccgaataccgcgtgaacggtcaggacaaatggaccgccgcaggctcttctcccatggcgttcagaggaggggacgaggtcgagatacgcattgccggaactgtaaattacctccccggagccgccgtgaccgtcgtcataaaggcttatgagggcgcgaccgacatagttcccggctccaccggtctttcggttgacggagagtatctgacagttgacggctcgaagaacaccgcatcggatatccttgacggacttgaaaacagcggcggcgtcgttatccgctcggagcagggaatagtcatgaacggcaccgacgactacgtgggaaccggcgcgacaattgctgttgaggatgaggacggaaacgtttatgtctcccttaccgtgatagtcctcggcgacatggacggcgatggcatcgtcacccgcgcggatgcggaggcgataatgctgatatcaaacggcatggcaccggctgacgggaaattcgaccttgttgccggcgaccttgaccgcgacggaaagctgacctcaaaggacgcgtaccttgcgcttatgagaagctga

SEQ ID NO: 449 - DNA, 2031 bp, Unknown
  Description of Unknown: Firmicutes bacterium sequence
atgtcaaagatcatcactaacgaaaaagaaaaagaaaccgccgcggcaagatatgccgaatggttctccgatcccgcgaagataccggtgtcattcaggctcggaaacgaggtatatcacggcttcggagagggattctcggtaacaagagagccgcttcccgccggaacacaggtcggaacgccgttcgacggtctgcgcagataccgcagtctcagcgaccggggtgaaaagatcacggcaaagcatccctccggcatcacagtgacagtcatgacggcggtttacgaaaactacggcacgtttgagtgggcggtatacttcagaaacgaaggaacggagaattccccggtgctttcggagatcaacgcagccgacctttcgtttggcggacaggatccctgccttcactatttcatcggcgacgacagcgaggacagacacgcgatgaagccggagagcattctgatccgtccggggatctcacttgaaatccagccgttcggcggcaggccgacgaatttcatgctccccttcttccgcctttcgacgggagaggagactgctgttatctccgtcggctggtcgggacagtggagatgccgtttcgacaccgtcaacgcgatacgctcggtacgtatgagcgccggacaggtgaatctgcacgcatacctcacccccggtgaggagatcagaactccgatgatgaccttcctctttgccgactgccgctgtgactgcgaagccggagaggaccgcgtcataaacctctggagacgtttccttatcgactgcaatatgcgcctgataaacggtgagctcatgaagccgcacaccggtgcaagcacctcatggatatacgcggaaatgcgtgacgcaaccgatgcaaatcagatagccgcgttcgacgtttaccgtgaaaacggcataaaacccgattactggtggatggacgccggctggtacttcaagggagatcacgagctgatcgacaactggacgcagaccggcagctgggagatcgataccaaccgcttcccgagcgaaatgcgcgacattacgacccatgtcgaaaagtacggaagcaagacgcttctgtggtttgagccggagagaatcaccgagaataccttccttgccggaaagccggagtggcaggttaccccgtcgcttcttgacctcggcaaccccgaagcacgcgcatggctgtccgaaagggtcaattcggtgctgaaaaaagccggcatttcgatctaccgtcaggattacaacatcgacccgctcggtcactggctcagccgcgattccgaaaacgctcccgacaggtggggcattaccgagaatcactatgtgacaggatatcttgcatactgggattcgcttattgcggagaatccggaaatgatgcttgactcctgcgcctccggcggaagacggaacgaccttgagacggtgagacgttcggtgtcccttcacaagaccgatgcagattactccgacttcacaagaaaacaggcaatgcactactcattctatcagtggctcccctatttcggaactccggtcaccggcgccggttataccaccgatattgaaaagtatgctttccgttccgcgatgatcccgtggttcacatacagctacgatgtcagaaagagcgcggaggagaacgcgtacgaacccgccgccgaggctcttgaggagtggcacgacacgaatatgttcttctggggcgattattatccgcttaccggctggtcgaacagcgatttcgactggatcggctgggagttctacgatgacgaacagcgcggaggcataattcagctcttccgccgcgacagcagcgaagaggatatgaagacatttgttcttcgcggtcttgacccgaacaccacctacgttatacacgactacgacggcgaccccgtgtcccttgctaccggcagagagctctgcggaaccggcattacggtcgtaattcccgaaaagcggtcgtcggcgcttattaagttcacggcacgcaaatga

SEQ ID NO: 450 - DNA, 2508 bp, Unknown
  Description of Unknown: Firmicutes bacterium sequence
atgaaacaaatagcaacccgttcagccgataccgacgctccggagaaggcggaggcgcaaaaaaaaccgcaatacccgctttctgcggatgccgcgaggtatttccccgacccggacatgggtctttcgtcgtcacaggtcgaaaagagaaccgccgacggctatgtgaacgcaacggtcgatacgacatcaaaatcaacgtcgaaaatcattctctccaacatcttcacatacttcaacataatcttcttcgtcctcgcgcttgtgctgataatcgccgggacatcgatatctaacctgacgtttcttgccgtcgtcatcgtcaataccgcgatcggaattattcaggagcttcgcgcaaaaaaaacgcttgaaaagctgtcgctcatctcagcccccgtgacaaaggtcatccgcgacggacacgaggacagcataaacagcgacgagcttgtccttgacgacattgtcatctttgaagccggaaaccagatctgcgccgatgcaattctctgcgacggcgagatcaccgtcaacgagtcgcttgtgaccggcgaatccgacgagatacgcaaaaccgccggcaaacagcttctttccggcagctttgtcatttccggaagatgccgcgcgcggctcgataaggtcggacacgagtcatttgcctcccgtctgacccttgacgcgaaaaaaataaagaaaaaacagcagccgggcatgatgaagtccctgacggtgcttatacaggtcatcggcgtgataatcatccccttctcggttctgctgttcctcaatcagcactataagctcggacagtctgtcgtttccagcatagaaaaaaccaccgcagccatcatcggcatgatcccggaggggctgtatctgctgacaagcgtagctcttgcggtaagtgttatgcggcttgcaaagaaaaaaacgctggttcacgacatgaagtgcatagagacccttgcccgagtcgatgtcatctgcgtcgataagaccggaaccatcaccgagccggaaatgcacgttaaggaggtcgtcccgctcgacggtgaaggcggcgacgactactacacctgcgaacggctgattcgcgacttcgttctgaacatgagcgccgacaacgcgacaatgaaggctctgaaggatcatttcgacgacaagcgcgaattccgccgcgccaacatgataaagggcttctcatcggaaaccaagtacagcgccgtcgaattccgcgacgggtcatacgtcctcggtgcgccggaattcatactcagggagggctatgagcagttccgctcggtcatagaagagcattcctcggtcggagagcgcgtactgctctttgccgaataccggtttgagaaaaatacagacaatgacatctttgcacgcggttcgcttgacgggatcgttatccccgttgcccttgtaacgcttgaaaaccgcgtccgtccggaggcgagagagacatttgagtacttcacaaagcagggcgtgactatcaaggtcatttccggagacaatcccctcaccgtttcaaaggcatccgaagccgccggaattcccggttcggcaaaatatattgacgcttcccttctcaatacaaaggaaaagatcgcaaagggcattctcgattacaacgttttcggcagagtcaccccagaccagaagcgtgccttcatacgcgcactgaaaaaagccggccacactgtcgccatgaccggtgacggtgtcaacgacgttcttgcactcaaagacgcagactgcagtgttgcgatggcatccggaagcgaagcggcggcaaacgtgtccgaccttgtgcttctcgattcgaattttgcctgtatgccgtctgtcgttgccgagggacgaagagtcataaacaacatcgagcgctccgcatccctgttccttgtcaagaacattttctcgttcattctgaccttcttcacgctgataattggtctgcactatcccttccagccggctcagctgtcgcttgtgtcaacactgatgatcggcatcccgtccttcttcctcgcgcttgagccgaacaccgagattgtgagaggaaagttcctgcgcaatgtcatgttccgcgccttccccgccgcgcttaccgcagtcattcttgtcggatggtcgctgctgttcaccgacgcgttcaaaatcgacaccatgctttcctccgtcgcggcattctatctctactcgatcgtcgcctacatgatgctgttcaaggtctgccagccgatgacgctgttccataagatcctgttcggatcgatgggattcctgtttgtccttgccgccgctatcatccccggatggttcagccttgtcccgcttgactacggaacggtacttgtaacgctctccctggccgctcttgccttcccgctcaaccggctgataggcaacatattcgagggcttcggagattggaaaaaccgtatgaaagaaaagataagacgcgacatcgacaagatcggcgaatga

SEQ ID NO: 451 - DNA, 3540 bp, Faecalibacterium sp.
atgcctgaaaccacccaaagacaatttacccacctgcatgtgcataccgagtacagtctgctggacggcgcctgccgtattgaccgcctgtttgaccacctcaaagccatggggcagacggcctgcgccatcactgatcacggcgttatgtacggctgtgtggcgttttttgatgcagccagggccgcaggcatcaagcctatcatcggctgtgaggtctatgtagccacccgtacccgctttgataaggtcaaccgcatcgacggcaacaaccacctgatcctgctgtgcaaaaacgagataggctacaaaaaccttatcaagatggtctccgccggctttaccgagggtttttactccaagccccgcatcgataaggacctgctggaacagcaccacgaggggttgatctgtctgtccgcctgcctggcgggcgagatcccccaggccatcctggcaggggactacgagcgcgcaaaacaggccgcgttttactaccgcgaccttttcggcgagggaaactattatatcgaactgcaggaccacggcctggaggaagaccaggtcgtcctgccccagctcatccgattggcccgggagaccggcatccccatggtcgctaccaacgacgcccactacattaccaaagaggacgccaagatgcaaagcatcctgctctgcatccagaccggtaagaccatagccgatgccgaccgcatggaatttcagaccgatgagttttacctcaaaagcaccgacgagatgtacgacctcttcgcgatggtgccggaagcctgcgaaaacaccaacaaaattgcggaacagtgcaattttgagttcaccttcggcgagacgaaactgccgtacttcaaagcccccgatggcatggagaaccaggaatacttcgagaagctttgctgggagggactcgagcgccgctaccccggcaaagtcaccgacgcgctgaaagagcgcctttcttacgagatcaacgtcgtcaaaacgatgggctataccaactattacctcatcgtctacgacttcatcaactacgccaaaagccgggatattcccgtcggccccggccgtggttccggcgcgggcagcctggcggcttactgcgtcggcattaccgacatcgaccccatccgctacaacctcatctttgaacgtttcctgaacccggagcgtgtttcgatgcccgacttcgacgtcgacttctgctatgagcgccgccaggaggtcatcgactacgtcaacgaaaagtatggccgcgaccatgtggcccagatcgtcacctttggtacgatggccgcccgcgccgccgtgcgcgatgtgggccgcgtgatgggcatgacctaccaggacgtggaccgcgtggccaagctcatccccatggagctgaagatgacgctgaaaaaggcgctggaggtcagccccgacctgaaagccctttatgacggtgacaatcaggtgcatgaactcatcgacacttcgttaaaagtcgagggcatgccccgccatgcctccacccacgccgcaggcgtcgtcattacccgtgaaccggccaccgagtacgtgcccctgtccaccaacgacggcctgccggtcacccagttcaacatggtggagatcgagcgcctgggcctgctgaagatggacttcctgggcctgcgcaccctcaccgtcatccacgataccgagatggccgttcgccacaccaaggacccggatttccgggtggccaacattgactacgacgaccccgccacctacgagatgctgactcgcggcgagacgatgggcatcttccagcttgaatctaccggcatgacccaggtgctgatgagcatgcgcccgaaaaacctggaagatgtcatcgccctgatctcgctgtatcgccccggcccgatggattccatcccaacgtatttgcgcaacagaaaggacccgtccaaggtcgtttatcagaccccgcagatggcccacatcgtggatgtgaccaacggcgtcgtcatttatcaggagcaggtcatgcagatctgccgtgagctggcaggcttcagcttcggccaggccgacaatgtgcgccgcgctatgagcaagaaaaagctcaaggtcatggaggcagagcgcgaacattttgtccatggatgcaccgagccgggcaaggagtgcgctggctgcgtcaaaaacggcatcccggaggcagtggcaaaccagatctacgatgatatgatcagttttgcctcctacgccttcaacaagtcccacgcggcctgctacgcctacgtggccttccagacagcctacctcaagtgccattacccccacgagttcatggccgccctgctgaccagtgtgctcgataatacgtcgaaagttattgaatatacttccgagtgccagcgcttgggcatcaaggtcctgccgccggacatcaacgtctcccgcggtggcttcaccgtcgatggcgacagcatccgcttcggtctcaacgccgtcaaaagcgtgggccgcaacctgatagattcggtggtaaaggagcgcaaaaaccgcccctaccgcagcctgtacgatttctgcaagcggctgcacggcaacgaactgaatcgccgcgcgctggaaaacctcatcaaggcaggctccttcgatgcgctggagcccagccgccgcgctatgatcgacagcgccgagggtatcctgaaaagcgtcgagaccgacgcccgtcaaaacctggaaggccagatggaccttttcggcatgatgggcggggaacaggagcaggccgccagcgattacaagatccccaacacgccggaatatcccgccggcgatctgctcaaaatggaaaaagaggtctccggcctctacctgtccggccacccgctggacgcctaccgcgcccagatcagccagatctccacctgcaccatcgccgacctgcagggcgaggatgccaagcgttttgacaaccagaatgtcacgattctttgtacggtcgtcaaaaataagatcatgaccaccaagtccaacacgctgatggcctttactaccgtcgaggacctgaccggtacgatggaactgctgatcttcccgcgggtgctggccgagtgccgcgccgccctgcaggaaaacgccgtcgtcgtggccaacggccgcgtctctgtaaaagaggaagaagccgcccgcctgatcgtcgagggggtgcagcccatcgagcactacgacccgagtcaatctttcggtaaaaaccgggtggaaaaagtccgccgcgagaccggcgggggagaggccgccggctatttcctgacggtgcccagccgccagggcccggagatgcacaaggtggaaaacctgctgtgcaacatctttgacggcggcactaccaaggtctatttccgctttgcggacaccggccaaaaggtgctggcccgccatatgaccatcaaggatgacccgctgttgcgcgccgaattggaacgcattttgggtaaagctcatgtaaaagttcagacggctgaacaaaatgcaaaataa

SEQ ID NO: 452 - DNA, 3462 bp, Faecalibacterium sp.
atgctgttttcttcactttttgctaaaacagccgaatatgaaaaactggcgcatgcgctctccgcaccgggggcatgcgccttattcggtttacccggttccggccgggcgatggtctacgccgcgctgtcgaaggagaccgggcgctttctctgcatcgtgacccccggcgaggctgaggccactcgctttgccggggacctgaacgccctgggcatccccactgccgttttccctgcccgagattacgtgctgcgccccattgaaggcacggcccgcgagtatgagtaccgccgcctgagcgtgctgggcgacatcgtgggtgggcggctgcaggccgtctgtgtgccggacgaggggctgacccagtataccacgccccgcgccgagttttgtaacaacacccgcaccctgcacccaggcgacaccgtgccccgcaccgagctgaccgcgctgttgtacaacgccggatacgcccgccgcgcccaagtggacgggccgggccagttctccatccgcggcgacattgtagacctgtacgccccggatatgaagctgcccgtgcgtatggaattttggggcgacgagatcgacacgatgcacaccttcgacctggccacccagcgccgcgaggaccccatcgaaaaaatttacgtcagccccgcacgggaggttctgtttggttcccctgccgaagctgccgagctgctgcgggctttcatcaaaaaattccgcggcaaaaagcgcactgccttagaggcctgcctggccaccgagctggcccagctggacggcggtgctctgcctgtgaatatggacaaatatctcgcggtgcgctatccacagcccgccacactgctggattatttcgatgatccgctgctggtgctggaggaaccagcctccttacgggaggctgaacacaccaccacctaccgtcgtggcgaggaaatttctgcccttttgcaggatggcgtgctggccgccgggctggacaatctgtacgccgagaatggctacctctgggcgcaggccgcgaaccgccgcacgatctgcgctgagaactttgcccgcagcatgccggacattccactgaaggacatcgtcaacgcgcccgcccacacgctgcccgcctggggcggcgaggtgaccagccttttggaggatctgcagccgctttgcaacggcggcgcagccgtcaccgtattggcgggcacccagcgtgccgccgcgggcctggccgccgacctgcgcaccaaggggctgctggtcaccacggacccggacgccgcccccggcgcagggctggtgcaggtgctgccggggcagctttccgccgggtgcagcgtgccctttgccaagtacgcgctgttcacggcgcgggcgtttggcatcagcagcacccagaaaaagaaaaagcgcaacaaagacgcgctgaacagtttaagcgaaatcgctgtgggcgatctggtggtacaccagaaccacggcatcggccgctatgcgggcatccagcggatggccgtgcagggcgtcaccaaggattatctgcgcatcgagtacgacaaaaaggacgtgctctacgtcccggtcacccagctggacctgctgtcccgctacaccgcccccaacgacagcgacaacgtgaaactgtcccgcctgggcggcagcgactgggccaagacacgcaaaaaggtcaaggccgccacggagcagatggcgaaagagctgatcgaactctacgcccgccgcaagcaggccaagggtcacgctttcccgcccgacgacacctggcagggggattttgagcagcgcttcgcctacgatgagacccccgaccagctgacctgcgccgccgacatcaagcacgatatggaagagccctggcccatggaccggctgctatgcggcgacgtgggctttggcaagaccgaggttgctctgcgcgcggcgttcaagtgcgtgatgggcggcaagcagtgcgccattctggctcccaccaccattttggcttggcagcatttcaacaccgccattgcccgcatggaggcattccccgtgcgcatcgggctgctctcccgctatcgcagtgccaaggagcagaaagagacgctgcgcggcctaaaagacggcacagtagacatcgttatcggcacccaccggctgctgtccaacgatgtaaagttccatgatctggggctggtcatcatcgacgaggagcagcgcttcggcgtcaagcacaaggaaaagctgaaagaggctttcatcggcgtggatatgctcacgctgtcggccacgcccatcccccgcacactgaacatggccctgtccggcatccgggatatgtccacactggagcagccgccctttgagcgccagcccgtggaaacctacgtgctggagtacgacgagggcatcgtagccgaggccatccgcaaggagctggcccgcggcgggcaggtctactacctgcacaaccgcgtggacactatcgaggaatgtgctgcccgcgtaggcaagatggtgccgggcgcgcgcataggcatcgcccacggcaaaatgaccgaggagcagatttcctcggtgtggcagcaattgctggacaatgaaattgacattttggtctgcaccacgctgatcgagaccggcgtcgacgtgcgcaactgcaacacgcttatcattgaaaatgccgaccgcatgggtttaagccagttgtaccagatccgcggccgcgtggggcgctcgtcccgcaaggcctatgcctactttaccttcacccgcgacaaggtgctgaccgaggtcgccgccaagcggctttccgccatccgggagtttacctccttcggctccggcttccgcattgcgatgcgcgacttgcagattcgcggcgcgggcagcctgctgggccacagccagcacgggcatatggagtcggtcggctacgacctgtatgtaaagatgctgagccaggccatctcctccgcccgtggcgagacccccgcgccggacaagagcgattgcctcatcgacatcacggtggacgctttcctgcctgaggattacatccccgatgccgcaggccgcatcgaagcctacaagcgcattgcggccattgagaccaccgccgacgcggatgatgtcattgatgaactcatcgaccgttacggcagcccgcccaagagtgtgcaggggctggtggatgtatcgctgatccgcgtgaccgccgcccgcgtaggcattgccgagatcgtgcagcggggcgaccagctgattttgtactccgacatcgtgggcccaaaacagctggccccgctgatggaccagtacccccaccgcgtgctgtataacgcgctgggacggccgtatttcagcctgcgggtgcaaaaaggcgagaacccgctggtgctgctgcgggatattgtaaccctgctgccgggggcacagggtgaaaaggaaaaataa

SEQ ID NO: 453 - DNA, 2775 bp, Faecalibacterium sp.
ttggcgcagaattacaacgacaccatccacaagatgcagaccccgtttgaaatgcgtgctggtctgccgaaaaaagagccgaaaatgctggaagactgggagcagaaccacgtctacgagcagatgatcaaaaacaacgagggcaaaccccgctgggtcctgcacgatggccctccgtatgccaatggcaacatccacatgggcaccgcgctgaacaagatcatcaaggacatcattctgcgctacaagaacatggctggtttccaggccccctatgtgccgggctacgatacccatggcctgcccatcgagctgaaagccctgaagtctctgggcgataagaagtccggcgtttccaagctagaactgcgcaagatctgcaaagagttcgccaccgagcatatcgatgtcatgaactcccagttcaagcgcctgggcgtccagggcgatttcgccaacccctacctgaccctgcgccccgagtttgaggcccgccaggtcgagatcttcggcgagatggccaagaaaggctacatctacaagggcatgaaggccgtttactggtgccccgaggaccgtaccgccctggctgaggctgagatcgagtacgccgaggacgagtgcgactctatctacgtccgctttaagctgaccgacgaccccaacggcgtgctggccaagcacaacatcccgctggataaggcctggatcgtcatctggaccaccaccacctggaccctgcccgccaacgtggccacctgcctgaaccccaacctggagtatgccttcgtcaagatcggcgatgcttaccacatcatggcccgcgagctggtcgagtccacgatgaagggctgccacatcgacgagtacgaagtcctgcccgacaccgttctgggcagcgagctggagctgatgcagtatcagcatcccttcctggaccgcaagggcctggtcatcctgggcgaccatgtcaccctcgaaggcggcaccggctgcgtccacaccgcccccggccatggtgttgaggactttgaagtctgcgttaaccactacccgcaggttcccgtcgttgttcccgtggatgacgccggccgcctgaccgccgaagctggcgagaaatttgccggtctcaaggtctgggatgccaacaaggttattctggagcacatcaaggagagcggccacctgatgggtgtgcagcacatcacccaccagtacccgcactgctggcgctgccaccatcccatcatcttccgcgcgaccgagcagtggttctgctccatcgatgctttcaaagaggatgtctacaaggctattgacagtgtacactggcagccggcctggggccatgaccgcatggctggcatggtccgtgaccgcagcgactggtgcatcagccgtcagcgcgtctggggcgtgcccatcccggtcttctactgcaagaagtgtggcaagtaccacatcaccgatgcttccatcaaggctgtctccgacctgttccgcaaggagggcagcgacgcctggtataagtacgatgccaacgagatcatgcccaagggcgaagtctgcgagtgcggcgcttccgattgggagaaagatcccgatatcatggacgtttggttcgactccggctctacctggagcgctgtctgccgcgagcgcccggagctgacctatcctgttgatatgtacatggaaggtgccgatcagttccgtggttggttccagtccagcctgttgaccagcgttgccacccagggccaggctccgtaccgcgaggtgctgtgccatggctgggtcgtcgacgaaaaaggcaagcagatgcacaagtccgctggcaacggcgtggaacccagcgaaatcattcgtgactacggtgccgacatcgtccgtctgtgggtcgcttccagcgattataccgtcgacgtccgcgccggtaaggagattttccgccagctgtccgaggcttaccgcaagatgcgcaacaccgcccgcttcatgctgggcaacatcaacgactttgatcccaacaaggatatggtcgctgacgatcagctgttcgagatcgaccgctgggcgctggaagcctgcaaccagctgaccgccaccatgcgcgatgcctacgaccactacgacttcagccgcgcttaccatgcgttgtacaacttctgcgtcatcgatatgtccaacttctatatggacgttatcaaggaccgcctgtactgcgctgacgaccatgcccgccgctgtgcacagaccgcgctgtaccgcatcctggtcgactttactaagctgctggcccccatcctgagcttcaccagccaggagatctggagctatgtgcccaagatgcccggcatgaaggactatgtcgtctttgagcagatgcccgaagccaaggccgctgctgacgaagccttcactgccaagtgggaccgcatcatggccatccgtgatgatgtcaagaaggtgctggagcaggcccgtgccgataagaccatcggatcttctctggaagcctgcctgacgctgtactgcaacaaggaggtctatgacttcctgaacaccatccccatggatgagctggccgacctgttcatcgtctccaaagtcgatctgactgagggcgagggcggtgtcaagggcatcgtcgagggtctgggtgctgccgctgcccacgcagccggcaacaagtgcctgcgctgctggaagtacgagcccgccgttggcgaaaacggcctgtgcccgcgctgcgctaaggtgctgggtctttaa

SEQ ID NO: 454 - DNA, 1794 bp, Faecalibacterium sp.
atgaccaccgagcgcgccaaagactttaagggcagcctgctgcagctgctgcgggcgatgggcaagtataagctttcgctcatcgtggtcgttgtttttgccattttgtctaccatatttaatatagcaggccccaaaattctcgccaaggccaccacggccctggccactggctggatcgccaagctgcggggcaccggcgccatcgactttggctacatcggtaaaattttgctgatcctgctgggcatgtacctgctgtcctcggcgttcagctttatccagagctggctgatgagtggcctgtcccagaaagtctgctatgatttccgccgtcagatcagcgaaaagatcgaccgcctgcctctggcctattttgaaaagcgcaccgtgggcgaagtgctctcccgcatcaccaacgatgtggacaccctgggccaaagcctgaaccagtcggtcacacagctgatcaccagcgtgaccaccatgatcggcgtgctcatcatgatgctgtccatcagtcccaaaatgacgctgatcgcactgctgatcctgccggtctcgttggcgctggtgctgctggtggtcaaattcagccagaaatattttaaggcgcagcaggcaacgctgggcgttgtcaatggtcaggtcgaggagatctattccggccacaacgtcatcaaggctttcaatcgtgagaacgccgtgctggcagatttcaatgccgccaacgataaattgtacgaatccgcatggaaaagccagttcctctccggcctgatgcagcccatcatgaactttgtgggcaacctggggtacgtggccgtagctgtggcgggcagtatttttgctgccgccggtgctatcaccatcggtgacatccaggcgttcatccagtacgtcaaaaacttcacccagcccatccagcagttggcgcaggtatccaacatgctgcaaagcatggccgccgcgtcggaacgtgtgtttgaatttttgggcgaggaagaggaggaccagctggctgatccggcccgccgtgccgacccggccgccatcgacggccaggtcaccttcgaccacgtccgctttggctacacgccggaaaagaccgtcatccacgatttcagctgcaaggtccggcccggccagaaggtagccatcgtcggtcccaccggcgcaggcaagaccaccatggtcaagctgctgatgcgtttttacgatgtggacgccggtgctatcaccttaaacggccgcaatgtgcaggactttgaccgcagcgccctgcgggaaggcttcggcatggtattgcaggatacctggctgttcaagggcactattatggagaacatccgctacggccgcctggatgccaccgatgaggaagtcatcgctgccgccaaggctgccaatgccgaccacttcatccgcacgctgcccggcggttaccagatggagctgaacgaggacgcctccaacgtcagccagggccagaaacagctgttgaccatcgcccgcgccatcctggcggataaccgcatcctgattctggatgaagcaacgtccagtgtggatacccgcaccgagcagcgcatccagtccgccatggaccacctgatgaagggccgcaccagcttcgtcattgcccaccgcctgtccaccatccgtgatgccgacaagattttggtcatgcgggatggcgacattgtggagcagggcacccacgatgagctgatcgaccagggcggcttctacgctgatctgtataattcccagttcgaggatgtgacggcgtaa

SEQ ID NO: 455 - DNA, 2379 bp, Faecalibacterium sp.
atgaaaaaaatgacactggcagaaatcaaagttgggcaggatgcggtactgcgcaccatcggcggccagggcgagctgcgccaccacctgctggatatgggcctgaccccgggcaccgaggtgaccctgcgcaaggttgcccccatgggcgaccccatcgaagtagagctgcgcggctacgagctgaccctgcggctggctgatgccgccaagatcgaagtggacaatgtccacgaaacggaccgcgctgcccgcagcgagacacggcacgcgcctgtgccccaccccggcgtgggcgaactgcgcaaggccgccagctaccacgaccgcaaggcgggccgtgagatcgccaaaggacagccgctgcgttttgccctggccggcaaccagaactgcggcaaaacgacgctgttcaatcagctgaccggctccaaccagcatgtgggcaactttcccggtgtcacggtagaccgcaaggacggcacgatccgcggccatgccgaggccaccgtcaccgacctgccgggcatctattccctgtcgccctattccagcgaggagatcgtcacccgggacttcctgctgaacacccacccagacggcatcatcaatatcgttgatgccacgaatattgagcgcaacctttacttaaccatgcagctgatggaactggggattccaatggtgttggcgctgaatatgatggacgaagtgcgcgccaatggcggcaccatcatggtcaacgaactggaggaactgctgggtgtgccggtggtgcccatctcggccgccaagaacgagggcatcgacgagttggtggaacatgccctgcatgtggcccgccaccgcgaggtccccggccgcatcgatttctgcgatgccaccgatggcaaggacggcgcggtacaccgctgcatccacgccgcggcccacctgatcgaggaccacgcccagcgcgccggtcttccgctgcggttttccgccaccaagctggtggagggtgatcagctgatcgaagctgctttgcagctggacgaaaacgagaccgaactgctgggccataccatcgccgagcttgaaaacgagaccggcctggaccgcgaggctgccctagctgacatgcgctttacttttatcgagcgcctgtgcgacaagaccgtggtgcgccccggtgaaagccgcgagcacaagcgcagcgtggctatggataaggtcctgaccggcaagtacaccgccctgccctgctttatcggcattatggcgctggtgttctggctgaccttcggggtcatcggcgcggcgctgtctgacctgctgactttgggtatcgacgccgtgaccaacgccgctgaccatgtgctgaccgcctacggcatcaacccggtggtgcacagccttgtcatcgacggcatttttgccggcgtgggcagcgtgctgagctttttgcccgttatcgtcactttgttcttcttcctttccatcctggaggataccggctatatggcccgcgtggcgtttgttatggaccagctgctgcgccgggtggggctttcgggccgcagttttgtgccgatgctgatcggctttggctgctcggtgcctgctatcatggccactcgtactttgtccagtgaccgcgaccgcaagatgaccattctgctgacaccgttcatgagctgctcggctaagctgccgatctacgcactgtttaccaccgcgtttttcccgcggcagtggcgggccgttgtaatggtggggctgtacctgaccggcatcgtatgcggtattttgtacgcgctggtgctgaaactgacccgctataagggcgagcctgttcccttcgtcatggagctgcccaactaccgctttccctcggcccgcagcgtgggccagctgatttgggagaaggccaaggactttttgcagaaagcctttaccattatttttgtagccaccgtgttgatctggttcctgcagacttttgatacacggctgaatgttgcagcgccggataccagcctgctggcattgatcggcagttgggtagcgccgatctttaagccgcttggctttggcgactggcgtgtttctaccgcgctgatcaccggctttaccgccaaggagagcgttgtttccaccttgacggtgctactgggcggcgatacggcagcactttccacgatgtttaccccgtttaccgccgtggtatttttggtgtttaccctgctgtataccccctgcgtggccgctgtggccgccgccaagcgcgaacttggcagtgcaaaagccgccgccggggtggttgtgatgcagtgcggtattgcatgggtggttgcctttgtggtacactgtataggtacactgctggggtttgtgtga

SEQ ID NO: 456 - DNA, 3867 bp, Faecalibacterium sp.
atgacacgcagttatcgcaaaaataccctgcggaccttcaaaagcaccgccagccggttcgccgccgtctttgctatcgtggcgctgggcgtcggcttcctggccgggctgaacgccacgcccatcgatatgaaagagtcgatggaacgttatatggatgatggcaacttctacgacctgcgcatcgtctccaccctgggcctgaccgatgaggatgtggacgccttgcgccaggtggagggcgttcgccaggtgcagccgggctactcggcagatttgctggtggaggtggaaggcgacaccgtcgtcagccgcgtccacagcctgcctgcgccggagaataacactatcaaccagttgaacctcgtcgagggccgcctgccggaaaagtccggcgagtgcgtcatcgaagccagctacaccaaaaagcaatctacctacaccgtgggcacaaagctggtggtggacaaagccaacgaagatctggacaccaagctgagcaccaccgaatacaccgtcgtgggcatcgtgcacaacgccaactatttcagctttgagcgcgagcccgccagcgtgggcaacggcacggtcaagctggtgttctacatcccccagcaggatttcgcctacgaagcctacaccgaagtctacctgaccgccgaaggcgcgttggagcaggacagcctgggcgacgcctaccaaaccaatattgatacggtcaaggccaacgtcgaggccatcgccgatgcccggtgtgaagcccgctatgacggtatcatcgccgatgcccgtgccgaactggacgatgcctgggctgagtacaacgacgccaaagcggatgccgaccaacagctggccgacgctgccgccgaactggctgacggcaaacaacagctggcggatggccagaaagaggtggatgacggcgagcgccagtatgcagacggcttgaacgaactgaccagcaacgaagccctgctcaacgatggcgcggcccaattggcggatgccgaagcccagctgaaagacgccgaggcgcagctgcaggcaggagaggacgaacttgccgccaacgcccccaagctggaagccgcccgcaaacagttagaggagggccaggctcagtacgaagccgggctgaaacaatacaacaacggcctggcacagatcgaaaccgccgaaaagcagctggccgacgccaaggcccagctggacgccaacgcggacgcctaccagcaggggatagcagcctttgccgaaaagctgggagtggatgcggcccaggtggatgcgtttatcggctggctggcccagaactgcgatgccaacggcacccagccgccccagacggtggaagaactgtggcaagccatccagaattacggtggtctgaccattcccgcaggcctgacacaggagcaggtggatgccatccgcgcccaggccaacgatctgctggcggccatcgatgaaatccccgcagacaccctgccggaagaacaacagcagcgcttgcaggaggcccggacgtatatcgccgccgtggctgatgctgccgaccctgccgccatgcagacggctttgcagaatgctgtcgattgggcgcgtcagttcgcccccgaactgcccgatgacatccgggacaagctgaacgccgctgtcgaagcctggtgggccagcctgcccgaggacagcaaagcccggctggaagaactggtttccggcgtgggccagctgacccagtaccggttgggcctgctgcaatacgaacagggcacggctcagctggctgccgcccgtgccgagctggaagccaatgccccaaaactggccaccgccaaggcccagctggacgatggctggaagcagtactatgacggcctggcccagtacgaggacggcaaaaagcagctggcggctgcccgcgcccagctggaggagggctgggccaccctgcaggacaaaaaggtgcagatggccgatgctcgccgccagatcgacgacgccaaaggccagctgagcgacgcccgcaaaaagctggatgacgccaaaacaaccattgccgaaaacctgcaaaaactacgggacggagaaatagaatatgaggacgccaaggtcgaagccgaaaaggccttggccgatgcccgcgtgcaaatcgaggacggagaagccgccctgaacgatgtggagtaccccacctggtacgtctgggaccgcagcaaaaacgtcagctatgcgtcctttaccgccaatgtggataagctcaccgccattaccaccatctttccggtattcttcttcctggtggcggcactggtggtatccaccaccatgacccgcatggtcgaggaagaacgcctgcagatcggcacgctgaaagccctgggctattcgggcgcagccatcatgcaaaagtacctgatctacgccttcacggcggctgcagcgggcacagtagccggactggccgtcggcttcaaggccttcccgtccatcatctggtccgcctatgaaatgatgtattatatgccgtctattgccaccccctggcggttgagccaggcgttgcttgcgggcggcacccttatcctgctcaccgtgggcatcacggcgctggcctgccgcaccaccttgcaggagagcccggcggccctcatgctgccccgcgcacccaaggccggcaagcgcattttgctggaacgcatcaccccgctgtggcggcggctgcccttcagctggaaagttacctgccgcaacctgctgcgctacaaaaagcgcttctggatgacggtcatcggcgtggcgggctgcacctcgctgctggtggctggcttcggcctctcggattcgctgaactccatcatcaccaagcagtacggcgacatttaccactacgacctgatgaccatcgtcaccaagcaggaggccaccgaaagcggccctgcttacgactacctttataataaggagaatgtcaccgattcgctgactgtcgccatggaatccacccggcaggatggccccaacggtgagatggacgtctacctcatggttcccctggatgtggacaagtttgctgagtttgctgacctgcacgagcgcctctcccgcatggcggtgccgctggggcagcagggcgtggtcgtgaccgaaaagatggccaagaccctgggtgtaaaggcaggagacaccattaccctgactaacagcgacgataagacagctgacttcactgtcagcggtgtgtgcgagcattacgtcagcaattacgtttacctcagcccggcggtgtacgaggccggttttggcgaagctcccgcctacaacgcaatcatgagcatcctgcccgaggacacccaggaagcccgcgataccctctcggcggacctgctggcgatggacaatgtggccagcctgaacttcacgcaggacaacgtgaaccaggtgctcaacatgcttaactccatcgatgcagtgatcgtactcatcatcgtctgtgcggcatcgctggcgttcgtggtgctgtataacctctccaacatcaacattgccgagcgtgtcaaggaaatcgccaccatcaaggtgctgggcttctacgacccagaggtctacgcctacgttaaccgcgagagcgtggccttaacgctgatcggcacgctgttaggcctggcaggcggcattgccctgcatagcttcgtcatcaccacggtggaggtcgatgccgtcatgtttgggcggcagatctacccccaaagctttgtctacgccattgccctgaccctgctgttcagcacgctggtcaacctggtcatgcagcggctgctgaaacgcatttcgatggtagagagcatgaaagcgccggaataa

SEQ ID NO: 457 - DNA, 2619 bp, Faecalibacterium sp.
atggcggaacaagcggtttccccaatgatgcagcagtattttgaaatcaagaaacaacacccgaacgagattctgttttaccgtgtcggcgatttttatgagatgttctacgacgatgccttaacggcctcccgagagctggaactgacactgaccggcaaaaactgcggcaaagaggagcgcgcccctatgtgcggcgtgcctttccactcctacgagacctacgtcgcccgcctcatcgccaagggctacaaggtcgctatctgtgagcagatggaggaccccgccttggccaaggggcttgtcaagcgggacatcatccgcgtggtcacccctggcactgttatcgagagcagcatgctggccgaggataaaaacaactacctttgcagcgtttacaccaagcgcacccgcggccgctggaaggctggcatctgctttgctgacatctccaccggcgaggcctacgccaccgagttgaacgccgaaaagatcggcggtgcaatcattaccgagctatgccgctacatgcccagtgagatcctgatttgcccggcgatgctggacttcaaggatgtgactgcctacatcaagcagcataccaacgccctggtggaactgcgggaggatgcctgctttaaggacagcgtgatggaagccactatggcgaaccagttcggcctcgattggcgggatgccctcggctacgagaaggatgccctggtgccttatgctgtggccgccatgatcaactacctgcacgaaacgcagaagcacggcgtcgagcgtatcaagaccgtgcagaactatgccgacgcccagtacatgcgcctgtcgcctgtgactcgcgcgaacctcgaactgaccgagacgatgcgcggccgcgagaagcggggcaccctgctttgggtgctggacaagaccgagacctcgatgggcaagcgcctgctgcgctcctggatcgagcagccccttgtggacgccgaggctatcaaccgccgcctgtctgctgtgcaggcgctctacaccgccaacatggcccgcgccgatttgaaagaagcgctctcccacgtctttgacatcgagcgcctgaccacccgtattctctacggatcggccaccccgcgggaggtcaaggccctgggcgatacctgcgctatgctgccggaagtgcgcagccaggccgccgcctgcggtgcaccgctgctgaaagacctggcagaccagatcgacccgctggaagatattctgaacaaaatcacgaccgcgctggtcgatgacccgcccgctaccttaaaggacggcggcgccatccgcgccgggtacaacagcgaagtcgacgagctgcgggatatcatgcacggcggcaaaggctatctttccaatctggaagccaaataccgcgaggagaccggcatccccaagctgaagatcggctttaataaggtgttcggctactacatcgaggtcagccgctcctacactgactcggtgcctgataccttcacccgcaagcagaccctgaccaccggcgaacgctacatcacgccggaattgaaagagctggaaaataaaatcctcggtgccaatgagcgtttgctcgtcctggaacatcagcttttctccgatctgttgacggaaatctccgaccagatcgtgcgcatccagcgcaccgcctcggcggtggcccagctggatgtactggctggttttgccgaggccgcgctccagaacagctacgtcctgccggtggtggataccagcggcgagatcgagatcaaagagggccgccacccggtcattgagcagatgctcaagggcagcttatttgtccccaacgacaccctgctggacgaggacgagaaccgcatgctgctcatcaccggccccaacatggccggtaaatccacttatatgcgccagaacgccctgatcgccctgatggctcagatcggcagcttcgtgcccgccgccagtgctcatctcggtgttgtggatgcaatcttcacccgcgtgggtgcttcggacgacctggctgccggacagtccacctttatggttgagatgaccgaggtggccgagatcctcaagcatgccaccagggacagcctggtcattcttgatgagatcggccgcggcacttcgacctttgacggcatgagcatcgcccgtgctgtggtagagtatatctgcgagaacatcggctgcaaaacgctgttcgccacccattaccacgagctgaccagcatggatcaggacatccacggcgtcaaaaactataacatcgccgtcaaaaagcggggcgaggacatcacgttcctgcgccgcatcatcgccggcccggcggatgacagctacggcattgaggtcgccaaactggcgggcctgccgggcagcgtgaccaagcgcgcccacgccgtgctgcgccagttggaggccaacgcccccggccgcagcaacacgatgcagctggactttgagaccgtagaagcctacaacaaccccagcgtgcccagcgaggtggtggacaagctccacagcgtggatattgaaacgctgaccccgctggaagcgctgaacttcctgtacgaactgaaaaccgttttagataaagaataa

SEQ ID NO: 458 - DNA, 1704 bp, Faecalibacterium sp.
atgaaattttctgagatgccctatcagcgcccgaacctggacgagatcaaggcgcagtttgctgctgtgacccagcgctttgccgccgcgcctgactacgctgccgccaaggccgcctttctggacgaacagaccctgaacaagcacgtggacacgctggccaacctggccagcgtccgcaacaccatcgatacccgagatgaattctacgatgatgagatgaatttctggaacgctgccaccccgcagatccaggagtgccagaatacctggagcgccgccctgctggcatccccctaccgcaaacagctgggcgaggaatacggcgaactgatgttcctcaacgccgagatcgcccagaaagccttctcgccggagatcctggacgagatggcccaggaaaacgacctctccacccagtacggcaagctgatcgcctcggctcagatcccctttgagggcggcgtctacaccctaagccagctctctcccttcaaaaacgaccccgacgatgcccgccgcctggccgcctggaaagccgagggtgcttggtataaggagcatcaggaggagttcgactccatttacgacaagatggtccacctgcgggacaccatgggcaaaaaactggggtacgaaggctacactaccctgggctactaccgcatgggccgcaactgctacaccaaggctgatgtggaaaaattccgcgctgctgtggtgaaatatctcgtccccgtggccgacagcatctaccgcgagcaggccaggcgcctgggcaagcagtacccgatgaacgccgccgacaacgccctgatgttccgcagcggcaaccccaaaccctgcggtgatgccgatgccatcgtggctcagggcaaaaagttctacgaggagctgtctcccgaaaccgccgagttcttccacaagatgctggacgaccagctgatggacctgctctccacccccggcaaggcgggcggcggctactgcaccagcctggatgattacgaagtgccgtttatttttgccaacttcaacggcacccagcacgatgtcgaggtcgtcacccacgaggccggtcacgcttttgctgcctacatgaaccgcaagcgcatcccctactccaccgtatggcccagcatggagggctgtgaggtccattcgatgtcgatggagttcctggcctggccctgggccgagggcttctttggcaaggatgcccgcaagttccgctacagccatctggccggggcgctgaccttcatcccctacggcacgatggtggatcacttccagcatatcgtctacgaaaagccgaatatgaccccggcccagcgccacgagacctggaaggagctggccgccatctaccagccctggatgcgcctggacggcgagatccccttctatggtgcaggcgagtactggcagcgccagatgcacatctaccagagaccgttctactacattgactactgcctggcgcagaccgtcagcctgcagatctgggcgctgatgcagaaggaccgcgtcaacgcatgggaccactacatggcctacacccgccagggcggcagctgtgtgtttaccgagctgctgaaaaacgccgacctggtcagcccctttgaggaaagctgcctgcgcggcgtctgcgagaccgccaaggattggctggaccactacgacctgacggggctggaataa

SEQ ID NO: 459 - DNA, 2184 bp, Faecalibacterium sp.
atggaaaacacccaaaccggtgatgtaaaaatgcccatcacctatgaggacttaaagcagtcgctggtggacagcggtcgcccctatgattttgacatgatcgaccgtgcctacgcattggccgagaaagcccacggcggtcagcgccgccgcagcggtgagccgtatatctgccatccgctgtcggtggcgtccattctggtggaactgggtatggacagcgagagcatcgccgccgccctgatgcacgatgtggccgaggatacccccgtcacggtggccgaaatcaagcagaaatttggccccgatgtggccctgctggtggacggcgtcaccaaactgacccagatcaaattctccaatgtcgaggaccgccaggccgaaaacctgcgcaagatgctgctggccatgagtcaggatgtccgcgtgatgatcattaaactgtgcgaccggctgcacaatatgcgcaccggcgacgcctggccggagcagaagcgccgcgataaggccctggaaacgatggaggtctacgcccccattgcccaccgcctgggcatcagcaatatcaaggaggagctggaggaccgcagcctgcactacctggaccccgtgggctacgagaccatccgcgacctgctgaacaagcacggcgatgagttcctgcacacagtctgccacaccattgccaagcatctggcggaaaacggcatccagaaagccaccatccgccaccgcgtcaagagcatctacggcatctaccgcaagatgtacatgcagaataaggatttcgaggagatctacgatatttacgccgtgcgcatcatcctcgagaatgtgtccgagtgttataacgcgctgggcctcatccacgacatgtaccacccgctgcctaaccgctttaaagattacatctctacgccaaaaccaaacggctaccagagcctgcataccaccgtcatcggccgcgaggccatcccctttgaggtgcagatccgcacctgggatatggatcgcatggccgagtacggcatcgccgcccactggaagtacaaggcaggcatcaccaacggcagcagcgataagctggacgagcgcctggcctgggtgcgccaactgttagaaagccaacgctccagcgccgatgccaccgacctgctcagcgacattaagagcgacctgctgccggaggaagtgtttgctttcaccccgcggggcgacgtcatcaacctgcccgccggtgctaccgcgatcgactttgcctacgccatccattccgccgttggcaaccgcatgatcggcgccaaggtcaacaaccgcatcgtgcccatcgatcataaggtgcagaccggcgagatcatcgaaatcatcaccggccctgaaaaccgcggccccagccgcgactggctgaacattgtaaagaccagcgaagccaagaacaagatccgcaactggttcaagaaagaacgcagggaagagaatatccaggagggacgcgaggcactggaacgcgagctgcgccgcaacctcatgtcgatgaccgatgagcagcacgagacctttatggaggcgctggcccgccgcaaccactgcaactcggtggatgagatgtatgcggccatcggctacggcggtttgcagatcagccgtatgctgcccaaactgaaagaggagtacaccaagctcaaggccaccgaggtcaagcctgtgaccgtggacatcaagcggatgcactccaccgacggcgtcgtcgtcgagggcatcgacaactgccccatcaagtttgccaagtgctgctctccgctgcccggcgatgagatcatcggtttcgtcacccgcggcttcggcgtgtccatccacaaaaaggattgcgctaacgtgcgggagagcatgcgccagggcgagaacgccgaccgctgggtgaacgcctactgggccgacgatgccaaggaaaactacaaagctacgctggatctgctgtgcatggaccgcgcgaacctgttgtctgacgtggcgctggcgctgggtgatatgcgggtgcctatctactcgctgaccgcccgctcggccgagcagggccgcgcccgcatgagcgtgaccgtgggcatcaccaacaccgaacacctgaacagcgtggtcgctcgcctgaaaaaggtcaaggatgttgtcagcgtgaaccgcaactga

SEQ ID NO: 460 - DNA, 2376 bp, Faecalibacterium sp.
atggataccgcatataaaaaaacactggaactggacaaggtcctggcccgtgccgtgcagctttgtgcctgccgggagaccaaggaaatgatgcaggatctgcagccctgtgagacccctgaggacgaacgctacgctctggagcagaccaacgccatcaacagcctgctgatcaaaaacggcagcccgcgcttcggatctgtctccgaggtgcggcgcgtggtcgctcatgcccaaaagggcggcatcctctcgatgggggaattgctggaaattgccgccacgctgcgcaattttgcaggcctgagccagtggtacggtctgagtgagcatgacatgatgcccaccgatgacctgttctattctctggcgccgcagccggtgctggagcgccagatttccgacagcatcatctcgccggaagaaatggctgacaccgccagcaccacgctggccgatctgcgccgcaagatccgccagaccgaggattccatccgcaccaaactggatgccatcatcaaaaactcaaccaccaataaatttttgcaggacgctgtggtttcgctgcgtaacggtcgttatgtcgtgcctgtacgtgctgagtatcgcggcgaggtcggcggcgtcatccacgacgtttcctcctccggcgctaccgtctttgtagagcctaccgctgtggtcgaggccaacgcccgcatcatgcagctgcgtgcgcaagaacaggaggagatcacccgcatcctgtccgctttctcggcgcaggtgggctcgctggagccgcagttcagctacagctatgatgccatgctgaagatcgatctgctactggccaaggcccgtctggccattgaacagggggccttcatgcccgctgtcagcgataccatccactttaagctgaataaggcccgccacccgctcatcgacaagaaaaaggtcgtgccggtggatattgccctgggcgacgaatacgacacgctggtcatcaccggccccaacaccggcggcaaaaccgtctcactgaaaacggcaggtctgctcaacgccatggctcagtacggcttcctgattccagcacacgagagcagcgttgtctgcaactttagggaatacctggtagacatcggcgacgagcagagcatcgaacagagcctgtccaccttctccggccatatgaagcgcatcagcggcattttggagctggccgggcacggcacgctgaccctgctggatgaactgggggccggtactgaccccgccgagggcgctgcgctggctgtcagtatcctggagcagctgcgccgccagggcagcctgctgatggctaccacccactacgccgaaatgaaagtttacgcgctggaaacgcccggtgtcgtcaacgccagctgtgaattcaacgtagaaacgctgatgcctacgtataagctgagcgtcggcgtgcccggtaagtccaacgcattccttatcagctccaagctgggcatcccgcagaacatcatcgatgcggcccgcagccatatgtctaacgacgataagcgcctggacagcgtgctggcccagctggatgatttaaagctgcagttgaaggttgctcagggtgacgccgaaaaggcccgctatgaggctgagcatgccctggaaagcgccgagaagaagcgtgacgagctgatcaagaagggcgagcaggaactggaagatacccgccgccgcgcccatgatctgatgcagaatgtccagaacgaggcctacgccctgacggatgagctgcgccgcatccagaaagacgaaaagaccaacgctgcccagcgtgctgtccgtgcccgcgagattgcccgcaaggacactgaaacactgctgaaaaagaccgattccaagcctaagcccgcccgtgaattcgtgcccctgaaagaggtgcagattgggcaggaagtactgattgccgagctgaaccagctggctaccgttaccgcccggcctgaccgcaacggtatggtagaagtacgtgccggcatcatgaaaacgaaggtgcctctctccggtctgtgcgtcccggacaaaatggacaagcgcccggcccgcgagccgcgccgttccagcacccgcgtgcagctggataaatcccgcaaggccagcatggagatcaacctgctgggctacaccgtggatgaagctttggccgaggtggataagttcctggacagcggcatgctgcgcggccagcagacattgtacatcatccacggcaacggcactggtgcactgcgcactgccatccaaaagcacctgcgcacccacaaggcagtcaaaagtttccgccccggccgctatggcgagggtgaaaacggcgtgaccgtggtagaattgaaataa

SEQ ID NO: 461 - DNA, 3687 bp, Faecalibacterium sp.
atggtatatcgcatttatgttgagaaaaagcccggttttgacggcgaggctcagggcctttgccacgagctggtcgacctgctgggcattaaggccctgaaaggtctgcggctcatcaaccgttatgatgtcgagggtatcgacaacgtcctgttccagcaggccatccctactgtcttcagcgagccgccggtagacaccacctacaccaccctgcccgaggcccagcacgtttttgctgttgagtacctgcccggccagtttgaccagcgtgctgactctgccagtcagtgcatccagctgctcagccagggcgagcgccccaccgtgcgcagcgcccgcgtctacctgctggagggcgatttgaccgaggacgacatcgccgccattaaaaagtacgtcatcaaccccgtcgaggcacgcgaagccagccttgaggagcgcagcaccctcaagatggagtttgccatccccaccgaggtggagaccctgaccggctttaccgccctggacgacgatgccctggaagccttccgcaacgcgaagggcctggccatggaccacgccgacatcaagttctgccaggactacttcaagtccgagcaccgcgaccccaccatcactgagatccgcctgatcgacacctactggtccgaccactgccgccacactaccttcggtaccattctggacgatatgcagatcgatgacgagctggtgcaggctgcctttgaccgctacatggccctgcgcaaggagaccggccgcgacaagaagaaccgcaccctgatggactgcgccaccatcgccgccaaggccctgaagcagcgcggcatcctgaagaacctggacgagagcgaggagatcaacgcctgcactgtcaagatcaagtgcgatgtcgacggcgagctgcaggactggctgttcctctttaagaatgagacccacaaccaccccaccgagatcgagcctttcggcggtgctgccacctgcatcggcggtgccatccgcgatcccctgtccggccgcagctacgtctaccaggccatgcgcgtgaccggcgcagccgacccgctgaagcctgtctccgagacgatgcccggcaagctgccccagcgcaagctggtcaccaccgctgctgccggttactccagctacggcaaccagatcggccttgccaccggccaggtctctgaactgtatcatcccggctacgctgccaagcgcatggagatcggcgcggtcgtgggtgcaacgcctgccagccatgttcgccgcgaggaacccgcccccggcgatgtggtcatcctgctgggcggccgcaccggccgtgacggcatcggcggtgccaccggctcctccaaggcccacaagctgaccagcctggagacctgcggtgccgaggtacagaagggcaacgcccccatcgagcgtaagctgcagcgtctgttccgccgcgaggatgcctgccgcctcatcaagcgctgcaacgactttggcgcaggcggtgtctctgttgccatcggtgagctggccgacggcctgaagatcgacctgaacaaggtcaccaagaaatacgagggtctggacggcaccgaactggccatctccgagagtcaggagcgtatggctgtggccgttgctgccgaggatgccgagacctttatgcagtacgccgccgaggaaaacctcgaagctacgatcgttgccaccgttaccgaggaaaagcgcatgcgcgaattctggaacggcaaggccatcgtcgacctctcccgcgagttcctgaactctaacggtgccgagcgtcacgccaacgtgcacatcctcaagggtcatgtctggcagccccagtttgccggtgctacctttgagcagaagatggaacacctggtctccgacctgaacgtctgcagccagaagggtctgggcgagcgcttcgactccaccatcggcgcggccactgtgctgatgccctacggcggcaagtatcagctgacccccaccatggccatggctgccaagctgcccgtggacggcgagaccaccacctgctccggcatggcctggggcttcaacccctacctgaccgaggccgacccctaccgcggcgcttatctggccgtggtcgagagcatcaccaagctggtgtgcgccggtttccaccacaaggatatgtacctgaccttccaggaatactttgagcacatgaacgacaagcccgagcgctggggcaagccgctggccgccctgctgggtgccctggatgcccagatgggcctgggcatcgcctccatcggcggcaaggactccatgtccggcagctttgaaggcctggatgttccccccacgctggtcagctttgccaccgccatcggcaatacccgcgatgtgcagagccccgagttcaagaaagccaacagcgccgttgttatgctgcgtccccagtataaggacggcctgcccgagatcggcagcctgattgccatctacaagaccgtcgagcagatgatcgacgaaggcaaggtgctgtctgccgctacccccggttacggcggcgtggccgaggccctgttcaagatgtgcgtgggcaaccatgtgggcctgcagctctccaatgacctgaacttcaacgacctgttcaagcccgcttacggcagcgtgattttggagctgctggacccgtccgccggcgagttcctgggctttaccaccgtggactacacgctggaggctggcaaagagatgatcgacctggccaagctgcaggagaagtgggaagccaagctggagccggtcttcccctaccgcaaggccggcccgactgtgcccgcgctggagcatgactgccccgccaacaagcgcgtggcccccgctgtgcgcctggctaccccgcgggtcattatccccgtcttccccggcaccaactgtgagtatgataccgcccgcgccttccgccaggccggcggcgacccgcacattctggtgctgaaaaacctgacccccgccgatgttgccgagagctgtgaagccctggtcaaggagctggacgaagcccagatcctgatgctgccgggcggcttctccggcggcgacgagccggacggttccgccaagttcatcgcggcgttcttccgctcccccgctgtggccgatgccgtcaaccgcctgctgaaccagcgcgacggcctggccctgggcatctgcaacggcttccaggctctcatcaaactgggcctggtcccctacggcgagatccgccccatcacggccgatgacccgaccctgaccttcaacaccatccatcgccaccagagcatgctggtgcgcacccgcgttgccagcaacaagagcccctggctgagccgctgcgacatcaacgatgagcacctgatcgccatcagccacggcgagggccgctttgtctgcagccagacgctgctgaaccagctgatcgacaacggccagatcgccacccagtacgtcgacttgacctgccagcccaccatggacctgcgctacaaccccaacggctccgtaatggccatcgagggcatcaccagcccggacggccgcgtctttggcaagatgggccacagcgaacgctacggcgaacgcctgtacaagaacgttaccggcgacaagtaccagcctatctttgagggcggcgtgaactattttaagctgtaa

SEQ ID NO: 462 - DNA, 2589 bp, Faecalibacterium sp.
ttgctgtacgctttgctttattctgtgattaaggaggcggttcccatagaacccaaacagccgcgccacatttcaaccgatggcgtaaaatctaccgcaggggccaccgggcagccggtacccaacaaaaagaaaccgaagcgtaagcgccacccggtggcggcattcttccgctttatcggctgcctgctttgcgtctgcgtcatggcggccagcgtaggcggcgtcctgctctcgatgtacatcgtgcaggtcacggcaaacgatggcgatgtcctggacctggataaccagaaaaacaaacagaccaccattgtctacgacaaaaacagcgacgagtacgccaccctgaccaagggcgagaaccgtatctggcgcgagctttccgccatgccggaaaacctccagcacgcggtcatcgctatcgaggataaggacttctacaacgagcccggcatcaatatcaagcgtaccatcggtgccgcgctgaacgagtttaccgaccatgcactgtacggctcccagcagggtgcatccacgctggaacagcagctgatcaaaaacctgaccggcgataacgagaccgacaagatgcgtaaggtgcgtgagatcttccgcgccctgggtctgtccaacaagtacagcaaagagaccgttctggaagcctacctcaataccatcccgctgaccggtatcgtttgcggcatggaggccggcgccaacgagtactttggcaagcatgtcgaggatctgaccctctctgagtgcgccatcctcgcatccatcaccaagaatccgaccaagtacaaccccttcaccaaccccgaacagttgatgaagcgccgcaaccacgtgctgtatgagatgtacaaccagggctacatcaccgaggatgagtataattccgcaacggcggagaccatcaaggtggtggagagcaagggcggtgccgagaacgtgacccgcacctccaacaactcctacttcaccgatgcactctactatgagctgctcaacgacctgcaggagaaggccaactacacggccgaggaagccagctcgctgatctttaacggcggcctgcgcgtctactccaccgtcgatcccaaggtccagagcgtcatcgaggaagaactgtacaacgccgatgacgccattccggccctctggcacgaagcgccggtcgccctgcgcgactacccggcggatagcagcagttgggacgatgtgcagtacgacgaagccaccggcttgcccgtcaccaaggacggctacgctgtctacggcgtcgaggacatccccgtctacgaggatgatgccgagactgaactgaagaagggcacctccaccgacccgaactatcccaacgatgacaccgtctacctctgcgtgtacgagaaagtccgcaccgaggcttcggctgcgatcctggactataacggcaacatcctgggcatcggcggcggcattggcgaaaagcagtacgacctgggcaccaaccgcgccacgatcccgcaccagaccggttctaccatgaagcccatcggcgcctactgcctggcgctggattacggcctgatcaactactcttcccagattctggacgcgccgttctattcggctgctgataaggaagtgctgaaagagcagtactcttatatggacaagtactccgctgcagcccagtcccgcagcgacatctggcgcgattggcccaccaactacggcggtgccggcggccagggcaaccccatgctggtgtatgacgccctgcgtcagtcctacaacacggtggctgtctgggtcggcaacatggtcggcgtggattacctgtacaacttcgtgcatgatacgctggaatgcagctatatcagcgccgaaaacgatatggacctggcacctctggtgctgggcggccagagccgcggcatgaccgtggtgcagctggccggtgcctactccatcttcaacggtggtaccttcaccagcccgcactattataccgaagtggaagattacctgggcaacacggtgctggataacaccaagtatatcaacaccacccaggctatcagccccgagaccgcgcagatcatgaaccgtatgctggccaacgtcctgaagaccggcggtacggcttccagtatcggcgtgccccaggcaggcggtatggacgcggtcgccaagacaggtactaccagcaacaacaaggattacaccttcgctgccctgaccccctactacgtcacagccctgtggtggggctttgaccgcccggaggatatgtcccagtacagcggcggtaaatacggtacgcccatccagaaagcctggaagaacatgatggaagagctgcaggcagacctgccctacaaggagtttgccaccagcgaaaacgttgtggagcgtcacttcgacacctccacgggtgccatcatctccggcggcggtgccattggctactataccgaggataacatgcccgacagcagctatgcagcttcgacggatgacccctatgccgccctggcccaggccgctgccgagggtgcccaggatggcgacaccaccaccgaacccaccgagtaa

SEQ ID NO: 463 - DNA, 2304 bp, Faecalibacterium sp.
atgctgcgcgaactgcgcagcgagatgggcaagtacgccgtcatcgccattctgctcatcgccaccatcggctttgtgtcgggcttctttgtggccggctccagcatgatcgccgcctacaatgagggctttgagaaatacaacatcgaggatggccacttccgcgtggaaaagcagctcaaccgtgcccagcttaaggcgattaccggcgcaggtgtgaccctgtacgacctgcactaccgtgagaccgccatggaaaacggcagcacgctgcgcatctacccggaccgcacccaggtcaacactgtctgcctgatgcagggtgccatgcctgccgcccccggtgagatgggcctggaccgcatgtatgccgagaacaacggcatcgcggtgggcgataccgtgaccgacacaaacggccagacctggaccgtcaccggctatgtggccctgccggattacagctgcctgtttaaggataatacggacacgatgttcgacgccatcaagttcggtgtggccatcgtcacgcaggaggcgttcgatgccctgccagaacagcagacctggaactacgcctggcagtacgacaccgccccggcggacgaccgcgccgagaaggacgcagccaccgactttatgaaagtcgtcaacaaaacggcgtccctgcaggattttgtgcccgagtatgagaaccaggccatcatctttaccggtgacgacctgggcagcgaccgcgccatgattgccgtgttgctctacatcgtcattgccattatggcctttgtgtttgccgttactacgtccaatgccatcgccaaagaggcgggcgtcatcggcacgctgcgggcctccggctacagccggggcgagctggtgcgccactacatggccatgccggtggtggtcacccttatcagcgcggcggtgggcaatgtactggggtacacggtgctcaaaaacgtctgcgtcgacatgtactatggcagttacagcttgcccacctatgtcacacgctggaacgccgatgcgttttggatgacgacagtcatcccggtggcgttgatgatcttcatcaactggctggtgctttcccgcacgatgcgcatctcgccgctgcaatttttgcggcatgacctcagccgccacgctaaccgcaagcatgccctgcccctgccgtcggcactgccgttttttgggcggttccgcacccgcgtgattttgcaaaacctgggcagttatgtggtgctgtttgtgggcgtactgttcgccaatctgctgctcagttttggcatgatcctgcccgatgcgctgaaccattacagtgatacgatcgcggacaacatgctgagcaacacccagacgatgctgcagatcccctacagcgccatggacgaggaccgcaagctgaatgccctgctctcgatgctgcagttccgcatggagaccgataccgaggaaaacaacgccgaaaagttcagcgcctacagcctgcagaccctgggcaccgacgagggcggcgcggccaaaagcgagagcgtgctgctgtacggtgtagagccggacagccgttacgtgcagctgccgggggatggtgtctacctgtcctcggcctacgcggacaagtacgaactgggcgcaggggacacgattaccctgcgggaaaagtacgaagatacgacctatacctttacggtggacggtgtgtatgattacatgggtgcgctggccgtctttatgccccgggaaaagctgaacgaagtgttcgacctgggcgacggctactacggcggctatttctccgacgcaccgctgaccgagatcaaggatgaatacgtcggctcggtcatcgacctggaccagctgacgaaagtttcccgccagctgatggtctcgatgggggcctccatggggctggtcaacggctttgccgtaatgatcttcttcgtggtcgtctacctgctaagcaaaatgatcatcgagaagaacgcccaatccatctcgatgacgaaaattttaggctacaacggcagcgagattgcccggctgtatctgctgtccaccacggtggtggtcgtgctgtgcttggtcatcagcctgccgatcgaagtatacgtgatgaagttccttttccgcgctgtcatgatggaaagcatgaccggctggatcgagatgtgggtctcgcccacgctgtacccgcgcatgctggcggcgggcctggccacctacgcggtggtggcggtactggagtaccgccgcatcatccgcgtgccgatggacgaagcgctgaagaatgtggagtga

SEQ ID NO: 464 - DNA, 2442 bp, Faecalibacterium sp.
atgtctgagaaagtaaaagtcaaaatcacccgcaatgtcagtgtactgccggctatcgccctgcgcgggctggtggttttccccaataatatcgtccactttgaggtgggccgcgccaaatccatcgccgccatcgaggctgccatgcacgccaacagcagcgttttccttgtcgcccagaaagagatggacgtggaagaacccacgatgcctgacctctacggctacggtgtcatcgccgagatcaagcaggtgctgcgcgtttccgacgacctcgtcaaggtgctggtggaaggcaagacccgcgcccgcctgctggaactgaacgacggcgacttcctgcaggccagcgtgcgcccggtgccggtgcgcggcatcggtgccgataaacgcacccagaccgaggccctcgttcgcagtctgaaagactgctttgaggagtacctctcctacagcccgcagatctccaaggacatcatctataacatcgtcagctcagacagcccgctgttcctgagcgagtacatgcccgcgaacctcttgctgaaatacgaggataagcagaccatcctgaatgagtcctcgctgctgagccgcttggaaaaactgctgatgctgctgcgtcaggagtgccaggtgttggaaatcgagcgcgaccttgatgataaggtcaacgcctctttggacaaaggccagcgggaatactacctgcgagagcagatgcacatcatcagcgaagagttgggcgattccgaagatacccgcgccgaagccgatacctaccgccagaagatcgccgccctcaagctggacgacgaatccaccgaaaagctgctgaaagagtgcgaccgtctggcccgtatgcagtccaactccgccgaaagcggcgttatccgcagctatctggatacctgcctgggcctaccctggcacatcaccaccgaggatgacctcgaccaggcccatgcccgcagggtgctggaccgcgaacattacggtttgcagaaagtcaaagagcgcatcctggaactactggccgtgcgcaagctgaacaccgaggtcaagggccagatcgtctgcctcgtcggccctccgggcgtcggcaagaccagtattgcccattccattgcggactgtatgggccgcaagttcgcccgcatgagcctgggcggcgtacatgacgaggccgagatccgcggccaccgccgcacctacatcggcgccatgccgggccgcatcatcagcgccatcaactccgccaagtcctccaacccggtcatcctgctggacgagatcgacaagctggcgggggactacaagggcgatccctccagcgccctgctggaggtgctggaccccgagcagaaccgcacctttaaggataactacctcgacatcccgttcgatttgagcgaggtgctcttcatcaccaccgccaacgatgcctccacgattcccggcccactctatgaccgtatggatgtcatcgaactgcccagttatacccgcaccgaaaagttcaacattgccaagcgccatctgctgcccaaacagctgaaaaacaacggcctggacggcaaggtcaccatgacctccggcgcgatttatgagatcatcgacggctacacccgcgaagccggtgtacgtaacctggagcgcaccatcacctcggtgctgcgcaagtgtgcccagaaaattgccgcaggcgagaccgaaaagatcagcgtctccggcacgatggtcaagtcgctgctcggccccgagaaggtcaagccgaccttcatctcccgcaccgactccgtcggtatcgccaacggcttggcctggaccagtgtcggcggcgagatgctgcccgtcgaagtggcggtcatccccaacggcaccggcaagatcgaaatcaccggcagcctgggcgacgtgatgaaggaaagcgctcagcttgccgtcacctatgcccgtgtccatgccgaggagtacggcatcgctcccgaccgcttcaagaacaccgacctgcacatccacgcccccgagggcgctgtgcccaaggacggtccttccgccggtgtcacgctgaccacggcgctggtctcggccctgtccggcatcccggtacgccatgacctggccatgaccggcgaaattacgctgcacggcaatgtgttgcccatcggcggcctgaaggaaaagagcatggccgccttccgcgaaggtatctccactgtgctgatccccaaagagaacgccaccgacctctacgaagtcgatgccgaggtcaaggagaagatccacttcatcccggtggagcgcctgtcccaggtgctcaagcatgcactcatcatgcccggccatgctgccgcccgcagcgcccacgccatgccccaggccaccaacctgatcgccggcgaaaagcccgtcgccaaggacccggccactgtaatgtaa

SEQ ID NO: 465 - DNA, 2574 bp, Faecalibacterium sp.
atggaagaaaatatcatcatggtgccggggtccggcaccaaggtcattgtgcgcgatgtaaaacaggagatcgagacggcctttttggactactcgatgtctgttatcgttgcgcgcgcattgcctgatgtgcgcgatggcctgaaacccgtgcatcgccgtatcctgtacacgatgcacgagcgcggcaatgatccgcagcatccataccgcaaatccgccgataccgttggtgctgtgctgggttcctaccatccccacggcgacgcctccgtctacgacgctatggtccgtctggcccaggatttcagcctgcgttacccgctggtcgatggccaaggtaacttcggttctgtggacggtgaccccccggctgcttaccgttatactgaggcccgcatgtccaaaatggcctgcgagatgctgacggatattgacaaggataccatcgattgggaccccaactttgatgagaccaaaaaggaaccccacgtcctgcccagccgctttccaaacctgttggtcaacggcagccagggcatcgcggtcggcatggctaccaatattccgccccataacctgcgcgagatcgtcaacggtatggtcgccctcatcgatgacccggaaatcgacctggcgggcctgatggagtacgtcaaaggccccgatttccccactggcggcatcatcatgggccgctccggcatccgtgccgcttacgccaccggccgcggaaaaataacgctgcgcggccgtgccgaaatcatcgaaaagaaaaacggccgctacgagatcctcatcaacgagatcccgtacatggtcaacaagacccgcctgatcgaatccatcgcggacctcgtgaaggataagcgcatcgagggcatcagcgacctgaacgatgaatcttccagccgtaccggcatgaaaatcgtcatcgagatcaagaaggatgccaacccccaggtcgtgctgaaccagctgtaccgttacacccagctgcaggacaccgtaggtgtcattatgctggcgttggatgacggcgtgcccaagattatgagcctgaaaaccatgatggaacgctatattgagttccaaatgcaggtcatccgccgccgcaccgcctttgatttgaagaaggccaaggagcgcgagcatatcctggaaggtctgcataaggccgtcgacatcgtcgatgaaatcatcgctaccatccgcgcctgcaagggcggctttgccgaggcccgtcaggctgtgatggataacttcggctttgacgaactgcaggcggatgccatcgtcaagctgcagttgggccgtctggctggcctggaaatcctcaaaatcgagcaggaattgggtgaactgcgcaccgccatcgccgattatgaggacatccttgccaacgacgagcacgtgaagaacatcgtcaaaaccgacctgaccaccctggccgacaagtacggcgacgagcgccgcacctccatcgaggctgtttccggtgaggtcgacatcgaggaccttatccccgaggagacctgcgtcttcacgctgacccacgagggttatatcaagcgcaccacgctggacacctaccaggcacagaaccgcggcggccgcggcgtgcagggcatgacccaaaaggacgacgactttactgaggaactttttgtcggttctacgcacgattatatgctgttcatgaccgaccagggccgcgtctaccgcctgaaggggtaccaggtaccagagggcagccgcactgccaagggcacccacatcgtcaacctgctgcaattgcaggagggcgaaaaagtcaccctgatgctgcagcaggccgccgatgtggacgaggacaacacctacgccacgatggtcactaagatgggcctcattaagcgcacgccgctgtcccagttccgtaacattcgcaaagcgggtctgatcgccattgccctgaacgagggcgacagcctggtctggagccacctgaccaagggcaacgatgagatcatcgttgccacccacgatggtgccgccatccactttaccgagagcggcgcccgcgctatgggccgtaccggccacggtgtgcgcgtcatcaagctgcgagagggagactatgtcattggagccggtgtatgccgcccaggtgccagcgtgctgaccattaccgaagaaggcaagggacgccgcagccgcattgatgattaccgcatcaccaaccgcggtggtttgggtatccgtaactacaacaacggcggcgtggccggcatcaagatcgtggacgatacagacgacctgattttgatcagccagaatggaatcctcatccgcatccatgcagctgacatcaacactcagagccgttacggcagtggtgtgcgtgtcatgcgcctggctgagggtgacaaggtagccgttgtagcccgcgtggaccgcgacaacgaggccgagaccgtccaaatcgacaacgagggcgaaaccgacccgacccccgaggaactggccgccatcgaagccgaagaactcgcccaggaagccgccgaggagagcgcaccgagcgacgaggaataa

SEQ ID NO: 466 - DNA, 2262 bp, Faecalibacterium sp.
atgaatatgaccgccgccatcgaagccctgaccggcaaagccctggccgaaagcaccgaccaggagatctatctcgccctgctggacatcgtccgcgagcagagcgccgagaaggtccggcccgtcaccggccgcaaactctactacatcagcgccgagttcctgatcggcaagctgctgtccaacaacctgatcaacttagggctgtacgacgacgtccgcgacgctttggccgctgcgggcaagaacctgtccgacattgaggaagttgagccggagccgagccttggcaacggcggtctgggccgcctggccgcctgcttcctggattcgctggccaccctcaacctgcccggcgacggcgtgggcctgcgttaccacttcggcctgttccaccagtccttcgcgaatggcgtgcagaacgagctgcccgacccctggctaaccaaccacagctgggccgaaaagaccgacgttacctacccggtcgagctggccggcaaggagtacaccgcccgcctgtacaagctggccgtcaccggctaccagggccgcaccaacaccctgaacctgttcgacctggacaccatcgatgagacgattgtccatgacggcatccagtttgacaagaccgacatcgacaagaacctgacgctgttcctgtaccccgatgacagcgacgaggccggccgccgcctgcgcgtttaccagcaatacctgatggtcagtgccggtgcccagctcatcctggccgagtgcgccgcccgcggctgcaactaccacgacctggccgactacgccgccatccagatcaacgacacccatcccagcatggtcatccccgaactgatccgtctgctgggcgagaagggcattgaatttgacgaagctgtggagatcgtcaccaagacctgcgcctacaccaaccacaccatcctggccgaagccctggagaagtggccccgcgcctacctggatgccgtggtcccgcagctgatgcccatcatcgagaagctggacgagttggcccgcacccgcaccgaggacgagagcctggccatcatcgacaaggacgaccgcgtccacatggcccacatggacatccacttcacccactccaccaacggcgtggcgaccctgcacaccgagatcctgaagaactccgagctgcacggtttctacgagctgtaccccgagaaattcaacaataagacaaacggcatcaccttccgccgctggctgctggagtgcgaccccgccctgaccagcctgatcgaggagctcatcggctccggcttccgcaaggatgccgccgagctggaaaagctgctggcctgcaaagacgacgtggacatgctgcagcgcttctccaaggtgaaggctgacaacaagaaggcgctggccgactggctgcagcgcacccagggcgtgaccgtcaacaccgacgccatgttcgacatccagtccaagcgcctgcatgagtacaagcgccagcagctcaacctgctctacctcatccaccagtattacgagatcaaggccggccacaccccggctaccccgctggtcagcatcttcggcgccaaggccgccccggcgtacatcatcgccaaggacatcatccacgccctgctgaccctgtccaaggtcatcgccgctgaccccgcggtcagcccctggctgcaggtggtgtttgtggagaactacaacgtcaccgccgccgagaagctcatccccgcctgcgacctgtccgagcagatctccctggcctccaaggaggcttccggcaccggcaacatgaagttcatgctgaacggcgccctgaccctgggcaccatggacggcgccaacgtcgagatcagccagcaggtgggcaacgacaatatctacatcttcggccagacctccgaccaggtcatccaccgttacgaggccgccgattactgcgccgcccagtggtacgagggcgaccccaacatccgccgcgccatcgacttcctgaccggccccgaaatgctggccgccggcaatgccaagaacctgcagcgcctgcacgacgagctgatccacaaggattggttccagaccctgccggacttcaacgcctacgtggtgcgcaagggccaggccctggccgactacgcctgcgacccgctgggctggcgccgcaagtgcctgatcaacatcgccaaggcgggcatgttcagcagcgaccgtaccattgccgagtacaatgccgacatctggcacctgggcaagtaa

SEQ ID NO: 467 - DNA, 2571 bp, Faecalibacterium sp.
atggtagcatacaaaataggggggaacatccactttaagggaggctacatttctttggaaaacgaaaagccaaaaggtaatgcgatggaaaagctggcgacgcttatcgtcgataagcgtaacctgattttccttttatacatctttgcgttgattttctgtgtcattgctacgggctgggtcaacgtggaaaacgacatcaccacctacctgccggactccaccgagacccgccagggcctgactgtgatgaacgataacttcaccacctacggcacggcccgcgtcatggtgtccaacatcacctacgataaggctgttcagctggaagaacagctggaggacatcgacggtgtggactccatcgacttcgacgagacctcagaccactacaaggattcctccgcgctgttctcggtcagttttgacggcgaggtcgacgatccccgcgccgaggccgccatggacgagatccgcgccgagctggccgactacgacacctcgatctacaccgaggtcggctacgattcttcggcggacctgcaatccgagatgagcgttatcatcgtcatcgccgccgtcatcattgtactggtgctgacgctgacctcccgttcttacgccgaggtacctgtgctcatcatgacttttggtgccgccgccttgctgaacatgggcaccaacttcctgtgcggcaccatcagcttcatctccaactcggtcacggtcattttgcagctggcgctggccatcgactacgccatcattctgtgccaccgcttcagcgacgagcacgagacgctgggcgtgcgggaagcctgcattgccgcgctttccaaggccatcccggagatctcttcttcctcgctgaccaccatcagcggcctggccgccctggcgttcatgcactttggcattggccgcgacctggctactgtgctgatcaaggccatcctgttcagtatgctgtcggtctttacattgatgcccggcctgctggtgctgttcagcaagctgatcgacaagacccgccacaagaacctggtgcccaggatcactgccgtaggcaagttcgacgtcaagacccgctacatcgtgccgcccatctttgcggtggtcatcatcgcggcagctgtttttgcgaacctgtgcccctactgctacacctacaccgacctggtcaccgccaagcagagtgagcgtcaggccgcctaccagaagatcaagggtgagtttggcaccagcaacatggtggccatcatcgtaccggcgggcgattacgagtccgagggcaagattttggccgagctggacagctgccccgaggtcgactctacccaaggcctggccaacatcgaagccatggacggctacatgctgaccgacgccctgaccccgcgccagctctccgagctggccaacctggactacgagattgccaagactctgtatggtgcctacgccgtcgagcacaacgagtatggcgagatcatcaacggcctgagcgactacaaagttccgctgtacgatatgtttatgttcctcaaacaggagatggagaacggcaacatcaccctgggcggcgatgtgcaggacacgctggacgacctgttcgcccagttggacaaggctcaggtccagctgcagagtgacaagtacagccgcttggtcgcctacctgaacgtgcccgaggaaagcgacgagactttcgcctttgtggacaagatccatgacatcgtgggcaagtattatgacagtgactactacgtggtaggcaataccaccagcgccatggacctgtccagctccttcggccaggacaacctgctcatcagcgtgctgtctgcgttgttcgttattctggttttgctgttcaccttcaagtctgccggtctgccggtgctgctcatcatcgtcattcagggcagtatctggatcaactttgcgttcccgtatctgcagcactcgcagctgtacttcctgggttacctcatcgtcaactctatccagatgggcgcgaacattgactacgccatcgttatctccagccactacaccgacctgaagaaagtcatgcaccacaaagaggccattgtagcggctttgaacgaatccttcccgaccatcttcacctccggctccatcctggcatccgcgggtgtgctgatcagcgtgctgaccaccaaccccgttatcgccgctatcggcgagtgcctgggccgcggcaccatcatttccatcatcctggtactgtttgttctgccgcagatcctggtgctgggcgactccatcatcgagcgcaccagctttgagatgaagggcatcggcgtgaccacccgcactgccagcggcacgatgcacgtcaacggccgcgtccgcggttacatcaacggcgtggtagatgccgagatcaagggcgtgctgcatggccagttcaacgccagcatctccaccggaaccgaagtcacggtggatgaacccgatatgtacctgtcggagggcgacgtgaccgccaccgacgaatccccgaatgaacctgccgacaccacgaaagggggcgatgctgaatga

SEQ ID NO: 468 - DNA, 1434 bp, Faecalibacterium sp.
gtggcatcatcgcaaaaaaaatactcaacgctggtaagcaatacactgctgtttgccatctccaacttcagctccaagctgctcagcttcttcatccgcccgtacttgagctacgcgttggatacgccggacatcatgggtgtgtccagcctgctgcagcaggctactaacctgctgatcccggtggtcagtttgggcgtgtcctacgcagtcatccgctttggcctggataaaaaggtcaacaagtccagcgtcttcgtcaatggcggcgctaccatcagcgtgggctttttgctgctgctgctggccataccgctggtgcggctcatccccaacgcggcggaatacctgccgtatctatacctctgcgtgctggccagttgcctgcgcacgctgtgtacccagtttatccgctcccgtatgttgaaccgcctggtggcgatagacggcgtgctgactaccggcgcactgctggcgtattacctggtgtttttgagttggctcaagctgggcgcagcgggttttttgctggcaaacgcctgcgcggacctgacctcgatggtgtttgtgttctttgcgggcaggtgctataaattctgcacccccaaagcctttgacaaaaagctgtggcgcgacatgctgcgctactgcctgcccatgatccccgcggccatcagcttttggatcatcaacgccagcgatatgttctttgtgcaggctatgtgcgaggattacggcggccgcagcggcaactattgggtcggcctgctgtcggcgggctatttcctgccgcaggtcatcacgattttgggcagcatcttctacgaggcctggcagctctccgctgtgaccgaggagcaggaccgcgaggtgttcttctccaaaattttccgtatctacgccagtgttttgttctgctgtgtggcgggcgttatctggctctgccgaccgatgatgcacctgttcaaagccgaatattacgacggctggatctttgtgccgtttctgacgctctgctccatgtgcacctgcctgaaccagttcctcaacagcatctacgtggtgtataagcggtccaccggttcgctggtcacgatgctgtgcggtgcggtgctcaacctgatcctgaactactgcttcatcctggcctggggcccttggggtgtcactccggccagcttcttagggctgctgttggtttttttgctgcgtgcctactccacccgcggcctgctggaagtggatttccaccccggctggctgctgctgaacctggcgctggtgctggcggaaattttctgcatcatgcggctggaaaattggggcatccctgtcacggtgctgacggccatcgtctgcgccatcaacttccgcgaaattttcagtatgctgaacaaactggtgggcaaattcctccaccacaaaaaggtgtga

SEQ ID NO: 469 - DNA, 1980 bp, Faecalibacterium sp.
atggcaaaaaaacaacaggaatacggcaacgacagcatccgccagctgaaaggcgcggaccgtgtgcgtaagcgcccggccgttatttttggctcggacggtgtggaaggctgtgcccattccatctttgagatcatctccaactccatcgatgaagcccgtgacggccatggcaaccgcatcaacgtcaccctctaccccgaccacgtcgttgaggttgaggacttcggccgcggcatcccggtggactacaacaaggctgaggaccgctggaactgggaccttgtcttctgcgagctgtacgccggcggcaaatacgccgagggcagcggcaactacgatttcagcctgggcctcaatggcctgggcctgtgtgccacccagtacgccagcgagtggatgaccgccgacatctaccgcgatggcttccactaccacctcgactttaaaaaaggcgagaacgtgggcggcctgcaaaaggagccgttcaagggcaagcgcaccggctcggtcatccgctggaagccggacaccgaggtctttaccgacatcgccgtcccggccgacagctttaaagatatgctgcgccgccaggctgtggtaaacgacggtgtgacgcttgttttcgaggataaatccggcggtgacacggagaagtacgagtacctctacgagcacggtatcaccgattacgtcaacgaactggttggcgataagggcctgaccccggtgcacttctgctccggttccgccactggccgcgaccgcgccgaccagcccgactatcaggtcaaaatgaacgtggccttcgccttctccaacaccgtgcaggcgttggaatactaccacaactccagttggctggagcacggcggcagccccgaccgtgccgtccgcctggccttcgtcaaccaggtcaacgcctggctgaaatccaagggcctgtacaaaaagaacgaaagtgcgatcacttttgccgatgtgcaggattgcttggtgttggtttcgtccagtttctccacccgtaccagctacgagaaccagaccaaaaaggccattaccaacaaatttgtggcccaggccatgaccgagttcctcaagcatcagctggaggtctacttcatcgagcaccccgacgaggcggagaaagcctgcaagcaggtgctgattaacaagcagagccgtgaacacgcagaaaaagcgcgtatcaccattaaaaagacgatgacccagcagatggacctggccaaccgtgtgcagaagtttgtggactgccgcaccaaggaccccacccgccgtgagctgtatatcgtggagggcgattccgctatgggcgccgtcaagcagagccgcgactcagagttccaggccatcatgcccatccgcggcaagattttgaactgcctgaaagccgactatgcccgcatttttaagtcggaaatcatcaccgacctcatccgcgttatgggctgcggtgtcgagctgggcggcagccacaacaaggatttagccagcttcaatctggataacctgcggttcaataaagttgtcatctgcacggatgccgacgtggacggctaccagatccgcaccctggtgctgacgatgctctaccgtctgacgcctaccctcatcaacaagggctacgtctacatcgccgagtcgccgctgtacgagatcaacaccaaaaacaaaacctactttgcctacaccgagccggaaaaggctgacatcctgcgccgcatcgatggtgaaaaatatacgattcaacgttcgaaaggcttgggcgagaacgacccggaaatgatgtggctgacgactatgagtcccgaaagccggagacttattaaggtactgcccaccgatgccgagcgcacggcagaagtttttgacctgctgctgggcgacaatctgcaaggccgaaaagaccatatcgccgaacacggcgcggagtatctggacgatttggatgtaagctga

SEQ ID NO: 470 - DNA, 1812 bp, Faecalibacterium sp.
atgaccatttttaatgtgttcaccctgatgggcggcatcgctatgttcctgtatggcatggacctgatgggcaaggcgctggagcagaccgccggcagcaaattgcagggcatcctctccaccatgacttccagccccatccgggcgctgctgctgggcgtagcggtcaccgccgttattcagtccagcggcgccaccaccgttatggcggtcggcttcgtcaactccggtctgatggaactgcaccaggccatcggcgtcatcatgggtgccaacattggtaccactgttaccggctggctgctgtctttgtcgggcctcgagggcgagagctttatcacaaaaatgctcaaccccaatgcctggagcccgatcctgggcttcatcggcatctggctgtatatggtcggtaaggaccgcaagcgcggcgtaggcaagatcctactgggtttcgccattctgatggccggcatgaacactatgtccaacgccatgtctcccctggctgatgagccctggttcatgaatctcttcctcagcttcagcaacccggtgctgggcgtcattgccggcgctgtgctgactgccgtgctgcagtcgtcctcggcggcggtgggcatcctgcaggcgctgaccagcacgggtgctgtcacctactccgccgccgtgcccatcatcatgggccagaacatcggcaccaccgttacagcgctgatctcctcggccggtgcgaacaaaaacgccaagcgcactgccttcgtccatctctatttcaacgtcatcggcaccatcatcttcctgttcggcttctacggcctgcatgcgctgatcagtttcagcttctttaatgcgacggccaataccttcggcatcgccatggtgcataccatttttaacatagtcaccaccgccatcctgctgcccttcaaccgcctgctggaaaagctggccatcatgaccgtacccgactcccccgccgacaaaaagcaggagaactccctgctggatgatcgtctgctggcaactccgtctgtggctgtcgcccgcgccatgctcaccggcggcgatatggccgagatctgccgcacctcgctgctgcaggccatgtccaccactcataagtggaacgatgccatcgccgacgaggtcgagcgcaaagaggacgccgtcgaccattacgaggacgtgctgggcacctacctggtcaagctcagtgccaagcatctctccaccgaagataaccgcacgatcaacaccctgctgcacaccatcggcgatttcgagcgcgtctcggaccatgccgtcaacctgatcaagacggctgaggagattcgcgataagtccatccagttcagcgaggaagccttgggcgacttgggcgtgctggaagccgctgtgcaggacatcgtcaaccgcaccgtcgatgccttccagaagggcgatgtctacgccgccggcaagatcgagccgctggagcaggtcgtggacggtctggtgcgcgaggtcaagacccgccatatcgcccgcctgcaggctggtgtatgcaccatcgagtacggctttgtgctggatgatctgctgaccaactacgagcgtatcgctgaccactgctccaacatcgctgttgcaatgatcgaggtcgccgccgataagttcgacacccacgagtacctggcttccgtcaagcatggcggcagcgtgaaatttgagcagcggtacgagaaataccgcggccgctataccttcccgccggagacttacgccgagatgcagcctgtttcggcccccggcaacgcggaagaagacgcataa

SEQ ID NO: 471 - DNA, 2013 bp, Faecalibacterium sp.
atggaacagaaaaaattctacatcacaacgccgatctattaccccagcgataagctgcacatcggccatacctattgcaccgtggccaccgacgccatggcccgctacaagcgcctgcagggctacaacgtcaagttcctgaccggcaccgacgagcacggccagaagatcgagttgaaagccaaagaggctggcgtcaccccgcagcagttcgtcgacaacatcgtcgaaggccccaagggcgtcaaggacctgtggaaactgatgaacatcagctacgaccgctttatccgtaccaccgacgattatcacgttgccgccatccagaagatctttaaaaagatgtacgagaagggcgacatctacaagggcacctacaagggcaagtactgcaccccctgtgagagcttctggaccgagagtcagctggtcaacggctgctgcccggactgcggccgtcctgtcgtcgatgctgaggaagaggcttacttcttccgcctgtccaagtacgccgaccgcgtgcgcgacctgctggtcaacaccgacttcctgctgccccgttcccgcgtcaacgagatggtgcacaacttcatcgatccgggcctggaggacctctgcgtctcccgtactagtttcaagtggggcatccccgtcgacttcgaccccaagcacgtcgtctacgtctggatcgacgccctgttcaactacaccaccgccctcggcttcatgaacgataagtaccccgacagcgactacgagactttctggcctgctgacgtgcattttatcggcaaggagatcgtgcggttccattccatcatctggcctgccatgctgatgagcatggatatgcccctgcccaagcacgtttacggccacggctggctgctgctggacggcggcaagatgtccaagtccaagggcaatgtggtggacccctacctgctggccgagcgttacagcgccgacgccctgcgttacttcctgctgcgtgatttcccgtttggttccgacggcaacttctccaacgagctgctgatcaaccgtatcaatatggacctggccaacgacctgggcaatctgctgtcccgtaccaccgccatggcggacaagtactttggcggctgcctgcccatcgagcaggacgaaggggccgaggatgccgccctgctggaaaaagtcagcggtctgcgcgcccggtacgaggccgacatggaggcttatgctttccagaacgctttggccgacgtgtttgaggtcatcgacaacgccaacaagtacatcgacgctaccgccccctgggtgctggccaagagcgaggacaccaagccccgcctggcccgtgtgctgtataacctggccgagaccctgcgcatctgcaccgtgctgctgcagccgtttatgcccgccacctgcgagaagatctttgcccagctgggtgtggatgacagcctgaagacctgggacagcgccgctgccgtggggtctatgcctgccaatgccaccctgcacaagggcgagaacatcttcccccgcatcgacaccgccaaggagctggccgaactggatgccctggaggctgcccagaaagccgctgcccaggctgccaacgcccccgcagaggagcctaaagccgaagccgctgctgccagcgctgagctgatcggcgaccatgaggaagagatcagcttcgatgatttctgcaaggtagagctgcgcgtggccgaggttcgtgcctgcgagcgcatgaaggaaagcaagaagctgctgcacctgaccgtttttgacggcgagcgcgaacgctgcatcctgtccggcatcgccaagtggttcgcacccgaggatctgatcggcaaaaagatcggcatcgtggccaacttggcaccccgcccgatgatgaagggtaagtatgtcagcgagggcatgatctttgctgctgatactgatgtcgacggcggctgctccatcgccttcttcccggacagcacccccgccggtgcacgcatccattaa

SEQ ID NO: 472 - DNA, 1860 bp, Faecalibacterium sp.
gtgaataagaaaagcgaaaaggagggggaagccatgatcttcggcaagtatatcaaccggtattatctgcgcagtgcacccgtgctgcttttgggcctgctggcgctgctgacggtcgattatatccagcttatgatccccgagctgtaccgcctggtcatcaacggcgttaatctgggagaggtcgccatcgacggacagaccctcgcctttaccaaagaggtgctgttccagcatatctgcctgcccatgatctggatcgtgctgctgatggtcgtcgggcggtttttgtggcgcgtctgtttctttggctcggcggtgctggtcactgccgatctgcgggagcggatgtttgaccacagccgccagctgtcccagcaatactaccaggtcaacaaggtcggcaacctgatgagcctctacaccaacgacctggacaccattcaggagtgtttcggtgacggcatcttgatgttcttcgatgcctcggtgctggggctgctggcactgtttaaaatgtggcgtatggactacaagctcacgctgctggcactgatccctgcgggcatcatgttcgtcatcggcaccatcatgggcaccaccatgaccaaacggtgggaggaacgccagcaggctttttccgacctgtctgacttcgcgcaggagaatttctccggcatcgcggtcatcaaggccttcgtcaaagagtacaaggaattgacggcttttcgtaaattaaaccgcgagaatgaggagatcaacgtcacctataccaaaattgccaccctgctggaagtgctggtcacgctgtttgttgagtcgatcatctgcgtcattttgggctacggcggctggctggtctaccgcgggcagttcaacgcaggccagctggtggagtacatcggctactttgaggccatcgtctggcccatcatggccatctcgatgctgatcgaaaagacctcccgcggcaaggcgtccctcaaccgcgtcaccgagctgctggacgcccccatcgacgtgaccgaccgggtcgatgtgcacgaactgaccgcccccaaaggcggcatcgagttccgccacctgaccttccgctacccggatggcgagtatgatgtgctgcaggacatcagcttcaccgtcacccccggcgagagcgtgggcatcgtaggcaagaccggtgccggcaagaccgcactggtagacctgctgctgcgcacctacaacgtggccgacggcaccctgtttgtggacggtcaggacgtgaacagcctgtccatccattcggtgcgcaacgcctgcgcctacgtgccacaggataacttcctgttctccgacaccatcgcccacaatattggttttggcgtggacgatgctgcgcaggaagacattgaccgcgccgccgccctggcggatgtgcgggacaacatcgttgacttcaaggacggctacgagaccgtgctgggcgagcgcggcgtgaccgtctccggcggccagaagcagcgcatctccatcgcccgcgccctgctgaaagacgcgcccattctgattctcgacgactcggtctccgccgtcgatacccgcaccgagaagatcatcctcgacaacctcaaatccacccgcgcgggcaggaccacgctgctcatcgcccaccgcatctccaccgtggagggactggacaagatcgtgttcctcgatgacggcagggtagaggccgtcggcccccatgatgagctgtatgccacctgcgccgagtaccgccgcatggtggacctgcagcgccttgaggacgagaccgaggcgggcgagactgccgcccagcccgtgactaacgcagaaggaggtgccgtccatgactga

SEQ ID NO: 473 - DNA, 1989 bp, Faecalibacterium sp.
atggcagaagaaatcatcaccgaaaccaaccgcgaaacggccacagaccatgcctacggcggtgcgcagatccaggtcctggagggcctggaggctgtgcgcaagcgccccggcatgtatatcggttctaccggcccttccggcctgcatcacctggtctacgagatcgtcgataacgccatcgacgaagccctggctgggtactgcacccatatcgaagtaacgatcaaacccggtaatatcatcgaagtttccgataacggccgcggcatccccgtggacatccagcccaagctgggcatcccggccgtcacagtcgtatataccgtgctgcacgccggcggtaagttcggcggcgaggattccggctacaaggtggctggcggtctgcacggcgtcggtgcgtcggttgttaatgcactgtctgagtggctgaccgtccgcgtccgccgcgatggtgccgagtatgagcagagcttcaagcgcggcaaacccgatggtgatctgaaaaagatcggcgcggcagcctccaccggtactacggtcaccttcaagccggacccggaaatgttccaggaaacaacgctgtatcgttacgaaacgctgctcaagcgcctgcgggaagaagccttcctgaacgccggtgtccgcatcaccctgacagatgagcgtcccgagagtgaccgcccacaggaggaaaagagcgaaggaaacgaggtccgcaccgaaaccatgtgctacgagggcggcatccgttccttcgtcagctacctgtgcgagcgccgcgacctcaccccgctgaccccgcaggtcatgtatatgaagggcgagggccagggcgccgtggccgaggtggctttgcagtattacgataacagctataatgaactgctgctcagttttgccaataatgtgcatacgcctgagggcggaacccacgaggaaggctttaagctggccctgacccgtgtgctgaacgagtacggccgcgctaaaggcatcctgaaagataaggacgagaatctttcaggccccgatgcccgcgagggtatcattgccatcatcagtgtcaagctgcaggaggctcagtttgaaggccagaccaaggccaagctgggcaataccttcatcaagggcctggtcagcaatgtggtctacaaggccctgaccgagtactttgaggaaaatcccgccgttgccaaggcaattctggaaaaggccacccaggcagcccgtgcccgtgctgccgccaaaaaggcccgtgaactggtccgccgcaagagcgcgctggaatccaaccgcatgcccggcaagttggccgactgccatgaaaaagatcccagcaagaccgaactcttcattgtggagggtgattctgcaggcggctcggccaagatgggccgagactccaacattcaggccatcctgccgctttggggcaagatgctgaacgtcgaaaaagcccgcgccgaccgtatttacggcaacgataagctgatgcccgtggtcacggctctgggcaccggtatcggcgatgaatttgatatttccaaggtgcgttaccataaaatctttattatggccgatgccgatgttgacggctcccatatctgcaccttgatgctgaccttcttcttccgctatatgcggccgctgatcgacaacggttacgtctacgtggcccagccgccgctgttcaagctgcagaaaggccagaccgtcaagtatgcctataatgacgatgaaatgaagattttgagcgccgaaatgcccggcgccaaggtcaaccgctacaaaggcttgggcgagatgaaccccgaccagctgtgggagaccaccatgaacccggataaccgcgtcatcgtgcagatcaagatcgaggatgccgagcgtgccgacgaagctttcagcatcctgatgggtgagcaggtcgaaccccgccgccagttcatcgagaaaaacgctaagtacgcgaatcttgatgtgtaa

SEQ ID NO: 474 - DNA, 2094 bp, Faecalibacterium sp.
atgccgaaattagtcatagtggagtcccccgccaaagcaaagaccatcagcaaatacctgggccggggctataaagttacggccagcatgggccatgtgcgtgacctgcccgccagccagctgggcattgatgtggacaatggctttgcgccgaagtatatcaccatcaagggcaagcagaaactggtcaaagagctgaaagccgaggctaaaaagtgcgacggcgtcctgcttgcaaccgacccggaccgcgaaggcgaagccatcagctggcatctggccaacattcttggcctggaccccgccgcccccaaccgcgtgacctttgacgagatcaccaaaaagggcgtcaaggagggtatggcccatccccgtgccatcaacattgatctgttcaacgcccagcaggcccggcgcgaactggaccgtctggtgggctacaagctcagcccgttcctgtggcgcaaggtccgccgcggcctctccgccggccgtgtgcagagcgtggcggtgcgcctgatccgcgaccgcgagctggaaattgaaaacttcaagccagacgaatattggaacatcgacgccgcgctgtacccccagacccagagcaacagcaaaaacggctttacggcccgcttggccgctaccgctgacggcaaaaagctgaccgtcaccaacaaagagcaggccgataccatcgtggccgcgctggatggtaaaagctacaccatctccaaactggaaaaaggcaagcgccgccgccagcccgcgccgcccttcatcacctccaccctgcagcaggacgccagccgtgcctttggcttctcggccacccgcacgatgcgcgctgcccagacattgtacgaaggcatggacattgcaggccacggcaccgtgggtctgatcacctacatgcgtaccgactcgctgcgcatcgccgccgaggccagcgccgccgccaaacagttcatcgcgggccgctggggcgacaactacgtctgcaacacccagcgcaagtggaagtcccgctcggccacggccgcccaggacgcccacgaagcgatccgcccgtctatgccggaactgacccccgatgaagtggagcagagcatcagcggcgacaccgccaaactgtaccgcctgatctggagccgctttatggccagccagatggccgactgcatccaggataccgtctcagtgtccatcacggcaggggattacctcttccgtgcatctggcttccgcgtgtcttttgacggcttcaccgccctgtacgaggaatccaccgacgacaagcagaaaaaggagaccgccctgcccccgctggaggagggccagaccctcaaactgcgcagcctgacggcagaccagaagttcacccagccgccgccgctctacaccgaagccacgctgatccacgcactggaagaaaacggcatcggccgcccttccacctacgcgcccatcatcaccaccatcgtcgaccgcggctatgtggaaaaagaccagaaaaagctgaaaaccaccccgctgggtcaggccgtcaacactgtgatgatggagcagttccccaacattgtagatgtgaaattcagcgcagatatggagaaaaagctggatattatcgaggctggcaaggctgactgggtccagaccatcgatgacttctacaaaggctttgccaagagcctggaggacgccgagaagaacatggagggcaagcgcgtcaaggtcgaggacatccccaccgacgagatctgcgaaaagtgcggacgccccatggtcatcaaatccggccggtacggcaagttcgtggcttgctccggcttcccggagtgccgcaacgcccacccgctggtcaaagataccggcggcatctgcccggagtgcggcggccacatgctggtgcgcaaaagcgcgaaagggcgcatttattacggctgcagcaactaccccaagtgcaactttatgacctgggacgagcctgtgcctgaaaaatgcccccagtgcggccagaccctgtttaagaaaaaaggccagctctactgcgccaaagagggctgcggctttacgaagcctatcgaaaagaagtaa

SEQ ID NO: 475 - DNA, 2019 bp, Faecalibacterium sp.
atgcaaacgcaaagcggaggaaaaactatgccgttcgataaacttctccatggcggagattataacccggaacagtggctggaccgcccggatattctggccaaagatgtggaactgatggaaaaagcacatgtcaacgtagttacgctgggcgtgttctcctggtccaccatcgagccgcaggagggcgagtttcacttggattggctggcggacatcatccacaacctgtacgcccacggtatctccaccattctggccacgcccagcgccgcacgcccggcctggctggcccagaagtaccccgaggtgcgccgtgtgcgcggcgaccgcgtgcgcgaactgtacaaccgccgccagaaccactgctacacttcgccgatctaccgcgaaaaagtggccatcatcgaccgcaaactggccgagcgcttcggtgatgacccggccgtgatcctgtggcacatcggcaacgagtttggcggcgagtgccactgcgagctgtgccagaacgctttccgcgcctggttgcagaagcgttacggcagcctggacgcgctgaacaaagcctggaatgccaccttttggagccacaactacaccgaatggagccagatcgaaagcccggcgccccatggagagaacgccgtgcagggtctggctctggactggaagcggttcgtcagctaccagagcatcgatttttacaagtgggagcgcgattgcgtgcgggaactggcccccaaggcggagttcaccgtcaacatgatgtatcgcttcaacgacatcaactactttgactttgccaaggagatcgacgtggccagctgggacaactaccccacctggcacaagcccaccgagaccatcgaggagactgccctggacacggcgatgatgcacgacctgtactattcgctgaagggcaagcctttcctgatgatggagtccagccccagctttactaactggcagcctgtcagcaagcagaagcgccccggcatcgccgagctgtctgccctgcaggctgtggcccatgggtcggacagcgtttgctacttccagtggcgtgctagccgcggtgccgaggagaagcttcacggtgcagtggtcggccatgacggccgcgaggatgcccgccccttccgcgagaccgccgaagtcggcgagactttggagcagatggcctttgtggcggacactcgccgcgtcaagcaggcggccatcgtgcatgactgggagaacaagtgggcgttggaaggttcctgcggaccgcgcaactgcggcctgggctactggaaagagttggcttgccactacaacgccctggcccgccgcggcatcaccgtggatttcgttaaccaggaaagcgacctgaccggttacggcctggtcattgtgccgatgcagtacctgctgcgcaacaaatttgcgcaggcactctgcgattacacgacccagggcggcaccgtggtggtgacctactggaccggcgtggtggatgagagcgatctgtgctacctgggcgacaccccctacggcctgaccgatctgttgggcctgcgccgggaggaaatcgacgccctgtacgatggtgagacctgccactgtgctgccactgacgatggcgagatggaagcggacggcagcatcctgtgcgaggtggctgctctgaacgacaccgatcccgccaccccgctgatgctgtatgcggaggattactacgccggctgccccgccgctgctgtgcatgcctttggcaagggccaggcgtattacctggccagccgcttcaatgcggatttttacaatgacttttatgcgcaggtatgcgagaaagcaggcctgcagcctgcctggccggagcagctgcctgccggtgtgctggccactcgccgcggtgatttcgtatttatgcagaactgcaacgaccacagcgtagacatcgatggcgtggagctggagaaatacagcacccgtttggtccagctggaacctgtggacgaggacgacgagagctga

SEQ ID NO: 476 - DNA, 1002 bp, Clostridium sp.
atggtcacttttgaaggatacgaaagaagaatagataccctgcgccccgtgcttgcaaagtatgggttcgacggctttgaagcatgcgaagccttcaccaaggagcatggcgtagacgtgcgcggcatagtgcagggcattcagcccatagcattcgaaaacgcggtttgggcatataccctcggcgcggcgatagcgctgaagaagggcgttaagagcgcggcggaagcggccgaatgcataggcgaaggcttgcaggcgttctgcatacccggctccgttgccgatcagcgcaaggtgggtctgggccacggaaatcttggcgcgatgctgctttccgaatccacgcattgcttcgccttccttgccggacacgaaagctttgccgcggcagagggcgcaatcggcatagcccgcacggcgaacaaggtgcgcaaggagccgctcaatgtaatactcaacggccttggcaaggatgcggcctatataatcagccgcataaacggcttcacccacgttgaaaccgaatacaaccagtacacgggcgagcttaccatagtaaagaccaccgctttcagcgacggcgaccgcgcgaaggtgctctgctacggcgcggatgacgtgaacgagggcgttgccataatgcgccacgagaacgtggacgtatccataaccggcaactccaccaaccccacccgtttccaacaccccgttgcgggaacatacaaaaagtggtgcgttgaaaacggcaaaaagtatttctccgttgcctccggcggcggcacgggccgcacgctgcacccggacaacatggcggcaggccccgccagctacggcatgacggacacgatgggccgtatgcattccgatgcgcagttcgccggctcctcctccgtgcccgcgcacgttgaaatgatgggccttatcggcatgggcaacaaccccatggtcggcgcaacagtggccgtggcggtggcttgcgaggaagccctcgccaaataa

SEQ ID NO: 477 - DNA, 789 bp, Clostridium sp.
cacgttttacagaaaggattgatgaatatgcggcttgtatcatggaacgtgaacggactgcgcgcctgcatgggcaaaggcttcatggagtttttccataccgtgaacgcggacattgtggcgctgcaggagaccaagcttcagccgcaccagatagagcttgagcttgacggctacgaacaatattggcacagcgcggagaaaaaaggatacagcggcacggcggtattcactaagcaaaagcccctctccgtaagctatgacctgccggacatggaaagcctcggcttcccgaacgagggcagggtgataacgcttgaatttgacgaattttattttgtcaactgctatacgcccaattcccagcgggagcttacgcggcttgaattccgcatggattgggaggacgaattcaggaaataccttacggagcttgataagaaaaagcccgtaataatgtgcggcgaccttaacgttgcgcacgaggagattgacctgaagaaccccaaaacaaaccataacaacgccggctttaccgataaggagcgcgcaaagttcacagcgcttatgcaaagcggctttgtggacagcttccgctatctttatccggacaagcgggattgctactcctggtggagctacatggccaattcccgcgcgcgcaacataggttggcgcatagactactttgttgtgagcgagcggtttaagcacaggatagaggaaagcagcatactgcccgaggtgacgggcagcgaccattgcccggttatgcttgaaatacgctga

SEQ ID NO: 478 - DNA, 1578 bp, Clostridium sp.
atgtatgatctgctgataaaaaacgcatatgtgctggacggtaccggagcggaaggcttccatagcgacataggcatatcaggcggcaaaatagccgccatggcgcaggcaataaatgcccaagccgaaagcgttatagatgcctccgggctcacgcttgcgcccggctttatagacgcgcacagccatcaggacgttatagttgaagaataccccgaatgcatctgcgccgtggagcagggcataaccacgcagataaccggcatgtgcggcgactccgccgcccccgtttcgccgcggcatgtaggcgacgcccttcgcataataagctccctcaagggcggcgcgctgccgtcccccgttgaaaaccgcttcacgttcggcggctatcttgaccatattgataagccgctcggcacaaacatggcgttccttgttggccacggcatgattcgcgcggcggtaatgggctttgaaaaccgcaagcccacggcatatgagacagagcagatgaaggcccttgttcagcaggccatggacggcggcgcgttcggcatatcgttcgggcttatatatccgccgggatcgtattgcgatgcggaagaaatgagcgagctttgcaaggtggttgcgcaaaacggcggcgttatgaccgtgcatgtgcgctcggaaagcagcgggcttatagaagcggtggaagaaatgctcggcgttgtgcgcgcaagcggagtgcgctgcgtaatatcgcaccacaaggcgaccggcggcagcgcaaactggggcaaaaccgccaaaacgcttgaactgatacaaaaaataaacgccgaaggctacgacgtttttacggatcaatatccatacaccgcctccgccaccggcctttccacaaacattcccgacgatatgttcacgctcggcacggataagcttatcgccatgctgtcctccgcgcaggggcgaaacgagctgcgtccgcttatactcggcgcgttaacgcccaaggagcgctttaagtacaccatgataggctcttcccccgcgcatcccgaatacaacggcagaatgctcaacgacatagcggatgagctaaacattgatccatacgagctgcaatgcgatattctgcgcgacgataagctgctcaccggcggcatataccataccatgagcgaggacgatctgaggcgcgttatgcaataccgccgcactatggtgggcacggacggcatgtggtaccccggctgcggcggctgccacccgcgttcgataggcacgttcccgcgcgtgctcggccgctacgttcgcgaaaagcagtatatcaccctgccggaagccatacggcgcatgacctcactgcccgcgcaggtgtatgggcttaaagacaaggggcttatagtaaagggctatgatgcggacatggtgcttttcgacgcggacaagattatagaccgtgcagattacggcgcattccgcacccgctgcgaagggcttaattacgttatagtcggcggaaaaacagcggcggaaaacgccgtattcaccggcgctaaagccgggcggataatacggcggccgtaa

SEQ ID NO: 479 - DNA, 855 bp, Clostridium sp.
atgagcgacaaaaaaggaactaaggacatgaaaagagttttgggctgcatccgccgcgcggacgaaagatacaatatgatacgcgaaggagataaaatatgtgttggcgtatcaggcggaaaagacagtcttctgctgctgtatggattaaagctgtatcagcggttttgttacaggcattttgacgtatgcggcgtgatgctcgatcttgggctgacgaaccaggatcttgcaccggtggaggaatttgcgcgcagcatagacgtgccttttgacattatcaaaaccgacataggcgatgttgtgttcaacatccgcaaggaaagccacccctgcgccctttgcgcaaagcttaggcgtggcgcactgaacgacgccgccaaggaacgcggctgcaatcttgtagcccttggccacaaccgagacgatgttatagaaaccttcttcatgagccttctttacgaaagcaggctgaatactttcggcccggtaacataccttggccgcaaggacgttaccgttatccgcccgatggtattcctgccggaaaagcaggcgctcagcatcgccacgcggctggagctgccaatacgcaagccaaactgccccgccgcaggccacaccaagcgcgaggaaatgaagcaggtgatgcgcttctttaccggccttataccggacgcagaggagcgcataatgaacgcaattgcagacacggaaaaatacggcatgtgggacaatcttcgcctgccgccgcgcgacgtgcttgatattgtttcctccccgaaggcgccgcgcttttgccgcgagtgtccaaacaacgcaaataaatcagacgataacggcgaggatgaataa

SEQ ID NO: 480 - DNA, 1125 bp, Clostridium sp.
atgtccaaatacgttctggttccggattcattcaaaggaaccatgacatcgcgcgaaatatgcgaaattatgcagcacgcaatagaaagaatagacagcgatgcaaaaatcatatccgttcccgttgcggacggcggagaaggcagcgtggatgcgtttctttccgcgctcggcggcaagcgaaaggcgattaccgtgaccggcccgcattttgaaaagcttagcagttcatatggcataacggatgacggtacagctgtaatagaaatgtcagcatgtgcggggcttccgctggtatacggcaaaaagaatccggagctcacaacgacctatggcgttggcgagctgatatgcaacgccgcccgctccggcgcaaagcgcatagtaatcggccttggcggcagcgcaaccaacgacggcggctgcggcgcggctgctgcggcaggcattaaattttatgataaatcaggcaaaagctttatacccgtaggcaaaacgcttaaagatatagcaagcattgattacagcgggcttgattcggcgcttagcggtgtgagtatatccgccatgtgcgacgttgacaatcctctgcttggtgaaacgggtgccgcgaacgtattcggcccgcagaagggcgcaaatgtggccatgatagcgcggctcgacgctggattaaagcaccttgccgaagtatccggcaaagcgaagcttgcgtcgatgccttccgccggtgcagcgggcggcatgggcttcggcatgatggcttttttcaactgcccgctgcaaatgggcatagacggcctgcttgacattatagattttgaatcaatactcgcaggcgcggaccttgtactgacgggagaagggcgcatagacccgcaaagcatgcgcggaaaaactgttataggcgttgcgcggagggcaagcaaatgcggcgtacccacaatagccgttgttggggacattgcggatggtatagaaagcgcatacgaccttggcgtcagcgcaatattcagcataaaccgtgtggccatggaacgaaaacttataaagcttcgcgcaaagtcagacatggaagccaccgtggaaaacattatccgcgcggtaaaggccgtgaagctctga

SEQ ID NO: 481 - DNA, 747 bp, Clostridium sp.
aagggaggagcaacaatgaaatatgctgcaaagaccattaccggtataagaaagcaaaatcaggacgccgtttttatacccgaaaggggcatgatagccatcgctgccgttgcggacggaatgggcggccataacgcgggcgatattgcaagcgcgcttgcaataaaaacgctggtggagaatatgcataaaaacgcgcccggaactattcgggagcggcttataaacgcggtgaacatggccaattcagccgtgtatgaactatccttcagcgatgaaggataccgcggcatgggcacaacgcttgtggctgcggtgctggaagaaaagcgttttatcgcggcaaatgttggcgacagtaggctctatcattatgatgggctgcatcttaagcaaataactgaagatcattcgtatgttgcccagcttgcggcgcttggctatatcacgcgggaggaagccgcgcgccatcctcagcgcaatattataacccgcgctgtaggcacacgtccaattgagcgggtggatgtgtttgaatgcgcatgggaaaagggagataagctgctcatatgcacggatgggctttacggtgaactgagtgaagatgaactggcggacgcactcggccggtcggctgaagaattgcaaacagcgtgcgatgcgcttgtcgaacgcgcgctgaaagccggcagtcgggacaatataagcgccgtaataatatataacgatggggagaatgccgaatga

SEQ ID NO: 482 - DNA, 1218 bp, Clostridium sp.
atggacagatttgtaaaccaattttccgaaataggcaagcttaacgccgttatgctgcaccgtccgggcgacgaactgaaccaggtcacgccggatttttttgacgatatgctgatagacgatacgctctatcttcccgcggcgcagcgggatcacgaccgctttgccgaaatcttacgcgaaaacggcgcagccgtatattatcttaaagaccttttctgcgaagttattgcgaacgataaattaaggcttcaatatatagaggatttcttaacccaaagccccatccccggagacgccgtgcgcgatgccatacgcgcctatcttttgcccaaatctccaagcgacttgttcgatgccgtggcccgcggcatacgcccgcgcgaccttgccgccattccaggcaaccgcatagcgcttgacgttaccaatgtttatccgtttatactcgacccaatgccgaatatttacttcacgcgggatacgtccatgtgcattggcggcggcatggtaataagcagcatgagcatgccctcccgcagccgtgaaacgctgtttacccgctatatacacgactatcatcccctgttcaccgcttctcccgtgccgctgtggtatgataatgagcagcggtataatatggaaggcggggacgtgcttattctttccgataagctgcttgcaatcggctgtggagagcgcacgaacattgccgcggtggaaatgcttgccaaccgcgtttttgcggaagggtttgagcgcatattggttttcaacaatccccgctcgcgcaagtttatgcaccttgacgtgctgtgcacaatggtggattacgataagttcataacccacccctgcatatatgaaaagcagtttgacgtatatgagcttaccggcaagcccgggaagctttccatttcctgcactaccgatccggtgaataaaatatttgcccgctgccttggcctgcccgcggtaaagttcattgaaatgggcgggggcgatccaataattgccgcgcgggagcattggaacatgggctcgaattcgctcacgctgtccccgggcaacattgccgtatatgaccgtaacgaggttactaacgagcttctcattaaggccggcataaagctgaatctcgtccccgcgggcgagcttgtgcgcgggcgcggcggcccccggtgcatgagcatgcccataaaccgcagtgcaatataa

SEQ ID NO: 483 - DNA, 1767 bp, Clostridium sp.
atgaatataaaaagaacaattgcggtggtgataatgctaagcatattgcttacggccctgccaacacttgccgccggcaaggtggagctgagctttgattgcgacccgtctaccgcaagcatagaggtcataggcggcaaggcataccttggtaactacaccgtacccggagacggcacatatccgtttacggctacggcagacggatatatggattacaacggctcatttgacgtggtggacggcaaagtatacttcaacggcgctgagtgcggcggcaataagatacatattgttatgagcaagcagctttatcctgtgctcataaccaagaatccgcagaatatgacgcttaatgttaccgactcgctcggcaatccggtaagcgacacagccaacctgcccgcgggaacgtatctttatactgcatttgcagatgggtacgaaagtgcggcaggcaagtttgccgttgaaaatgcccctgcggtggtgaacataacgctcaaagcaatagctaaaaccatgccgactacaagcggcataggcgcgcttgcgctgctgccggcaaacattgccggggaatattacagcgcgcccacgggaagcccgggagaactggttagcctgtatcttcccgttataaataacggagaaccgcttactgacataacaatagagcccataatatcgaataacgttgaggaattcccgtttgctgcggatgcagcaaattatgggctgaggctgccggatcttgataccggggcatgggctgtggcccaatatatgctgaaaatatcgccttacgccacaaatggtgtaaagactgtgcagttccgcgccatataccgcgagaacggcgtgcttagggacagcacgctgagcgcgagcgtgacaatagtgaatggctatgaagcgccgcaggaaacgctgcataccgcgccaaagctgatggtgagcggctatgccgtgaatcttgacaccatttatgcaggcgatgatttcacgcttacggtgtttgtaaagaacacatcggcctcggcttccgccgtaaacattacgggtgcgcttacgcttgatccgtccgcgcttatggcggcgcttggcaggagtgataccggctatgcggccaagatagcgcccggcgatactgcggaaatagtttatgaccttaccgcaatgcctgatatccagggcaatgctcaaatagccataaagcttgaatacgaggataaagaaaacaccgccgcaaacgttacgcagaccataacgctgcccataaagcaaaggatgcgcataagcgtggatcagccggaaatattcgcggaaggcgcagcggagggggattacatcgccgtgtcgctgccgatagtgaacaagggcaaaacgaaggcatacaacgttgaagtaaagcttgagagcgaaaagctgagcatgagcgaaagctattacggcggcgatatactgccgggtgctaagcaaagcgcagagtttcagctgctttgccttaagggcggtgcagcggacggaacgctgacggtaagctttgaagatgccgaaggcaatgtatatgaacagagcgtgcctatacgggttgatattgccgaaagcataagcgcaccggctgcggcggatacggaagccgaacaaccgcaggagaagcccgaagcattcccaatatggatagctgcggcgggcgcggcggcggtaatcgcggtggcggcagcgctgataataaaaaaggggcgtagcaatgcggccaagtga

SEQ ID NO: 484 - DNA, 1089 bp, Clostridium sp.
atggcagataagaagaaaaaactccttttcaacaggcagatgcgccgcatagacgaactggataagcacatacaggaaggccttgcgctggagcaggcggataaagagctgcctatgtatgatgcggcggattataccgcagagcagatagccgcaatagaccccaaatggtttgaactgcatggctttaacgagcaggatgccgagcgcacggcatattcaaactattcatactgggcaagtacgttcaaaaacttttggcgcaatagggctgcacgcatactgatagttacgctgatagcgataattgccttcgctttcattcagccgctgctgcccaatcagcatgaccccgttacaataaacaatgaccccgagaccggcatgcaccttcgcaaccttgcgccgtgtagcgaatactggttcggaacaaacgcaataggccaggacctttgggcaagggtatgggccggcacgcgcacgtccataataatcggccttgtggtcgcgctgagcgatcttatatttggcgttataataggcatggcatggggttacgtaaggagtcttgataaagcgctgacggagatatataatgtaataagtaatatcccgcaaacgcttatattgatccttgtaagctacatactgcgcccgagcatgaccaccataatcatatccatgtgcatggttggttggatggccatggctcgctttatccgcaatcaggtcgttatattccgcgacagggactataatctggcatctcgctgccttggcagcagcacgctgaggatagttataaagaacctgctgccgcagatggtttcggtaattatgctgcaaacttcgcttgcaattcccggcgccataggcgacgaggtattccttacctatattggtcttggtatacccacatcccaagcttcgctgggcaatctggttgaagccggccgcgtactgatgatggacagcacgttgagatatcagcttgtgttcccggcagccgttgtggcgtttataactattgcgttctatatcatcggcaatgcgttcagcgatgcggccgatcctaagaatcacgtttaa

SEQ ID NO: 485 - DNA, 1038 bp, Clostridium sp.
gtggctccctttgaccttgcttcattgagcaaggaaaaggaagagctggaggccgaaatgggcaaggaaggcttctggaacgatgttgagaacgcgaacaaggtgaaccgccgcatgaaggccataagctccaagctggacaaataccagcaccttatgagccgctgcgaggaccttgaaacgctgattgaaatggcggacgaggaaaacgacgaaagccttgtgccggaggtacagagcgagtttgcctcgcttgaaaaggacatagaggcgctgaagcttgaggcgctgctgaagggcccatatgacagctataatgccgtgctgagcctgcatgcgggcgctggcggaaccgaggcgcaggactgggtaagcctgctttaccgcatgtatacccgttactgcgaaaagatgggctattccgtaaaggtgatagactatctggacggcgaagaggccggcataaagagcgttacgttcgaagtggacggcgacaatgcctacggctaccttaaggccgaaaagggcgtgcatcgtttggtaaggatatcgcccttcgattcttccggcaggcggcataccagcttcgcttcccttgacgttactcctatattcgacgacgatacaaacgacgttgagatagacatggacgatctgcgcatagacacataccgttccggcggcgcaggcggccagaacgttaataaggtaagctctgccatccgcataacccatcttcccaccggaatagtggtgcagtgccaaaatgaacgcagccagcttcagaataaggaaatggcaatgcgcatactgaaaggcaagcttatggagctggcggagcaggagcgcatggcccagatgaacgaaataaagggcgaaatgaagcgcatagaatggggcagccagatacgttcctatgtattccagccgtatacgctggtaaaggaccaccgcaccggcgaggaaaacggcaacattcaggccgttatggatggcgacatagagaactttataaacgcctaccttgcaaaatcctga

SEQ ID NO: 486 - DNA, 1674 bp, Clostridium sp.
atgggtatacttcagtttgaaagcgtaaactgcaaggattgctgcaaatgcataggcgtatgccccgttaaggcgatagaggtcaaaaaccaccgcgccatgatagttgagcgggactgcatactgtgcggaaactgcacgatagcctgcccgcagcatacaaagcacggcactgatgaatctgcctccgtaaaggaacttatacgctccggcaggaaggtgattgcaagcgttgcgccaagctatgcggcgtattttgacggctgcggctttgaagcgctgcgcaccgcgctgaaggcattaggcttttatgatgcgcgggaaacagccgagggcgcatatatagtaaaaagcgaatacgaaaagcttattgctaacggcataaaaaagccggtaatatcatcctgctgcacaacgctgaacctttatattcagaagcattatccggacgcgatagagctgctggcccccgtgcttacgcccatgcaggcgcatgcgagggtgatacaccgcgatgaacctggcgcggcggtggttttcatagggccctgcatatccaaaaaggccgagtgcgagcaggaagagagcgaactcgaatacgcaataacgttcgatgaattggacgactggcttggcgaagcgaagataaccattatgcccgcagcggagagcgagcagcggctttcgcgctttttccccgtatccggcggcatactgaaaacaatgacgcagcagagcggcgtgaactacgttgccgtggacgggccggaaggctgcatggctgccgttaaggacgcgatggcgggcaagcttgacggctgctttatagagatgagcttctgccagggctcctgcataggcgggccggttttccgcaacgttaaccgctccgctgcggcaagctacgttaaagtggcgcatgacgccgcaggagaggcggactttgacattgcgcccgcgccggacatggaggcgcactttaagaacagccgcacatattatatgcagcccacagaaaagcagatagccgccgtgttcaaaaaaatgggcaaggaagggccggaggatgagctgaactgcggcatgtgcggctacgcatcctgccgcgataaggccattgccgtaataatgggtcgcgcggaaataaccatgtgcatgccgtatatgaaaaagcgcgcggagtcattctcggacaaaatactcagtattactccggacgctatactggccgtggacatggatcttcgcgtgcagcagataaacaacgccgcgtgcgaaatgttcggcgtgcagccaagcgatatagtgggccaaagcgtgagcgcgctggtggacgagttcgactttgttgaccttatttcaagcggggaagccgcaaaggaaaagttcacgtatttggcggaatataacctttatctcaagcagtcgctttattacgacgcttcaagcggcatagttatatgcataatgaagaacataacccgcgaaaagcagcggcagaacatggtaatgcggcacaaaacgcaggttgccggcatggcggacgacattgtggataagcagcttaggatagtgcacgaaatagcgtccctccttggcgaatcggccgcggaaacaaaggttgccatatccaggctgaaggaagccgttatgatggagaacgaggagcagtaa

SEQ ID NO: 487 - DNA, 1104 bp, Clostridium sp.
atgaagatgagtgctaacaagagcaaagcggagcggaccgtggcgaaaggaggcggtgaacaaatggagcttgacgcaagaaagatgcgcattcttcaggcgataatagacgattatattctcaccgcgtcgcccgtaggttctcgtaccattgcaaaaagcacggacatcggcctttcaagcgcaacgatacgcaacgaaatgagcgatttggaggagatgggcttccttgagcagccgcatacctccgcgggaaggataccttccgataaggcgtacagactgtatgtggacagcataatgcgccgttcccagctgagccgggatgaattgagctttatcagcgaacactattcaaaaaagcttggcgaagtggatgacattgtgaagcaaacagccttcgtgctttccagcgtaacgcgctatgcatccatggtgctttcaccgcggctgcatacggcaaggctgaggtacatacacttggtcggccttggcgaagggaaggcgctgctgcttatcgttaccgattccggtcttacgcgggattcactgatacggatcccttacggaatggagcagagtgagcttgagcgtatatcgcttatgctaaacgctaagctttccgattgcaggctggatgatataatggcaagccgcatggatgatattgccggggagttgggcgagcatgctcggttcctcaactcgataataaaatcgcttggcgaaagccttgagcagaaagcgaagcgggttgaattgagcggagcgatgaatctgctcagtttgccggaatacagcgacgtggatcgcgcaagagatatactgagcgttatggaaaaaggcgatgcgctttacgaaatgctcaaagggcgcgaggacgttgaatttaccattaagattgggcatgaaaacgaacttagcagcatgaaggactgcagcattgttaccgcaacgtataaaataggttcggagccgataggcacgttcggcgtgatagggccgacgagaatgaactatcctaaggtgctggccgttatgggtcacatcggaagaacattgagcgaaacgcttacaaatatgcttgatgaggagcgtaaatag

SEQ ID NO: 488 - DNA, 1518 bp, Clostridium sp.
atcatggcatattattttgattcaccctcccatactttcagcgagtatttgctggttccgggctattccggcgccgaatgcacgcccgcgaatacctcgcttaaaaccccaatcgtgcgctataaggcgggcgaggaacctgcgctatcaatgaatataccgctggtcagcgctgttatgcagtccgtatccggcgataagctggccgttgcgcttgcgcgcgaaggcggcatatccttcatattcgtatcccagcctatagaaagtcaggcggctatggtaagccgggtcaaaaagtataaggcgggttttgccatgagcgattcttctatccggcccgatcagaccatggcggacatacttgcccttaaggagcgcacgggtcattccaccgttgccgtaacggacgatggttcggcaaccggcaagctgctcggcgttgttaccagccgcgattatcgccccagccgtatggaccctgcaacgaaagtgagtgagttcatgacgccgatagacagacttgtttttgcatacgaaggcgtatcactcaaggaagcaaacgacataatttgggagcataagctcaactccctgcctgttataacaaaggaaggcaacatggttgcattcgtgttcagaaaggactacgatgcgcataaggaaaacccgacagagctgcttgataagcaaaagcgctatgttgttggcgcgggcataaacacgcgcgattatgaggagcgcgtacccgcgttggtcgaagcgggcgcggacatactctgcatagattcttccgaaggcttcagcgaatggcagacgagaacgctgaactttatacgggctaaatatggcgacagcgtaaaggttggcgcaggcaacgtggttgaccgcgaaggcttccgcttcctggccgatgccggcgcggactttgtaaaggttggtataggcggcggatcgatatgtataacaagggaaaccaagggcattggccgcggccaggcgaccgccgtgcaggaagttgcccgcgcgcgcgatgaatactttcttgaaaagggcatatatgtgccaatatgcgccgacggcggcattgtgcatgattatcatatcacgcttgcgctggccatgggcgcggacttctgcatgctgggccgctatttcgcccgctgcgatgaaagcccatccgccaaggttatgataaacggcaattacatgaaggaatactggggcgaaggttccgcacgcgctcgtaactggcagcggtattacagcggcggggataataagctttcatttgaagaaggcgtggactcatatgttccctatgcgggcagtctgcataacaacgttaccgtaacgctcagtaaggtgcgttcaacaatgtgcaactgcggcgcgttgaccatacccgaactgcgcgaaaaggcgcggctcacgctcgtttccgcagccagcataaccgaaggcggcgcgcacgacgttatgctcaaggatgccaacacatacgccgtaaaaagggactga

SEQ ID NO: 489 - DNA, 579 bp, Clostridium sp.
atgaacgtacttcaggagcgcatcaagaaagagggcaaagtcctgcccggcaacattattaaggtcgacggatttttgaaccaccgcgtggacgttaagcttatgcgggagatggcaaaggaattcggtcggctttttgatttgaccggcatcaccgccgtgcttacggtagaggccagcggaatagcgcttgccaccatctgtgccgaggaattcggcgtgcccatgattttcgccaaaaaggccaagagcgacaatatcgaaggcggcctgtacaaaagcgagatattctcctatacatataaaaagaaagtaacgctgctgatgagcaagcagtggctcggccccaacgataaggtactcattatagacgatttccttgccaacggcgaagcgctgcatggcttggtggatataatagagcaggccggcgcgcagctgataggcatgggcgttgcggttgaaaagggcttccagcccggcggcgcgcgcctgaggagcgagggcgtgaacctgcattcccttgcaataatcgaaaaggccgacgaaaacggcatagtattccgtaacgaggagtaa

SEQ ID NO: 490 - DNA, 951 bp, Clostridium sp.
atgagaggacctaagctttttgaaggggcgcgcgttgcgctcatagcgccgtcaagtccggttaacggtgatgttgaagctaaactcgaccgtgccgtaaaaactgcggagaagctgaaccttatacccgtgctgtatccaaccgcccgcgcgagccacggctaccttgccggtaccgatgaaatgcgcgcaaaggatataaacgatgcctttgccgataaggatatagacggcatatggtgcctgcgcggcggctacggcgcgcataggatactgcccctgctcgactataccaccatacgcgaaaacgccaagttcttcggcggatacagcgacattaccgctttccatatcgcgttccgccagcagtgcggctttggcacatatcatatgaccatgcccaccagcgataatcttatcgatggcagcgaatacagctataaatacgcaaaggccatgatattcggcgaggatataacctatgaaaaccctgccgatatgccaataaagacccttgtcggcggcaaggccgaaggcgaactctgcggcggcaatctttcgctggttgtggcaagtctcggcacaccgtgggaaatagatacgcgcggcaagataatattccttgaggatgttgacgagcagccgtacagcatagaccgcatgtttacccagcttaggaacgccggcaagcttgacgactgcgcgggcataatacttggccagtataccgattgcgaagccaaaaagcccgaaaattcgctcactcttgaaaccgtgtttgaggaactggtaaagcccagcggcaagccctgcataaccaactttatgtgcggccactgctcccccaccatgagcctgcccttcggcgcaaggttcgcgctggatgctgacgcatgcacggtgatagaaaataatgtaaaagaatatatgcaatccgttaagattgcataa

SEQ ID NO: 491 - DNA, 1008 bp, Clostridium sp.
gcagcaacaaaaagaataagggaggcgtataacatggaccagttgcttaaaacgctcggcattgtgcttaatgccacgcttatgtatactcccccgctgctgtttgcggcgctcggctcctgctgctccgaaaaatccggcgttataaacatcggtatagagggcatgatgacaataggcgccttcaccggcgctgccgtgggctatttttccggcgatccttggctggcgttcctttgcgcgggccttgcgggcatggtttttgcgctgatacacggctttgcctgcataacctgcaaggcggaccaaaccatatccggcacggcaataaacttccttgccagcggcattgccgtttacgtttgccgcctgctctttgcaggcaatacggaaacgcacccagtgcccaataagctcccccgcatattcaacggcctttttgaatggtgcaacgccaaccttggcggcaaatggggcgaagcgtttgcaaagaacggcttccttgacaacgtgttcaacacatacgcttccgcgtatatagcgttcatactggtgcttgtgatatggttcgtgttctataaaacgcgcttcgggctcaggcttcgcgccgtgggtgagcatccgcaggcggcggatacgctgggcgtaaacgtttccctcgtgcgctatatctgcgttgcgctttccggcttccttgcgggccttggcggggcgagcataacgcttgcaacggtttccgtgtatcgcccgtccatagttataggccagggcttcatagccattgccgcggtaatattcggcaagttcaagccgcagggcgcgatgctcggctgcatactgttcggcttctgcaacgggctgaaggtagtcgtcggctccagcggctccatacccgtaaacataatttcaatgataccgtatgtggtcactatagtcgcgctcatactcttcgttggcaaggcgcatgttcccgccgcgaacggcaagccgtatattaaatcaaaataa

SEQ ID NO: 492 - DNA, 1470 bp, Clostridium sp.
atgaactacgacctgaaggcgctggacaaggcgcttgacgcaaggataaaggagaagaagctgcccggcgtgagctgcgcgatatacggccccgacggcgttatattcgaaaaaggctacggcttcggcaacaatgaacacaccaagctgattgacgaaaacaccattttcggcatagccagcatgagcaagtccacctccactttggcgcttgcaatactggaagccgaaggcaagttcagctatgacgatcccgtgaccaagtacattccctccttccgcatacccggcaaccccacggacacggtgctggtaaggcaccttgccatgcacaccgccggcataccgcccatggagccgctggaatggtccatcgccatgaacagcaccgatcgtttctccgatgcgagcgaggagaccgttggtaaggacgtatactccgccgcggatgaaagcgacagctgggcgctgcagatgcgccgcacgtcccccaaccagatggacaaaattgagcaggttatagattacattgccaactgcaagtataagacccttggcgcggcgggcgaatacatgagctattccaacgaaggctacgccgttatatcctatatagttgacgcggcagcgggcatgccgcttgagcagttccttaacgagcgcgtgttcgggcccataggcatgaccaggaccgtgcttgacatagacggctccgaagccaggaagatagcttccgacggcaatatcaccagcctttttgaagaagtaaacggccagagcgttgcggacgactgctggagcatactgcccccgttccgcgcatgcgcctgcgtaaagagcaccgcgcacgacatggcgcgctactatagctgccttggcaacggcggcgtgatagacggcgtgcaggccatccccgcgaaggcggttgaaataatggtaggcaaccgcttcggcgaagaagagaagcccatctattgctacggcctttacaagcgcaccaagaacggccatgttatatgcgaacactctggcggactgcacggcgtatctacccacggcggcttcctcaagggcgagggctacggctttgccgcgctgtgcaaccagggcgactgcgacacggaagacctgtgctggatgatgtacaacatgatgatgggcgatcccatagagaacagccaccgctggctgcatcccgtaggatatgacttcggcgcacccgagaccatagtcggttcctatatctgccacgaaggtattccttccacgctgaaggtatatataaacgacgagggcaagctgataggcgagactgccatgggcccgatggacatggtatactgcggcgagacctggttccagggcttccgcaacggcgatgttgccaaccgtatgcgcttctatatccgcgacaacaaggcctggtccgtaatggttggcagccgcgtatgggagcgcatagaggactaa

SEQ ID NO: 493 - DNA, 972 bp, Clostridium sp.
atgaccaaaatgcgttttatagacctgcactgcgataccgtagtatgcgaggtcatggggaacgaggacagcaaaaacctgcgctccaaccccaccggcatgcttgacctgcttcgtatgaaggaggcgggctgcctgctgcaatgctttgcgctgtatatcccgcccatgaagcgaatagcaagcaccaccggcgaagccgacgagtgggatttcttcaacgatgcagccgattgctacgaccgtcagatagccgccaacacggaccttatccgccccgtcggtaaatatgcggacattgaaaagaacatggcggacggcataatgtcctccatgatgacgattgaaaacggcgaaccgcttaacggcaaaatagagcggctggacgaaatgtaccgccgcggcgtaaggcttataacccttacccataatcaggaaaacacgctcggctaccccaactgccttgagcccgatgcggggcttaagcccttcggcatagaggccgtaaggcgcatgaacgagcttggcattataatagacaccgcgcatctcagcgacggcggcttctgggatgttgtaaagcattcctcaaagcccttcgtcgcctcccattccaacgcaagggagctttgccccgttatgcgcaaccttacggacgatatgctgcgcgccgttgcggataagggcggcatggtcggactcaactacgctgccgatttccttgtggacaagacccgctatacctactgcgccgatatagcgcgccatgcgcgttacatggccgataaggcgggcgtggacatagttgcgctcggcagcgattttgacggcataagcagcacgcttgaattcggcggggtagagggccttggcatgatagaggaggcgctgaaccgctgcttcaccgcggacgaggtggataagataacccatcttaacgcgctaagggtaattaaggacaccgttggttaa

SEQ ID NO: 494 - DNA, 1269 bp, Clostridium sp.
aaggagaaacagatggcatccattttggtttccggcggaagaaggatagttggtacggcgcgcgtatcgggcgcgaagaacgcggcgctgcccatattggccgcaacgcttattgcaaggggccctgtggagctgaccgattgcccacatttgagcgatgttgaaaatatgctcaaaatactgcgctcgctgggcgtaagctgctcgcttgaagcaggcacggcgcatatagacgcggcaaaggccgagcgctgcataatgccgcagagcatcagcaaggagataagatcgagtatattcatgctggggccgctgctggggcgcttcgggcgggcggtatgcacattccccggcggatgcgaaataggccacaggccgatagatctgcacctgaaggggcttatgatgctgggcgcggacgtgcgcgaggagcgcgggctgataatatgcgaaggcaggcggcttaagggcgcggacatacatttggattacccaagcgtgggcgcaacggaaaacattatgatggccgcagcgtgcgcggagggaacaacaaccgtgttcaatgcggcgagagagcccgaaatagacgacctggcgcggtttttgaacaagcttggatacgaggttgaaggcgcgggcagctcgaccataacaatccgcggcggcgatgcagcggagaaaaaaacaacgcaccgtataataccggacagaatagttgcaggcacgcttatgactgccgcggcgataaccggcggagagcttacgctgacaaacgttaatacggagcatataggcagcattgcggcaaagctgaaggaagcgggctccgtaataactgcgggcgaggggatgctgcacataagctcgcctgacagaccaaacgaaatacgccttacggaaaccatgccgtacccgggcttcccaacggatatgcaggcgcagctttttgcgctgtgtaccattgccattggaacgagcataatcgttgaaaacgtgtttgaaaacagctaccgccacgcggcggagctggggcgcatgggtgcaagctttacacaaaaggacagaacggcgataatacgcggcgttgataagctgacgggcgcaagggtgaaggcatgggatctgcgcgggggcgcggcaatgctgcttgcgggccttgcagcggaaggcgaaacgataatagaccacgcggaattgatagaccgcgggtatgacaagctgcatgaaacgctcaatgcactgggcgcacaaataatacgaaaggaaaac

SEQ ID NO: 495 - DNA, 1002 bp, Clostridium sp.
atgaaatttgttttatatccgcatatttccccttaccaccgcgatacatattgcaatttagcattccctgcctttataataaaagcagcaaaagcggcatataaacgcacaaaaggagcacacatgctaaacggtaaaaacatagataaatggaacgatatgaagtttgggctggtattgtccggcgggggcgcgaagggcgcgtatgaagcgggcgctataaaggccatgggcgaaatggacgttatagagaaggtgtacggcgtgagcggcacgagcgtgggcgcgctgaacacgcttgtgttcgcaatggacgacgttgcgctgatggaggaactttgggagaacatcgggcttatgaccgttgccgcgccaaaggttgcggacggcgacagccgcgccataaaggacattgttggcaagctgcacattaccgcgcagatgcagggcagcggggataccgccgttttcacgcagaattcgctgcgggaattgataaataaaagctgcgactttgaaaagatacgcgcgcacagggcaaagcttttcgcctgcgcgtatgacataaacgagcgccacgttaaatattttgagctgaaaaagctcagcgacgaggaaatgacggacgccgtgcttgccagcgccgccataccccacgtttacgaccccgttgaaatagaaggccataagtttgccgacggcggaataaacgatccttcctacggcgttaaaaacagcgacgttacgcccctttctcccctgcaggatgaaggctacgacgcgataatagtcattcacctgagggagcaggaaacgctggacatcgaccacatcggctcaacgcggctcatacacatttatccttcaaagccgctggagcagataaagggcagcggcacaatgaactttacccgctccgccatacgcgaacgctttgccatgggctatgccgatatgtacatcgccttgggcaagcttcttatgagcattataaaagagtaa

SEQ ID NO: 496 - DNA, 489 bp, Clostridium sp.
ttggaggcagaagctatggaggcagaagctatggaaatagattcccttgaaataagaaaagtcgataaggatacggagcttgcggaaaagctgctggacttcgttgaaaacttttcgtgggaagaagtaaaagaacacaccgtaatgatgataaaaaactggagatttacggactgggagactatgtttgccgcaatagcggacggcacaatcgttggcatggcatcgtttatgaaaacggactattatccgctgccgaaaatatacccgtggatatcgaccatatttgtttccgaagaataccgcgggcacagaataagccaaaggctgatagactttgccaatgattatgccaaggcgtgcggctttgacgtgacatatataccttccgagcatgttgggctttatgaaaagtttggctatagctacgttaaggacattgtaaactacggaaacggagcggacaggctgtattttaagcgaatataa

SEQ ID NO: 497 - DNA, 891 bp, Clostridium sp.
atggatttcaaaccgatagatatatcgatgaagcaaatggttgagcattacacggcaaaatggaagctggaatgctcggaatacaccttttcaaatctgctcatgtggggctgcggcgggaacataatgcttgcggaggatgagcaggcgctctatatactgctgcattggggcaatgaacgcttcatgttcgccccgcttacggttgagcccgagtctgagtattatcaaaccgcgctcgataaggcggaggaatacatgagcacgcacggcatagatcctatcttcaagggcatatccggccccataaaggccgcgtttgagcgctgcacaggctatgaactgatagatgaccgcaacaacagcgactatgtttacacaatggaaagccttagagacttagccggcaaaaagctgcacgccaagcgcaaccatatacaccagttcatggcgcagtacggcgaacggtacgaatacgttaaaataaccagcgatatgatgggcgaatgcgttgacgtatacaatgaatggctcagcgaaaaatctcccgacgaaacggacaatatggagctgtgcgcaattaaaacgctgctcatgcacatggacgtgctgggcatacgcggcggcggcataaggatagacggcaagcttgcggcgtttacgctggggcagaagatggacgataacatggccgttgtgcacattgaaaaggccgataacgagataatgggcctttacacggtcataaacaatcaatttgtgcagcatgaattgacggacgttaagttcataaaccgcgaggaggacatgggcatggaagggcttaggaaggccaagctatcctattatccggcatatatgatagataagttcgacgggagacccatttga

SEQ ID NO: 498 - DNA, 1302 bp, Clostridium sp.
atggctaaggaaacaaacgctgccctgcaaaagcaggtgatatattccgtttatgtgcgcaaccatacgccggaaggcacctttgccgccgtgacgggcgaccttgaccgcatacgcgcgctgggcacggacataatatggttcatgcccattcatcccatcggcgtgctgggcaagaagggtacgctcggctgcccgtatgcgaaccgcgattacagaagcgttaatcccgaatacggcactctggaagattttaaggcgcttgtgggcgaaatacacgcgcgcggcatgaaatgcatgatagacgttgtatataaccatacctcgcccgattccgtgctttataatgagcatccggagttcttttactataatgccgcgggcaagccgggcaacaagatgggcgactgggcggacgttatagatttggattacaataaccgcgccctttggcaataccttacggatacgctcgttatgtgggcaaagattgtggacggcttccgctgcgacgtggcgtcattcgtgccggtggagttctggcggcaggcacgcaacgctgtggctaaggtcaatccggactgcatatggcttgcggagacggtgcatttaagctacggctgcttggcccgcaggcagggcatatattcagcgcttgattacgacgcttattccgcgttcgatatggaatacgaatacgacgtgcgcgaggtttttgataaatatctgcgcaatgaggctgccctgagccattatacggacatgctcaactttcaggagggctgctacccggccaactacaataagctgcgcttccttgaaaaccacgaccagccgcgcatatgctccttcgtgcgcgatgaacgcgcgcttatcaattacaccgccatgctctatttcataaagggtacaactctcatatacgccggtcaggagtttgaaaacgaccatctgcccagcctttttgacatagataaaatggaccgccataccgggcgcgacataagcggccttatgcgcacgctttacggcataaagcagcgcttcggcgaagcggactggtttaccgcagcagcggatgatacaaacgacattgccgttatgcagcgcggaagccaaggcaagcggttcgtgggcatattctcgctgaaggctaaaggggcggacgtaagcatagccgtgccggacggcgaatacgaaaacctgatagactcctctaccgttaccgtaagcggcggcatgctgcattgcggcggcaagcccataatattccgggctgagcgaagctataacgcattataa

SEQ ID NO: 499 - DNA, 810 bp, Clostridium sp.
atgcccgcaaataacaagatacgctccgcgtatgtgacgctgccttcggcggagcgtaaggttgcagactttatcctggacaatcctgaccgcgccatgcgcatggtcatcaacgaaatagccgaggctgccggcgtaagcgtgccaagcgttacccgccttgcgaggaggcttggatacaagggcttccttgatttccgcgtggcgctggcgggcggagcggccgcaaacggcgcaacgcagaagctttcccccgtgagcgacgaggacagcgactccaccgttatagacaagctgtgcggatacagcataatgtcgcttgaggatacatatcatgcgctggataaggatgcgttctgcgccgcggcgcagaatattgccggcaaaaagcgcgtgttcgtctgcggcgaatcggagctgcttgcaaaggacatggtgcacagctttaacatgatgaatatggaagcaattcccctttgcaacgaggtgagtatgggcatataccgcacccgcttcacaaaggacgatgcggttatagccttctgccgcagcggccgcaataaggatatattcgatgaaataatcgccgccaaggccgcgggagcgaccacggtgtacctgagcagctatgccggaaatcaggccgcgcaaacatgcgactatttcttcaccgcatcgcacataggctcggccaaggtgccgttcaggcttgaaaattcaatgtctacaataacgctgagcacgcttttgataacgcttgtggcgcgcttccgcggcatgagcatatcggggagcaaaaatagaaaatga

SEQ ID NO: 500 - DNA, 1257 bp, Clostridium sp.
atgccaaaaagtgacgacaatggaacgatcaaatgctccttctgcggcaaatctcaggacgaggtcagccgtataatagccgggccgggcgtatacatatgctctgactgcatagaactgtgcaaggatattatagacgacgattatcccgaagaacccgaggaactgaaggatctgcccaagcccaaggacatagttgacgtattggatcaatacgtggttggtcaggcggacgcaaagcgcgcacttgccgtggccgtatataatcactataagcgcataaatgcggacgattccaaggacgatgttgaactgcaaaagagcaatattgtcatgcttgggcctacgggcagcggcaaaacactgcttgcggaaacgctggcgcgtgtgctgcaggtgccgtttgccgtggccgacgctacaagccttaccgaggccggctacgttggcgaggatgtggagaatatattgctcaagcttattcaggcggcggactttgacgtttcccgcgctgaaaagggcatagtgtatatcgatgagatagacaaaattgcccgcaagagcgagaatccatccatcacgcgggacgtaagcggggaaggcgttcagcaggcgctgctgaaaataatcgaaggcaccgttgcaagcgtgccgccgcagggcgggcgcaagcatccgcatcaggagtttatacagataaatacgtctaaaatactgtttatctgcggcggtgcgttcgcggggatagaggatatcatttcccgacgcacggcgaagaagctgcttggcttcggcgcggaggtatccagccaaacggagaagaacgtgggcgagatactgaaaaagatactgcccgaggatttgctcaaatatggcctgataccggaattcataggccgcgtgccaataatcgttacgctggagcagttggacgaaaacgcgcttatggacatattgacaaagcctaagaacgcattggcgcggcagtataagcggctgtttgaaatggacggggtggagcttaacttcgacgaggatgcgctgagagaggttgctcacatggcgatagagcgcaaaaccggcgcacgcggattgcgcgccatactggaaaacgccatgatggacataatgtacgacgtaccctcgatgccggatgtaaaaagctgcgaaataacaaagggcgttatagacggcacatccgcgccggtatacggtaggggcaaagcattattgccggaagaaaacgcggtaagctga

SEQ ID NO: 501 - DNA, 1497 bp, Alistipes sp.
atgagcgaaaaagtatatatcttcgacaccaccctccgcgatgcggagcaggttccgggatgccagctcaacaccatagagaagatcgaggtggcgcggcagctcgaaaaattgggtgtggacatcatcgaagcgggctttccgatatcgagtccgggagacttcaactcggtggtcgagatctcgaaggcggtaacgcgccccgtcatctgtgccctcacgcgcgccgtgaagaaggatatcgacgtggcggccaagtcgctggagttcgccaaacgcggccgtatccatacgggtatcggcacctcgacataccacatctacgaaaagctgcgcatgacccccgaaacggtcatcgagcaggccgtcgatgcggtgaagtacgcccgtcgtttcgtcgatgacgtggagttctacgccgaggatgcaggccgcaccgagaacgagtttctggcccgcgtggtggaggccgtaatcgcggccggcgccactgtcgtaaacatacccgacacgacgggttactgtctgccgagcgagtacggcgccaagatcgcctaccttaagaacaacgtccccaatatcgacaaggccgtcatctcgacccactgccacaacgatctgggcatggccacggccaacacgctggctgccgtcgagaacggtgcccgccagatggaggtgacgataaacggtctgggcgagcgtgccggaaatacggccctcgaggaggtcgttatggcaataaagtgccacaagaatctcgacttcgaggtaggtatcgatacgcggcagatcatctctacgagccgtcttgtgtcgaacctcatgcgtatgcccgtacagcccaacaaggccattgtcggccgcaacgcctttgcgcactcgtcgggaatacatcaggacggcgtgctcaagaaccgtgagacgtatgagataatcgaccccgaggatgtcggagtagaccagtcgagcatcgtcctgacggcccgcagcggccgcgcggcactcaagcaccacctcgcagagataggctacacgcccgaaggcgatgagctggacgagatataccagcgttttctggagctggccgacaagaagaagatggtcactacgcgcgatctggaggtactcgtgggtacggccgcctcgcgccgccgcatgagcatacagctcacggggctgcaggtcgtctgcggcaagacgagcataccgaccgctaccgtacagatcagcttcgacggcgacaccttcaccgagactgctaccggaaacggtcccgtcgatgcggccatcaccgccgtcaagaacatcaccaagcgtcgcgtccatatcgaggagtacctcgtgcaggccatcacgcgcggcagcgacgatatgggcaaggtacacatccagatctcgcacaagggcaagatgtatcacggcttcggcgcctcgaccgatatcgtaaccgcatcggtggagtcgttcatagatgcaatttcgaaaatagcataa

SEQ ID NO: 502 - DNA, 1413 bp, Alistipes sp.
atgatctcattgaaaacatacataccatattacaaggagaatctgcggctggccatgcccgtcatactgtcacaggtgggacagatcaccgtgcagcttgccgacacggccatggtaggatggtacggaggcgacgcccccacgccgctggctgccgtatcgttcggcacaagcatattctacatcatattcatctcggccatgggtctggccttcggtctgacgcctcttgtgggtgaacacttcgcacgtggagaccaacgccacgctgcgcacctgcttcagaacggcctcgtactcttcacacttgccggaatcgccacatcggccctactcatcgccgtacggccgctgatgcggtggatgggggccgtgatgataggctcaggcggcgatgcatccgtctccgaagtcatcgaggcggccctaccatattacgatacgctcatctggggtatgatccccgtaatcatcttctgtaccttcaagcagttcctcgagggcataggcaacacccgcattgcaatggtggtgatcatatcgtgcaacctgataaacatattcctaaactgggtcctcatcttcggcaagttcggcatcgaacccatgggtgccgtcggcgccggtgtcgccaccttcgtggcccgatgctgcatgtgtgtcatgatcggcggatatgtcctcctgaatccccgcttcaagagcttcatacacgacttcgaccgtgcggcaatacgtctgcgcacgatgtgggagatacttaaagtaggtattccgatagccttccacatgttcatggaggccagcgcattcgtcgtcaccaatattctcgtgttgtcgttcggtgcgcacgccatcagcgcataccagatatgcaccaacatgatgcaggtgacgttcatgatagtcgtggccataggctcggccaacacgatcctatgctcgcacatattcggccgcggcgacttcgaccgcctgcggcgtacggtatattcggcctaccatctcggactcgtgtggtgcatcacggccgccgtatgcttcgtcgccttccgctacaccatacctgcactcttctcgtcaaacctgcaggttatagaacttacgggaacactgctcatattcatatcgctcttccagatacccgactgcctgcagacgctctccataagcgccctgcgtggtctgcaggacgtacgcgtcatcatgcccatcgtattcgtatcgtatgtgctgataaacattccggccggatacctgctcgctttccccgccgggatgggtgccgaaggtcttattctgggtctcatagccggacttacgtgctgtgccgtgctgaccatacgccgcctgcgccgcgacatggtctcactcgaaaaacgcatagcatcatcctcgacgaagaccatctga

SEQ ID NO: 503 - DNA, 687 bp, Alistipes sp.
atggaaattaagaaatcgccagaggcagatcttcagaacagaaaaggtctgttttttgaaatcggtttagtcattgcccttgcggcggtgctcggagccttcctctacactccgaaggagtaccgcatcgagcaggtggtatcgaacgtagtggtcgaggaccagcagatcgtcgaggtgacgcgtcaggagcagaaaccgcctgagcagcccaagaaggtcgagatgcaggtggttaccgacattctcgacgtggtgaccaacgacaccaagatcaccagcgacatcaacttcgacgagttcaccgaggatatggagatcacggcagctcccgtcgaggtcgaggaggaggttatcgaggaggagacccccttcatccgtgtcgagaagatgccttcgttccaaggcggtgacctgaatgctttccgtaactgggttcagggcaagctccactatccccagatcgctcaggagaacggtatctcgggacgtgtggttctgtcgttcgtgatcgagaaggacggtacgcttaccaacatcgaggtgctgcaggcacccgaccgttcgctgtcggaggaggccgtacgtgtgctcgagacctcacccaagtgggagccgggcatgcagagcaacaaggccgtgcgtgtgaagtacacgttgccggttgatttccagattcacaactaa

SEQ ID NO: 504 - DNA, 1479 bp, Alistipes sp.
atgtcaaagaaaatctcaagagctgactttctgaagacctctgcagctggtctggcagctatgactgttgttcccggcaacgtaatgggttcagccttcggacacaaggccccctcggacaaacttaacatcgcaggtgtaggtatcggcggacgtggatcggccgtgctggacgacctcaaggaggagaatatcgtagccctctgcgacacggactggaactatgccaagggtacgttcgaccgtttctcgaaggcacagcgcttctgggactggcgcgagatgtacgacaaggtcgcaaaccagatcgatgccgtaatgtgcgctacgcctgaccacacgcacgcacttgttgctgccaacgccatggagctcggcaagcacgtatattgcgagaagcctctgacccactcggtatacgagtcgcgtctgctcaccaagctcgctgccaagaacggcgtggctacccagatgggtaaccagggatcgtcgggcgaaggcgtacagaaggtgtgcgactggatctggaacggcgagatcggcgaggttacccgtgtggatgccttcaccgaccgtcctatctggccgcagggtctgatgcgtcctacgcaggttgaccccatacccgagaccttgaactgggatctcttcctcggatcggccccctatcgtccctacaacaagatctaccagccgtggaactggcgtggatggtgggacttcggtaccggtgctctgggcgatatggcctgccatatcctccaccccgtattcaaggctctgcagctgggataccccacaaaggtacagggctcgtcgacggcactgctcaccgactgcgctccgcaggctcagatggtaacatacgtattccccgagcgcggcaagaaggacaaggtcaagctgcccgaggttactgttacgtggtatgacggaggtctgacgcccccgcgtcccgaaggactcgagcccggcaagaacctcaacgacggtggtggcggatgtatcttctacggcaccaaggatgtcctcatctgcggatgctacggtgtcaatccctacctgctgtctggccgtgtgcccaacgctcccgcacgtgcccgcaaggtcgagctctcgcacggaaaggactgggttcgcgcctgcaaggaggacaaggctacccgcgtgaagtcgaattcggacttctcggaggcaggtcccttcaacgagatggtcgtaatgggtgttctgggcgtacgtctgcagagcctcaacaagaccctcgagtgggacggcgcaaacatgcgcttcaccaatatcggcgacgacgagacgctgcgcatcatgatcgaggacggattctcggtacacgacggtcacccgactttcaacaagacctacaccgaccccatcaacgcaaagcagttcgccgaggagatgatcaagcacaactatcgcaagggttgggacactttgctccccgccatgcccaaataa

SEQ ID NO: 505 - DNA, 942 bp, Alistipes sp.
atgacgcttatggccggagaagaagcactttgcggcgtggttctgcgcgccacgggaagcctctacgaggtgttgctgggcgaacgtacggtctcgtgccgcatacgcgggcggctgcgcctgaaaggggtgcgatcgacaaatcccgtcgtcgtgggcgacatcgtgcgttgcgaacgcgacgagacgggggagaccgtcatcgccgatatcgagccgcgccgcaactatatcatacggcgcgcgtcgaacctctcgaaggagtcgcatatcatcgccgccaatctcgatcaggcgctgctcgtggccacgctcttctcgcccgagacggctccggagttcatcgaccgttttctggttacgtgcgaggcgtacaaggtgcccgtgacgatacttctggccaaggccgatctggcgcgcacggcgcccgaggctatggctgcattccatgatacgtacgagcgtgcgggctaccgcgtcatcgacgtctcggccaccgagggcgagggcgtcgacacggtgcgggatctgctgcgcggacgcacgacactgctgtcgggtaattcgggcgtgggcaagtcgacgcttgtggcggcggttgagcgtacggccgaggtgcgcacggcggagatctcgcgcagccaccacaagggccgccatacgacaacattctcgacgatgtatccgctctcggaggggggatacataatcgatacgccgggcataaagggattcggacttattgacatagacgatgcggagctggcgcactacttccccgagatgatgcgttggctgcccgagtgccgctactacaactgttcgcatacgcacgagcccgattgtgcggttatcgaggctgtggagcgtggcgacatagcgatgtcgcgttacgagagctatctgaaaatactggacgaggatgacaaatacaggaaatag

SEQ ID NO: 506 - DNA, 1770 bp, Alistipes sp.
atgagggcttcaaatacactctatgaacttcttgaaaacagcataaaagagtataaggacaacatcgccttctcgatgttcggaggggagaatgtgacctatgccgaggtcggactgcgagtggccatagtacagcagatgctgctcgatgccggtctgagcgccggcgacaaggtggcgatactgagcagcaacatgcccaactggggtgtctgctatttcgccgttacgacggcaggcatgatcgctgtgccgatccttcccgacttcaccgaggcggagctcgacatgctcatacgccattcggaggccaaggcgctcttcgtgtcggacaaactgtttaccaagctgtcgaaggagactgtggcgatgctcgacatcgtcatccgcacgaagaatctcggtatcatatcgcagcgcacgacgggcaagggaacgcgcaccgtgccgcgtcccgatgatctggccgtcataatatatacgtcgggtacgatgtcgcggcccaagggcgtgatgctcacacactacaatctggcgtcgaacgtcaacatgatgtacggcctgttccccatcgacgagaatgactcgatgctctcggtactgcctctgtcgcacacatacgagtgtacggtcggcatgctctatccctttgccgtcggaggaagggtcacatacctcgagaagccgcctacggcttcgattctgctgccggcgctgcagtcggtgcggccgacgtgtctgctgatcgtgccgctcataatcgagaagatataccgcagtcagatatatgccaagtttacctccaacgccttccttcgcaaggtctacggcaacgatttcctgcgtcggcagatacaccgtatagtgggccgccgtctgatgaaggtcttcggcgggcgtctgcgcttcctcggcatcgggggcgcgaagctcaatcctcaggtagagcagttcctcatcgaggcacgtatgccatacgccataggatacggccttacggagacggccccgatggttgcgggtgccgtaccggccatgccgcgaaaggtggggtcgacgggattgcctatggtgggactgcaggtgcggctggacaacatcaatcccgagacacggcagggtgagatcgtgatcaactcgccgtcgatgatgcgcgggtattacaagaacgaggaggctacggccgaggcctttaccgaggacgggtggttccgtacgggtgatctgggttatatcgacgaggatggcttcatcttcatcaagggccgtttgaagaacatgatcgtgggcccgagcggcgagaatatatatcccgaggagatcgagtcggtgttgaataccaacgcctatgtctcggagtcgctcgtgacgcagcaggatggccatcttgtggcgttgatacatttcgacaaggaggcaatcgagaaactcaaggacgagctgatggagaagtgggagatcacgcgtgaggactggcaccgcaaggtgggcgagtggaatgccaagaaggaggagatcaagcaggagatcatgcgttacgtcaactcgaaggtgaataagttctcgcgtattacggaggtggtcgaggaggacggcggcttcgagaagaccccgacacacaagatacgccgcttcaaatataacggcagcaataacgccaagacaggcgaggcatcgccctcggctgcaacagagacggctccggccgaggagaagggttcggagagtgccgattcctcttcgggggcggagacgcggggtgacgcctga

SEQ ID NO: 507 - DNA, 2463 bp, Alistipes sp.
atgaaaatagcattcaagaatttcattacgacgctgcggcgttacaagatggcctcggtgttgaacatcgcgggcctgacgctggccttcacggcattctacgtgatgatggtgcaggtgacctacgatctgggctacaaccgctcgatcagagatgccgaccgcatctggacggtgaatgccaactggataggcggcggattctcgctgatctcgccgcgcggccccttcgaggcggcgctggcgcagtcgcccgaggtcgagggcagcgccatcattacgcgcaactgggaggggcccgtgtgggtgcagaagtcggagttcagcttcaccgaatatgcggctgtgatggactatatatcgctgccgtcgctcgacctgctgggcttccgcacggtggagggcgaccttcggcagatcgagaaccccaatacggtgatcctgcccgagtcgctggcgcggctctacggagtgcatgccggcgaccgtatcttcacgagcgacaccaagcccggggagaaaccgcgcccctcgcacgagtggaccgtggtgggtatatacaaggatttcgccgacaacacgcttatgggcgagcctcgtatatacagctacttgggcgacagggacatgaacgacacgtcgcaatatggctatatctgtatggtaaagatgcgtgacgggtccgtgcccgacagcttcaagaaggcgtgggacgacaacatgtaccgtcagcgcgtggcacgtgtgcgtgatgacgatagtgcgcagagtgccgaaaagggcgacggtgaggatgccggcggcacgacagccgccgagaccgatgccaaatacgaatacctgcgcagcgatgtgcgtttgacgaggctgacggatgtctatttcgacacctcgctcggttctggctcggaccacgatcatggctcgaaatcgacgatgctgacgtgtctgggcgtagccatcctcgtggtggccatagcgctgataaacttcgtcaacttcttcttcgcgctgatccccgtgcggctgcgtgccgtcaatatctgcaaggtcttcggggcctcgacccgtacgctgcgctggagcttcctgttcgaggctgtgggacttgtggtgtgcgcgctgctgctgacgatgtaccttacgatcgtgctgcccgataccttcgtagcggagtatgtctcgcggtcgctctctttgaaggataatctgacggccgtgctgctgctctttggcataggcgtggtggcagccctcgccgcggcgctgtacccgtcgtactacatcacctcgttcaacgcctcgctcgccgtcaagagcggcttcgccggctcgggcgcgggtcgccgcctgcgtcttgttctggtcggggtgcagttcaccgtctcgatagcccttatcgtggtggccgcctgcttctggctgcaatacaggtatatgatcaattacgacataggaatcgaccgcgagaacctgatgtgtttcaatctctcgtacaaggacggcgacatgtatcccgtattggcggaacgcatgaacgagatgcccgagatcgtcggcgtgacggcatcggtggatgccgtggtgggagacggctcggccgaggtgatacgcatgaagtacgaaggccgcgatctggagctccacttccgatatgtgcgcagcaacttcctcgacgtgatgggcataaggctcgccgagggtgaggacttctccgacgacatggacaacgccgccaccaagtatgccatcatgtgccgcagtacgtgcgacgagtacggattctatccgggtttcgtggtgatggcgggaactacgccgatatgccgtgttataggtatcatggatgacgtgctcggacagcctctcgactcgaagcagagcaatacggtctactgcaccacgtcggaggatcagtggatgggcgacgtatatttccgcacggcggcgaatgtcgacatcccgcggctgtgcgacaagatccgcgccgtggccaaggagataaatcccgacagcgaagagttggatatcgagttcgtggacgaacatctgcagcggctctacgagaagacgcagcgcagcgccactatcatcgggctcttcgccctgctggccgtcgtcatatcgctgatgggtgtcttcggtattgttctcttcgagacgcagcaccgccgccgcgagatagcgctgcgccgcgtgatgggatcgtcgatcgagggcgtagtgtggttgttcgggcgccactacttcgctatcttggccgtatgtttcgccatagcggtgcccgtggcgtggtacgtggtgagcgagtggctcaacaggttcgcctaccggatcccgacgccgtggtgggcctttgcggcggcattcctgctggtgacggcgctgacgctgggcatagtcgtcgtacgctgccgccgcgccgcgagcgagaatcccgcacgcgtgctgggcggcgagtaa

SEQ ID NO: 508 - DNA, 1242 bp, Alistipes sp.
atgcttgttcttacgttgattctgctgaccatatcggctctggtttcggggtcggaggtggcattcttctcgctcacgcccaaggagttgcaacgcatgtcgcagagttccgactcgcgtgacgggctgatcgtctcgctgctgtcgaatgtcgaccgtctgttggcgacgatcctcgtgacgaacaatctggtaaatatctgtatcgtaatactctcgtcgaacgtgatgagttcgctgtggcacttcgcccgttttgagttccttttcaagacggtgcttgtgacgttcctgctgctgctcttcggcgagattctgccgaaggtgctggcgcagacggctcctttgaagttcgcgcgtgcggtggcatatccgatcaaggtattcagctggctgagttaccctgcggcatacgtgctcatacgcacgggtggccgtctgagccgtctggcgacgcacaatgtcgagatctcgatggaggatctggccgacgcggtcgaccttacgcgtacatcctcgaacgaggagcacaagatgctctcgggcatagtcaatctggtcaatacggaggtcgaggagatcatgcgcccgcgcatcgacatcatggcgctcgacatgagtgtggactacgacgaggtgaagcgtgagatcatcgagtcgggatattcgcgcataccggtctatgacgaggatctggacgacatcaagggtgcgctttacgtgaaggatctgctgccttatatcaaccgcggcaaggacttcgagtggcagaaactgctgcgcaagatatatttcgtgcccaagcacaagaagatcgacgacctgttgcgggattttcaggagaacaagatacacatagcgatcgtggttgacgagtacggcgccacgcaggggctcgtgtcgctggaggatatcctcgaggaggtcgtgggtgagatcaccgacgagagcgactcggaggagacattctaccaccgcatcaatgccaatacatacctcttcgacggcaagacccatatcgtcgacttcgagcgtgtgctcgacatggatgacgacgctctggccgacgttcaggggcgtgccgagactttggcgggcctgatgctggagctcaagcgcgaccttctgcgcaagggagacacggtcgagacgcacggcgtgcggctgacggtggagaagatggagggccgccgcgtcgacaaggtaaaggttgttgtgaacgatggcggaagtgaaggataa

SEQ ID NO: 509 - DNA, 1128 bp, Alistipes sp.
atgaaacggaaagctctgttcattgatcgtgacggcacgatcatcgtcgagcctgtggaggatatgcaggtcgactcgctcgagaaactggagtttgtgccgggggcgatctcggcgctgcgctcgcttgcggcgctggactacgacatggtgctggcatcgaatcaggacggtctgggtacggcatcctttcccgaggagaccttctggccggcgcaccgcaagatgttgaagacattggcgggcgagggggtgatattctcggacgaacttatcgaccgttcgatgcctgaggataatgccccgacgcgcaagccccgtacggggatgttcggtcgctatatggacgggagttacgatctggcgtcaagttacgttataggcgaccgcgctacggatgtcgagctggcgtataatctcggtgcgcgtgcggtgctgttgcaacggcccgaagatggtgagcgcatgctggcaggaaagccctgcgcgttgagttgtgtgctgatgaccgattcgtgggccgatgtggccgagttcctgcgccgcacggagcgtcgtgctgtggttgcacgccgcacgtcggagacggatattcgtgtcgaggtcgatctcgacggcaagggtgagagccgtatcgatacggggcttaaattcttcgatcacatgctggatcagataccgcaccattcgggtatgtcgctgtcggttgcgtgccgcggcgatttggaggtggatgaacaccacactgtcgaggatgtggccatagctctcggagaggctatatatgacgctctgggatcgaagcgcggcatcgaccgttacgggttcgtcctgcctatggacgagagccgtgccatggtgttgatcgacttcggcgggcgtatcgacttttcgtgggacgtacccttcactcgcgagtatgtgggcgacgtgccgaccgagatgttcagccacttcttcaagtcgttgtgtgctgccatgcactgcaatctccatgtgcaggcccgcggcgagaacaaccaccacatgatcgaaggggtgttcaaggcctttgcccgcgccctgaagatggccgtgcggcgcgatgtcttcagcagcgaactgccttcgagcaagggggtgctgtaa

SEQ ID NO: 510 - DNA, 1683 bp, Alistipes sp.
atggatacgaatacacagacaaccgagcccaaagagaagctcaactttctggaggagatcatcgaagagtcgatcgccaaaggcgaaaaacgcgttcagacacgttttcctcccgagccgaacggctacctgcatataggccacgccaagagtatctgcatcaacttcgggctggccaagaagtacggaggcaagtgcaacctgcgtttcgacgacaccaaccccgtaaaggaggataccgagtatgtcgactcgatcaaacgcgacatccagtggctcggcttccaatgggccgaggagcgttacgcgtcggactacttcgaccagctctacgagtgggccgtggaactcataaagaagggtctcgcatacgttgacgaccagtcgcaggaggagatacgcctcacgcgcggaacaatttcggaaccgggcaaggagtctccgtggcgcaaccgtacggtcgaggagaacctcgatctgttcgagcgcatgcgcaacggcgagttccccgacggggcaaaggttctgcgcgccaagatcgacatggcgcatcccaacatgctcttccgcgaccccataatgtaccgtatcatccacgcagagcatcaccgcacgggcaacaagtggtgcatctatcccatgtatgactacgcacacggacagtgcgactcgatagagcacataacccactcgatctgtacgctggagttcgacgtacaccgtccgctctacgactggttcatacaggctctgggcatatacccctcgcaccagtacgaatttgcgcgtctgaacctcacctataccatgatgtcgaagcgcaaccttctcaagctcgtgaaggagggtgccgtgatgggttgggacgacccacgcatgccgacgatctgcgccctgcgccgcaagggttacacccccgcatcggtgcgcgcgtttgccgagatggtgggcgtggccaaacgcgacaatgtaatcgatctgggcaagatggagtattgcgtacgtgaggacctgaacaaggtagccgagcgccgtatggccgtgctcaaccccctgaaggtcgtgatcaccaactgggaggagggcaaggtagagatgcgcaacgccgtgaacaaccccgaagatcccgaggccggaacgcgtgaagtacccttcacgcgcgagatatacatcgaccgcgatgacttcatggagaacccgcccaagaagtatttccgtctgagcccgggcggcgaggtgcgtctgcgctactcgtacctcatcaagtgcaacgaggtgataaaggacgctcagggcaatatcgtcgagctgcactgcacctacgacccaatgtcgggcgaaggttcgtcgagcgacggccgccgtgtcaagggcgttatccactgggtatcggctccgaccgccataaaggccgaaatacgtctgttcaaccccctgttccgcaccgaggatccgttcgacacgtcggaggggcagcagtcatgggaggacaacctcaaccccgactctatgatcaaggtgacgggatatctcgagccctcgctggccgatgcgcccataggacgcacctatcagttcgagcgcgtgggatatttctgccccgatacggactctacccccgagcaccccgtattcaaccgtacggtgacactcaaggattcgtgggccaagatgaataaatag

SEQ ID NO: 511 - DNA, 954 bp, Alistipes sp.
atgaaattcagatatataatgactgctgcggctctgctcggtctcgttgcctgcaacgagaacaaggttttcgagaaggagcagtataagaatgtcttcggtttcatcagtgacaccgaaaacatgaacagcaaggttttcagtcttcacaagaccgagtcggaaggttatctggccttttcgatgggcggcacgaataacattacggaggatgtgacggtgaacatcgtcgaagatcccgagttgatcgagacgtacaaccgcaacaactacgatcaggaggttgccaagtatgccaagcccatgcccaaggacaagtatgagatcacgtcgatgcagtgtgtcatcaaggccggagagacgggaggcgtcatacccgttaagattcgtcctgcggggctttcgcccgacacgacctatctgataccggtgcgtgtcgatacctacgatcgttgtgagatcaatcccgagaagagctatcttctctacaaggttcttatcgagaaccgttgggctgtcggtgacggaacgacgagctatacgcttcgcggcaagcgccgcattctgggtgaccagtcggagctctcgatgcccggaacaaagattctcttcccgctgactgacaagcgagtacgtacgatggtcgggaacgaggcctatgcggccgacgaggagacgctctatcgcggagccatgatactcgaaatcgccgacaacggcaaggttaagatccttccgtatcgcgacgtagaggtcgtgcagctcgacaatgaggatcccgagtatcccaacaagttctttatcgaggatgacggattcaacacctacaagaccttcctgttgtgctaccagtacacgttcgagggtgtcacctacgtgatgaaggaggagttgcgtctgcagttcaatcccgacgatgaggaagactatgaagatacccctgttgaagaataa

SEQ ID NO: 512 - DNA, 1017 bp, Alistipes sp.
atgaacaaagtaatgatattctgccagacccgcgacggcgccctgagcgaggtgagtctggaacttcttaccaaggggcggcgtctggccgccgagactgcaggtcaactcgaagccctcatcataggcgacaatacatcccttgcagccgaggaggcacgccgatacggtgccgtgaagatattctgcgccgaggatgcgcgtctgaaggattacctcacgctgccctacgtccgcatagccaagcacgtcgtcgaggccgagcagcccgacatattccttgccggcgccacatcggtgggccgtgacatggcaccgcgtcttgcagccgagatcggatgcggacttacggccgactgcacggctctcgaactgggagactgctcatacaagggcaatgaatacaaaggtgtgttgaagtgcatacgaccgagtttcgttgccaaccagctcacgacaatcatatcgcccgcaacgcgcccgcagatggctaccatacgcgagggcgtcatggccaaggagcctgtcggcagcccagtcgagagcgagcgtatcgacatcgacactaatgcactgctcaagcaggaggattttgccgtcgagatcatcagcaagacagcgcgcgagcgcggtgcagacctcaagtcggcaaaggttatcgtcgccggaggctacggcatgggcagcgccgagaacttcggtgtactgttccgtctggccgagatgctgggcggtgaggtaggcgccacgcgtgccgccatcgacgcaggatatgtcggcggatacgagcgcatgatcggacagacgggaataaccgtacgtccgaaactatatatcgcctgcggcatatcggggcaggtacagcacaccgtaggcatggaccattcggcctgcatcatatcgataaactgcgacgcggaggccccgatacaccgtatcgccgactacgccatcgttggcgacgccgtgcagacggtcgagcgcatcatggcacagatcagaaacaacagacgttag

SEQ ID NO: 513 - DNA, 1011 bp, Alistipes sp.
atgaaacacgtgatagtcataggcggcggtatcgccggcatgcagtgcgccgtggagctggcgcgtggcgacgtgcgggttacgcttctcgagaaactcaacgacacgggcggcaaggtgcgaaactggcataaactctttccgacacttacgccggccgaggaggttctcggcggattgaaccgtgcggtcaagggctcggctaacatcgaggtgcgtacgggctgcgaggcgtcggaggtgacgccgcagcgggtgcgcctctcgacgggcgaggatctggagtgtgatgccgtggtggtggctacgggcttcactctgttcgatgcccgcgtcaaggaggagtatggatacggtatatacgacaacgtgatcacctcggccgacctcgagcagatgttcaacacgggcaaggtcgcgctcaagaacggggcggcgccgcgccgcatagccttcctgcactgtgtgggttcgcgcgacgagaaggtgtgccagcgccactgttcgaaggtgtgctgcgtgacgggcgtcaagcaggccatggagatgaaggatctcttccccgcggccgacgtcttcaacttctatatggacatacgcatgttcggcccgggatacgaggagatgtaccgcgaggcgcagcagcgttgtaacatacacttcgttcgcggccgcatctcggaggtggggcccacgatcgacggccgccttcagatcaaggccgaggatacgctcacaggccgtccgttgaagatcggggtcgacatgttggtcctgttgatcggcatgcgtgccaacgacatgaatgccgtattggagcagcggtgctcgctggcgcgtcaggcgagcggtttcatgcagccgcgcgacgagttcctgcacaacaccgagagcggcatcgagggtatattctatgccggggcggttacggcacccaagtgtgtgggcgaatcgctgaacgaaggtgtcacggcggcgcgcaaggccatcgagtggcttgcggcaagatag

SEQ ID NO: 514 - DNA, 1365 bp, Alistipes sp.
atgagactgagaaatctcttttttgcgctggcggcgtcgataggcgttgcggcggcgccggctggggcgcaggagatggcggattcggtagtgtccggtccgttgatgttgacgctcgaacaggcgcttgacatagcgctgagcgagaatccgacggtcaagatcgccgatcagaccgtggaggtgaaaaagtatgccaaacgcggcacctatgccggcctgtggcccgagatcagtgcctcggccacctacaaccgctacatcaagaagcagacgatgcacatcatggaccagacgatgaccgtcggtacgagcaatatctatcagggcggtttttcggctacgatgcccgtggtgaacgcacagttgtggaagtcgctcaagatctcggccatggatgtcgagctggccgtcgagcaggcgcgcggctcgcgaatagacatgatcgagcaggtgtcgaaggccttctatcaggtgcttctggcgaaggattcatatactgtatacaagcgcgtctacgacaacgccgtcgagaaccacaagatcgtgaccaagaaatacgaggtgggatcggtctcggagtatgagtttctccgctcgaaggtgaccgtatcgaacgccgagcccgacgtgctcaacgctgagaactcgatcgtggtggcgctgtggcagttgaaggcgctgctgggcatggatctcgacatagatatcgactgcgcgggatcgctggccgactacgagtcgatgatgacctcgcacttcgacatggagttcaaccccgagcgcaacagcgagatgaagcagttggagattcaggagcgtcagctgcagaagacgctcgagatgcagcgtgcggccaacctgccgacgctggatctctcggcaagctacaacttcacggccatggaggatacgttcaagttcaaccagtatacgtggaatccctattcgtatgccacgctgagcctcaacattccgatctttgccggcggcaagcgccgtgcggatatccagcaggcgaagctcaacctgagcaacatgcagcttcagcgcgagaatacggagcgtacgctgcgcacctcgataatgcagtatgcaagcaacatgcagaccaatctgaagcagtacaactcgtcgctgtcgagcgttgcggaggccaagcgcggctatgacatagccgtgaagcgctacgaggtcggtgacggcacgctggtcgagatcgacgactcgcagctggcctacacgcaggccgagctgacgcgcagcacggccatatacgactatctggtcaatcaggtgtcgctcgagaagatacgcggaacctatatgatggatgacgaggcgtcgacggcggatgccgagtag

SEQ ID NO: 515 - DNA, 1059 bp, Alistipes sp.
atgtcaacatttcgacatacaatacaggccctcataacggtattcgcaaccatcacgtgctcatccggcgccgcggccgcgacaccgtatccggagctggattccgtaatatgcgctctgatgaggcgatatgaccttccggccgcaagcatagccctcatgcgcgacgaccgcataatctacaccgccgcatacggcgttaccgacaccctgcgacatacgccgacgaccatacgcacccgtttccgcatagccagcctctcaaagcccgtcaccatggccggcatattgctgctggcggcacatgggcggctgtcgctcgatgaccgcgtcttcggcgagggcgccatcctcggcaccgactacggacccgtaccccgaggctcgggcaaagacctcataacggtacgcaacctgctcgaacacaaaagcgggtgggagaacatccccgacgacccgatgttctccaacgccggcgccacacaacggcagatcattgcccgcatgctggcggcacgccctctatccgcacctgcaggcgaaaaatacagctactcgaatttcgggtacctcgtcttgggacgcataatcgagaaggtgagcggcatgccatacgggaaattcatacgccgccacgtgctgcgcccctgcggcatacgccgcatgcgtatcggcgaggcccatggagacaaaccccgacacgacgagccgcaatactgcctgctgcccgaagagaccggccaatcatactacctcgacatacggcggatggattcccacggcgggtggatagcctcggccgccgacgtggcccggttcatggcgcgtatcgaccgcaatccggccgtcggggatataatacccgactcgctcgcgtctcagttctatttcgggttcgagcgttggatacataccggctccctgcccggcacggcggccgtaatgatacgcatcgacgacaggtattcattcgtgctgctctcaaacaaacgctcctacgacgaacgattctgggacgatatgtcgcaaatacccatccatgccataaccggccgctga

SEQ ID NO: 516 - DNA, 1095 bp, Alistipes sp.
atgaaaaccacagctttcaccaagtatcacattgcaaacggcgccaagatggccgagtttgcgggttacaacatgcccatcgagttctcgggcataaatgacgagcacatgaccgtgcgcgagaaggccggcgtgttcgacgtaagccacatgggcgagatatggatcaagggagacaaggctacggccctgttgcagcacatcacctcgaacgacgtatcgaagctttacgacggcaaggtgcagtattcgaccatgcccaacggccgcggcggcatcgttgacgatattctggtctaccgtttcagccctgagaaatatatgttgtgtgtcaacgccgccaacgtcgagaaggattggcagcatatatgcgccgagggcaaggcattcggcatggagccgggccgcgaactggaaaacgcctcggacaagatcgcacagctggccgtgcagggacctctggccatgaagatcgtacagaagctctgcgacgagcccgtcgaggatatggcatactacaccttcaagcagacacgcgttgcgggttgcgacgccatagtatcggctacgggatacaccggatcgggcggctgcgagatatacatgtacaacagcgacgccgacaccgtatgggacgccctgtggaaggcgggcgtagagtacggtctcaagaatatcggtctgggcgcacgcgacacgctccgtctggagaagggattcgcactctacggcaacgatatcgacgacactacctcgctcatcgaggctggtttgggttgggtcaccaagttcgccgagggcaaggacttcatcgaccgcgagctgctcgcacggcagaaggccgaaggcgtggagcgcaagctcataggattcaagatgatcgaccgcggcgtgccgcgccacggatacaagattgccaacctcgaaggcgagcagatcggacacgtgacgtcgggcaccatgtcgcccatgctccatacgggtatcggtctgggatatgtcaagagccaatatgccgccgtaggcaccgtcatcgccatcgtcatacgcgaccgcctcatcaaggccgaggtcgtaaaatatcccttcgtataa

SEQ ID NO: 517 - DNA, 936 bp, Alistipes sp.
ttgagcatagcggtaaccatactcggctcatcgtcggccaagcctacggccgaccgtcacccctcggcgcaggcggtgaacgtaaacgagcaatactatctgatggatgccggcgagggtgtgcagcagcagctcgtgcgtgcggggatcaaccccctgaagctgcgggcggtattcatctcgcacctgcatggcgaccacgtctacgggctgctgccgctgatctcgacgctcgggctctacggcaagcgcacgccgctgccgatatatgctccgcggcccttcggcgagatactcgaggcgcatctccggtacttcgacacggcgctgccgtacgagccacaatggcacgaggtcgacaccacggcccaccgcatcgtcttcgagaacgactcgctggaggtgtggtcgctgccgctgcgccaccgcgtacccacggccggatatctcttccgcgagaaggagcccgcgctcaacgtcagcaaatatgccatcgaacgctacgggctctccgtagcgcagatcgtggcggcaaagcgcggcgaggatcttgtcggggcagacggggagccgataccaaacgaccttgtgacataccgtccataccgtcccgtatcgtatgcctactgttccgacaccaactactcggcgcggctggcttcgatggtcgagggcgtagacatgctctaccatgaggccacatacgccgccgacgagaggcgcacggcacgcgatagggggcattcgacaaccgtcgatgcggccaacgtggcgctcaaggcgcgggcgggaaggctccttatagggcacttctccacgcgatacaaggatctcgggccgctcctcgaagagagccgcgccgtattccccgcaacggacctcgcccgcgagggacagacattcaccgttaccgaacagcgacatgacaagatctga

SEQ ID NO: 518 - DNA, 1362 bp, Alistipes sp.
atgtcgaataatccacttaacgacggcgcggtgtatgacgcccgtttgctggggaaacccaagatgctggctctgggcctgcaacacatgttcgccatgtttggcgctacggtacttgttccggccataacgggcctctcggtctcggccacactgctctttgcgggtctgggcacgctgctcttccacgccatcacacgattcaaggtgccggcattcctcggctcgtcgttcgccttcatcggcggctatgctactgtcaccgagatgggtacggcgcagggtctcacgacggccgaagcgctgccttatgcctgtgtcggggtattctttgccggtttgctgtatttagtgctggccggattgttcgccatgttcggtgcgcgccgtgtgatgcgttacttcccgccaatcgtcacgggccccattatcatatctatcggcctgatactttcgggttcggccatcaccaactgtatggctaactggtggatcgcgctgctggccatcgccattatcatcgtggccaacatctggggccgcggcatggtccgcattgtgcccatattgttgggcgtggtcggttcttatgtagtggcagccctttgcgggcaggtggactttacggccgtgcgcgaggccgcatggatcggagtcccgttccacatgaaggatacggccttcgccgtcttcgccaaccccgactgggggcttctcgtctcggccatcatcaccatcatgcccatagctctggccacgatggtggagcatataggcgacatgtgtgccatatcgtctacggttggacgtaatttcctcgccgacccgggactgcatcgcacgcttatgggcgacggtctggccacctcgatagcgtcgctgttcggggcgcctgcaaataccacatacggcgaaaatacgggcgtgctgaaccttacgaaagtgttcgacccgcgcgtgatacgtcttgcggccgtcttcgccatactcttttcgctttcgcccaagtttgcggcgctggtgagctcgatgcctacggctaccatcggcggcgtgtcgctggtgctctacggtatgatctcggctgtgggtgtgcgtaacgttgtggacaacaaggtcgactttacggcctcgcgtaacgtcatcatcgcggccatgatcctcgtgctggccataggtatcaagtacggcgccaacgatgccgtctcgctcggatttacctcgctgtcgggtctggccgtagccgctatcgtgggtattgcgctgaacgccctgttgccgggaaaggattacgtcttcggccgcaactcgaagggcgacacgtcggtcgatttcgaggtcaaccgcgtcacggaggagtga

SEQ ID NO: 519 - DNA, 1110 bp, Alistipes sp.
atgaaaaccgttcgactacttacagcagtttttctcctgtggacggtgccggcactcgcgcagaccgaggtcaacaggatttacgacgcctccgagatgatggacaacatcgaggtggcaaagagcatggaggtattcggcagagccctctcgtcgtattcgcagagctacctcaccaactacgagttgggatatgcctactaccttcaggaggactacacccgtgctggacgtatcttcagccgcctatcacgcgacatgtctgtcgacgacaggctgtatcaggtatggggaaacagctacgccgaccgcggaaacgaccgcaaggccgagaagatataccgccgcggactcaaggcattcccccactcgggagccctgcacatggagctcggagccctcgcattcaaggacaaacgctacgacgaggccctcatgtacttcgagcgcggcatagagctcgacccctcgtatcccgacaactactggcgtgccgccggaatatacctcagctcgcccgaatcggtctgggggatgatctatggcgagatatatatgaatatggtgtgcaacggcgaacagaacatggaggtgagccgtctgctggccgaggcatacgactcgaacatctggcacgagaagaacgaccgcgggcaggatctcatatacataagtttctcggagaacaactccatctggtacgacgagaccctcaaggtgatgcgcttcccgtacggcgtggccgtatatgagcccacgctgggcaatgccgtagtcaaggtggggctgccgccattctcggtcgacgagctctgccgcatacgcgacatcttcgtcgacgaatacttctccgaaccgaacgactacggatacgtatatcccaacctgctattcgaccgccagcgccagatcaagcaggcgggacacatggaggcatacagccgttggatcctgcgcgggagtgaccccgaagccttcaatgagtggtgtgccgacaacaaagagcagtggcgcgccttcgtcgagtggttcaactcccacgaactcaccgtcgacgacgaacacaacttccgcagctggcaatacaccgccaagctcccagacaaataa

SEQ ID NO: 520 - DNA, 864 bp, Alistipes sp.
atggtcgccatgccggagcaggcggccgcaaagaaaaagaagatcggcattcagctctactcggtgatgggagccgtacagaaggaccctgcgggttcgatcaagcgtctggccgacatgggttacaacgtggccgagcttgtgcagtggggcggcgacaccaaggtgttcggacttgcgcccgcggagttcaaggccatctgcgaccgtaacggcatggagatcgtctcgacccacacgggtatacaggaggaccccgcaaaggaggatgaagtgattgcgcgctggcgccagatcttcgagatacagaaggcgtgcggcggccgttatgtcgttatcccgagctacggcgtcgactacacggagaagggtgtgcggcagatgtgtgactacttcaaccgtatcggcaagatcgcatcggagtacggtctcaagctgggctaccacaaccattcgggcgagttcgccaaactgaaggattcggacaaggtgatgtgggagtatcttgtcgagcataccgacccgagctacgtattcttcgagttggacgtctactggtgcaccaagggtggcaaggatcccgttgcctacctgaagaagtatcccaaccgtgtgcgcatgctccacgtgaaggatgacttcgttatcggtgccagcggcacgatcgattttgagtcgatcttcaagcagttctatgccaacggcatgaaggactatgtggtggagatcgagatcccgggatggctgcgcgaggagcataacgccgcaggcgagaagctctcgcaggatgagatcatggagcgcatgttcgatgccgccaagcagagcgccaagtacctctcgaaggccaagttcgtgaagtga

SEQ ID NO: 521 - DNA, 576 bp, Alistipes sp.
atgaaaaagattctactctacctatcgcttctcgccttcgcggcgacggcactgggctgctcgccccaagccaaatggaatcgtgaacagaagaaggccatgaacgaggctctgaatgcatatcgtcagatggtctacctgcaggatctgaccgatccagagttcgtggtatttgccgacgacgtaaccagcacgctcgaagaggcattccccgtctacacgaccttcatcgagatgcctgccgtcaacgacaccgtcgagttctacgtcataaccaccatcgtcgacgagctcaatgccgatgcgcacaacatgcgtcacctctacccctaccagtatcttgtaagtcagggcgttctgcccgaatggctgacacacgaccagcagaaggcattctaccagtgctttgcccagaaggtcaatgcacaatactcgaccatggaccagttcttcgccgccattctggccgacacgtccgattactcgcagctggcactgttccagcagcagtgcgccaacgatctgttcgactgggtcgtggaggtggatgagcaggtcgagatcacggaggattga

SEQ ID NO: 522 - DNA, 2334 bp, Alistipes sp.
atgtgcggcggggagctgcacggcgaagagatcgaggtgcgcggcgtcacggtcgactcgcgcagttgtgcctacggtgcggatgtgatgtttgcggccatgcgtggcgcaaaccgcgactcgcacgaatatgtggcccagatgtacgaccgcggtgtgagggccttcatggtggagcgccttgaggcgcgcatgccgcatgaaggggcagggtatatcgttgtggataactcggttgaggcgttacagcgtctggcggcggcacatcgtgcgtcgttccgcggcgtgatggtgggcattacgggatcaagcggcaagaccgtggtgaaggagtgggcggcatgctcgctgccgtcggcggtgcgttttctggcatcgcccatgagctacaactcgcagttgggtgttgcgctgtcgcttcttatgatcgagggcgacgaggatgtcgcgctgatcgaggccggcatatcggagcgtggtgagatggagcgtctggagcgtatgatacgtcccgatgtggttctcttcacatcgataggggaggcccatcaggcaaatttctcgtctctgcgcgagaaggtggaggagaagatggtgctggcccgcaatgcccgcacatttatataccacagtatgtatggcgatgtggctgcggctctggggtcgctgcctgcggcgtgccgcgtcgcggatgccgcatcggaggatgtatccgagctgccggcatgcaacgaggcgttgcgtgtggatgctcaggaggtaaagagcctctgccgtgagttgggatacggtgtgccccgtctgtcgctcggcgacgccgccatgcgtatggaggtcaaggagggcataggcggctcgaccgttatagtcgatacctacaattcggatatcaattcgctggctctggcattggatacgctgcgcgatgcggcggctgcgggggtgtcgacagccgtgatatacgatatcgctcacagtggcatggatgaggcggaactgtacggacgtgtggcccgcctgatacgcaacgcaggtgtggatcgtgtcatcggcgtcggagagcgtatcggcgcccatgccgatgccttcgacggcgacaaacgtttctacgatacggccgagcagatgttgagtgcgttgacacatgacgatgttgcgggtcgggcgatcctgctgaagggcgaccgccgttcgcatttcgacaaggtgtgccgtgcgttggagcgtcggtgccatacgacggtgctggaggtgaacctcaatgccatgacgcataacgtcaactacttccgtcggttcctgccgatgaatcaccgtctggtggcgatggtcaaggcccacagttacggtacgggcgacgccgaggtggcgcatctgatgcggcatctgggtgtggattacctcgccgtagcatttgccgacgagggaataacgctgcgcgagcgaggtgtcacgatgcccgtagtggtgcttaatgccgatgccgcgtcgttcgacaagatgatagcctactcgctcgagccggagatatacagtttccattcgctcgacgacttcattcgctgtgccgaccgttacggtgtgcgcaactatccgatccacatcaaactcgatacgggcatgcaccggtggggttttctggaggatgagatcgaccgtgtggccgaaatactgatttcgtcgccgcaggtgcgtgccgcaacgatcttctcgcacctctcgtgcgcggatgatcccgcacaggatgactttacgcgcgggcagattgcgctgtttgaccgcatgagccgccgcctgtcggatgcgctgccatacaagcccatacgccatacggccaactcggctgccatagagcgtttcccggaggcgcatttcgacatgtgccgtctggggctgggactctatggctacggatactgtcataacgacgaattggaacccgtggcgacgttgaagacgcgcatcgtgcagatacgccgccgcagtgcgggcgaggccataggttacgggcgttcacagcgtctggagcgcgacagcctcatagctaccgtccccataggttatgccgacggtctggaccgccatctgagcggcgggcggtggtcgatgctggtggcaggacggcgtgccccgattgtgggccgtatatgcatggacagctgtatgatcgacgtgacggatatcgagggcgtacgcgagggcgacgaggcggttgtcttctcggcggcggcaggcaatacgcttgaggatatggcccgtgtgctgggaacgatctcatacgagatcatgacctcggtggcgatgcgtgtgaaacgtatatatacgcgtgagtga

SEQ ID NO: 523 - DNA, 1500 bp, Alistipes sp.
atgtttaacatgacggagaatatattgctcgtatgggcgctgctgctctacgttgcggtgatagccggaaaggtggcctatcgtttcggggcgccggccctgttgcttttcctcggcgtgggtatgatgttcggactgcacttcctcaagttcgagtcgttcgaactgacgcagttcataggtatgatcgccctctgtataatcctgttttcgggaggtatggataccaagttctcggagatacgccccattctggctccgggtatcgtgctggcgacgcttggtgtggtgatcacggcggcagtgacgggtgtattcatatatttcttctcgtcgtgggtggggttggccatgtcgctgcccgtatcgttgcttctggcgtcgacgatggcctcgaccgactcggcatcggtattctcgatcctgcgtaccaagaaacagggcctgaaggagaatctgcggccgctgttggagcttgagagcggtagtaacgacccgatggcatacatgctgaccatactgctggtgacggtcgccacatcggccggcggcgacgtgaatctgggacagagtattctgaagtttgtcgtgcagatggtggtgggtgcactgctcggatacggtatcggacgtctgacggtctttacgataaaccgcatcgacatcaagaacaacatatcgctctattcggtgctgctgttggcgtcggtattcttctcgttctcgttcacctcgctgctgtggggcaacggctatctggccgtatatattacgggtctcgttgtcggtaactacaagatcgcccaccgtggcaaccttacgaccttcatggacggattcacgtggctggcgcagatcgtcatgttcatcaccataggattgctggtcaactccgatgagctgatgcgtcccgaggtgttgatcctcggcggggctgtggctctgttcctgatgttcgtggcgcgtccgctggcggtgttcttgggtctgctgccgttccgcaatttcagtcgtcgggcgcggatctttgtttcgtgggtgggcctgcgcggcgccgtacccataatcttcgcgacatatcccattgtcgcgggcgtcgagaacggacgtctgatcttcaatgtcgtattcatggttacgctcatctcgctgcttgtgcagggtactacggtgagcggcatggccaatcttctgggtctggcgttcgaggagaaggagccgctgttcaagatgggtattcccgacagtataaagagcaacttcaccgagatcgaggttacggcctcggccctcgagggtggctcgacgctgcgtgatatcgaacttccggataatacgcttgtggtgatgatatgccgccacggcgaatatttcgtgccgcgcggaaatacctcgctcgaggtcggggacaaacttctcgtcgtgtcggatctcggcgacaaggagctgcagaaggtctacgatacgctcggcataaaggatgtggtgaaattgcagtag

SEQ ID NO: 524 - DNA, 957 bp, Alistipes sp.
atgcaaatcgccctcactctgatactcgccctgctggccgtcgccgccctcgccacagccatgcgcgccatcgtcatagcccgcgccgcggcatggatggatatggtcgccataggcgccacggacagctgcgaatcggccggatatgtcggatgctcggtcgtatgcaccggggtggagaacatgcagcagatagagagcctgctcgatgtcgaatatgaccgttacgagaccatagtcgtactcgacgcccgcgccgccggcatcacgttccgcgccatcgtcgcacgctacgacctcatacgcgtcgacgccgacccttcggacgagttcccctcggcgcgcatacgctcactcttccgttcgcgcacgcgcagcatgcggcgcctcaccctcgtcgaccgcgccgccgcctcgccctacgacgatctggacgccggcgccagcgtcgcctcctacgactacatccttcccgtcggacgcgacacctatctcatgcccaacgccatcgagaaggcggtcatagccatagcctcgacgcccgatacgcccatcgccgcgctgcactccgtctccgacgaccagtgctacgttttcaaccgcgagacccttatcgcccaaggcggattctcgcctcatcttctcggcggcatacgcagcggcgaagtgcgccgcacgttcgtgcccctcatataccgcacgagcaacacacggcgcataaaaattgttacccgcctaacaattttaatccttatggcaacgttacttacaatagagactgtcacgctcggcgcacgcctcgccacagcctcggcggcggccgtggcgatggctctggcaaatgcggcatacgcccgtacggctctgggcaggtacaactgtttcgaaaagtcaattttatgttacatagatcgtatgttttccattttgggcaaacgaaaatttactatttcataa

SEQ ID NO: 525 - DNA, 2091 bp, Alistipes sp.
atggcgctgttgtcgctgttgccgcggcaggcgtcggcacagctcgacgccgcggctctggcacgtgcgcagcgcaacggcgagaatgtctctttaggcggcgtcaacccctacgatacgggtaccgacgaggggcaggagaagggcgactcgacacgtacgcgacgcataaagcggccgctggagtcgtatctgttcaacgactcgatccgcgcgctgcccaatttctcgtggaccgtggaccgcgacctgaacagcgtcaacatcatgccgctcgacacgcttatcgacaactggcgcatagactattcctattacctgaagggcgtgggtgacatgacgctcggcggactggggcagtcgaccatgccgttcaactacttcgaccgcgcgcagggtcccgacttcaagttcgcacgcgcctacgatgcctatacctaccgtatggacaatgtgccgttctacaactcgaagacgccctatctgaacctgacatatcttgagtcgggtcagaaacgttaccgtgaggagcacttcgagatcaccacggcgcataacgtctcgcccacgacggggttcaacgtgagctacaaggcgcgcggcacaaagggcctgtacgagtggcagaggacgatagaccacaacctttcggtggcattctcgcatacgggcaagcgctactcgatatatgcggccttcatcaacaaccgcatacgccagcgcgagaacggcggcgtcgtaggcacatgggccattgtcgatactgtattcgaacatccgtcgggcgtaccgatgaagttggccgaggccgaagccgagaactcctaccgcaacaactccttcttcgtgaagcagtcgtatgccataccgcttcagcccgtgaccgactacgacttctcgatagcgggcctttcggcagtatatataggtcatgtgttcgagtacaacacgtggagcagactctacaccgacaagtatgccacctacaccaacgaccgcggcagccgcgacgagaacggcgagtatgtccccacgacggagacatactacaaggattggttcatctcgccggccgagtcgcgcgactcgatacgcgaaagggttttgtcgaaccgctttttcgtggaggcgcagccgtgggaccgtaacggcgtggtgggagtgctggacggcggtatcggtatcgacatgtatgcctatacgcagttcgcgctcaaggattacgccgcaggcaagtacggtgtcgaccgccgtacggcgtggtatgcctacggcgccgtgagcggcaagatacgtaaattcgccgactggggagctgacctgaagttctacccgtcgggttacaggagcggagacctcgccctgaacgcccatgtggcgcttacggcgaagttccgcggtcatccggttaccctctcggggcggttctcgcaaacgagactctcgccctcgtattgggaggagaacctattctcgaaccactatgtgtggtccaactctttcgataaagagaatgaaacccgtttcgaagtatcgttggagattcccgattgggcgctcgaactgagcgcatggcagggcgtggtgtcgaacaaaatatattacggcgccgacagccgcgtggcacaatcgggagcgacgataagtctgacgagtttgtacgcccgcaaggatttccgcctcggcggattccatttcgaccacagggtattgttgcagtggagtacgaatcaggaagttatccccgttccattgtgcagcgcctacttgtcgtattattacgatatgtgggtggtgcgcgatgtgttgcgcctgcagatgggtttcgacggacgttacaacaccaagttttacgccccgtcgtataatcccgcacttgcggccttctacaaccaacgcgacgtgcgattgggaaattatccctatatcgacgtgttcgtggcggccaaatggaagagaatgcgcatattcttgaagtaccagcacgcgaatgccggtttgttcggtaacaaccagtatttcaccgttgccggttacccgctcaatccgggtatgttcaagatgggcatctcatggggattctatgattag

SEQ ID NO: 526 - DNA, 2298 bp, Unknown
  Description of Unknown: Firmicutes sequence
tgccacaagaacatggcggtggtattcatcaaccgtattgaaaacggccagtcccaccaggagggactgtgtctcaagtgcgcccgtgagctgcacatcaagcccatcgacgatatcatttccaaaatgggcatcaacgacgaagatctcgacgggctttcctccgaaatgatggaggccatgcagaatctctccggcagcggggacgatcttatgaacattgaaaacgacgacgacagctcggacgacgacgggaagaccgcaacgttcccgttcctcaaccggcttttcggcgcgcagaacgccgccaacgccgaaaatcgcgacagcgctgccgagaccgagcgtccccgcgtcggcaaggacggcggcgagcgcaagcccaagcgcaagtttctcgataactactgcatctcgctcaccgaccgcgcccgcgcgggcaagctcgaccgtatgatcggccgcagcgaggagctcgagcgcgtcatccagatcctcaaccgccgccagaagaacaacccctgtctcatcggcgagccgggcgtcggcaagacggcgatcgccgagggtcttgcgcagcgcatcgcctccggcgacgtgccggcgaagctgcgcgacaagcaggtatttctgctcgatctcacctctctcgtcgcgggaacgcagttccgcggccagtttgagtcgcgcatgaagggtctcatcgaagagatccgccgcgagggaaacatcatccttgtcatcgacgaggtgcacaatctcgtcggcgcaggcgacgccgagggcagcatgaacgccgcaaacattctcaagcccgcgctctcccgcggcgagattcaggtcatcggcgcgacgacgttcaacgaataccgcaagcacattgaaaaggacgccgcgcttgagcgccgcttccagcccgtgaccgtcgccgagccctcgctcagcgacagcgtggagattctcaagggcatccgcaagtattacgaggacttccacggcgtgaagatctccgacgagatgtgccgcatggccgtgacgctctccgagcgctacatcaccgaccgtttcctccccgacaaggccatcgacctcatcgacgaggcgtgctcggacgtgaatctccacaacaaggacatcgagcgcagcgctgagatcaaaaaggaatgcgccgatctcgacaaggagcgtgagcttttgctcagcagcacggcgggcgacggcgactttgaaaagctcgccgagctgcgcagccgcgatcttcagctcaaggatgagctttctcagatcgaagccaagggcatgccggagctcaccgcggacaatcttgcgcacatcatcgagctctggacgaagatccccgcttcaaacattcgcgccgacgagtttgagcgtctctccggtcttgccggacggctcaaggcacatatcatcggccaggacgaagccgtgaacgccgtttgcgccgccatcaagcgcagccgcgcgggattacagtccaagcgcaagcccgtgagcttcatttttgtcggctccaccggcgtcggcaaaacggagctcgtcaagcggctcgccgccgatctcttcaactcccccgaatcgctcatccggctcgatatgtccgagtttatggaaaagttcagcgtttcgcgcatcatcggttcccctccgggctacgtcgggtatgacgaggccggacagctcaccgagaagatccgccgcaagccctacagcgtcgtgcttttcgacgagatcgaaaaagcgcacccggatgtgatgaacatcctgctccagatcctcgacgacggacgcatcaccgacgcgcagggccgcacggtcaattttgaaaacaccgtgatcgttatgaccacgaacgcgggcagcgacaagcgcaccggcagcgtcggcttcaatatgagcgccgacgagcagggcaaggaaaaggctgtcaaggctctcaacgacttcctccgccccgagtttatcaaccgcgtggacgagatcatttacttccaccgtctgacggaggaaaacatccgcgcgatcgcctcgcttatgcttgaggatctccgcaccgcgatggccgagcgcggcaccgccctcacctgggacgagagcgtcatcacctatcttgccgaaaagggctacagcgctgcctacggcgcgcgcaatctccagcgtctcatccagaaggacgtggaggacgccattgctaccgagatcatcgatcatctcaagggcgcggcaaaaaccgtcgggctcaccgtacaggatggaaagatcgtcgttctcgcgatgtaa

SEQ ID NO: 527 - DNA, 1410 bp, Unknown
  Description of Unknown: Firmicutes sequence
atgaagaaatttatcggaaacaaagacttttacaagctggtcgctgcgctcgcgctgccgctgctgctgcagaacgccgtatcgacgtttgtgaatctgctcgataaccttatggtcgggcggatcggcacggaatcgatgtcgggcgtgtccatcgtcaaccagcttctgttcgtatataacctatgtctcttcggcggcacgggcggcgcgggcattttcggcgcgcagtttttcggccgcggcgactataacggcgtccggcatacgctgcgcttcaatatcctgctctgcgccgggtttacagtgatcgccacggtgctgctcgcgctcatcccggatacgctcatcggtgcgttcctgcacgaggcgggcaccggcggcgatctcacgctcacgctttcggaaggcgaggactaccttcgcatcatgctcttcggtctgccggcgttctgccttacgacggcgtatgtgagcatactgcgcgtcaccggcgacaaccgcctgccgatgaaggcgagcatcgcggcgatcttcgtcaatctcgttttcaactatctgctcatctacggaaagctcggcttcccgatgctcggcgtccgcggcgcagccattgccacggtgctctcgcgctatgtggagttcggtctgatcctgctcggcacccacggaaagaaaacgccgccgcggtttatccgcgggctgtaccgcggctttgcgatccccggccatctcgccgggcagatcgtccgcaagggcatgccgcttctcgtgaacgagatgttctggtcgctcggcatgacgatgctcacgcagtgctactcctaccgcgggctggacgccattgctgcgctgaacatcaactccacggtgctcaatctcttcaataccgttatcttcacgatgggcaacaccgtcggcatcatcatcggcaacctgctcggtgcggaggagtatgaccgcgcgcggaattactgcccgaagctcgctgcgctcagctgcgcggccagcgcggcggtcggcgttgtgatgttcctcgtcgcgccgtatgccccgcggctttacaacacctcccacgagatcatgacgctcgccgcgtcgctcatgcgcatctgcgctctcatgctgccggtccacgccgtggtaaacgccgcgtactggaccatccgtgccggaggccggacgtacatcaccatgctttcggacagcgtgttcacctgggtcgtgtcggtatcgatcgcgtgggtgctcatccataaaacgggtctgccgctcgtggaggcgtacctctttgtgaatctcgccgaccttatcaaaatggtcatcggcatcgtgcttctccgccgcggcatctgggtgcgcaacatcgtcaccggcgaggagatcgcggccgggaatgctgcgggctga

SEQ ID NO: 528 - DNA, 1416 bp, Unknown
  Description of Unknown: Firmicutes sequence
atggcagatctgaaaagcgtagttgcggaaaagcttccgctgacgatgggcgagacgatcgccctcgcaaaagaatacggcgtgcgcgtggtggacgttgtcctcacggagagcgagctgcgcaccggtcttgaccgcgaaggcgtgctcaaggccgtcatggaagagtatgcgcacaacctcaaggctgtggagatcggcgtttccggcggaaacagcttcctgctcggcaccgttcccacccagctcaaggaaatgggccccggcaccatctttgcggatgtgctgcttgacaaggcactcatgtacaccgtggccgccgaagtcggcaaccactgcatcggcgtgcgtccgtgcgccggcacgggcgacccctgcccctacaccggcttcctgcgcgcgctgatggatgtcggcaccgacgagaccactctcgccgaggtcgcctgcctcatgctcaaggtcggcagcctgttccgcgtggcgaaggtcaccaccggctgcaatctggaaggctacggcgcgggctctgccgccatcgccgccgcgaccgttcatctgaagaacggcacgcccgagcagatggaaaaggccatggtcctcgccatgtccccgacgatcggcgttccctgcacgccgcgcgtgctcgttccggcgctctgcaccgcccatgtcggcggcgcgatcctcggcggcatgtacgccggccgtctctgcacgaccgtggagatgaccgtcaacgtcccgttcgacgttatgttcgctatggcgtccctcgttcacaaggagagcgcgcaccacatcgtgcccaccgtcgtggagtacatggagcccttcttccagcgcaccgctgaggtcgaatccctcgtttccgaggaagtccacaaggccgacaagaagcgtattgaagagacgctcgaaaaggccaaggagatcgccaagaagatggcggacggctccgcccccatcatcaagacgctcggcgacgccgttgtcggcggttcctctcaggctgtcggcagcccgacgaactgcggccgcatcgcccacgagcttctcaatgagggcgagaaggtcaccgagatcaccatcgaactgtatccggagctcttcgcccgccgcacgatcaacgtgcccggcgtgctcatgggcgcggtgtacggctgctccacctccgactataagacctatgaggtcgccgtggagcgcgtcaaggccgacggcgtcaaggtgaacatcgtccgcggtgaagagtaccagatccagaaggtcactctcgtcaccgataagggcaacagcgttatggtcgatacgctcaaccgcggcggcggccgtctcgtgctgcgcaacgccacgccctctctcgagaaggcgcaggaagccgcgaagaagctcggcatcgttgttgtcgagtaa

SEQ ID NO: 529 - DNA, 1026 bp, Unknown
  Description of Unknown: Firmicutes sequence
atgaacgttctcgttaccggcggcgccggatacatcggcagccacgcctgcgtggagcttctgaacgccggacattcggtcgttgtggtggacaatctcgtcaacgccaacgcggagtgcctgcggcgcgtcgagcgcatcaccggaaagacactcgaataccacgaaatggatcttttgaaccgcgcagctctcaatgagcttttcgatacgcaccggtttgactgcgtgctccactttgccggtctcaaggcggtaggggagtcggtgcagcagccgctgcggtattataacaacaatctcggcacgaccatccacctctgccagacgatggcggcgcacggcgtgaagaagatcctcttctcctcgtccgcgacggtgtattcgccggacaatacgatgcccgtggacgagagcgcccgcaccggcggctgcacgaatccctacggctggacgaagtacatgagcgagcagatcctctccgatacggcaaaggccgacggcgaatggaccgttatgctgctgcggtacttcaaccccgtcggcgcgcatccgagcggactcatcggcgaggacccgcgcggcatcccgaacaatctgatgccgtatatcgcccagaccgccgccggacggcgcgagtatctgagcgtattcggcaacgactatcccacaccggacggcacgggcgtgcgcgactatctgcacgtcgtcgatctcgcgcgcggccatgtcgcggcgatggactatatggcggagcggaagggtgttttcgtgttcaatctcggcaccggccacggctacagcgtgctcgacatggtgcatgcctttgaaaaggcgacggggaagaaggtcccctacaagatcgccccgcgccgcgccggagacgtcgccgaggtgtactgcgacccgggcaaggccgagcgggagcttggctggaaggcggaacactctctcgaggatatgtgccgcgacagctggaactggcagagcaaaaatccgaacgggtttgcggcagacggagagtaa

SEQ ID NO: 530 - DNA, 2334 bp, Unknown
  Description of Unknown: Firmicutes sequence
atgaaaagaaccgcaaagatgctcaccgcggcgctgctcgcgctggcgctcgcgctgcccggcaccgccgccgcggcggacgatacgccggcggtgcgcatctccgaaatgatgtataaaaaccacgcgacactccaggacgccgacggcgatttttccgactggttcgagctggagaatacgtcgaaccgcgtcgtgcgcctcaaggggtggagcgtgtcggacggaaagaccgtctgggattttcccgcggacgcgacgataccgcgcggtggggtgcgcgtcgttttcgcctcacgcaaggataagaccgcggcgggcgaaagccacacgtcgttcgcgctcggcgagggggagacgctgtatctcatcgcgccgggcgggacgatcgccgaccgcgccgcgtgcgatcccgagctgcccgccgaccatgtgctgcggcgcgaaaacggcggcgagctcaccgaaagcgtctgggcgacgccgggatacccgaacaccgccgcggggtacgcggcgttctgcgagagccgcaaaacggaaagcccgctcgtgatctatgaggcggcggtctataacgacacgttcgctctcaagggcgagtattacgactgggtcgagataaagaacgtatcgaaagagagcgtgaagctctccgactactgcctttcggacgaccggcgggagctggaaaaatggtcgcttcccaaccggacactcgcgaaaggacagtcgatcctcatctactgcaccggcgaggagaacccgacgaccggcaacggcctgcgggcgaatttcgcgctcaacgcttcgagtgaaacgctctatctcacgaagaagggcgagagcgcggcggcggacttcgtctggctgcacgatatcccctacgggtacagcatgggccgcacggacgccgaaaacggctttttctatctccgcaggcagacgccgaacaagccgaacgagaccgacgcttaccggtatatctccgaagcccccacggcgaaccgcgaatcgggggtcttcgaagcggggcagaccgtgcgcgtgaagctcgccgcggcaggcgatatttactatacgaccgacggctccgcccccacggaggagagcacgccgtacaccggcgcgatcaccgtggacaaaacgaccgtccttcgcgccgctgccgtggaggagggcggcgcgccgtcgcgcgcgctcacgctcagcttcttcatcggcgaggagcacacgctgccggtgctcagtcttgtgaccgactcaccccgacggttttccgaaacatataacggcgccgtaaagtaccgcgaatgcgcggcgaatctctcgcttctcgccccggaaggcggtttttccatcgactgcggcgtggagctcaaggggcgcaccagtcttttcaacccgaaaaagagcctcggcgtttcgttccgcggctgctacggcgcggagacgctccgatacgacatcttcggtaaaggcccggcggagttcaccgagctttccatccgcgccgggcaggactatatctccacggtgttccgcaacgagctcatgcaggagctgtgtgccgagctcgatacgaccgtgacgcagcgcagccgctactgcgtgctgtacatcaacggcgaatactggggcatctactgtctcaaggacgatatcacgcggcagttttatgccaatctcaccggcacggcgaaggaagatgtgacgatgctgccctcgccggtgtcgcagagcacggcggtatataccgaggcgctcggactctggcaggacacctcgctcacacgccgggaagcctatgagcgcttctgcgaggccatggatatggacggcttcatcgactgggtgctgctcgagggctactgtgcaaacgtagacatcaagagcaatctccgttatttccgcaccggcgacgagccgtggcagatcgccttctacgatctcgactgggcgttccagacgaggagcaactgctttttcaatctcatcggctcggagcagaccgcgcagatcgccccgacgatccgctggctcttcggcatcgacgactttaaggagcggcttctcacgcggtacgccgagctgacggaaacgacgctctcggacgagcacgtcacggagaagatcgacggattccgcgcgctgctcgcgccggagatcgcgcgggagcgtgcgcactggggcggcagcgaggaaggctggaacgaacaggtggacgcgctgcgcgcgaacattgccgacgactacgccgcccacaccgtccggaacctctgcgacgctctcggcgtgggcgaggaggaacgcatggagtatttcggcttctga

SEQ ID NO: 531 - DNA, 2271 bp, Unknown
  Description of Unknown: Firmicutes sequence
ttggatttgaaaaccgatgcgttggtcgaaagactcgtcaacagctatggcagctgggtgcagaaggactgcgaaaataccgaaggcggtaccggacgctataccagggagctctggccgtatgacacgatgttctcccccatccaggtcaaccgtctgacgatcaagaatcgtcttgtgatggcgccgatgggcaactgccagatggcggaagagaccggccgcccgaacgacaaaatgcgcgagtacttttttgcccgcgccgaaggcggcgtcggccttctcaccacgggcctcatccccatcagccaccacatcgactcatccgtgacggaaaagggcaacttctcctacttcccccgcatcgacaacacccgcaccaacttcatgggctggcgcgatctggcgcagggcgtccacgcgcgcaacagccgcattttcatccagctcaccgccggtctcggccgtgtcggcaacccgcagtgcctcatgacgaagtacgcgctgcccgtgtccgcctcctggaatccgaacttctatattccgagcattccctgccgtccccttaccgaccttgagctggaccagatcgtccgcaactttggtcagggcgcagcagacgccaagacgatgggcatcgacggcgtgtatctgcacggccacgagggctatctcatcgatcagctcaccaacaccgcgttcaaccaccgcaagctcggcaaatataccgactggcagctcttcggtatcaacatcgtcaaggagatgcgcaagcgtaccggtccgtggttcccgatcatgtaccgcatcgatctgagctgcgctctcgaagagacctacggcgagcgcatggacaccgtttcctccctcaagggcttcaagaacggccgttccatttatgaaacgctcgactatatggaaaatctcgtcaaggcgggcgtcgatatgttcgacgtggacctcggctgctacgacaactggtggctcccgcatccgcccgcgtacatgcccgccggctgcttccttgacgtggcgaaggtcgccaaggaatacttcaaggagcgcggcgtgaagtccaacgccggatttgaggttcccatcgtcgctgtcggcaagctcaactatcccgatatggacgagaaagccctgcgtgacggcaagtgcgacatgatcatgctcggccgcccggtgctcgccgatcccgactggtgcaggaaagcctatgcgggcgacgtggaccagatccgtccgtgcatcggctgtcaggaagcctgcgtcaacgagttcgtcgagggaggtcacccgcagtgcgccgtcaacccgcgcaccggccatgaggacgtgctgcccaagcagtccgcgcccgctgtaacggcgaagaagatcggcgtcgtcggcggcggccccgccggcatgaactttgccatctacgccgcgcagcgcggccacaccgtcgagatccttgagaaaacgagcgagctcggcggcattgcgaacgccgccgccgttcccaaaaataagtacgacatgcacaactatgtcgaatggctcaagcgccagacgctcgggcagaagggcgttgcggtgaagttcggcgtagaggccacgccggaatatctcaaggcgcagaactacgacgccgtgatctatgccgtcggcgccaagcgcatcagcccgcgcattcccggcatcgacaccgtgaacatggtcgaagcgaccgagcttctgcgcaatcccgaaaagctcggcggcgcgaagaaggtcgttgtcctcggcggcggcgcggtcggcatggagaccgcctactggctgagctacgagcacggctgcaggatcaccgtgatcgacatgctcggcaacttcatggacggcgcctgcaccgccaaccgcggccacatcatccactatcttgaggataacggcgcgaagctcgtcaactgcgcgacgatcaagtcgtttgagccgggcagggtgctcgtcagccgcaacatctccaagggcgcgccggacgtttactgcacctggacgccggttctgccgaagaacgtcgtcaacccgcttgcgccgaagatgggtcccgaaacggtcgtcgaagagcaccacgcggagctgttcgtcaacgcgctcggccgccgcgccgacgagagccagtatctcgagggcgtgaagcagcatgtcgccaaggagatctacaacatcggcgattccttccaggctggcctcgtctggggcgctaccaaagctgcctacaacctcgcgcagtacatctga

SEQ ID NO: 532 - DNA, 2091 bp, Unknown
  Description of Unknown: Firmicutes sequence
atgcagaaaatggtaaaacccatccggctcgttgtgctcgccgtcgtctttgtgctgctgctcggcgtttacttcgtcgcgctttataagctgcagatcatcggcgggcgcgaatactacgccgtaggggaaacggagacgaaagaagacatcaccatcgccgcggcgcgagggaacattctcgaccgctacgggcgtctgctcgtgtccaactcgctctgcaacaacctgtctatcaacgtaacggagctcttcagccaggacgacccgaacgcggtcattctcgagctgtgcagcgccgtggagcgcttcggcgacacctataccgacacgctgcccatcacgaaggccccgccctttgagttcaccgagatggacacgctgcagaagagcatgctcgacgcctggctcaaggcgaacgacatgccgctcgactccagcgccgtggagatcctcgcggcgatgcgcacgcgctacagcgtcggcagcgagtataacgccgaggacgcccggcgcatcgtcggcgtccggtacgagatcaacgaccgcttcaacatcaacaccacgccctacgttttcgccgaggacgtttcgatgccgctgctcacctatctcatggagcaggacatccccggctttgagctctcctcctcctatgtgcgcgaatacaaaacgcagtacgccgcccacctgctcggctacaccggcaagctgacggcggaggaatgggcgacctacgccggcaaggactactcgctcgacgcctatgtcggcaaggacggcgtggaatacgcctttgaggattatctccacggcgtggatggcgaggcggaggtctactccaatctcgacggcgtcacgctccgcaccaagtacaccaaggagccgcagcccggcgggcatgtctatctgacgctggacatcggcctgcaggaggtgtgcgaggaggcgctcgccgcgcacatcgagtcgatcaacgaagatcgcgcccgcatcattgcggaagccgaaatgtacggcaccgagagcaccgaaatgatctccggcggcgcgctgtgcgtcgtcaaggtcgataccggcgagccgctcgcgctcgtgagctatccgacctacgacgccgccacgatgctggataattacgaaacgctcgtcgcggacgagaacgccccgctctataaccgcgcgctcatgggcgtttacgcccccggctccacgttcaagccctgcaccgctacggcgctgctcgccgagggcatcatttccccgacgcgcacgctgaagaccgaaggtcagttcaccaagtacatcgacgacggctacgcccccgagtgctggatctactcgacctacaaatacacccacggcgagatcaacgtcgtgcaggcgatcacctactcctgcaactacttcttctactatttcggcgacgagctcggcatcgacaagatggcgtactacgccaagctctacggtctcggcgagcacaccggcatcgagctgcccgaggtcaccggccagatgtccacccagagcttcaaggaacagtacaccggtatctcctggttccagggcgatacgctgcagagcgccatcggccagtcgttcaccgaattcacgccgctgcagatggcggagtattgcgcagccatcgccaacggcggcacgcgccacagcgcctccattctcaaggaagtgcgcagctacgattactccaaaacgctcttccagcgtgaaacggaagtgctcagcaagctcgatatcgatcccgagatcttcggctacatccagtacggcatgtacggcgtgctctatgacgccgcgagcacgctcaaggagcattggctcgacagcagcatcgtcgccgccgccaagaccggtacggcgcagcgcggcgaaggtctcgtcaacaacgccatgttcattctctatgccccctatggcgataaccccgagatcgccatcgcgatcgctgtggaaaaaggcggcgcgggcgccacgctctcgccggtcgcgcgaaagatcgtggattattacttcacgttccagtccagcgccaacactgtggaaaatgcgtattctctgctgaaataa

SEQ ID NO: 533 - DNA, 1731 bp, Unknown
  Description of Unknown: Firmicutes sequence
atgggagctttttctgttgcacagcggcagatcggcggttataatgaaagtcgcaaaaagcataacatgcaacagtatatatatacggaggttgacgcgatcatgtacgataacggcaaaatctatctcggtctctccggcgaggagcgggtggagcttcccctctccatgtgcaaccggcacggcctgatcgccggtgcgaccggcaccggcaagaccgttacgatgaaggtgctggcggaatccctctccgatgcgggcgtgcccgtcttcctgtgcgacgtgaagggcgacgtcgccggtatctgcgcccccggcgcggacagcgaggatatgcagaagcgtatcgagcgctttgccctcaccggcaaatttgcctaccgcggctaccccaccacgttctgggacatttaccagaccggcggccatgccgtgcgcgccaccgtgagcgaaatggggcccgagctgctctcccgcattctctgcctgagcgaggcgcagacgggcgttctgcagatcgttttccgcgttgcggacgaccgcggactgctgctcgacgatctcaaggacctgcgtgcactgctgaactatgtgaacgaccataaagaagattaccgcatgaagtacggcaacatcaccacgcagtccgttgcggcggtcctccgcgcgctgctgccgctggagaaagagggcggcgagctgttcttcggcgagccggcgctcgacgtgaaagactggatccgcaccgacgccgagggacgcggcatggtcaacgtgctcgactgcgtcaagctcgtgcagaacccgacgctgtacgcgagcttccttctctggctgctctcggagctgttcgagaccatgccggaggtcggcgatcttgaaaagccgaagctcgtgttcttcttcgatgaggcgcatatgctcttccgcgacgccccggcggtgctcgtgcagaagatcgagcagaccgtgaagctgatccgctcgcgcggtatcggcgtgttcttcgtgacgcagagcccggcggacgtgccgaacaccgtgctcgcgcagctttccaaccgcgtgcagcacgcgctgcgcgcctatacgcccaccgagctgaaagcggtgcgcgtggcggcgcaggcgttccgcgaaaacccggcgttcaacgccgaggacgcgatcatggagctcggcgtcggcgaggcgctcacgtcgttcctcggcgaggacggcatccccgccatggtgcagcgcacgaagatcatctgcccgcagagcctgatgggtgcgccggaggcgatgacgcgcgccaaggcgatcctccgcgacggcatggaaaagtacgacgaggcggaggacaatgtctctgcttatgaggtgctcgccgacgaatcgcaggccgcggaggaggcgctcgcgcaggagcgggagcggctggaagaggaaaagcgcgccgccgaagaggaaaagcagcgccggaagcaggcggaggcagacgaaaagcgcgcgcagaagctcgaagacgaagcgcgccgccgcgcgcagaagctcgaggatgaggagcgccgccgcgcccagaagctcgaggacgaggcccgccgcaaggccgagcgcgaaaaggagaaaaaggaagcggaggaaaagcgcaaagccgaacgcatccgctccaagatcgaaacgcagctcatctccgccggcggccagatgctcaagcgcggtctgctcggtatcctgaaaaagtaa

SEQ ID NO: 534 - DNA, 1197 bp, Unknown
  Description of Unknown: Firmicutes sequence
atgccccggacgccttttgctttatccgggctgcagcgggcggaaaggagaatttttatgtacatcaagccgtttgccgtagaggaatggatgaacgaatgggaggtcggcgcgcgatacaacatcgcggagacgtgcgtcgattccgtgtcgctcaacgagctgttcgcgctgaccggcgaggacaaggccgcctttctggagaatctcgccgcgcgccggctgacctacggcgacattgaaggcgcgcccgcgttccggcagggcatctgctcgctttataaaacggtcaagcccgaaaacatcgtcacaacgcacggcgcggcgggcgcgaaccaccatgtgttctgctcgctcgtatcgccgggtgaccgcgtcatcagcgttctgccgacgtaccagcagctctactccatccccgaatcgctcggcgcaaaggtaaagattctccccctgagccgcgaaaacgggtatctccccgatcttgacgcgctgcgcgcgctcgccgtgccggggacaaaaatgatctgcatcaacaaccccaacaatccgaccggcgcgctcatgagccgcgatatgctcgaagagatcgtgcagatcgcgcgcgaggcgggcgcgtacattctctgcgacgaggtataccgccatctctcccagaccgacgagtggagcgagtccattgcggatctttacgaaaagggcatctccgtgagcagcatgtcgaaggtcttctctcttgccgggctgcggctcggctggatcgccacgcgcgacaaggacgcgctccgcgcgctcgtctctcaccgtgattacgatctcatcagcggcggcatgatcgacgaggccattgccgcgctcgcgctcaagcacagcgataaaatgctcgcgcgcagccgcgccatcgtgcgggaaaatctcgccattctggacaattgggtcgccggagaaaagcacgcgagctacgtcaagcccctcggcggcacgacggcgctcgtctactacgatttcgacattccctcctatgagctgtgcgaggagatgtaccataagaccggtgcgttcgtcacgccgggcgactgctttgagcagccgaagagcatgcgcatcggctacgcctacggcaaggaagcgctcgtgaaagggctgaaggccgtgagcgagtactttgcgtggaaggaaaaggagctggaaaaatga

SEQ ID NO: 535 - DNA, 1830 bp, Unknown
  Description of Unknown: Firmicutes sequence
atgtgtggaattgtaggatttaccggctcgcaggcggcggctccgctgcttctggacgggctgcgcaagctggaataccgcgggtatgacagcgccggcatcgccgtgcagaaggacggcgcgctgcatatgatcaaggcgtccggccatatcgacgcgcttgcggagaaaacacaaaacggcacgctgctgcccggcacttccggcatcggccacacccgctgggcgacgcacggcgcgcccaccgacacgaacgcgcacccgcatatgtccgccgacggcaaatttgccatcgtccacaacggcattatcgaaaactacgcagcgctgcgcgacgagcttaaaagcaagggcttcgtattccggagcgagaccgacacggaagtcatcgtgcatctgctcgacatgtactataccggcgatctcaaggccgccgtgctgcacaccgccgcgcggctcgagggctcctatgcgctcggcgttctctgcgccgaccagccggggacgatctgcgccgtgaaaatggcctcgccgctcattctcggcgtgggcgtcggcgaaaatttctttgcctccgacgtgaccgcgctcgtgagccacaccaaaaacgtgatctatctggaggacggcgagtttgctgagataacgcccaactccatttccatttatgacagcaccggcgcgacggtgcaccgcagcatttcccgcatcgtctgggatatcgaagccgcggaaaagggcggctacgagcactttatgctcaaggagatcatggagcagccccgcgcgctcaaggcgaccatcgccccgcgcatcaagaacgggaagatcgtcctcgacgattttgacgaggcgttccgcgccgacttccggtacatcaaccgcatcgtcatcaccgcgtgcggcagcgcatatcacgccgggtgcgtcgggcggtacatgatcgaatcgctctgccgcgtgccggtggaggtcgatgtggcgagcgagctgcgttaccgccacccgatcgtggatgagcacacgctgctcattgccgtttcccagtccggcgagactgccgacaccatcgccgccatccgcgaatgcaaggcgcacggcgcgcgcgtgctcacaatcgtcaacgtcgtcggcagcaccgtggcaaagctcggcgattatgtcatgtacacctgggccggcccggagatcgccgttgccaccacgaagggctacaccacgcagatcgccgtgctcgatctgctcgccgtatggatggccaacgagcgccggacgctcaccgcgccgcggtacgccgagctcgtcgccggcattgcggacctgcccgagcgcacgcagcgcagcattgacctgaacccgcaggtcagctatcttgccgagcgctactgcggcaacagctcgctcttcttcatcgggcgcaacatcgactacgccgtcgcgcttgaagcctcgctcaagctcaaggagatctcctacatccactccgaggcgtacgccgccggagagctcaagcacggcaccatcgcgctcatcgatccgggccgtctcgtcgtttcgctcgcgtgctacgaggaactgtttgacaagacgatgtccaatatcaaggaggtcaaggcgcgcggggccaaggtcctcgccgtggtgaacgagggcaaccgccgtgtgttcgccgaggcggacgacgtgctctttgtccccgtgaccgacccgctcttctccgccattccggagatccttcccctgcagcttttcgcctaccatgtcgcccggtgcaacgggtgcgacattgataagccccgcaatctcgccaaatccgtcaccgtggagtga

SEQ ID NO: 536 - DNA, 1986 bp, Unknown
  Description of Unknown: Firmicutes sequence
atgagattcgctcttgccggaaaccagaactgcggcaaaacgacgcttttcaatcagctcaccggaagcaatcagcacgtcggcaatttccccggcgtcacggtggacagcaaaagcggcagcatccgcaacacgaagggcgacgaggtcgtcgacctgccgggcatctattcgctgcggccctattccgccgaagagatcgtaacgcgcgatttcattcttgacggccggcccgacggcatcatcaacatcgtggacgccacgaacattgagcgaaacctttatcttacgctgcagatgatcgagatgcaggtgccgatggtgctcgcgctgaatatgatggacgaggtgcgcgccaacggcggaacggtcgatactgtgaagctctcggagctgctgggcatcccggtcgtgccgatcagcgcggcaaagggcgaaggcatcgccgatctgacggagctcgcctgccgcacggcagccacggggcgcaagccggaggtatacgacttctgcccgcccggaccggtccaccgctgcatccacgccgtgacgcacgtggtggaggatcacgccgagcgcgcccggatgagcgcccgctgggcggccatgaacgtgatcgaggggaatagcgatatcgtcgcgcgtctcgcgctcgacgagaacgagttggagctgtgtgagcacagcatcgtggaaatggagcgcgaaacggggctcgcccgcaatgccgccattgccgacatgcggtattccttcatcgaatcggtctgcgccgaaacggtgaaaaaacccgaggagagccgcgagcggaaacgttcgcgcgccatcgataacgtccttacccaccgcatattcgccctgccgatctttgtcggcattatgctgctggtcttttatctcacgtttgaagtgatcggcgcgtttttgtccgacctgcttgccatggggatcaacgcattggcaggagtgacagacgcggcgctcacggcttacggcatcaatccggtcgtacactcgctcgttatcgacgggctgtttggcggcgtcggcaatgtggtgagcttcctgcccatcattgtagtgctgttctttttcctctccatgctggaggacaccgggtatatggcgcgcgtcgcgttcgtgatggacaagctcctgcgccgcatcggtctttccggaaaaagcgttgtgccgatgctcatcggctttggctgcaccgttccggcggtcatggcaacgcggacgctcacgagcgagcgtgaccgccgcatgaccgtgcttctcacgccgtttatgagctgcagcgccaagatccccatctattccgtgttcgtcgcggcgtttttcccgaagtataaggcgctcgccatgggcggactgtacgttttcggcatccttatcggcgttctggcggcgctcgtgttcggaaaaacgctctttcgcggcaaccccatcccgtttgtgatggagctgccgaactaccgcatgccctcggtgcgcacaacgctccagctcatgtgggacaaggcgaaggactttctccatcgcgcctttaccgtcattttcgtggcaagccttgtgatctggtttttgcagacgttcgacacgcgcatcaaccccgtttcggacaattcgcagagccttctcgccgcgctcggcggacttctcgcgccgctcttcgcgccgctcggttttgcggactggcgcgtatgcacctcgctcatcgcgggctttatggcaaaggaagccgttgtcagcacgctcggcgtgctcaccggcggcgcggcgctctccacgcttttctccgtgcgcagcgcggcggcgtttcttgtgttcacgctgctctatacgccctgcgtggcggcggtcgcggcgatccggcgggagcttgactcggtgtggaaaacgttcggcgtcgtggtgtttcagtgcctgctcgcctggggactcggcgcggcggtctaccagatcgcactgcttatttga

SEQ ID NO: 537 - DNA, 3246 bp, Unknown
  Description of Unknown: Firmicutes sequence
atgagcggagggaataccatgacaaacgcaaaagaaaaaaagaagatcgtcctctggctgatcgtactggcaatactcgccgcggcggcattcacggtcacggccattgtgcgccataaccagcgcccggcatgggacggcggctacagcgtccacatcagcgaggtcatgaccgataataagacctgcccgaacggcgagggtgtcctctgcgactggatcgagatcgaaaacacgtcctcgaaggacttctccatcggcggatactatctctccgacgagacgggcaaaggcaaatactgcttcccggcggggacggtcgtcccggcgcggggatatctcgtcgtgtggtgctcgccggacgaggagggcgactatgcgccctttgccctgcgcaaggcgggcggggagacggtgtgccttatgaacgaaaaccgcacggtgctcgacagcgccgtgaccgctgcgtgccggagcgggcagtcgcttgtccgcggcagcgacggcgcgctcattcccgctgatacgccgacgcccggctacccgaacagcgaggcgggcgcaaaggcgtggcaggaggcgctcgcgcagcgcagcggcggcacgcttgagctcagcgagatacagtcctcaaacacgctctatgccgcgcccgacgggaatttctacgactggatcgaggtacataacccctcggattcgccggtatctctctccggctacaagctctcggaccgcacgaacaaaacgaagtacgccttcccggacgaaatgctcggcgcgggcgaatataagatcatatggtgcgcccccggtgtggagggcgcggaatatgcgtcctttgcgctggcgagcgcgggcggggaaacggtcgtgctcacagcgccctccggcgcggagagcgagagcgtggaactgccgatgctggagaagaacacggcctatgccaaggaaaacggtgaatggacggtgtctcaccgcccgacgccgggatattccaacgacgacgcggggtatgaggcgtggctgcgttccggcggctacgaaaacgacgaagtttacatcaccgaggtcatggcgcaaaaccgcggtacgctcgccgacagcgacggcgacctctccgactggatcgagatcgcaaacctcggcgagacgagcgttgatcttgcgggctggtatctctcggacgatccggacgtgccggacgaatggaagatcccgtcgctgacgcttgcgccgggcgagtatgcggtgatcttcgcctccggcaagaaccgcaccgagggtgagcttcacacgagcttctcgctcaccgacagcgacacggtcattctctccgccggaaacggcgcggagatccgcagcgtgaagatcgaggccgtgccggagggctcttcgctcgcgatgcagccggacggcagcttcgccgtgaccgacttcccgacgccggggcttgaaaataccgccgatggctacgccgacttctgcgatgccgacacgcgcacatcgccgcttctgctgtgggagatcgtcgtgtacgaggcgggttcgcccgactgggtggagctcaaaaacgtgtcgggcgagtcgatcgatctttccggatacacgatctcggataaattcaaggaaccggcactcgacgccctgcccgccgtgacgcttgcgcccggcgaaagctatgtgttcgagtgcgaaaacgtggggctgagcgcgcagtgcgacgagctctatctcttcgatgcttccggcacgctctgcgactgggcgttcctgcgcgatatcccggccggcggcagctacggccgtctaaacggggagaacgggtatttctattttgcgcagagcagccgcggcgcggacaacggcacggggtgccgcatggtggcggcaaagcccacggtcgatatcgccgcgggcgtgtacgacgacgccgagagccttacgctgacgatcaccggcgagaacgtgcactatacgctcgacggcagcgacccgacggcggacgatccggcttataccgcgcccatcacgatcacggaaacgacgatcgtccgcgccgcgagcttcccggcggacgcgctgccgggcaaagcggcgacatggtcgtatttcctgcgcgagaacagcacactgcccgtcgtcagtctcgtgaccgacccggacaatctcaccggcgcgcagggcatttactccaaccacgaacgcgcgtggagcgagaagtgggagcgcgaggcgaccgttgccatgtacgaggacggcggcgagttctccattgactgcggcatccgcatgcacggccgcacgagccgccgtgtgagcgaaaagaaatcgttcacgctcaagttccgcggccggtacggcggggatctcaattacgacgtgttcggcgacggcgtcgtaacggacttttcctcgctgctgctgcgcgcgagcgtggaggatacctacacctcctacatgcgcgacgagttcttcgcccgcatcgctatggactatacggatgtgcccgtgcagaattaccggtatgtttcgctcttcctcaacggcgagtactggggcatttacgccatccgcgagcaccacagcgcggaatatttcgcctcgcacaagggcgtggacgccgacaccgtcgatatgcagacgggcgagtttgagggtcagaccgcgtggagcgagatcctgaactacgcgcgctacaactcgctgagcacgccggagggctgggcgtacatccaggagcatgtggacatcccggagatgattgactggctgattctcgagtgctggtcgggcgatatcgacgtatacgaaaacgtccgtttctacgcgagccccgagtacgaaaacgggaagtacatttacggtctcgcggacatggatctcacgatgatgggcatggactcgatgagcgtcggcttcaacaacttccagctccacggcatcattccctcggcgctgcgttacaatgaagagttccgcgacatgttcctgacgcgtctcggcgaaatgctgcgcgggccgctctcggacgagaacgcgcagaaaacgctcgatgagctgcgcgcgatcgtcgagccggagagtgcgcgcgatctcgcccgctggggcaagtcgtccacgttgtttgccacgcagatggcgaatctccgcggcttcgtctccggccgcgccgcgcggatgcagaacgaggccatcgccttcttcggcgtctccgccgaggatgccgccaaatacttcggataa

SEQ ID NO: 538 - DNA, 1383 bp, Unknown
  Description of Unknown: Firmicutes sequence
atggaggaaacaaacagcctggcccggtcccgacgcatgggcgaaatgccggagggaaagctgctgctgtcaatggcagtgcccatgatgctctcgatgctggtgcaggctctctataatattgtggacagcgtatatgtggcgaaggtgtcggaggactgcctttcggcgctctcactcgcgttcccggcgcagaacattctcatcggtcttgccaccggcacgggcgtcggcgtttcgacgatgctctcccgcgctctcggcagccgggacaataagctcgccaaccgcgtggcgggaaacagcctgttcctctgcgtgtgctgctggattattatggcgatcttcggtattttctttgccgacgccttcatccactcgcagacggatatcgagtccatccgcagctacggagattcgtatctgcgcatcgttacgatcggctccgtattcgtgtattttgagatcaactttgagcgccttctgcagtccacgggccagacgaagctctccatgtgggcgcagataatcggcgcggtggcaaacatcattcttgacccgttctttatctacggctggtgcggcctgcccgcgatgggcaccaccggcgccgccatcgccacggtcatcggccaggcgttcggcgcgctggcgggctttctgtttcacctcaaacataataaagaagtcaatatccgtctttccgactgccgcccggacgggcacatcatcctcgacatctatcgcatcggctttccgtccatcctcatggtcggtatcggttcccttacgaactatctcatgaaccgcatcctcatggcgttcacgtccacggcggtcgcgttgtacggcgcatacttcaagctgcagagcttcttcttcatgccggtgttcggactgaataacggcattgttcccatcgtcggctataactacggcgcgcggaaaaaagaacgcatttaccggacgatccgctacggcgtgctgtatgccgtgtgcatccttgctgtcggcctgctgctctttgaagcgattcccggcgtgctgctgcaggcgttctcgccgtcggagcacatgcttgccatcggcattcccgcgctgcgcaaaatcgccatccatttcccgatcgcggcgttctgcattgtgggcgggtcggtctgtcaggcgctcggcaagagtctctattcgttcttcacgtcggtgctgcgtcaggtcgtggcgctcatcccggcggcatatcttctgtcgctgacagggaacgtcggcaacgtatggtggtgcttcccgatcgcggaggtcgtatcggcgtgcgcaacggcgtttttcctgcgccgcgcgctgcgaaatatggaccgggagctgacgttcgcggaggggcaatga

SEQ ID NO: 539 - DNA, 1503 bp, Unknown
  Description of Unknown: Firmicutes sequence
caaaagacctttgggaggtttatccgtatggacaatacatggtttgagaaaatggaagagcgcatcccgcgcggcgaggtacgcacccgcttcgcgccgagccccacggggtatatgcacgtgggcaatctgcgcacggcgctctacacctggtgcatcgcccgccacgcgcacggcaagttcctgctccgcattgaggacaccgaccagtcccgccaggtagagggcgcggtcgaggtcatttataaaacgctgcgcgactgcggtcttgaccacgacgaaggccccgacgtcggcggtccggtcggcccgtatgtgcagaccgagcggcgcgacacctatcttccctacgccaagcgcctcgtggagcgcggccacgcctattactgcttctgcgacaagaccgaatccgaagaggactccggcgacttcactcgcaaggacgacccctgccgcgatctttccgcggaagaggtgcagcgccgtcttgacgccggtatgccgtgggtcatccgccagaagatcccccacgagggcgaaacgacgttccacgacgagatcttcggcgacatcaccgcgccgaacgccgatctcgacgatcaggtgctcatcaagcgcgacgggctcccgacctacaacttcgcaaacgtcattgacgatcatctcatgggcatcacccacgtcgtgcgcggcagcgagtatctctccagcgcgccgaagtacaaccttctgtacgaggggctcggctgggacgtgccgagctacgtccactgctcgcccgtcatgcgcgacgcgcacaacaaaatgtccaagcgccacggcgacccctcgtacgaggatcttgtcgcgcagggcttcctcaccgaggcgatcgtgaactacgtcgcgctcctcggctgggcgcccggcggcgagcgggagatcttttcgatcaacgagctcgcggaggcgttcgatatgtcccgcatctcgaagtccccggccattttcgatatcgaaaagctcacgtacttcaacagcgagtacatcaaggccatgtcccccgaggcgtttgcccgcgccgccgagccgtggatccgcaaggccgtcaagaccgaaagctgcgatcccgccctcatcgccgccattttgcagcagcgcaccgaaaagctctcggacattcccgaaaagctcggcttcttcgatacgctgcccgagtacgacaccgcgctttacgtccacaagaagtccaagtgcgacgagactgtcgcgctcgatatgctcaaaaagatgcgcccgcgtctcgcggccatcaccgactggacggaggaggccgtgcacgactgtctgatcggcgcggcggcggaattcggctgcaagaacgctctcgtcatgtggccggtgcgcatcgccgtttccggcgaggccgtgacgcccggcggcgccgtggagatctgccatatcctcggccggaccgaaacgctcgcgcgcatcgacaagggcatcgagaaactggaaaaatga

SEQ ID NO: 540 - DNA, 1251 bp, Unknown
  Description of Unknown: Firmicutes sequence
aattttatggaagaaagacgggaaacgaatccccgcgtaaacttccttatcaacattgcgtactgggcggtgatcgttgcgatcatcttcctggtgttcaagtacctcatcaacataatgatgccgatcttcctcgcgttcattttcgcggcggtcgtgcgtccgatctcccgcgcgctgagccgggaaacgcgctatgtccgcggcaaggacgggaacaaggtcctcgtgaagcggaaattccatatgaaccgcaatgtggccggcatcatcagcgtgcttgttctgttcatcgtcgtcggcggccttctgacgctcatcgtcgtccgcctgaccgatacgatcgtggatttcgtgtcgttcgcgccgacgttttatgaacagagcgtcctccccggcatcacaaagctctataactgggtgctggaggtaggcgaacggttcgatgtgtccatcatggacgctattgagcaggccctgcccggcatgatctccaatcttggcagcgcggtcaccaacctctccggcaagatcgtcagcggcgtcaccggcattgcgagccgcctgccgagcatattgctcaacagcatcatctgcctgatcgccacggtctttatttccgtggactttgaccgcatcaggctcttcattcggaaaaacctgcccgaaaaaccgctgcgcgttgctgtgaatgtcaagaactcgttccttgagatgatctggcagttcatcaagtcctatgctatcatcttctgcatcaccgtggcggagatcaccgtcggccttctgatcgtcggcgtggggaacccgctgcttttcggtatcctcatcggcatttttgatgcgctgcccatcgtcggcagcggcatgatccttcttccgtggtcgatcatcacgcttctcaccggcaacacgatgcgcggtctcggcatcctcatcatctatgccgtcgttgtaatcgcgcgccagatcattgagccgaagatcgtcggcaagcacgtcggtctgcgcccgatcgtaacgctcacgtgcatgtacgccggttccaagctcttcggcggtcttatcggtctttttggtctgccgatcaccgccgccattatcatggatctcaactcgagcggtattttccatatcttcaactccgtgggggatgacctgaacgacggggacgaaacgggagccggcgaagcggaaacaggcgaagccgggacgaacgaatccggaacggacggagagaaaaacgcatga

SEQ ID NO: 541 - DNA, 2781 bp, Unknown
  Description of Unknown: Firmicutes sequence
atggataagcagaccaagtccggaatgcctgtggacgaaagcaagtattcctttacgatcccccgcacggacgagccgagagagaagatcctcaagctcggcgcgatgatcaccgaccgcatcggcaaggtcacgggcaacgatcccgagtattggggactcgcgggcgttgttacggacgaaatggcagatgtcgcgctcaagatgaaggtgcgcaagccgaaaacgaccgcgcagatcgccgcgctcaccggcaaaagcgaggaagagctcgaaaagctgctcaccgagatggcgtacatcggccttgtcgagtacaactgggaaaatctggacgggaaaaacccgaaccacgagaagcgctggacgctgccgcagttcgttccgggcagcgcggagttcgtcaacatgcgccagtcgcagatcgacgagcacccggaggtcgcggcgttctttgagcgcatgacgttcctcccgctggagaaggtcacgccgatggtgcctcccggaggcgccggcatcggcatgcacgttatccccgtggaaaaggcgatcgagaccgagaacaagtccgtctccatcgagcacatctcccactggctgaaaaagtacgacggtgtttacgccgcttcgccctgctcctgccgtatgtcccgcgccaagctcggcgagggctgcggcgacgatccgcaggactggtgcatcgccgtgggcgatatggcgcgctacgtcgtcgagaccgaccgcggccattacatcacctatgacgaggtgctcgagatcctgcacaaggccgaggagaacggctttgtccatgagatcacgaacatcgacggcgaagagaagatcatcgccatctgcaactgcaacgtgaacgtctgcaacgcgctgcgcacgagccagcttttcaacacgccgaacctctcccgcagcgcctacgttgcgaaggtcgagagcgaaaactgcgttgcgtgcggccgctgtgttgagacgtgtcccgcgggcgcggtgaagctcggccagaagctctgcacgaaggacggccccatcgagtacccgcgccacgagctgccggacgagacagcctggggcccggataagtgggacgtcaactaccgcgacaacaaccgcatcaactgctacgataccggtacatccccgtgcaagacggcgtgcccggcgcacatcgccgtgcagggctatctgaagctcgccgcgcagggcaagtaccgcgaggcgctccagctcatcaagcgcgaaaacccgttccccgccgtatgcgggcgcatctgcaaccgccgctgcgaggacgcctgcacccgcggcaccgtcgaccaggccgtcgccatcgacgaggtcaagcgcttcattgcccagcaggatctcgaagccgccacgcgcttcatccccgaaaaggtcatcccgaaggtcgagggcggattcgatgagaagatcgccatcatcggcgcggggccggcgggcatgtcctgcgcgtacttcctcgccgagaagggctaccgcccgaccgtgttcgacaaatctccccgtcccggcggcatgctgatgaacgccattccgaacttccgtctcgaaaaggacgttgtggaggccgagatcgacattctgcgcgagatgggcgtggaattccgctgcggcgtggatgtcggcagggacgttaccatccccgagctgcgcgcgcagggctacaaggggttctatgttgccgtcggtctgcaggacggcggacgtctccgcgttcccggcgacggcgccgagggcgttatgtccggcgtggactttacaaagaaggtcaatcttgcacccgaaacgaagctcaccggcaaggtcgttgtgatcggcggcggcaacatcgcctccgatgtcgcccgcaccgccgttcgctgcggtgcggagagcgtgacgctctattgcctggaggggtacgacgaaatgcccatgggcgaagaggaccgcaccgagtgcgagcgcgacggcatctccatccatgccggctggggccagaccgcgatcgacaccgagaacggccatgccagggccattcgcttccgcaagtgcctgtccgtcaaaaatgccgagggccgcttcgcccccgcgtttgacgacgcccggaccgagactgccgaggcggacacgatcctttactgcatcggccagcacgccgactggggcgagctgctcgccggaacgaaggtcgaattcaaccccaacggcaccgtcaaggccgacccgctgacctaccagactgccgagcctgacatcttcgtcggcggcgacgcctacaccggccagaagttcgccattgacgccattgccgccggcaaggagggcgccgtgtccctgcaccgcttcgtgcagccgaacacgagccttaccatcggccgcaaccgccggcagttcatcgagctcgataagaaaaacgttcttctcgatatcaacagctttgacaacacgccgcgccagcgtcccggctacaacgaggagctgcgccgcacgatgcaggacggccgcgtgtgcttcaccgaggagcaggtcaaggccgagaccgcccgctgcctcggctgcggcgcgagcatcgtcgatccgaacaagtgcatcggctgcggcatctgcacgacgcgctgcggctttgacgccatccgtctccaccgcgagcgtcccgagtgcagcaccatggtgcgcagcgaggacaagatgaaggccatcctgccgtatatgctcaagcgcgccgtgaagatcaagctcaagggcaaaaagggctga

SEQ ID NO: 542 - DNA, 1506 bp, Unknown
  Description of Unknown: Firmicutes sequence
atgaagaagctgctcgctgaccttttcaaaaaaaaagaaaaaagccgccacgccgcagccgccaagaaaccggtgcgcctgccgcgcctgcgcgatatccatttccgctccatccgcgcccgcggtatgttcgtcggaagcggtcttgtgctgctggcgatcgttatttcgctcgcagcgtatacgctctcgctgcaggcgtattactattccgccacgcgcgcctcgctgcaggcaaaggcggagaccgcttcggcgttcctttcgtcctatgtggaccgcacctacgcggagttttatcagcgcgccttcaactatgccgagaattttgacgacaaggattcgctcgaattgcagttcgtcaacaccgagggacgcgtagagatcgcctccaccggcatttccgccggttcgatccccggctcggatgatatcaaaaacgcgctcgactccggcaggatcagcttctggcagggcaagcgcgcctccacgggggaaaaggttctcgccgtatccgcgccgctcgtttccggcagcgggagcgtcgtcggcgtgatgcggtatatcacgagtctcaagctcatcgaccgcgcggtgaacacctcctcgctcgtcgcgggcggcatcgggctcgtggtgctcgcgatcgttgtattctcgaacctttactttctgcgcacgatcaccgagccgatcgcttcgctcacgggcgttgcccgccgcatcgccgaaggaagctacggcgcgcaggtggaaaaaacgcacgacgacgagatcggagagctgaccgacgcgatcaacgatatgtcgcagaagctctcgcaggcagaacgtgtgcagacggagttcatctcctccgtttcccacgagctgcgcacgccgctcaccgccatcaccggctgggcggaaacgctcgcctacgacgaggccatccggggcgactcgcgccgcggcatcgagatcatcacccgcgaagcgggacgccttaccaaaatggtcgaggagctgctcgaattcacgcgcattcaggacggccggtttacgctgcacgtttccacggtggagctgccggcgctggtcgaggattgcctttatacctataatgaacttttccgccacgaagatctcgccgtgacctatgtttcgccggaggaagaccttccggagattcccggggaccccgagcggctctcgcaggtgttcctcaacattctcgataacgcctgcaaatacggcaaaaacggcaaaaagatcgacgtgaacatcacgcacgacgacgcgaccgtctccgtatgcatccgcgactacggccccggcattccgccggcggagctgccgcaggtgaagaagaaattcttcaagggctcctccaaggaacgcgggagcggcatcggccttgccgtgtgcgacgagatcgtcacgcggcacaacggcacgctcgatattgccaccgccgccggcggcggcgtgcgcgtcacggtgacgctgccgcgcaaggcatcttaa

SEQ ID NO: 543 - DNA, 1872 bp, Unknown
  Description of Unknown: Firmicutes sequence
gtgttgaaccagaacgaaaaagaacttttatatagaataaacagcaatgccgatctccgtgccgtaccggaacgggacattccggagctatgccgggacatccgcgagtttcttgtggaaaacgtgtcgcacaccggtgggcatcttgcctcgaatctcggcagtgtggagctgacggtggcgctgcaccgcgtctatgacccgatgaaggaccgcatcctgttcgatgtcgggcatcagtcctatgtccacaagattttgaccggtcggagagattccttcgatacgctgcgccagctcgacggtatttccggctttcccaagccgtgcgagagcaacgccgatccgtttcttgccggacacgcctccgattccgtgtcgctggccgcggggatggcacgagcccgaacgctcatgcacggaaattacgacgttgtcgccgttgtgggcgacggcgcgatgaccggcggcctgtgctttgagggattgagcgatctcggtgcgagccgcgaggctgccgtggtcgttctcaacgacaacggcatgtccatcaacgaaaatgtcggcggcgtggcgagattgctccgccgcgcacgcacgcgccccggatatctccgcttcaagcggacgtaccgccgtgttatgaaaaagcacccgcacgcttatgaagagctgcaccggctcaaggagcgcatcaaagcgcgccttctgccgtccggtatatttgacgatctcgggttttactatatcgggccggtggacggccacgatgaaaaggcgctcgaaacgacgctgcgctgggcaaaggatcttcatcgcccggtcgttgtgcatgtggtgacggtgaagggaaagggctatgctcccgcggaggcggacccgcagacgtaccacggcgtcaacccgttcgatcggaagaccggcgtcatgaccgttccggccaacgatttttctgcggcattcggcgcatcggcgattgcgcttgcggaaaaggatccgacggtctgcgccgttaccgcggcgatggaacacggcacggggctgtccgaatttgcccgccgttttccgaaccggtattttgaactcggcattgccgaggagcatgccgccgcgatgtgcgccggcatggcaaagcaggggctgacgcccatttttgccgtttactccacctttctccagcgctcttacgatatgctcatcgagaacatcgggctcatggggctgcatgttgtgcttgccgtggaccgcgcggggcttgtcgggcgcgacggcgtcacgcatcagggctcttttgatatcgcgtatctcggctccgtgccgaatatgaccgtatatgctccggcgagcttctgcgaactggactccatgctatccatcgccgtgcgtgaaaaatccggtcccgtagcgctccggtatccccgcgggggagagggcgcatatactgacgaccactcccgcgaggattcgaccgttctgcgcagcggcggcgatgtaacgatcgccacctacggcatcagcgtcaacgcagcgcttgccgcggcggaaacgctttccgccgacggcatccgcgccgaggtcatcaagctcaaccggctgctgccgctcgctccggagaccgtccgtgagtcgctgcggaaaaccggacggtttattatggcggaggaagcctgccgctccggaagtcttggtacgcttcttcttgcagacgccgcggcaaacggcatttcgctgcgcggcgcccggctgctggatctcggcagcggcgttattaagcacgcttcggtccgtgagctgcagcactgcctgcatctggatgcggatggcattgccgccgcagcaaaggagatactgcatgaaaaagatccggcttga

SEQ ID NO: 544 - DNA, 1500 bp, Unknown
  Description of Unknown: Firmicutes sequence
atgaaaaaacgccttctttccctgctgctgaccgtatgtctcgttgcagcgctcttcaccggtctcaccggcacggcgaacgccgccaacgacaaggtcgtgggctatcttacgagctatactctcaaagcgggcgacacgatctacggtgtgtgtgaagcgaaaaagatcgacttcaacgccaacctcgccatgatcggcaagatcaacggcatcacgaactacaactacatgatgcccggcaaggtcctctggctgccgacgaagacggccacgacttcggagtcgtattattctctcctctcgcacacgctcgtcgccggggagacgcctgccgcgctctgccagagctacggcattgactacaacgccaactacaagctgctcgccgcgctcaacaacaatctcaatgtgttcatggcaggccagcagttcattctgcctctgtacgtaacgcctgccggcgccgcgacgccgactccggcgccgacctccggcacctctgccgcgccgaccgccacgcccaaacccggcacgacgcccgccccgacggcgaacgttcccaccggcgacacggtgagctattatctcgcgcagcacacgctgcagtacggcgaaaccgtttccggcgtctgcgccgcgctcggcgtggacttttcctcgaacgatgcgacgatccgcaagatcaacaacatcaccaactacaactatatgatgcccggaaaggtcatcctcatcccgacgaaaacggttccgggttccggttcttactacaagatcatggcgcacaagatcgtctccggcgacacgctctacgcgctctgcgcctcctacggtctggattactacgcctattccaagctgatctccctgctcaaccccaacgcggcctattataacctgctccccggcaacattctctatatgccgcagtatgtcgccgcctctacaacggtgaagcccgccgcaacgcccgcgccggccgcctctgccggtacgacgaccgccccggctgcgacgcctgctccgagcgcgtctgccggcacaacggcttccgctgcgccgagcgccacagccgccgcttccgccaagcccactacgacgcccaacatccccgccgaggatacgctcagctatctcatcatcccgcacaagatccaggccggcgacaccgtcatgagtatctgcgataaatacaaagtggacttcgctgcgaacgacgccgcgatccagcgtctgaacccgagcgtgagctacagctacctgctccccggcaacattatcctcatcccctcgaccacgtacccctcctccggtccgtattacaagatcatggcgcacaagctcgtcgcaggcgacacggtctacggtctctgcctcacctacggcctgagctatgagaacaacatcaccttcctgcagcggctgaacaaccgcgacaatctcgccacgtactacgtcggccagacgatctacatgccgctctacgttgccggctga

SEQ ID NO: 545 - DNA, 2268 bp, Unknown
  Description of Unknown: Firmicutes sequence
atggcaagaaagaaggaaaacccgacgccgcgccacgcgacggccgaggaacagaacgtaatggggctgcgctccgccgttgtggagcagcccgtcaccgaaacgctcgagaacaactacatgccctacgcgatgagcgtcatcgtctcgcgcgccatcccggagatcgacggctttaagccgagccaccgaaagcttttgtactgcatgtacaaaatggggcttctcaccggtgcgcgcacgaagtcggcgaacatcgtcggcgcgacgatgcactataacccgcacggcgactccgccatctatgatacgatggtgcgtctctccaaggggtacggtgcgcttctcacgccgtttgtcgattccaagggcaacttcggcaaagtgtactcgcgcgatatggcgtgggcagcctcgcgctatacggaggcgaagctcgcgcccatctgcgcggagatcttccgcgatatcgacaaggacacggtggattttgtcccgaactacgataactccaccacggagccgacgctccttccgaccacgttcccgaacgttctcgtctcggcaaacatgggtatcgccgtcggcatggcgtcgaacatctgcgggttcaatctcggcgaggtgtgcgaaacgacgatcgcgctgctgcgcgacccggaacataatattctgacaacgctccccgcgccggatttcccgaccggcggcgagatcgtgtgcgatcccggcgagatggaagcgctctataagaccggccgcggcggtgtgaaggtccgcgcccgctggcgcttcgatcccaaggagcgcatcattgagatctacgagatcccgtacagcacgaccgtcgaggcgatcattgacaaggtcgccgagctcgtcaaggccggcaagctccgggagatcagcgacatgcgcgacgagaccgacctcaacggtctcaagctcgccatcgatgtcaagcgcgatgtggagcccgaaaagctcatgcagaagctcttccgcatgacgccgctgcaggacagctttgcctgcaacttcaacattctgctcggcggcacgccgcgcgtgtgcggcgtcggcgagattctggacgaatggatcgcctggcggctggaatgcgtccggcggcgggtatactttgacgtatcgaagaagaaggaaaagctccatcttctcaacggtctcaaaaagatcctgctcgatatcgaccgcgccatctccatcatccgcaacaccgagcgcgagagcgacgttgtgccgaatcttatgatcggcttcggcatcgaccaagtacaggccgaatatgtcgccgagatcaagctgcgcaacatcaaccgcgaatacatcctcaagcgcaccgaggagaccgacgagctcgaacgcgagatcgccgagctggaggatacgctcgcgagccgccgcaagctgcgcgcgatcatcatttccgagctgcagcaggtgatgaagaaatacccctcgccgcgccgcagcgtcatcacctatgccgccgatgcgcccgaagcaccggaggaggacaacgtggaggactacccggtcaacctgttcctttcgcgcgaagggtatttcaaaaagatcaccccgctctcgctccgtatgggcggcgagcagaagtacaaggagaacgacgggccgagccaaagcttcgagacgacgaaccgcgccgaaatgctcgtattcaccgacaaggcgcaggtctacaagtgccgcgcggcggactttgccgatacgaaggcctcgcagctcggcgtatatctgcccggtcatctcggcatggatgacggcgagaacgtattctctcttgtcctgcccggcgattaccgcggcgaggtgctgttcttctttgaaaacggcaaatgcgcccgcgtgccgctcgagagctacgccaccaagacgaaccgcaagcggctcaccggtgcttactgcgacaagagcccgctccgagcgctgctcgtcctcacggaggaacagaacgtggcggtgttttccacggagggacgcgcgcttgtattcaacacggcgctgctcgcacccaagacttcccgtgccacgcagggcgtggcggtcatgacgctcaagccgaagttccggctcgagcgcgccgcgttcctcgccgatacgaccatccagaatcttgcgcgctaccgtatgcgcagcatccccgccgccggcgcgctcctccgcgaggaggaccggggcgaacggcagatgacgctgctcgacggcgcggaggaaaatacgaaataa

SEQ ID NO: 546 - DNA, 1935 bp, Unknown
  Description of Unknown: Firmicutes sequence
atgaacgagagcgagatcaaatatctggagcttctttccaagagctttccgagcatccccgctacggcggcggagatcgtgcgtctgcaggccattctggagctgccgaaaacgaccgagcacttcatgagcgacatccacggcgagtatacatacttctcccatatcctcaaaaacgcctccggcgcgatccacgacaagatcaacgacagcttcggcgatcttctcggcgaggaggagaaaaattcgctcgcccggctgctctattaccccgagcgggagcttgccgccgcagcgcactccgattcctggtaccgcgtgacgatccaccgtcttgtggccgtctgccggcaggcgacggacaaatatacccgcgtcaaggtgcgcgcccgtctgccgaaggaatatgcctatattatcgaagagctcattgactccgacgagcacgatcccaacaagcgcaggtattttgaaagcatcatcaacagcgtgatcgagaccggcattgccgaccggttcatcgtggcgctcgcaaatctcatctcccgcctgacggtaaaccagctgcacatcgtcggcgacgtttttgaccgcggccccgccgcgcagatggtcatggacgatctcatggacatgcacggcgtggacttcgtctggggcaaccacgacattctctggatgggcgctgcgatgggaaaccctgcgtgcattgcgaacgccctgcgaaactcactcaagtacggcaactttgatatgctcgaggacggctacggcctgaacgtccgtccgcttgcgctcttcgccatggagcagtacggcgacgatccctgcacgaacttcctcccgacgcacgtgaccgactgcgtggcggaaaacagcgacgttaccgccaagctcctcaaggccatcacggtcatccagttcaagctggagggccagctcatcctgcgccacccggaatataaaatggacggacggctcctcctcggagagctcgtccgctccgaaggaacggtcacgctcggcggcaagatataccgcacgaacgacatttcgctccccacggtcgatcccgcggatccctatcgcctctccgagcgcgagcagcagctcgtcgatcagctcgttttgtccttcctgcgcagcgagaagctgcagacccatatccggtatctgctggaaaaaggcgcgatgtaccgcgtgtgcaacggcaaccttctctaccacggctgcatccccatggagccggacggcagctttacgcgcgtgacgatgggtgacaaaacatatttcggaaagtcgctcatggatgcctgcgaccggctgtgccgcacggcgatgtacgaccgccgtatggagaacaccgatcttctctggtatctctggtgcgggccgtattccccgctcaacggcaaggacaagatcgcaacgttcgagcgcacgttcctcgacgatccggaggcccgaacggagcagaaaaatccgtactacgatctctggaacagcggggaaacggcgcgcacgatcctcaccgagttcggcgtggacttcgagcgcggccacattatcaacggccacgtccccgtgcgcaaaacgaagggcgacacgcccatcaaggccaacggcaagttcatcaacattgacggcggcctctcgaaggcgtaccagcccgtgacgggcatctgcggctatacgctggtgtattcctcgcacgagctgtatctcgccgagcaccagcccttcgacccggacaccgccgcgcgcgagagcgcagacgtcctctcccgcacaattatgatcgagcagtaccccgaccggcttcgcgtgcgcgataccgacggcggcgcggatgtggagcggcgcatcgccgatctcaaaaagctgctcgcggcctaccgcagcggccttgtgcgcacgccgagccgcatggagtaa

SEQ ID NO: 547 - DNA, 3933 bp, Unknown
  Description of Unknown: Firmicutes sequence
atgacttccttcagcgtaaaaaagccgtttaccgtgttcgtggcggtggtagccattctggtgttcggcgtgatgtcgtacgtcaagatgacccccgacctgatgccgaacatggactacccctacgtcgtcgtggtgacgacgtatccgggcgccgcgccggaggaggtcgaagccgtcgtcaccaagccgatggagcagagcatggcgacgctcaatgatatcaagaccgtgacctccacctcggcggagaactattcgatgcttgtactggagtttgagcagagcacgaatatggacagcgccgtggtggacattctgcagaaaacgcagatgctcaccggccggtgggacgattccatcggcacgccgagcatcatccgcatcaacccgaatatgatccccgtgatggtcgcggcggtcgattcgtccgaaatggaccgctacgagctctctcgctttgccaaggacaccgtcatccccacgctggaaggcacgacgggcgtggcgagcatcacgaccggcggcatgatcgagcggacgatgaccatcgaggtcaacgaggccaagctcgacaaaatgaacgcaaagatcgccgaagccatcgacaaggcgatggaagacgccagaaagcagctcgaggacgcgcagaaggagctggacgagaaccgcgagaaggtcgaggccggcacgaaccagcttctcagcgcatcgagcggcatctccgattccatcaagcagggcgaggacgatctcgccgacacgctcaccgccgccggagagaccgcggcgaagctcgcctccgcgcgcgccgccatcgacgcgctcaacgcccagctcgaacaggcggaggccgcgctcgcggaggccgaggcgcgtctggccgaaaccgacgcgcgcatcgcctcgctggaagcggacagcgcgctttatgccaaagcactcggcgagccctacgactccatggacgcctccacgacgctggaggccgccggactggacgcggacaccgttgccgcgctcaacgccaagggctgtaccgatctcggcagcgtccgcacgatgaacaacttaaacgacgtgaatctctccgcgcagcgcaccgcgcgcgcagcgcaggccgtcgcggtggagaccgcgcgcgtgcaggccgaggagctgcgcacgcagatcgccgcggcggaggagcgctgcgcccagctcgaagaggaatccaaaaagcagatggaatcgctcgaaaacatgcagaagcagctcgaggagctgccgggcgagctcatgggcggcgtaacgaagatctccctcgcgggcggccagctcgccgcggcgcagaccgcgctcaccagcgcgcagacgcagctcgacgcggcggtgaaaacgcttgaggagcagctagcctccgcgctcgacgcggccgacctccacggcgtcatcacgctggaaacgctgagcagcctcattgccgcgcagaatctcgacatgcccgccgggtatgtgtatgacgaaaacggcaacggcatcatcgtcaccgtcggcgacgccatcgcggacggcgaggatctcgaaaaccttgtgctgctcgatctcggcatcgagggccttgaccccatccgcgtgtgcgatgtggcggacgttgtccgcgccgacaacgcgggggagatctatgcctcgctcaacggcaacaacggtctcatcctcatgttctccaagcagtcaaactacgcgacggcgaaggtgtctgacaacatcaacgccgcgtttgaagagctgagcgcgcagtatccggggctgacgttcaccgcgctcatggatcagggcgattacatttatctcctgcgcgactcgatcctctcgagccttctctggggcgcgctcttctcggtcgtcattctcttcctcttcctgcgcgactggcggcccacggtcatcacgctctgctcgatcccgatcagcctgctcttcgcgctcacgctcatgtacttcaccggcgtttccatcaacatcatgtcgctttccggtctttcgatatcggtcggcatgctggtggataactccgtcgttgtgatcgaaaacacctaccgcctgcgcgcgctcggcgaatcaacggtcaagtccgccgtgtccggcgcgcggcaggtcggcggcgcgatcgcggcctccacgctcacgaccatctgcgtctttgtcccgatcgcgttcgtcgagggccttacgcgcgagctcttcaccgatatggtgctcacgctcagctacgcgctcatcgccagtcttatcgtagcgctcacgctcgtcccggcgctcgcgggcaagctgctcgcgcacgccaggccccagagcgaaacggcgttcacgcgcttcatgccgaaatacaaaaagtccgtcctctgggcggtgaaccacaaggccgtcacgctcctcaccgcggtggcgctgctcatcgcaagcggcgcggcggtgatcgccaagggcttcacgttcctccccgatatggagatggagcagatgatggtaacgctcacgatgccggagggcagttcctttgccgacacgaccgccgcggcggacgaggcagcggcgcgaatgctcaccgtgccgggcgtggagaccgtcggcggcgccatcggcgacagcgccggctccagcctttccatgatgaccaccgagggcgacgtttcgttctatgtcctgctcgagagcggatataaggcgagccgcgttgcgaaagagatcaacgagaaatgcgccgatatggaggccgccgtgaacgccgacgcaaactcgctcatgtcctccatgacgcagatgctcacgagcagcggcatcacggtgcgcgtatactccaacgatctcgacgatctgcgcgagaccgccgacgccgtggccgatgtgctgcgcggcgtggacggcacggaaaacgtcgccgccggggaagaggagcccaccgccgagctgcacttcaccgtggacaagaaaaaggcggcaaaggagcagctcaccgtggcgcaggtgtatatgcaggtggcaaaggcgctcaccggctcggccgatctcatcgagctttcggacggcggcgacacctatgccgtcagcgtacagaccgccgggaaggacaagatcacgcccgaatacgtccgctctctcacgtttgacgtgacggcgaaggacggcacggtgcattccgtcgcgctcagggacattgccacggtcgaggagaccgagagcctttcgagcatccgccgtctcaaccagcgccggtacatcgacgtgaccgccgacatcgccgagggctgcaacgtcacgctcgtgacgaacgccgccgaggaagcgctcgcatcgttctctccctcggacggcacgaccatcggcttcaccggcgagcgcgaatccatcgtcgaggcgctcagacagctcgttttgatgctcgcggtcggtatcctgctcgtatatctcgtgatggtcgcgcagttccaggatctcaaatcgccgttcatcgtcatgttcacgatcccgctcgcgttcaccggcggtttcctcgcgctgctcattgcggggctggagatcaacctgctctcgatgctcggcatgatcatgctcgtcggcatcatcgtgaataacggcatcgtgctcgtggactacatcaaccagctgcgcatcggcggcatggaccggcgtgaggccattgcggacgccgccgtcacccgtctgcgtccgattctgatgacgagcatcacgaccatcctcggtctcatcgtcatggcgctcggccagagcgaagcaacgtcgctcatccagccgctcgccgtaacgtgcatcggcggactgctgtacgccacgctcatgacgctttacgtcgtgcccgtcatgtacgacgcgctctccaaaaaggcgctctaccacgtggacgaggccgatctcgaactcagcgaaaaataa

SEQ ID NO: 548 - DNA, 1275 bp, Unknown
  Description of Unknown: Firmicutes sequence
atgaacaagcacgaatatcccaatctcggcgaaacgctgtatgaggaagtccttccgaacgggctttccgttctcgtcgcggtcaagccgggctttcgcaaaaacgcggcctttttcgccacgcgctacggcggggcggaccgccgcttcaaggtgaacggcgagtggatcgatacgcccgcgggcgtagcccatttcctcgagcacaagatgtttgatatgccggacggacgcagcgtcctttcggacttcgccgcgctcggcgcgagccccaacgccttcaccggcaccggccacacggcgtattatttcacgggttcggaaaacttcatggaaaatctccggttgctgctcacctacgtttctacgccgtactataccgaggagagcgtcgccaaggagcagggcatcatcggtcaggagatctgcatgggcgaggacagccccggctatgccggatatttccagcttttgagcgcgctctacgaccaccaccccatccgcgagaacatcgccggttccgtggagagcatcgcgcagatcacgcccgaaacgctctaccactgccacagcgtcttttaccatccctcaaacatggtgctctgctgcgtcggcgatgtagaccccgaggcgatcgcggcggcggcgcgagagatactgccggacacgcccggcgagaagccggagcgcgactacggcgcgcccgaaacgcttctgcccgcccggacgcgcgcggagaaaacgatgagcgtttccgcgccgcagtttctgctcggcgtgaagcttccgtatcccgcgtccggcgcggcgagagcgcggcagaagcttcttgcggagcttgccggcgagtgtctgttcggcaaggcctcggtctttttcaacgatctgtatgccggcggacttctgaacggcgactgctctgtcgaatacgattcctccgccgggacagccatgctggttcgcggcgcgcagggccgcgatccggacgccgtggcagaggcggtgcacgcggccgtgtccggcgttgcgctgggcggactggataaggaagcgctcgaacgctgccgccgcgcgaagtacggccagcttctcggctcgctcgattccttcgctgactatgccgtctcgctcgccgagagcaagctcgacggctgggatgcgcccgacgcgttcgccgtgcttgaatccatcactctcgcggagtgtgaggcgttcctctgcgaaaatctcacgcgtgagcgtctggcgctctccgtgatccgtcccaacgcctga

SEQ ID NO: 549 - DNA, 1419 bp, Unknown
  Description of Unknown: Firmicutes sequence
atgcacagaacgtatttccggaccttcaccacgaccgcggcgatggtccttgtgagctttctgctcatcggcgcagccttcggctttgcgagccgtcaggtgttcgtgtccgaagcgcgcgagagcatgatgacgaactcacgcgaaatatcgcgcatggcggtcgcctatgccgccgagggcgatctgcgctcgctcgagctgcgcatgacgctcagcaccatcggcgcgagcacgaatcagcacattttcatcgtcaatccctccggatatatcatcacctgctcggactccgccgttttctgtgagcacatcggaaagcgtctggatgagagcgtaacggcgatcctgccgcagtccggcacagtcgcgtcgctcggcacgctgggcgggttttacgcgagcgagcattataccgtcatttccgcgctcaccgatgacggcgcgctgctcggccatctgttcgtttccaaggacacggtaaccgcgctctccatctgggagacgatcctgccgctgttcttctttatcagtctcatcgtactctgtctcgcactcattttcagctacgcgagctccaagtacttcgccaagcccctgcgcgacatggcggacgcggcgcggcgcttcggtcgcggcgagctgaacgtccgtgtggagccgaccgacagcaccgacgagatcggcgagctgacggaggcctttaactccatggcggactcgctcgagcagtcggagacgaagcggcgcgagtttatcgcgaacgtatcacacgagctcaaaacgccgatgacgacgatctccggctttgccgacggcattctcgacgggacgatcccgccggagtcggaaaagaaatatcttcagatcatctcctcggagacgaagcggctggcccggctcgtgcgcagcatgctggagctttcgcgcctgcaggcaaaggaccgcgcaacgctcctcaagaacagctttgatatttccgagcagctccggctcacgctcatcacatttgccgataagatcgatcagaagcatctggaggtagtgttcaacgtccccgaggaggcgatcaaagttctcggcgatgtggacgccatcacgcaggtcatctacaatctgctcgataacgccatcaaattctcccgcgaaaattcaccgctcaccatttcgctatggaaggacagcaagaaggcctacgtctccatccggaactgcggcagcaccattccggaggcggagatcccgctcctcttcgatcgcttccacaagtccgaccgcagccgcagccaggaccgcgacggcgtcggtctggggctttatatcgtcaaaaccattttaaataaccacggcgaggacattgccgtgacaagccgccagggtgtgaccgactttgtgttcacgctcgcgctcaaaccgtaa

SEQ ID NO: 550 - DNA, 1125 bp, Unknown
  Description of Unknown: Firmicutes sequence
gtgaaagctatcaatcccggacactttcttctgacctgccggctggacaactgggtgcatctgctggaagagaaccacttccatatcgcccgcgaccggctgccgcaggcgctgtacatttccgcaacggcgctcgcgctcgcgcccgcggcggcggcggaatcgctcatttaccgcaagcgcatccgtgaaacaaagatcgaaaaggacccgatcttcattctcggccactggcgcagcggcacaacgtatctgcagaacgtcctctcgcgcgacgagcagttcggctggttcgatcccgtgaacacgatcggcctgccctactcgctgctgctcggccggctcatccagccgccgatcgaaaagggcatccggaacggccgcccgcaggataacgtgcagtactcgctcgatctcccgatggaggagacattcggcgtgctgacgatctcgccgtattcgatcatccacatgatcgcgttcccggaaaattataaaaagtacatcgaaggcgcgttcgtgagcgaccttcccgtggaggaactgcgcaaatgggagcgcagctacgattacgccgtccgcaagctcaccttcatcaaaaagggcaagcagctcattctcaaaagcccggacaacaccgcgcgcatccgcgagctgtggggcatgtatccggacgcgcggttcatcaacatccaccgcgacccctacaagaccgtccgctccacgatccacatgttccgcaccgagatggactcgctccggctgaccgaagagccggataacatcgacgagctcatcgagaacacggtcatcgatattttcgagcgcatgtaccgcgagcttttcgagcttgagggctttttcccgaagaaccggtacgtagacatcgcgtacaccgatttctgccgcgccccggtcgatacgctgcgggatatttaccggcgtctggagctctccggctttgaggcagccgcgccgcgctttcaggcgtatgtcgattcgcagcgcggataccagaagaataaattcgacatttcgccccggcttgtgcgcaagatcaacgcgaagctgggcttctacatggaacactacggctacgaaatgcgggaggttgaggaagaatga

SEQ ID NO: 551 - DNA, 1683 bp, Unknown
  Description of Unknown: Firmicutes sequence
gtggagaaaacgaaacgactgattacgctgcttctggcggttttgtgcgcgctggcgctctgcgttccggcgtttgccgcagatgtaaccgtcattaccgatatgaaaaccgactgcctggtagacgcctccggcagctgccagatcacgcagaccgtcaccatcgacattgccggcaccgaggataccatcgagcttcctctggcagcgaacgcgaagaaaatcagcgtcgcgggctacaagtacaagaaaacaacgcaggacggctacactgtgctggttttatcgtccaacggcggcttctccggcagccggacctttacgattctctatacaatctccgggcttgtcaccgagcaggataagatccagacgctgaccctgccgctgctggcgcccaaatggaactgggcgatcaacaactacgattttaccatctcgcttcccgctgcctttgagagctacccggcgttcaccagcgggtactacggcgatgtgatcgaggactacatgagcttcaccgtccgcgagggaatgatcggcggcacggtcacgaccgcgctgcgcgaccatgagtccctttccatgacgctcaccgtcggcgagggctactttgcgggcaaatacgccagatggtcgtccggctgggtagagacggcgcttgtgatggttttcagtgcgctcgcgcttttgtactgggcgctgacgcttcgctcgaagcggctctcggtgtccagccgcgcaacgccgccggacgccgcgctgccgtgcgatctgccgtacctgcttgcgggcggcgtgccggacttcaacatgctgatctgccactgggcagcgctcggatatctcacgatcgagatggatgaaaaggggcatgtgctgctgcaccggcaggtgatcatgggcaacgagcgaaagcggctcgaggtcaagattttcgcgtctttgttctcgcgcggcgacgtgtgcgacggggcaagcctcgtctataaaaccaccgcgcagaacgccatgcgcgccatccggcgctactgggaccggcggctttacgcgcgttcaagcggcaacgtcaaaatcatgcaggcgctgtgcgcgattgcagccagcatcgcgtctcttgccgtcatgagccagctgctgccgaacatgcccgcgcggggactgatcctgtttctgtgtatgctggcagggatcgccctgagcgttcttatttcgcgcatgccgcgctcttactacctcggaaatattccggcaatgattctctctgccgcgtgcgcgctggcgcttctgattgcggggcagctttccggcgcagggcctgcgatgcttgtcgcggtcgcaatgagctttgtgtgcgggcttctcacgctgcacggcggcaggcgcaccgagcttggcgcgcagctcatttcccagagcctcggcttccgcaagggactcgagaagctttccgagcgccatgtggcaatgctcataagccgcgacgggcagtatttttacaagctgctgccctatgcgcaggcgctgcatatgggcgcggactttgcaagacgctttggcgacaccgagctggaaccgtgcgagtggtacgtcacgcgcgttcccgcggcgcggaccgctgcggagttctataaccagctgcgtccagcgctggaaatgctcgagctttccatccgcaaataa

SEQ ID NO: 552 - DNA, 1764 bp, Unknown
  Description of Unknown: Firmicutes sequence
atgtatatgaatgtcctgattgatctgatttcccgggaggtttccggcgcattcgaaaaagccggcttcgaccccgcctacggaaaagtcacgctctcgaaccgcccggacctgtgtgagtatcagtgcaacggcgcgctgcccgcggcgaaggtctaccacaaggcgcccatccagattgcaaatgcggtcaaagagcagctgacggattgtgcgatgtttgaaagcgtcgaggctgtaaaccccggctttctgaacttcaagctctcggcagagtttctggcatcttatgtcgcagaaatgaaccttgccgagcacttcggcgtccagcccgagcagaacccccgcacgattgtcgtggactacggcggaccgaacgtggcaaagccgctgcatgtcggacacctgcgcagcgccatcatcggagaatccatcaagcgcatctaccgcttcttcggaaaccacgtcatcggcgacattcatctcggcgactggggtctgcagatgggtctgatcattgcgcaggtgcagtcgcagcgccccgagctttgctactttgaccccgattatacgggcgagtatcccgagcaggcgcccttcacgatctccgagctggaaaaaatctaccctgaggcaagcgcaagatcgaaggtcgacgcagagtttgccgagaaggcgcacaacgcgacgtatttactccagcagggcgagcgcggctaccgcgccatgtggaagcagatcatgcgcgtttcggtcgaggacctcaaaaagaactacgaaaacctcaacgtcagcttcgatgtatggctcggagagtcggacgcgcaggcatatatccccacgatgctcaaaatcgtcgaggacaagcatctggcagtcgagtctgacggtgcgcttgtcgttcccgtgcaggaagaaaccgacacgaaggaaattccgccctgcattcttctcaaatccgacggcgcaacgctctacgcaacgaccgaccttgccaccatcgtccagcgccagcaggacttccaccccggaaagattctctatctcaccgacaagcgccagagcctgcactttgagcaggtcttccgcgtggcaagaaaggcggagctggttcccccgcagaccgagctttcccacatcggcttcggcacgatgaacggcaaggacggcaagcccttcaaaacgcgcgagggcggcgtcatgcgtctggaggttctgattcgcgagatcaccgactatgtgaccgaaaagatcagggaaaatcagaccgtctccgacgaagagcttcccgagaccgcaaagaaaatcgcgatggcagcgctcaaatacggcgacctttcgaatcttgccaccaaggactatgtcttcgacctcgaccgtttctcctcgttcgagggaaacacaggtccgtatattctctacaccatcgtccgcatcaagtcgattctcgcaaaatacgatggttctgtcgcggactgcaggctgctgtcgccggaaagccgccagcagaaggacctcatgctgattctctcgcgccttgcagacagcctgacgtcgagctataaaaactccgcgccgaacgagatctgcgcgtatatctacgagcttgccggcgcggcaaacaaattctatcacgatgtgaagattatctccgagcccgatgaagcgaaaaaagccagctacgtcgcgctcatggacctcacgcgccgcgttctggaaacctgcatcgatctgctgggcttcagcgcgcccgaaaaaatgtaa

SEQ ID NO: 553 - DNA, 1239 bp, Unknown
  Description of Unknown: Firmicutes sequence
atgaaaagaagtaaactcattaccatggcgatttccctgctggcggcaatctgtctgtgggcatatgtggtgacggtggtgaatcccgacggcgacaccatcatctccggtattcccgtgacgttttccgggcaggaggttctgcgtgaggaccagcagctcgtcatcaagggcgactataccgacatggtgagcgtacatttctacggaaaaaataccgatctcaagaagctcgaacagtataaggatgaaatctccgccgtggtggacgtgtccaaggtccgcagcgcaaaggaataccagctgacctatcagctgacgcttccgaacgctgtgcaggcgtctgcggtgcaggatacggaccgcaatccgtccgtcatcaccattcaggtggaaaagctcgcgcggcgcgagattgaggtgcaaggcgattttacgggcgtcgaggtggcagatgggtatcttctggaatcgacgagctttgactacgacaccgtgacggtggaaggacccgagtccgtcgtatcgacgatttcctgcgcgcagatcgtcatgagccggacgaatgtggataagaacatcaccgaaagtgtcgactatacgcttgtggacgccgacggcaacgaggtcgacacgacggacctgacgacggacgttgataccatcgaggtagagcttgatgtggtcaaatacaagcaggtgccgctttccgtgaacttcattgacggcggtggcgcaaccggcgcggatgcagatgtggatattgacccgaagtccatcacgctcgcgggcgacgcgacggtcctggacagcgtgaacacgattgtcctcggaaacgtcgatctcggtgcgacggataacaacgccgttttgtcgttcgacatcaagattccgaacgatgcgaagaacgtatccggtgaagaatccgcgaccgtgaccatcaaaatcaagaacaagcggacgaaggtcatcggcgcgacgaacattgccttcatcaacacccccgacggcttcgacgccagaagcatcacgcagctggtgcagacgaccgtgcgcgcatcgaataccgagattgacagaattgcggcaaataacctgcgcgtggtggcagacctttcggaatatacgcaggcaggcacctatcaggtccccgtgaccatctacattgacggttaccctgacgcgggcgtcatcggcgacgattacaagatcgtcgtggtcctcgaagctgtagagtaa

SEQ ID NO: 554 - DNA, 2043 bp, Unknown
  Description of Unknown: Firmicutes sequence
atgaagaatttcaccatgaagcgggtacttgccggcgtcctttgcgccgcgggcgtgatcgcctccgcgcttaccacagcctctgcctgcaccacgatctatgcgggcgcaaatctcacacaagaaaacacgcgctttatcgcccgcagtgaggactacggctcggacatgaacaagctctggttcgtcagcgaatccggcgcttacagcggcacttaccgcggctgcccggaatacggaccgtttacctatgagctgtcccaccccagctaccgcttcacgtacttcaaaaacgacaacgtctacgacggcgtctgccccgagtgcggcgaggaaaatgcgcagcatgcctcctataccgagttcggtacaaatgaaaagggcgtgtccgtctccgccacggaaacgatctccggaaacgacgccgttctgtccgtcgacccctaccgcaacgccggttgggcgcaggaaaacggcaaacccgccggcattgaagagggcgacattcccacggtcctgctcagcgaggcagcgtcggcaaaagacgcgctcaagctgcttctgaacatctacgacacctatggctgcgccgacggtgcggggcttttcatcaccgatcagaacgagagttggtacattgaaaactgctccggcacgcagtatgcggcaatccggctgaacgatgatctgctgttcctggagcccaacatggcggtcatcggaagcgtcgatctggacgataccgaaaacgtgattgcctcgccgaagctcatcgagacggcaaaggcagccggaacgttccaaggcagcgagattgacaacgtgattgactaccgcgccagctacgccggaagactcgactctgccgacaagcgtctggtcgaaggtctcaactatctcaacagcgcctaccgctacgacgcggacgccttagtcaccgacaacagccgctttacgatttccaatcttgacaagaccggcgcgattgtcccgctctacacgaacatctccgccgaccggacgctggatgtcgacgatattctgaactactacaagctcagcaccatcgcaaagtccggcaatcaggagattgaaatcttccagatgttcaaagaccgccctgccgaatacgcaacggtcggctgggtcgcagtcggcgatctggcgtgcaatgtgtttgtgccgtattatccgatgctgatcgattccatgtatgagggctaccaggcaggcacgccgaccgtgcagtttaccaccgaacagccgaccggcggtctgttctacccctattccaagcgctcttacaaccgcgaaaccggcgagatcaccacgaccgacggctaccggattctgcccgagggctgggagaaatcctactactggagctttgaaattctcaacgactacgtgcgctactttgaatctgccgacggctcgaagctcgtcagcgacgcggaccggcagtatgtcaaggcgaagctgaacgacttgcagcaggaattctacagcgatttcgtttccatgcagacgctgcagtcgtcttcgaacgcccgcaagcttgccaccgagaacggcgcggcaatggcaaagaaggcacagcagaccgcgcaggagctgattgcctatctgcagggctccgaggcgctcacgcgcgccgacgcagtctacagtctctggctgcgctccggctctccgaaggcgaagacctccgcgtgcccgtttgcggatgtttcggaaagcgcttactactatgacgccgtcctttgggcagccgaagccggcatcgtccgcggtgtcagcgacagcagctttgccccggacgcgacctgcacccgcgcgcaggctgccgcaatcgcctaccgcgctgccggtgccccgaccgtttccggcgatggcttcgcggatgcagacgccgccggctactatgcgcagcccgcgctctgggcaaagcaaatcggcgccgtctcgggcagcagcttccagccggacagcgcctgcagcaaagcgcagctcgatgccctgatcggcgcgatcgccgcataa

SEQ ID NO: 555 - DNA, 2826 bp, Unknown
  Description of Unknown: Firmicutes sequence
atgcaagacaccatccgggtgcagggcgcccgcgtcaataatctcaagaacatttccgtcagcattccgcgcgacaagctcgtcgttctcacggggctctccggctccggcaaatcatcgcttgccttcgacaccatctatgccgaggggcagcggcgctatgttgagtctctgtcaagctacgcgcgcatgttcctcgggcagatggacaagccagacgtcgacgccatcgacggcttatccccagccatctccatcgaccagaagaccaccagcaaaaacccccgctccacggtcggcacggtgacggagatctacgactatctgcgccttctgtgggcgcgctgcggcgtgccgcactgcccgaagtgcggaaaggaaatccagcgccagtcggtcgaccagattgtcgatcaaatcatgcgtcttccggagaaagcacgctttcagattctctcccccgtcgtgcgcggaaaaaagggcgagcacacgaaggtgctcgacgatgcccgacgcggcggctatgtgcgcgcgcgcatcgatgaaagcatctacgatctttccgaggaaatcaagctcgacaagaacaaaaaacaccacatcgacgttgtggtcgaccgtctggtcatgaagcccgatcttgcgcggcgtctgacagactcggtcgagaccgctctgtctctttccggcggacttgtgattctcaacgaggtggacggggacaaagacaccatcttctcgcagaactacgcctgcgaagactgcggcatcagtctgccggagctgtctccgcgcatgttctcgttcaacaatccctacggcgcgtgcccggtctgctcgggtctcggcacgcagctggtcgccgaccccgaccttgtcattcccgactgggacaagtcgattctggacggggccattcaggcaagcggcttcaataacgtcaaggacgactcgattgcccggatgtattttgaggcactggcaaaaaaatatcatttctcgcttacgacgcccatgaaggaccttcccaaagatgcgctgcatgccgttctctacggcacgggaaaagaaaatctcacgatctactacgagcgcgccaacgggcgcggcacgctcgagcgcccgtttgagggcgttctcaacaacgtctcgcgccgcttgagcgaaacccagtccgacgcgatgcgcaaggaattggaggagtgcatgtccgagcgtccgtgcccgaagtgtcacggaaaccggctgtcggacatcagccttgccgtcacggtcggcggcatgaacatcatggatttctgccggctgcccgtgagcgaagcgctcgatttcatggagcatctggagctgaccggctccatggcggtcattgccgcgcagattctgcgggaaatccgctcgcgcctgcgctttctgcaggcggtgggcttatcttacctgacgctctcgcgcgcggcagggaccctgtccggcggcgagagccagagaatccggctggcgacccagatcggctccagcctgatgggcgttctttatatcctcgacgagccgtcgatcgggcttcaccagcgcgacaacgacaagctgctcgatacgcttcgccatctgcgcgatctgggaaactccgtgttggtcgtcgagcatgacgaggataccatgcgcgcggcggacttcatcgtcgacgtcggtcccggcgcgggcatccacggcggcgagattgtcgcggcaggcacgcttgacgatatcattgccgagccgcgctcgatcacggggcagtatctctcgggcgcaaaaaaaattcctgtgccggctgagcggcgcaagggaaacgggaaagcgctcaaaatctttggtgcagcggaaaataacctgcagcatctggacgtttcgttcccgctcggcacatttctctgcgtgactggtgtgtccggctccggcaaatcgagcctgatcaacgaaattctctataaaaagcttgccgcgagcctgaaccgcgcgcgcacgcgccccggaaagttcgatcgcatcgagggtctggagcatctggacaaggtcgtcggcatcgaccagagcccgatcggcagaagcccccgctcgaaccccgcgacgtatacgggtctgttcggcgacatccgcgatctgttcgcctccacgcaggacgccagaacgcgcggctacggtccgggcagattttcgttcaataccaagggcggcaggtgcgaggcatgctgcggcgacggtctggtaaagatcgaaatgcacttcctcgccgacgtctatgtcccctgcgaggtctgccacggcagccgatacaaccgcgaaacgctcgaggtccggtacaagggcaagaacatctcagaagtgctcgacatgaccgccgaggaggcgctctcgttcttcgaaaacctgccgaaaatccgccagaaggtgcagacgctggtggacgtgggtctgggctatgtgaagctcgggcagagctccaccacgctctccggcggcgaggcgcagcgcgtgaagcttgccaccgagctttcccgccgcgcaaccggcagaaccatctatattctcgacgagccgaccacggggcttcatatggcggacgttcaccggctcattgaggttctgcagcggctggtcgatgcgggaaacacggtgctggtcatcgagcataatctggatgtgatcaagaccgcagactacattctcgatctcggtcccgagggcggcagcggcggcggcaccatcgtctgccagggcacgccggaggaggttgccgcctgcgagaaaagctacacggggcagtatctcaaaaagcttctgaagtaa

SEQ ID NO: 556 - DNA, 1044 bp, Unknown
  Description of Unknown: Firmicutes sequence
atgaaaaccgtcacaaaactgctgcccggctgtgcgctggcgctggtgattgccgcgattgcgaagctgctggaatcgctcgaggcaagtgccgggctccatctgatcggcgcgtccgtcatcgcgcttttcatcggcatgcttgtcaaccatttctacaggcccaacgacgcaacaaagcccggcatccgcttcacatccaaaaagattctgaaatttgcgatcattctgctcggcgcaagtctgaacatcacgaccgttctgaccgtcggcaagttctcgctcacggttatgctctttacgcttgccacctgctttgggctcggctacttcatcggcaaggcgctggggctgaactggaagaccagcagcctgattaacgccggcaccggcatctgcggcggctctgccatcgcggcaattgcgcccgtcatcgacgcaaccgacatggacgttgcctacggcttatcggcgaccttcctgttcgacatggtgatggttgtggtcttcccgattctcgggcgaaagctcgggctgtccgacgccgcgttcgggctctgggcaggcactgcggtcaacgacacctccagcgttgttgcaaccggctacgccttcagtgaagcggcgggtgactttgcaaccatggtcaagctcacccggaccctttccattatccccaccgttctggtctttgctgtcatcagtctgaagctcaaaaaaaaggaagcggcaggcgcagatgcctccgtgaacgtcaacatgaagtccgtctttccgtggttcattctgggctttcttgccctgtcgggacttaccagcctcggtctcatccccggctccgtcgcctccgcactcaagacgctcagcaagttcctcatggtcgcggcgctcggtgcggtggggctgaacaccgacttcaaagccctctgcaaatccggtgcgaagccgatgctccatggcttcatcatttcgctgctcgtcgttctcgttgccatcggcgtggagtacatgctcggcattgccccgaccggaaatctgttctaa

SEQ ID NO: 557 - DNA, 1494 bp, Unknown
  Description of Unknown: Firmicutes sequence
atggagcatatcagcaaacgcttcggcaatttctatgccaatcatgacgtcaatttttccgtggcgaagggcgaggtgcataccttgctcggcgaaaacggcgcgggcaaatcgacacttatgaacatcctgatcggtctctaccagccgacagaaggaaaaatctttctgaacggtcaggaggtccgtatcgactcccccagtcaggcggtcaaactcggcatcggcatggtgcatcagcacttcatgctggtcgaggcaatgacggtcttcgacaacatcatcctcggtgacaagcacgcaaagggcgtcttcatcgaccgcgccgcgcgccggaaggaaattgaagcattgtccgaaaaatacgggctggacgtgcagctcgacaagctcattacggaaatttccgtcggcgagcagcagagaaccgaaattctcaaagcgctgtaccacggcgcagagcttctgattctcgacgagccgtcggcagcgctgaccgacatcgaggtcgagggtctgtttgccatcatgcacaagctcatcggcgaaggaaaatccatcatcttcatcagtcacaaaatgcgcgaggtgctgcgcatctccgaccgcatcaccatcctgcgcctcggcaagatcgtcggcaccgtgaaccgggcggacaccgatgggcagaagcttgccaacatgatgatcggcaaggagctgaccgagtcgcagtatgaaaagatcgatgccagcggcgcggaggtcgtcgcagagctcgaccatgtggactacagcaaagcctcgaagcacagcggcttaaacgatctgtcgctcaaaatccacgcaggcgaaattgtcggcgtcgcaggcgtcgacggaaacgggcagacgcagctggcacaactcatcaccggcgttcttgcgccggacgcaggtgaggtccatctcaagggaaagcgtgtcgcagtcttcgatcccaacggctttatcgaacacggcgtttgccacgtgccggaggaccggaacctgcagggtctgatcggcgacatgtcaattgcggaaaacctcgtgctcaaagacgcggacgacgcgcgcttcagcaagggacacgggcttctgctcaaaaagcgcgcaattaacgactacgccagacggatggcagaaaaatacgacgtgcgctgcacatctgtctcgcagagcgtacgctcgctttccggcggcaaccagcagaaggtcattctcgcgcgcgagctggaaaacgatccggcgctgctcgtcatggcgcacccgacgagaggtctggatattggcgcgacgagctttgtccatgagcagatgatcggcgcgcgcgcccggggcgtgggcattttgctgatcagcgcggacttcgatgaaattctcgagatgtccgaccgcattgtcgtctgcttcgagggcgaaattatgggcgaattctccggcaagaacccgccggtggaagaaatcagccttgccatgaccggtaagtga

SEQ ID NO: 558 - DNA, 1296 bp, Unknown
  Description of Unknown: Firmicutes sequence
atggaacagcgcagcatctgcctgatcaacgattcctttccgcctgtcaccgacggtgtggcaaacgcggttgtcaattacgcgaaaaacctgacgcaggacggcaaacgtgcaaccgttgtgacgcctgcctacccggacgcggacgatacgcagttcggcttcccggttgtgcgctatccgagcgtcgatctgacgaagctggtcggataccacgccgggcttccgttttcgagccagacgcttgaaaagctcgtcgagcagcgctttgacctcattcactgccattgtccggtgacgtccgcgatgcttgcgcgcgccctgcgagacaggattcatgtgccgctggtgttcacgtatcacacaaagtttgatattgacatcgcaaacgcgatcaagggaaagcttttgcaggaggaagcgaagaaggttctggtcgacaacatcaccgcctgcgacgaggtctggaccgtgagtcatggtgcgggcgaaaatttaaagagcctcggctaccagggcggctatcttgtcatgccgaatggcgtcgatttcccgaagggcagggtagacgaaagtctcgtgcgcgaggtgacgaaggactttgacctgccggaaaacgtgccgatgttcctgtttgtgggcagaatgatgtggtacaagggcttgaaaatcatccttgatgcgttgaagctgctgcgcgagcaggggaccgtatttcgcatggtctttgtcggaaacggcggcgaccgcgaggaggtgatctcctactgcgaaagcctcaggctgtcggactgcgtgttttttaccgcgccggcatatgaccgcaacgtgattcgcgcctggtactgccgggcagatctgttcctgttcccgtcgacgtttgacacgaacgggcttgttgtgcgcgaggctgcagcctgtgggctcggaagcgttctggtgcgcggcagctgcgcggcggaggatatcaaagacggcgaaagcggtttcctgatcgaagaaaacgcgccgtcgatggcagatatgcttgcaaagctctgcagggcgcctgcggcaatgcagcgcgtgggacagacggcgcagaacgagatttatatctcgtggaaggacgccgtttcgcgcgcggaaaagcgctatgaacttgtgctggaaaatttcaaagccggaaaatacccggcgcacaaccgccagagcgacgaagcgttccacgccatcgcgtcgtatctcgcggcagtcggcagacagcaggagaagatgaaactgcgcatagaggagctgtccgagcgattcctgtaa

SEQ ID NO: 559 - DNA, 1992 bp, Unknown
  Description of Unknown: Firmicutes sequence
atgcagaaaattggcgtttttgtctgccattgcggcacgaacattgctgcgacggtggacgtggcgagggtcgccgaaatgctcgggcgcgagccgggcgtggtgttcgccaccgactacccgtacatgtgttctcagaccgggcagcagatgattcaggataaaatttgcgagctggggctgaccggcgtcgtgatctgctcctgctctccgagaatgcatgagcagaccttccgcaaagcgtgcgcaaaggcggggctcaacgactacatggtcgaaatcgcaaatatccgcgagcagtgctcctggattcacaaggaccggcaggaggcgaccgaaaaggcaatccttctgggaagagctgcgattgcaaaggtgcagctcaatgcgcccttaaccgcaggcagcagccctgtgacaaagcgtgcgctggtgatcggcggcggcatcgcgggcatccagacggcgctcgatatcgccgaggcaggcttcgaggtcgacattgtcgagaagcagccaaccatcggcggcaagatgacgcagatcgacaagaccttcccgacgctcgattgtgcggcgtgtatcctgacgcccaaaatggtcgactgcgcgcagaatgataaaatccacatctatgcctattccgaggttgagcacgtgggcggctttgtcggaaatttccatgtgaaaatccgccgcaaggcgcgctttgtaaaagaagatgtctgcaccggctgtggggcatgtacggaaaaatgcccgcagaagaaggtgccgaacgagtttaacctaggactcgatacccggtgcgcaatctacataccctttgctcaggcagtgccgaaggttgcgacgattgaccccgactcctgcaatatgctcaaaaacggcaagtgcggcgtgtgcgcgaaggtctgcacggcaggcgccattgactacaagcagaaagacgagatcgtcgagcgcgagtacggcgcgatcgtcgccgcaacaggctttcaacccatcgatctttcccagtttgacgagtttgcctattcaaaatctccggacgttgtttcaagtctggagtttgagcggctgatgaatgcggcaggtcccacgggcggaacgctgcttcgtccttcggacggcgcgcatccgaagacgattgtctttgttcagtgcgtcggctccagatgctctgatgcgcagaagggaaagagctactgctcgaaaatctgctgcatgtatacggcaaagcacgcgatgctctgccgcgaaaagtatccggatacggatgtttatgtgttctacatcgacgtgcggacccccggcaagaacttcgacgaattttaccgcagagctgtcgaggaatacggcgtgcattacatcaagggcatggtcggaaaggtcgtgccggaaggcggaaagctcaaggtgcaggcgtcggacctgctggataaccggcagctgcatattgatgccgatatggttgtgcttgctgcggcaatcgagccggacaagtctgcacgctcggtcgcgacgatgctgaccgcgtccatggacacgaatgatttcttcactgaggcgcacccgaagctccgtccggtcgaaagcccgacggcaggtgtgttcctctccggtacgtgccagggaccgaaggacatccccgagaccgtggcgcaggcgtccgcggcagcggcaaaggtgatcgggcttttgtgcaaggacagcctgacatgcaacccgtgcgtggcagagccgaatgaacagatgtgcaacggctgctcgaactgcgaaaaggtctgtccctatggcgcgattacctacgccgacaaggaattccgcggaccgaaccggacaacgctgatccggcgcgtggcgcaggtcaatccggcggtctgtcagggctgcggcgcatgtacggtcgcgtgcatgtccggcgcgatggacctcaagggcttctccaacaaacagattctcgcggaggtggatgcgatatgcaggtaa

SEQ ID NO: 560 - DNA, 1797 bp, Unknown
  Description of Unknown: Firmicutes sequence
atgcagccgcagtctgaaaagaatcggaagaccgacagaaatccaaagtcgcgcaaagccaggcgtcgccagaaggagcagcagatgaagttcctccggcagaactcctggctgattttgcttgcggttctggtgctggtggcgctgattctgtttatctgtgtgattaccggcgggcaggaagaagcgcagcaggagcctgccgagacgcagaagacgagccgttatgaaaaggcatatctctgcgccgacagcccgagcgtgagctatctcgatgaaaatctggagcctgccggaactgccgtgcgcggcagcgaggtgacgtattctgcggaaaacacccgcaaaaaagacggcgtgacgtattacctgacgtatctggactcgctcaaatacggctacatcgccgagaccaatctgactgataccccggacgatttcgtccgggaggagagtgtcttcgtgcgcacgccgcagaatctgcgccttgacccggattctgtcgagctgggcgggcttctggaaaagggaaccgagctcaagattgtgggctacgactatatgaccgacggcattgtccacctctatcaggtgacggcgggcgaggaaaccggctatatttcaggcgagtacactgccagcacgcaggaagctgcgatagaggcctatgaccgcttcggcgtctatatgattcacgccggacgcgcggaccgctttggaggcggcgacggcgagagcctcgattattatcccagacaaaaggcgagctttgaaaataacgtcatgccggagcatgtctatgcgctgtacttgacctgcgacccggacgtactgggaaacatcgacgcctacattgcctacgcgaagaccacaaagatcaacgccttcgtcgtcaacatcatggatggcacgtccatcggctacgattccgaggtcttccgtaagtattcgcccacagcggattcctacgccaacaacacgcaggaggaatacaagacctgcattcagaaaatcaaggacgccggtttctatgtgatcggcagactgaccaccttcaacgattcgttcttcgtcagcgatcatccggaatatgcgatttcagacgccgcgggagaccccttgtacatcgcaggcagctactggccgagcgccttctgccgctatgtgtgggaatacaaggtagagctggcaaaagaagcggtggcgctgttcggcttcaacgaaattcagttcgactatgtccgtttcccggacggcacgtatgattacgaggaagacggcaacatcgactaccgcaacgagtatgacgagaccaaggcgcaggcgatccagcgcttcctgatgtatgcttgcgacgagctgcacgattgcggcgtgtatgtcagcgccgacgtcttcggcgagacctccggcagctacgtgaccgcctacgggcagtactggcccgccatcagcaatgtggtcgacgtgatcagcggcatgccgtacccggaccacttttcgcagaacggctcctaccgcccctgggagcatccgtatgagacgatgctcgactgggcaaagaacgcggcaaaacgccagaccgagacgccgagccctgccatcgtccgtacctggattcaggcatacgatgctatccgtccgccgtacaacacctacggcgcggaagaggtcggcggtcagctgcgggcgctgcaggaaaacggactcgacggcggctttatggcatggaacgcgatgtgcagcattccgaagttcgaaacactcaagcccgccttcgacgcattgcccgactga

SEQ ID NO: 561 - DNA, 2286 bp, Unknown
  Description of Unknown: Firmicutes sequence
atggatcaatacataggaacgctgttggacaatcgatatgaaattctcgaggtcatcggtacgggcggcatggctgttgtctacaaggcgcgctgcaaccggctcaaccgcctcgtggcaataaaggttctcaagcgtgagctgtcgcaggacgaggagttccgccgccggttccatgccgagtcgcaggcggttgcgatgctttcgcatccgaacattgtgagcgtctacgatgtctcgcattccaacaacctcgattatatcgtcatggagctgatcgagggcatcacgctcaagcagtatctggagcagaagggcagactcaactggcgcgaggcgctgcatttttccacgcagattgccaaggcactcgagcatgcgcattcgcgcggcatcatccaccgcgacatcaagccccacaatatcatgattttgaaggacggcagcgtcaaggttgcagacttcggcattgcccgcatctcctcggcgcagaataccctcacgcgcgaggcactcggctcggtccactatatttctcccgagcaggcgaagggcggcaaggtcgactaccggtcggacctctattcgctcggcgttgtgatgtatgaaatgctcacgggaagaccgcccttcgacggcgatacgcccgtttccgttgccattcagcacatcaacgccaagcccgtcatgccgcgcgaattgaaccctgatattcccgagggcttcgagcagatcaccatgcacgcgatggcagcggatatttccaagcgctacccctcggcgacgcggatgctggcggatctggaaattttccgcaaaaacccgaatgtgattttcgattttaccgacgatcaggacgccttcgatgtggagcgcctgctcaacgaccccgactatcttccagaccggcttccccggcgcgagcgcaagcagccgtcccgggtgtctattccacagcgcaagcagccgcctgcgccgcccgcgcagagccagagcaccaaaaagggcgcaaacgttgcgctgacggcaggcatcgtgtgcatcgtgctggcggtcctcggcatcggctacttcctgtattcgtatttcttctcggacctgttcagccggaccgaggaggtcgaggttccgcagatggtcggacagtattacgagaacttcgaccagagccagtaccccgatctgaccttcgaagtcacggactggcgcgcgagcgacgcttacgagagcggctatgtgatcgatcagagcgcgaacgcaggcacgatggtcaaggttggctccaaaatcgagctgacgctttcgaccggcattgaaagcaatgtcatgccgaacgttgtgaacctgccgctggaaaacgcgcaggactatctgaattcccttcccatcacgctttccatctcggtggattatcaggaaagcgatgtgtacaccgccggctatatcatccggaccattcctgagcgcaacgagccgctcaccgacgggcagagcgtgacgctggttgtctcgaccggcgtgccggtggagctggtgaaggtgccgacgctcattggctccgacgtggatgacgcaattgctaccatcaaggcagccggtctcggcgacggtatgatcaaatatgtcgacagcgatcttcccgaaggcacggtcacattccagtcgatcgatgcaggcgaggaggtcaaagccggaacggtgatcaacctgcaggcatccaagggacccgagcaggcgcaggagccgctcattcgcacgctttcacaggatgcagtggtggagcagggcgacaagctgacgctgcaggtcaaggcagaggttgcggacgacggcgagctgacctatgcgtggtacgtgtccgagtccggcaacgtcgccgatgcggagctggtctcgcgcagcgacaagaacaacaccacctgcgaggtcgatactgacaaggctggtgtctggtactatttctgcaagattgtcaacaccctcggcgagagccacacgtctgccaacacgcagatgattcgtgtggaggtcaagccgaaggcggagcctgtgcagacagaaattgccgtgcgcatgccgtcggtttcgagcggaatctatgagattctggtcaaggtcggcggagaaacgcaggtcggacccttcacggtggacatggaggaccagtcgggcagaactgtcatgattacggtagaaggaaacggcgtgcagacggtcgacgtgtatctcgacggcgtgctgtacgattcgcaggaaattgattttgacgcattggcagaacgatga

SEQ ID NO: 562 - DNA, 966 bp, Unknown
  Description of Unknown: Firmicutes sequence
atgagctttgtgtacaagggtttgaaggcaaattttgaaaagctgacggtcacggagcatgagctggaccgccagatggaccggctccgccagcagacgccgcgcgtgattcccgtcaccgagcgcgctgccaaaatgggagacgacgtggttctggactacgccggctttgtcgacggcaagcagtttgacggcggcacggcaaaagagcaggttctcacgctcggcagcggcatgttcatccccggcttcgagtcgcagctcgtcggcgcgcatgccggcagcgacgtgctcgtcaccgtgaccttcccgaaggactaccgcgccaccgagcttgccggaaagcccgccgagttccgctgccacatcgtcgaggtccgcgaaaagtctgcctatgagctggatgacgtatttgccaaagaggtcggcggctgccagacgctcgaagaaatgaagcagaagctccgtcagagcctgcaggactattacgacgagcgcgccgagatggaggtgcaggacaccctcatgcgtcaggcggctgcaacgctcgactacacgccaagcgcgcaggagctgaaagaaggtatcgacgcgcaggtcgagcttttaaaggcgcagctggggcgcaagggcttgacgctggaggcatatctccagttcaccggcaaaaccgagcagcagatccgcgacgacgcaaagcccgaggcggaaaacagcctgcgtattcagaaatctgccgagcgcattgctcttctcgaaggtcttactgcgacggacgaggactatgccaacgagcttgctgccatctgccggcagaacgggctgaccatggagcagctgaagccccacatgaacgcgcagttcgaagccagcgtccgcgacaacatccgcatgaagaaggcaatcgcctttgtgcgggcaaatgcggacgtgaccgtggttgacgcgcccgcgtcgaaggactga

SEQ ID NO: 563 - DNA, 1731 bp, Unknown
  Description of Unknown: Firmicutes sequence
atgaaaaccgtctggggggaacagttaaatcccgattccgtcttacaggaatatccgcgcccgcagctcgtgcgcgaaagctatgaaaacctgaacggtctctgggactacgccattacaaagacggacgcgaaacccgatgcctgggacggaaagattctcgttccgttttccccggaagcagagctttccggcgtcggaaaagctttgcaacccgggcagtttctctggtaccgccggacactcacccttcccgagattccggcggggcatcggctgcttctgcacatcggcgcgtgcgatcagcgcgcgaaagtcttctgcaacaggcagtatgtcatggagcatgtcggcggctacaccgcgttttcatctgacctcacggcgtttgtccacgcaggagacaacgaattgaccgttcaggcgcgagacgaccgggaagcctcgcagctctcgcgcggcaagcagagcagccgccgcggcggcatctggtacaccccgcagagcggtatctggcagacggtctggtatgagtgggtgccggaaaattacgtcaaggcaatccgctatacgccggacctcattaccaatcagcttctttatcagattcaggcgcccgcgcccgccggcgcaatcgtccggctctcgctgcatgggcagccggtcgcggaaagcgcggcagatgaaaagggcttcggcgcgcttgccattcctgcggaaacgctccggctctggtccccggagtcgccgacgctctacgatgtagacgtgacactgggagaagaccgcgtgacaagctacgccgccatgcgctcgttcggcgtcggagaagacgaagacggcacgccgcgcctgcttctcaacggcaagccgtattaccagaacggcgtgctcgatcagggctactggccggacgggctttacaccgcgccgtcggatgaggcaatgatctttgatcttcagctcatgaaggacatgggctttaacatgctgcgcaagcacatcaaaatcgagcccatgcgctggtactatcactgtgaccggctcggcatgctggtctggcaggatatgatcaacggcggcggaacatacaatctgctcacaatctctgccccgcttattaccggcatccatcacaaggaccacgactacaaaaaatttgcccgcaccgacgccattgcgcgggcgagctactataccgagctgaccgaactgatcgcgcagctctacagctgcccgtgtatctgcacctgggtgctgttcaacgaaggctgggggcagtttgacgcggctgcggcagcagaatatgcccacaggctcgacccctcgcgcatcatcgaccacgccagcggctggcacgatcagaaggtcgggaagctgcagagcctgcacgtctacttccgcccctatcattttaagaaggacaggctcgggcgcgccgtcgcgctgacggagttcggcggctacaccctcgccgtccccggtcacacctggggcaaaaagcgcttcggctacaagccgctgcgagacgaagcagcccttgccgacgccttccgcaggctctacgaacaacagatcattcccgcgacggaaaaaggtctcgctgccagcgtctacacgcagctgagcgatgtggaagacgagtgcaacggctttgtcacctacgaccgcaaagtggtcaagctcccgaagcagctggtccgcgaaatttccctttctctcaaagactga

SEQ ID NO: 564 - DNA, 1305 bp, Unknown
  Description of Unknown: Firmicutes sequence
atgggagtgacgcgcatgcacgagcagcacgaccggcgatatttcaaatgggggcttaccgctctgacggtcattttcatcagcattctgctggtggtcatctttacgaatcttccgggctttttttcgctgctcggtgcggtcggaaagattctctcaccgctggtgtcgggcattgtgatagcgtttctgttaaacccgattgtcaattttgtcgacctgcggctgcggccgctgctggaaaagcgggggctgaaagcctcgaaggcgtataaaatcagccgcggtatttcgctcgttttcgcgttcatctttgctgcgttcatcgtctatgcgtttttctcgatgctggtgccgcagctctatgagagtgtgatgagcatcatcgacagcgcaccggaatactatcagagtctggaaaaatgggcggtcaatgtgctcgaagacaatccggaaatccggacgtatgtcgagcgggcgctcaacacgatgcagagctatgtggaaaactgggtcaagacgagctttctgagcgatgtgcagaagattcttgccacgctcacgacgtctgtaatggcggtcgtcaagtcgattacgaacttcatcatcggtctggttgcgtcgatctatattctctggtcgaaggatacctttcaggcgcaggcgaagaagatggtcgttgctgcctgcaaaccggaggcggcaaatcatctgctggatctgggcagcagcatcaaccggattttctcgggctttatcatcggcaagatcatagactctgcgatcatcggcgtcttgtgctacatctgcatgacgctcatgaagatgccgtatacggcgctgattgcgacgattgtcggcgtgacgaacgtcattccggtgttcggtccgttcatcggcgcggtgccgagtgcgctgatcattctgctggtcgacccgctgcaggcgttctacttcatcatcttcatcattgttctgcagcaggtggacggcaacgtcattggtcccaagatcctcggcaacaccgtcggcatctctggcttctgggtgctcatttcgatcacggttgcggcaggcatcttcggcttcgcggggatgctgctgggcgtgccggtatttgcggtgatctatctcatcatcagcgatattgtgaactccgcgctgcgcaagaagcagaagacaaccgttaccgacgagtattatgatattcgagaggtcgccgacctcgaccgtaaggcggaagctgcgcggcaggctgcagcggaggcagcagacacaccgacggaagagccgaaatccgtatag

SEQ ID NO: 565 - DNA, 2703 bp, Unknown
  Description of Unknown: Firmicutes sequence
atgttgttgaaaactttttcgatagaaggagattttgttatggcacacaaagcatatggtctcaacgagcttcgtgagatgtatctgaagttctttgagtcgaagggtcatctgcgtctgccgagcttttcgctcgttccgcagaacgacaagtccatcctgctcatcaacgccggcatgacgccgatgaagccgtggttcaccggcgaggaagagccgccgcgccatcgtgtgacgacctgccagaagtgcatccgcacgggcgatattgaaaacgtcggtcataccgcgcgccacggcacgtattttgagatgctcggcaacttctcgttcggcgactacttcaagaaggaggcaattccttgggcatgggaattcctcaccagccccgagtgggtcggactcgagccggaccggctgtatccgtcggttttcgagggcaacgagacgacgcctgccgatgatgaagcctttgccatctggcgcgatgatatcggcatccccgagaaccggattttccgcttcggcaaggaggataacttctgggagcatggctccggtccgtgcggtccctgctcggaaatttactacgaccgcggcgcggagtatggctgcggcaagcccggctgcacggtcggctgcgattgcgaccgctatgtcgaggtctggaacattgtcttctcgcagttcaataacgacgggcatggtcattatgaagagctgaagcagaagaacatcgacaccggcatggggctggagcgccttgcctgcgtgtgccagaatgtgaactctctgttcgacgttgacactgtcatgaacatcacgaacaaggtctccgagctgacgggcgcgcactacggcgagtcccagaagaccgacgtttccctgcgcgtcatcaccgaccacatccgctcgtcgacgtttatgatctgcgacggtatcctgccgtccaacgaaggacgcggctacgtgctgcgccggctgctccgacgcgctgcgcgccacggtaagctgctcggtgtcaacgagccgttcctgtacagaatcgtcgataccgtcattcatgaaaacgagtgccagtatccggaactgcgcgaaaagcaggcatatattacccgcgtgatccgcaccgaggaggagaacttcgccaagaccatcgacggcggcatgaaaattttctccgagatgctggaaaaccacaaggcaaagggcgaaaccgtcttctccggtgcggatgcgttcaagctgtacgatacctacggcttcccgattgatctgacaaatgagatggtcaaggaagtcggattgagcgtggacgaggatgcgttccggcagctcatgcaggagcagaaggtccgcgcgcgtgaggcaagaaaagccctcggcgacctcggctgggcaggcgtggaattcggcaaggaaatcccggcaaccgagtttgtgggctacacgaacctggaatcggacgcaaaaatcgtcgcgattgtcgcagaagacgagcttcgcgacgcgattaccgcggggcaggatgcgattctggttctcgaccggacgccgttctacgcagaaatgggcggtcaggtcgcagaccacggcgtgattttcgcgggcgacgcgaaatttgcggtttccgacgttcagaagaacaagggcggcaagttcatgcactacggcaagcttctctccggctccgtttccgtgggcgacgctgtcactgcctctattgacgcagaccgccgcaaggcaatcatgcgcgcgcactcggcgacgcatctgctcgattacgcgctgcgcacggtcctcggcgaccatgcccatcaggcgggctctctggtcgagcccgaccggctgcgctacgacttcacgcatttctccgccgtgacggcagaagagctgatgcaggtcagccacctggtcagcgagctgattctcgacggcatggatgttgagacgaaggaaatgccggttgcggaggcaaagaagctcggcgcgatcgcgctgttcggcgaaaagtacggcgatgtcgtgcgcgtggtcaacatgggcggcaagtccattgagctctgcggcggcacgcatgtggaaaacaccgcgaaggtcggtccgttccgcattgtgagcgagtcttccgttgcctccggcgtgcgccgcatggaggcggtgacaggtcttgcattcatcgacatggtcgacgaaatgaatctgcgccttgtgaaggcggcagagacgctcaagacgacgccgggcgagctgattgccaaggcgcagagcagtatggcggaaatccgcgagctgcaccagacgattgagaagatgaaggacaaggtcttcgcgggcgatgtggacaatctgatgttcgcagcgaagaaggtcggagacctcaaggtcgtcacagccgtccggcagggaaccgatgccaacgaccttcgcaagctcggcgacttcctgcgcgacaaggacgcctctatcgtggcggtcctcggcactgtcaacggcgaaaaggtgacgctccttgccgtctgcggcaaaaacgccgtggcaagcggcatcaaggcaggcgatatcatcaggaatattgctccgattgtcggcggcaagggcggcggcaagccggattctgcgatgggcggcggcacgaacgcgctcaagctcgacgacgcgctggctgcggtggacgattttgttgccgagcatctgaaataa

SEQ ID NO: 566 - DNA, 2391 bp, Unknown
  Description of Unknown: Firmicutes sequence
atgccgaacgcaaaaaccaacctcgtaattgtcgagtcgccgtcgaaggcaaagacaatcggaaaatacctgggaccggagtatcaggtcaaggcgagcatggggcatctgcgcgatctgcgcaagagcaccatgagcgtggacattgaaaacgactttgaaccggaatactatcccatcaagggaaaagaagatatcatcaaggatttgcagtccgccgcagcaaaaagtgcgaacgtctttctcgcaaccgacccggaccgcgagggagaggcaatttcgtggcacctgaagtatctgctggatattccggacgataagacctaccgcgtcacgttcaacgaaatcacgaaggacgtcgtgcgaaacgccatcgccgcaccccgagccatcgatcagaatctggtcgacgcgcagcaggcgcggcgcgtgctcgatcgcatcgtcggctatcagttaagcccgctgctctggaaaaagatccggcgcggtctttccgccggtcgtgtgcagtcggttgcgacaagaatggttgtcgaccgcgaaaacgagacccgcgccttccagccgcaggaatactggaccatcgacgcgcagctcgaccgtgtgggaaagcccggcggctttaccgcgcgctattacggcaacccgaagaaaaatgatctcggcagtcgtgaggatgtggatcaggttctctcgcagatcgcgggaaaaccctttaccgtcggcagcgtcaagaagacccagcgccggaaaaatcccgcgccgccgtttatcacctcgagcctgcagcaggaggcgtcgagaaagctgaatctgaccccgaagcgcacgatgatgcttgcccagcagctctatgaaggcgtcgagctgcgggaagaaggctccgtgggtctcatcacctatatgagaacggactcgcttcgtatttccgaagaagcccttgccgctgcgggagaagtcatccgcagccgctacggcgaaaaatactaccccggtcagccccggcgctacaagcccaaggcaaacgcacaggacgggcacgaggcaattcgcccgagcaacgtcgcgctctatccggagctggtcgagcgcgatctgacgaaggaccagtaccggctttacaagctgatctggaaccggttcatcgcctcgcagatggaaaatgccgtctacgatgtgaccgcgatcgaagcgacctgcgaaaatcagattttccgggcgacacatcagtcagtcgccttcgcgggctttaccgcgatttacgaagagggaaaggacgacgagcaggaggcaatcggctctccgctgcccgatctttccgagggagaggctttgatgcttctttccaccgacccgcagcagcatttcacgcagccgcccgcgcgctacaccgaagcgacgctggtgcgcgcgatggaggaaaagggcgttggtcgcccgtcgacgtatgcgacgattgtctcgaccattcaggaccgtgaatacgttcagaagatcgaaaaacgcctgtctcccacgccgctcggcgaggtcgtgaacgggctgatgatggagcatttccagaatattatcaacgttgagtttaccgccggcatggaagccgagctcgacgaggtcgaagagggtaaaatttactggaaacgggtcctcgaagagttctacaagggcttccatcaggagatggaagacgccgaagaggcgctcaaggacacgaggctcaaggtccccgacgaggtgacggaggaaacctgcgacctttgcgggcgcaatctggtcgtcaagtccggcagattcggaaaattcctcgcctgtccgggctatcccgaatgcaagtttacaaagcccatcgtcgagcgcatgccgggcagatgcccgcgctgtggcagtacgattctcaagcgcaagagcaagcgcggctatgcctactatgcctgcgaacggggcgcggagtgcggctttatgacgtgggacgtgccaaccgagaacgactgcccggaatgcgggcagaccatgttcaagcgctccggcagaggtgcgatgaagcccttctgcatcaaccccgactgtaagaacttcctccccgaagaaaagcgcggctaccgcaaaaagcctgcggctgcggaaagcgcagagcaggcggcggacgaggtaaatcttccgcccgagcctgcggcagcgccagacacggaaacaacaaagacggcaaaaaagccggcggcgaagaagaccgctgcaaaaaagcctgctgcgaagaaaacagcgagcgcaaaaacggcagcagccaaaaagaccgcgacaaaaaagacgaaaaaaacagcggcagaagatgcaggcgaagcacccaaaaagagcgcatcgcgccggaagaagaaggaagacgcaacatga

SEQ ID NO: 567 - DNA, 2727 bp, Unknown
  Description of Unknown: Firmicutes sequence
ttggcagaactcaagcttatctcgccgctgctttccaatatggaagtagtcgagtgtgtgagcgttcgcggcgcagccgcagtatatatcgtcagaagcaccaaaagcgggcagacctacgttctcaagcacatctccgtgccggagtcgcagaagcaggtcgacgcgctgatgttcaccggagccgccgccacaaaggaagacgcgcaaaaatattatgagcaggttgtttccgattatcagacggagctgacaacgcttgaaacactctcggcaagcccgaatctcgattgcttccgcagctatcagatcgcgcccaaggaagacggcgtcggctacgacatgtatctgcttgccgagcatcgcaagacgctcgtcgattacttatccgacaacgccatgacgaagctctgcgcggtcaatctggcgatggacctttgcagcgccctcatcgatctgcgtgcggcggggctcattcaccgcgacgtcaagccgtccaacatctacttgaacgcacaggggcatttcctgctcggagaccttggcatcgcgaaaatcgacgatctcaaatactgcacgatgcccgagagcatgctcagctcctactccgcgccggagctgttcagtctgctcggcacgatcgagccaacgacggatatttattccgtgggcttgattctataccggattttcaacggcaaccacgcgccctttgaggacgaaaacacgtccgcgaaggcagcggatcgccgcagagtcaccggcgaggcgctcccggttccgatgtacgcggactacgagatttccgaaatcattctcaaggcgtgtgccttccagcctgccgaccgctaccagagcccgcaggaactgaaggacgcactggtcgagtacatgaagcgcaaccaggtcgacgacacgctgattgttcccccgatcgcgggtgagcacgagccggtcgatctgacgcaggaggaagaaattgagccggtgcagtttgcagacaccgattcgctgcccgaggatttcaaggagaacttctcgccggacacgcagatgctcaactcgctcatcgactcggtccataaagaagcgcagaaggacccggagggctatggcatctccgggtctctggagccggatgaagaagacgacgcaccgctggatgattccggcgcgcccaaaaagcgccgcaaaaagagccgctggcttcccatcgcgctgtgctgcctgttgctgattgccggcatcggcgcggcggtctacttcttcatcattgcgcccagcaatctgcacatcaacgagatcacccttgtggacaccggcacggactatctgaccgtgcaggtcgattccggcgaaaaggaaggctcgttccaggttgtctgctccgacacctacggaaacaagttccaccagagcttccaggcaaagacagaccttaccttctccggtcttgtccccggcacacagtacaccgtgaccgtcgagccgcagaacggagaaaccccgaccggcaattacacgctcatggcaacgacgctcgcgcagacggagattctgagcttcacggcaacgcctgtctccgtgacgcaggcggagctgaacctcatcattttggatggacccgaccccggcagctggaccgtcagctatgcggcagagggacaggaagcgcagaccgcgaccttctccggtcacagcaccgtcattgcaggtctcgcctccggcaccgagtatacctttaccctgcaggagcctgagaacacgaagctcatcgggcagacgagcgcaacgttctctacggttccgaccgtcagcatcgtcccgccgctgtccgtcgcgatttcgagctcgtcggcaatcttgtcctgggatatcgaaggcgacgcacccgagagctggaccgttaccatcacgggtcccaacgactactccgacacgcagatcgtctccacgccgtctgtgaccttcgagggcttgacgccgggcgagacatatgaaatcatcatctccacgcccacgatgctgcaaagcgtctcgacgtcgatcacgccgaacatcacgaagctctcctcgtttacagccgatgtcgacggtgaggatctcgttctcgactggacctgcgaggtagaccctgcggagccaggctggacactggaagcaaagatcgcgggtatcgataccgcggtcgagcttcccgaagcgcaggacgcgccgctgcgcgtgccgctctccgatctggttcccgatgcggactacacgttcaccattgcgctcaagagcggagaaaagctcgagggcgagacaaaagtggcgtatcactccccggctgtgacggacaagtacaccgaccacggcatgggcaacacctacctcggcttcttcctcaagcccgcaaatgtggaaaccgtgaccagttcgaacctctcgacctcgcgcaacaactactacacgatttccgagcagatggcgttcgcgctgcaaacgctctcgacgctcgacacgaaggcggaggatgacattaccgtcatgctcgttgtccgtaacgacgcgggcaagcttgtcagcttcgaggaaacgcagcggcagtggaacaccatgtgggaaaaggatctgttcgtcggttcgctttccagcatgccgcagaaggcaggcacgtacacgctggaaatttacttcaaccacaagcttgtcaccaccaaggacttcaacgtccgcgaatcgtaa

SEQ ID NO: 568 - DNA, 1005 bp, Unknown
  Description of Unknown: Firmicutes sequence
atgaccattcgcgaacgactcgaacagcaggaatacatgcttctcgcacccaacgcgcagaaggcagcggagacgaagggcaggctttatccggcggaggagaacgaggtgcgcacatgctaccagcgcgacgccgaccggattgtccacagcaagtccttccgccgtctcatgcacaagacgcaggtgtttctctctcccgagggagatcactaccgcacacgcatgacccacacgctggaggtcagccggattgccagaaccatctgccgcgcgctgcggctcaacgaagacttagccgaggctgccgcctatgggcatgatctggggcacacgcccttcggtcacgcgggggaagccgcacttaccgacatgatggggacgccctttcaccacaacgagcagtcgctgcgcgtggtggataagctggagcgtgacggagacggactgaacctgacctatgaggtgcgcatggcgattctggggcatacggggtcccggattccggagacgctcgaagggcaggtggtgcgcacatccgatcgcatcgcctacatcaatcacgacatcgacgacgccatccgcgcagggattctctcggaaagcgacattccccgggaaattgccgacgttctgggaagctcacactcggcgcgcatcaacacgctggtggaaaacatgattgcaaacacgcagaacaccggcgtcctttccatgcagccggaggttgcagcggcgatggacagcctgcgttcgttcatgtttgagcgggtctacaccaacccggtcgccaagggcgaggagtccaaggcgaaggacatcatgcgcaagctctttgattattattacacacacccggacaagctgccggaggacttcattccgcagctggacttcgacggcatcagccggaccatctgcgactacattgccggcatgaccgacaaatacgcgatctataaatattccgaaatctttattcccaccgcatggcaggtgcgataa

SEQ ID NO: 569 - DNA, 1296 bp, Unknown
  Description of Unknown: Firmicutes sequence
atgatttccgctggttgcaatggaaagaaaaatctggtacactggggaaaatacacccgaggaggatgcgccgtgccgattcatgtgacaagcgaaattggaccgctcagaagggtccttctgcagcgcccggggcgggagctcgagcacctgagcccggagacgatggagcagcttctgtttgacgacattccgtttctgcaccgcgcgcagcaggagcatgaccgctttgcggagcttctgcgcgaaaacggggcggaggtcgtctatctcgacgctttgacggcagaggttctggcgcgcgagccgtctctgcgcgagccgtttgttcaggacgtcatcgaaaaggcgggcggcagcgcgcgcggctaccgtgaggcgctgacagaatatctgctgtccgtgcaggatgccgaagcgctggtgcgaaagacgatggcaggcgtgatgtatgaagaggtttttggaagccatgcaccgggactttcaggtctggtgcgcgagaaaacgcgctttctcatgccgccgattccaaatctctattttacgcgcgacccgtttgcctgcatcggcaggggcgtgagtctcaaccgcatgtactccgccacgcgaaaccgcgagacggtctacggaagctatatcctcaagtatcacccggactttgccgggcaggtgccgctctattatacgccgcaggagcatttctctatcgaaggcggcgacattctgaatctgagcgaaagcgtgcttgccatcggcatgtcccagcggacgcagcctgaggcaatcgagcgtctggcagcgcgcatatttgccgacgagagaagcacgatcacaaccgtccttgccttcgagattcccagaacgcgcgcgttcatgcatctggataccgtttttacgcaggtggacacggacaaattcaccgtccaccccggtattttgggcacgctcagcgtgtatgagctgaccggcaggggagagacggcaatccggacgcggaagctggaggcgccgctggaggacattttgaagcagtatctgcatctggagcgggtgcatctgatccgctgcggcggcgcaagcccgattgcggcagaacgggagcagtggagcgacgggtccaacacgctctgtctccgccccggcgtggtgctggtctacgaccgcaactatgtgacgaatcagattctgaacgactgcggcatcgagacgctggaaatgcccagctccgagctgtccagaggcagaggcggtccgcgctgcatgagcatgccgctggagcgcataagcctgtaa

SEQ ID NO: 570 - DNA, 1350 bp, Unknown
  Description of Unknown: Firmicutes sequence
ttgactaacggaaaaaaaacacgttttcacacgctgcaccgaaagcttcttgcgaccatgcttgccgcgctgcttgccgccatcggcatctatcttctgaccgacgccatcgggcaggcgttcattgagcgcgtatacatgagcgcggaggcgcagaaccagagaaatcttgccacggtctcgtcctttcagacctacgcgcgggagttcaacctctcctcgcgcgacaccgaaatgatctcccgctgggcaatctcgcaggacgacacctatattttattgtataaagaccgccgcctggcattggaagccggctggtggggcatcgacgaggaaagctccggcacggaaagtctggacgatctgtatgatgtgatcacctacccggtgtatctccgagacggtgtgtttcaggcggtggtctacgatttttccgaggcaaagctctatgacggcgtgcagatcggtgcaattgcgctcgcatgcgtcatgtttgccatcttcatgctgatctacaaccggcgcatcacgcgcgcgattgtggaaatttccgaggaggtgaagcagatcggagacgggaatctgcaattgcagctcacggcaagcggagacgacgagctggcgcggctgactgagagcgtcgagtcgatgcgcaagtcgattctcaaaaagaccgacgagcagcagcaggcgctggaaaaaaaccagagcctgatctccgccatgagccacgacatccgaaatccgctgaccgcgctgctgggctatctcgatctggcgctgagcggacagtaccgctcgccggaagagatgaaaagctatctggaagctgcctacagccgggcgctgcagctcaaaacactgaccgacgagctgttccgctactctctggtcttcggtgcgcaggagcttcccattcagcttgagcccttcgacgccgcagcgcttctcgaccagatggtgggcgagggcatcgtgatgctggagcagaagggctataccatccgccgcgcggtgcagccggtctcgtgccagattcaggtggacgcctcgtatttcaagcgcgttcttgacaaccttgccgacaacatctgcaaatacgcagacccggcaaagcccatccacgttcttgtggcgcaggagagcggcgcgctgacactttgcgtgtcgaataccattctgaaaaaccccgggcaggtggagagcaaccgcatcgggcttcgcatctgcgagaaaatcatgcgccagatgggaggaacctttgaaaaaaggcagacagaagataccttcactgtcaccctgaccctcccggcgcagccgctggcagtcgaggaaggagaaacctcttaa

SEQ ID NO: 571 - DNA, 2610 bp, Unknown
  Description of Unknown: Firmicutes sequence
atgaagctgatgattttagacggcaacagcatcattaaccgcgcgttctacggcgtgcgcctgctcagtacaaaagacggcgtctatacgaatgcgatctacggttttctgaatattttagagcgcctgcgcgccgacgagcagccggacgcgctttgcgtggcatttgatctcaaggcacctaccttccgccataaggcttacgacggctacaaggcgacgcgccatccgatgcccgaggagctggcaatgcagatgccgctgatgaaagaggttctcggcgcaatgaacattcccatctatgagtgcgaaggctgggaggcagacgacattctgggcacggtgggcgagatctgtacgcgcgagggcgacgactgcgtgatcgttacgggagacagggattctttgcagctcgtaagcgagcacgtgacggtaaagctggtgacgtcgaaagccgggcagaccatcacgaccaactatacccctgatgcgttccgcgcggaatacggcttcgagcctgtgcggctggtcgacctcaagagcctgatgggggacagctcggacaacattccgggagttagcggtgtcggacccaagacggcaacacagcttttgctctcctacggcacgctggacggcatttacgagcatctgccggaaatcaaggagtcggtccgcaaaaagctcgagtgcgaccgtgagcaggcatacctgtcttatgacctcgcgaccatccggaaaaacgcgccggtggagtttgccccggaacgcaatctggtgcggcaggtagacaatgatgcgctgtatgcgctgtttcacaggctggagtttacgcgcctgatgagtcggtacaatcttcatgcgccgcaggaaaaagccgcgccgcaaaagacgacggatgtggtcgtcatgtgcgagtctgtaacggatgcgtcgcaggcgcgagagattgcggcaaagctcacaaaagaacgttatgtaaacttaatgacagagccggacctttccggaattgcagtcgatacggaggatacaagctatctgttctccggtgatgccgtgcaggataatgactttatgtcaactcttttcagcgcgtcgatcaagaaggtcacgcacgactgtaagcctctcatgcgcgtactgctggaaagaggactccctgccgacggctttatcttcgacacagcgctggctgcatatgatctggacgcgacgcggggcgagtatcagctcgacgacgtgttctcgcagtactgcggcgcgcagatcggctacgtggacgcgcagcaggtggggcaagaagcagcgcgggaggctgcgcttcgggcgcaggcagcggctgtggctgcactctatgaagtgctgcccggcagaatccgggaagccggtatggaaaagctctattatgagatcgagcttccgctctgcctgtgtctggcgcgcatggagacgcagggcgttctggtcgatcagatggcgctgattcgctttggcaacatgctgaccggcggcatcgaacacgatcaggaggaaatcttccgctatgccgggcaggaattcaacatcaactctcccaagcagttgggcgaaattctctttgagaagctggagcttccgccggtcaagaagacgaaaagcggctattcgacgaacgccgaggtactggaaaagctcaaaaaccggcacccgatcatcgaggcgattctggattatcggacgcttacgaaattgaaatcgacctacgccgatgggctggtcaaggaaattgcaggtgacggcagaattcacacaacgttccagaacatggtcacagcgacggggcggctttcctcgacagaaccgaacctgcagaatattccggttcgtaccgaactggggagcgaaattcgaaaaatgttcgtgccgcaggacggctgcgtgtttgtcgacgccgactacagccagattgagctgcgtgtgctggcgcatatcgcgcaggatcagcacatgcaggaggcgtttacctccggcatggatatccacacggcaactgccgcgcaggtgttccatgttgcgccggaggacgtgacgccgctgatgcgccgccatgcgaaggcggtcaacttcggcattgtctacggcatttcggagttctcgcttgctgaggatatcggcgtgacgcgcaaggaagcaaaggcgtatatcgaccggtatctggaaaattacgcgggtgtgcgcgcgtatatgaaagatatcgtcgcaaaggcaaagcaggacggttttgtcacaacgctgttcggaagacgccggaatctgccggagctcaaaagcagcaacttcaacatccgctcgttcggagagcgcgttgcgctcaacacgcccattcagggcacggcggcggatatcatcaagctggcaatgctgcacgtcgaccgcgccctgtgcgagcggaagctgcaagcccggcttgttctgcaggtccacgacgagctgatcgtcgagtgccccgtcgaagaacgcgtgcaggtcacacagcttctgaccgaacagatgcagcaggtggcaaagctctccgtgccgctgcttgccgaggcaaagagcggcgcaagctggtatgaggcgaagtga

SEQ ID NO: 572 - DNA, 1614 bp, Unknown
  Description of Unknown: Firmicutes sequence
atggaccccatctatgtcaccggtcacagaaaccccgacaccgactccatcgtctcggcgatggcatatgcggcgctgcagaatgcgctcggaaaccgcgaatatgtcgcggcgcggctcgggcatatctcagacgaaacgaagctggtgttagaccgcttcggctttgagccgccggtccgcatccagaccatgcgcacacaggtgcaggatctggactacgacacgccgcccgcgctctcgcgcgcggtgacgatcagcagggcatggaaggcactgcagtctgaccgcagcatccctgccattccagtcacgaacgacgacggcacgctctacggcatgctctctccttcggaaattgcggaatacgacatgcagacgattgcaaacacctacgccgagaatctgccgattttcaatctgctcaatgtcctcgacggcaaaatcatcaacgaggcggggtatctggtcgaccgcgtgagcggcgaggtgtcgattgcgctgccgcagcagaacgaaaatctgctgttttccggcaaggattccatcgttatctgcggcgaccaggcggcaatggcgcggcgcgcgatggaaatgaacgtcaactgcctgattgtgtgtcaggcggagcttccggcggagcttcgcgcgatgcagacgacaacgtgcatccttgcaacgccgtttgatgcgttcaaggcggcgcgcatgatctatcacgcgattgaagccgggcgcatctgccgcacggaggagctggatgcgttccatctgacggactttgtcgacgacgtgaaggacgtcatgctggaaagccgccacagaagctatccgattctcgacgaaaacgacaaggtcgtcggcacgatctcaagatatcacctcttaaagccgcgccgcaagcgcgtggtgctcgtcgaccacaacgagatgtcccagtccgttccgggtctggagcaggcggacattctggaaatcattgaccaccaccgccttgccgacatccagacgggcgcgcctatctactttagaaacgagccggtcggctcgacggcaacgatcattgcctcgatgtatcaggagcggggactgctgccgtctgaccggctggcagggctgatggctgcggcgatcgtggcagatacggtcatgttcaagtccccgacgtccacccagcgcgaccaccgcatggcagagcgcatggcgcgcatcgcgaacatttcgctcgacgagctggggcaggcgatcttctcggcgtcgatggacagcaagccgacggagtcgcttctgttcggcgatttcaaggacttccacatagccgaccacgacttcggcgtcagtcagatcacctgcatcgactccaagcgcatgatggagcgcaaggacgaattcctggcactgatgcaaaagacgatggaagagcgggggtatacgctcatgattctgatgctcacggatgtgctgctggaaggcacgcagattctctacatcggagacgaggagattttctcgcatgcgttcaatacgccgctcaaggaccacacctgcttcctgcccggcgtggtgtcgagaaaaaaacagatcattccgatgctctcggcgctttggggctaa

SEQ ID NO: 573 - DNA, 1833 bp, Unknown
  Description of Unknown: Firmicutes sequence
atgacgtttgaagaactgaaagacaaggcattgagtctgccgctcgagccgggcgtatatctgatgcaggacaaatccgggcagatcatctacgtcggcaaggcgaagaagctcaaaaaccgcgtgagccagtatttccagaacactgccgcgcatacgccgaagacaagaaaaatggtcagtcagatcgaccattttgacgtcattgtcgcggcaagcgagtttgaggcactggtgctggaatgctcgctgatcaagcggcacatgccgaaatacaacatcctcctgaaagacgacaagggctatccgtatcttcgcgtggacatgcgagacgaataccccgtcatggagctggtaaaccgcgtcatgggagacggcgcaagctactttggaccctacggcggcagatcgaccacacagcgggtcattgataccatccggctgacactgaagcttccaggctgctcgaaaaaatttccgcgcgatctgggaaaggagcgcccgtgcctcaattaccacatgaataactgcgacgcctggtgccagctgtcccgctcgcccgcggagtaccgcgcgcgcatggagcaggcaatgatgcttctgcaggggaaatacaccgagcttgctgacgccatccgcgaaaagatgcttgccagcgcagaggcgctggactttgaacaggcggcgctgctgcgtgaccggctgcgcgcagtggagtctctcggacagaagcagcttgtgaccgcaggttcgatggcaaataccgacgtcatcggctattatcagagcgaggcgaaggcgtgctttgcggtgctgcactatgtggatggaaatctgcttgacaaggactacgagattctgcagccgtcggacgaggaagaagacgcaatgggcgcgctcgtcaagcagtattatctcgcccgcggcgcggcgccgaaggtgattctgctgccgaagccgatggaggacgcggcgcttttcgaggagcttctgtatcagaatctgcagaagaaggtccacatccgcacgccgcagcgcggagacaatgtgcgtctggtggatcttgcgcagaaaaatgcgcgcgaagaggcagagcgcgtcacgaccaaagccgagcgcgccatggggacgctgggcttgctgcagagcatgctgggcttggagcagccgctgcaccggctggaatcctacgatatttcgaacatcgcgggcaccgacatcgtcgcgtcgatggtcgtgtttgtcgacggccggcccagcaagcaggactacaagcgctttaaaatcgaaggtttcaccgaccagaacgactacgcctccatgcagcaggtgctccggcgcagactcacgcatcttaaaaacggcgacgccgggttttctgcggcgcctgacgcgcttctgattgacggcggcatcgagcatgcgaacgcggtcttgcaggtgttggacgaactgaatctctcgattccgaccttcggcatggtaaaggacaatcgccacagaacgcgcgccttagttaccccgcaggggcatgaaatttcaatctctgccattccggcggtcttttccctgatcggaacgattcaggaggagacgcaccgctttgccattacctatcaccatacgctccgcagccgccgggtgcgcggctcgaagcttgaagaaatccctggcattggagaaaaacggcgcgagacgctgctcaagaccttcaaatcggtgcgcgccgtggaaaacgccagcctgacggcattggaggacgccatcggaaaggcagccggaaagaccgtctacgactattttcacaaagaatgcgaggaggaaacgccatga

SEQ ID NO: 574 - DNA, 2403 bp, Unknown
  Description of Unknown: Firmicutes sequence
atgacaaaggaaatgctgcatcagctggtagaggaaacgtgtctgcgcatgttcggctgcgagctgcgagaggcgacggaaaagcaggcgtaccgcgcgctgtgcgtgacggtgcggatgatgctcgaggacaggcagcgcgcatttcaggcggagacgcgggaaaaagagcgcaagcaggtctattatatgtccatggaatttctggtgggcacgtcgctgcgcaataacctctttaatctggggctctataacgaggcggacgaggtcctgacggagctgggcttctcgctgccgaagctctgcgagatggagccggacgcggggctcggaaacggcggtctggggcggcttgcctcatgctacatggacgcggcgactgggctttgctatccggtgacgggtttttccatccgctatgagttcggcatcttcaagcagaagatcgtcgacggctggcagatcgagttcccggacgactggctggggctgggcgacgtgtggctgcacacgagagaggacgacgccgtcgaggtccgcttcggcggaacggtccatgaatggatggaccacggcaagttcaaggcggcgcaggtgggctatcagtccgtgatggcagtgccgcacgacttttacatttcgggctatcattccgacgcggcaaacaagctgacgctgtggtcggcagtcgtgccgcaggggtttgatatggcagcgttttcacgcggcgactatgcaagagcgcttgagcagaacacgatggcggagaccatctcgaaggttctgtatccggcggacgatcatatcgagggcaagagactccggctcaagcagcagtatctgctggtttcggcgtcgctgcagtcgattctcaaggagcactgcaagcagtacggcacgctttccaatcttgccgacaaggtcgcggtccatatcaacgacacccatccggcgctgtgcgtgccggagctgatgcggctgctggtcgaccagtatgagatgggctgggacgaggcgtgggagatcgcctgcaagtgcctgtcctacacgaaccatacggtcatggcagaggcgctcgagcattggcagatcgacctgttccgtgagcagctgccgcgcgtatacggcattgtccgcgagattgaccggcgcacgcgcaaccggcttcagcttgcctatcccggcgactgggcgaagatcgattatatggcgcccatctccggcggcgaggtgcgcatggcaaatttgtgccttgctgcgtgccacaaggtcaacggcgtgtcacagctgcacacgcagattttgaaagacggtattttcagagactatgcccaactcgatgagagccggttcatcaacgtcacgaacggtatcgcctaccgcagatggctgtgtcaggcaaacccggcgctgaccgactatctcacaaaactgatcggcgacggctttacgaaggacgcacgggagctggaaaagcttctgggcttctacgataacgaggaagtgctctcgcagctgcgcgcgatcaagctggaaaacaagaagcggctggcagcgtatgtaagccgcgcaaacggcgtcaatctcgacccggaaagcctgtttgacgtacaggtcaagcggctgcacgagtataagcggcagcttctgaacgtgctgcatattttaaggctgtatctcgacatcaaggacaacccatccagggaggtcacgccgcgcacgtttatctttgcggcaaaggcgtctgcgggctatcagatggcgaagcggattatctcgctgattgtcgcggtggcagatatggtgaacgccgaccccgcgatgcacggaaagctcaaggtcgtgttcatcgaggactacaaggtatctttggcggagattatcattccggcggcggacatttccgagcagatttcagtcgcgggcaaggaagcgtccggcacgggcaacatgaagctgatgatcaacggcgcagtgaccttgggaacgctcgacggagcgaatgtcgaaatctgtcagcaggtgggagaagagaacatgttcctgttcggactgcatgctgagcaggtcgaggcgctctggagaagcggctatgacccgagggcgtatctgaccccgggattgcagcgggtgttcgatctgatgtgttcgggcgcgctgggcggaaagaagtttgacgacattgtcgccagccttacctccaatcgcttcggcacggcggacggctacatgaccgtggcggactttgagagctactgccaggcgcagcagaaggtgggcgcgacgtggcgcgatgcgcggaagttcggcaacatgtcgctggtgaacattgcgaaggcgggcattttctcgtcggaccgcgcggtcgagcagtacgcggaagaaatctggaatctggattaa

SEQ ID NO: 575 - DNA, 1074 bp, Unknown
  Description of Unknown: Firmicutes sequence
atgaaaacaagatcgaaaatccgcatccccatgccggcgcgctatgtgatcaatcttgcgctggtggtcggcttctacttcctgctgacggggctgatttcctctggcgtcattacgaactactggaccggcattttaatcaccgtcggtatcaacatcattctggcggtttccctgaacatcgcaaccggctatctggggcagctcccgctggggcacgcaggcttcatggcggtcggcgcctatgcaggcggcatcttcatgaaagcaacacctgccgctgcgctcctgaaagagggtaataacgcggcgctcattccgtacatccttgccgcaatcgtcatcagcgccatcgtcgccggtatcttcggcatcatcatcggcattccggcgcttcgcctgcgcggcgactatcttgcgatcatcaccctcggcttcggcgagattatccgcgtggttctgacgaacatcgactccgtgctcggctttgacttcacctacggcgcagctggtctgaagcggattcccaaattttcttccgtaacgctggtctttatctgcgtggtgttatcgtgcttcttcatccacacgatgatgaaatccaagcacggcagggcgattctctccatccgcgacaacgagattgcatccgagagtgtcggcgtcaacaccacctattataagacgatggcgttcgtgttctcggcaatgcttgccggtatcgcaggctgcctgtacgcgggctatctgggctcgctgtatccctcgacgttcaagttcatgaaatccatcgagatcctcgttatcgtcgtcctcggcggcatgggctcgatgctcggctcgatcgtctcggcgacggttctgacggtgctgcccgagcttctgcgttccgtcgcagactaccgcatggtcgcatactcgctggcactggttattatgatgatcttccgcccgaagggactgtttggcagttacgatttctcgatgtcccgcgtactggaaaaaggactcaactttgtgttcagaccagaactgagaagccggaaggaggagcagaacgatgagcagaactga

SEQ ID NO: 576 - DNA, 816 bp, Methanobrevibacter smithii
aaaggtgaaaatttgaatcattcaaaaattattttggtggctttcatttcagcgtttgtagctattactactgcggtacttggagttgcaggaactattattggttctgtattatcttctgtactttataatgtactttcagaagcattacaaaaaccagttgataatgcaaagcttaaagctaattttgagtgggaaatagcatattcctttccattaattgttatggcattaattcagctattgttaatttttgctatgttgtctgaaatgggatttttaccatcaacatttttaaatgtttatttatctcttcaaaatgttgcagataataatttatatagagttttaggattctcattgctgattatgagtgtttatccatttgtattaaaacctgattttgttaaaaaatctcatggaggtttaattgcatttattgggctgatatttttagctaaaggtttctgtgatagtggatttttagtgttgtattacatattccattattttgatttcccaatagctttaattgcatttgtattattgtctacagtaatttataagattttgatttctgctaaggaagctaaaggtgaaattaaaaaacgtccggttaatcataatttggatgatcttgagctaatacaaattcgtcaaaaaagaatggatgcatcttcaaaagataatagttatagggagcatggttatagggaaaaaccaataaaacatagagtcagacgaaaccaaataaacaaatcttctgaaaacattcaatttgaaactaatgagtttttagatgactataaaaagtag

SEQ ID NO: 577 - DNA, 615 bp, Methanobrevibacter smithii
gtgattttaatgaaacaaaaattaattaaaaaagctcaagagcttagacaacatggttttacaactggtgaaatagctgatgaacttaatgtaagtatggatactgccagatggttaactctccaaaaacctgctgaagaaaaaccagaagctcctgttgacttttttataaattggaaaagtttaggtggaaattcaacccgtttaagatatgtttccggagctttaagtgatatggcattatcacatggagaagctgaagtaattcttggaatagctgtcagcggaataccatttgcaactatgatggctgactttctagaagacatgagtggagttgaaacttcccttgcagtataccaccctcacaaacacagaaaagaaaaagacgacggcgaaggagctataagtaccaatttcggatctgttgaaggtaaaaaagttgtaattgttgatgatgttataaccagcggtaaaactgtaaaagaagttattcatgcagtaaaagaccatggtggagaacctatagctgttactgtattaatcgacaaatcaggactttctgaaattgaagaagtccctatcgaatctttaattaaagtaggtagattataa

SEQ ID NO: 578 - DNA, 1023 bp, Methanobrevibacter smithii
atgacttgtagtattttagtcggtggagcatggggtgacgaaggtaaaggtaaatgtatcacttatctttgcggtaatgataaaccggatatcattgctcgtgcaggtgtaggtccaaatgcaggccattctgtagagtttaatggtgaaaaatatggtttaaggctcatcccttctggttttgtacatactgatgctaaactcatgattggtgctggagtattagtagataaagatgttttatttaaagaatttgaagatttaaagaaatataatgtaaaagaaagaacttttgtggatcctagatgtgctattattactaaagatcacagagaaagggacaaaaaatcagaacatttagctaaaaaaataggaagtactggatccggctgcggaccagctaattctgatagggtattaagaacagttaaattagctaatgatgttcctgaacttgaggattatttagctgatgtttctttagaaactaatgatgttttggataatggaggggatgtatttattgaaggttctcaaggatttgcattatctctttactatggaacttatccatttgtaactagtaaagacactactgcaagtacatttgctgctgatgtaggtgtaggtccaactaaagtcgatgaagtaatcaatgtatttaaagcttatattacccgtgttggtgaaggacctttcccaactgaaatttcacaagaagaagctgaaagtaaaaatattgaagaatatggtgttgtaactggacgtaggcgtcgtgtaggtttatttgatatggaacttgcaaaagaatcctgcagaatcaatggtgcaactcaaatagctttaacctgtgtagacagattatatcccgactgtgctagaacacaaagttatgatgatttatctgctgagaccaaaaaattcgttgaagaaattcaatctgaaactggtgttccagtaactattatttcaacaggtccggatttaaaggacactattgatttgagaaaagaattattataa

SEQ ID NO: 579 - DNA, 540 bp, Methanobrevibacter smithii
ttgtttaagagtaaggtagaaggttttattgtgttacgtttagatgcagaattaaataaggatactatttcaaagcttaaaaaaccattaggtaaattatatcctgactttgaagatgctattgaagaaattaaatcttctgagtttttaatttctgttggtgatgcaacttttaataatcttactaaatatgaattatatcctgatattggtataattgataatttaattcaaagaaaaaatcataatcatgaagttatcaaggcagaaaatattttaaaagctaaaaaccctgcaggaaccattacagatgatctatgggaaaccataggccaagctatggagttatctggcgatggaaattgtcatgtaattgaagtagacggggaagaagatcttgcagttcttccttgcatcttaatggctagtgatgagactactatcttgtacggtcagccaaatgaaggtttggtacttttaaaagtttatgatgctaaagattatgctcaaaatcttattgatacctttattaaagaataa

SEQ ID NO: 580 - DNA, 1005 bp, Methanobrevibacter smithii
atgatggatggtgtttttatttcagattttaaaaaccttgtaaaagcagttcaagaatttgagggagtgacccgtaagtcttctattgatactgtaacatctcttttgactgaatcatataatgtttcaggtgatgttgtaattgacattggtgatgatgcttcagctattgatattggaaataatcaggtagttttaatagctgcagatggcatatggggtcaaataatgaatgttaacccatattgggcgggttattgttctgttcttgttaatgtaaatgatattgcagctatgggtggaaaacccttggctatggttaatataatgtcagtaaaacatgatgaaatttatgaaaatttactggcaggtattaaagacggctgtttgaagtttggtgtgcctatggttggaggtcatctacatcctgatggtgaagttgattctttgggagtagctattgtaggaattgcaaagaaagataaattaatcactagctttggagcagaagtaggtgataaaatcatcgttgctattgatttagacggcaaacctcatgaaatgtttgaactaaattgggacactacttatgataaggataaacaactggttcaggaccaaattacagcggttcagtatttggctgaaagagattatattaaatctggaaaggatattagtaatccgggtattttaggaactttggaaatgttgcttgaaacatctgataaaggagcaattgtcaatttggaggatattccgaaaaatgaaaatatcagttgggaaaattggttaaaatcatatcctggttctggttttatatttacagcaaatgaggaaaactgtgaatttattaaaaagtatttgaaggattattctattgaagcaaatgttgtcggggaagttactggggggtgttctttatatttggttaatggcgatggtgaaaaactggaagttttcaatcaaaaaaccaatccggtttttaaatctaaaaaggaataa

SEQ ID NO: 581 - DNA, 807 bp, Methanobrevibacter smithii
atgtgtaataatatttcatttttaggtccgaaaggaacttttactcatgaagcagcttatatacttgagggaaatttaattccatattgcacgattcctgcagtgatggaaagtgtttcaaatggggagtgtcaatttggagtagtgccaattgaaaactctattgaaggtccggtaggacttactctagattctttagctcataaatttgatttaaaaatatttaaggaaatggtaattccaattaatcagaatttaattgtcaatcctaaaacagttatgaatgacataactgatgtatattctcattctcaggcaatagctcaatgtcaggagtttattagggataatgaaatacagccccattatgctgtaagtacagcccgtgcagctaaaagtattttaggcgataaaacaaaggcagctattggaaattctaaagctgctgagatttatggcttggaaatcctcaaacctaatattcaggatttggataataacgaaacacgttttgtagttttatcgaaaaatgatcatgagcctactggcagggataagacttcaataatattctctatttatgaagataaacctggtatgctttataaaatattaggtgtttttgaaaaagaaagtattaacttaacaaaaattgaatcaagaccttctaaaaaaggtttgggcaaatatttgttttttgttgatttttatggtcatagaaaagataaaactgttcagaatattctaaatgaactggatgggcttacttactttttaaaggttttaggttcttacccggagttttag

SEQ ID NO: 582 - DNA, 723 bp, Methanobrevibacter smithii
aacattatggaattccaacatattgatttaaatcaaacccatatcagactaacaacagacttgaaaaataacaatttggaaaaatacatattaaatctaagaaaagaactggaacattatatagctaaaaataaagattttcaattatctctggagcctgttaatcatgatgaagaggatttgagtgaaataataaaaagaatgtatacagcttccagttactgtgatgtaggtccgatggcctgtgttgcaggatgcatatctgaaatgtctcttgattacctaatttccaaaaaatccgaatattccattattgaaaacggaggagacatagctattgtaaacaataaaaaagcagtatgcggaatttactcaaacaatcccatattaggaaataaaatcgggtttgaattaaaagcaagaaaaacaccgttgggaatctgtacatcttcaggtaaaataggccattcaataagcttcggttatgcagacagcgttacagtgctgagtaaaaaagcatcagtagctgacgggcttgctaccaaaatagccaatgaagctgttgggcaaaacagtgaagacaaagtatcaaatgcccttgaagctagtgaaaactatagggatctgtttgaaggagttttaatcatttcccaagataatgttggaagcattggaaaacttccaaaaattgttgaaactgaagaatttaatgttaagatgtga

SEQ ID NO: 583 - DNA, 783 bp, Methanobrevibacter smithii
gagagtatgaaaacatttacaaaaattgctaaaatctattttagcccatcaagtacaacaaggaaaatagtagatgaaatagccaataaatttgaaggcacacaggaagaatacgacttattaaatgtagctggtggaaattctccaaaagagtttggtgatgacacattagtaattgtaggaatgcctatttttgcaggaagacttccgaaaacagccagtacaaaattaatgaactttaaaggagaaaatatccctgcaatagctgtcgtaaactacggaaacataaatatcggagatgcactccttgagttaaatgacctgttaaaagaaaacggatttaccatcgtaggaaccggtgcaacagtcagccagcactcaatagtaacagatgttgcagcaggcagaccggatgaaaaagatttggaaaagcttaatgaatttgtagaaaaatgcagggaaaaattagattctgaagaatttgaagacattgaagttccgggcaataaaccgtactgcgaatataaaaaagttccattagctccaatctgtgacgaatcattatgtacatactgctatgagtgtgtttcatcttgtcctgaagaagctattcctgatatggaccctggacagacagatgctgatctttgcagtgcatgtactgcctgcatatatacatgccctgaagatgcaagatactttaccggagacttatttgaaggaatgaaagaaagattcctaactaacttcaaccaaagaaaagaaagtgaattttatttatag

SEQ ID NO: 584 - DNA, 759 bp, Methanobrevibacter smithii
atgattggaattattggcggcagcggagtttatgaaataactcagaaggcagacagtgttgaaaaaaagttagtcaaaacagactatggggaagttgaagtttctattttggatatattcaataaaacagtagcttttattccaagacatgctgcaggacacagcattcctccacataaaatcaatttcagagctaatattgatgcacttaggaatgtaggtgttacacagataatagctaccaattctgttgggtctatgaatctggaaatgcctcctggatcatttgtcattcccgatgactttttagattttacagaaaacagggataagacatactttgaagaccatgttgttcatgtagatgtaactgaaccttattgtagtcgtctaagggatataatggctgactgcggtgaagttattactggcggaacatatgtgtgtacacagggacccagatttgaaacacctgctgaaatcaaaatgttcaaacttcttggaggggatttggtaggtatgactggagttcctgaagtaacattggctcgtgaaagggcaatttgttacaactccatttgtatagtttcaaattatgcatcaggcatttctgaagataacttgaccattgatgaagtatttgaaatggttaaggctaaagaatcagatttgcttgaattgatttatgaaatcatcaggaatttagacgacgattttgattgtccttgtcgccatgctttaaatggtgctgaagtttaa

SEQ ID NO: 585 - DNA, 1020 bp, Methanobrevibacter smithii
atgaaaatagctattatatctgtttcaaaaaaaggttatgaactatctttattattaaagaaacatttggataaagattcaactataatcaacactgatatttattataaggatgttaaaaacacttttaaattattattttatgaatatgatgcaattatagctattatggcttctggaattttaattagaagtattgcaccattaatcaaatcaaaggtttatgatcctgctattttaaacattgatgaaaatgctaattttgtaatcagtacattatcaggtcatctgggaggagctaataaacttacatcaaaagtagctaacatgttaaatgcaacagaagtcattacaactgcaactgatgtcaataaaaagttaggtgttgatgtaatagctaaagatttatatttgacagttaaaaatccaaatgaaatcatatactttaataaagctattttaaacaatgaagaaataatgttcagagtcaacagtaaagaaaactatgattttttatttgattatttaaatgagaatacacttgaaattgatgtttcaattgaatttaccagttccataaatacagatgaaatacatgtcttatataaaaatcataaactgataatgaaaattgaagatattgttgtcggtattggttgcaaacgcggaaaatccaaagaagacattttaacaggtcttgataaagcacttgatgatttaaatatttctaaaaaaagattatctaaaatggcttcaggtgaaattaagaaagaggaaacaggtattttggatttaagtaaaatgttaaatattccagttaattttgttgaaatggacaaactgactttattcaaatcagaggatatacatgaatcagaatttgtaaaatctaaatttggtgttggcagtgtgtctgaagcttctgctttaattacagcaggctttgattcaaaattaatttataaaaaaacagcttttaatggtgttacaatagctttagctgtttctaaaaaagattaa

SEQ ID NO: 586 - DNA, 735 bp, Methanobrevibacter smithii
tatttaaatttaactaaagaattatattttaaaaacaacaaaatactacacatggaaaacaaaattatcactgattcaaacaaagatctggacattaaataccatccaaatattaaaggtgttcaaattatagaaggtaaaaacaatttcccaattagctggttaaatcaacagggatattgtgagtatcagctatatctgcagtacttccagggagtaaaagtaggagaaacccaggccatgactacaggaatcaaagtgcacaaccagctggaagagaagtttcaggaaagtgcaacacctgcaacctttgacgaagtacttgaattttcaaaaactgaaaaaacagtaaccagagaaatgtttgtaatttcacctgaatatggaatcagaggatttatagatgaaatatggatgacccctgatgaatttgtaataattgatgacaaaccaggaaaccaagcatacggctcaacaataaaccaggtcagagcatattgtcttgcatttaaaaatatgattaatgacaaaagaaaaattgtaggtgccctaagacaaagaggaactgacaacatattctggagtgaagaatttgacgaagatgctcaaaaatcaattaaattcctgattgacagaatggacggattgttcaaaggagaaaaaccctttataaaaacaaaaaatcccaacaaatgcaaaagctgcagattccaaagctactgtatacacgattaa

SEQ ID NO: 587 - DNA, 1080 bp, Methanobrevibacter smithii
atgagtaacaagaaaacagctatggtgggaacaccttgccaaatattagcagctacaaaaattaacagatacgaagaaaaaaccggcggttctcctattgatgttaaaataggtttgttttgtatggaaaacttctcataccaatatcttaaaagatatttgaaaagtcgcgatattgaattgtttgaagttaaggaatttagaatagaaaaaggacaatttgttgcatatttgatagatggtaatgtatttagaataccgatagctgaaactgaaccttttactcgtaaaaattgccatatttgtactgattatacttctgatgtttcagacatttctgttggatctgtcggttctccgaaatatcactcaacagttattgtaagaagccaaaaaggtaagcagataattgatgcatgtatagctgaaggatacattgaagctgaagcgatttccagaaaaggtcaggatttgctggaaaaaatagctaatcaaaaaatcagcaaaaatacaaaaatctataagaaaagggaagctattggaaggcctgttttatcaaaaagacaaatatccgaagaagaattctatgatgaatgtggcaaatgtcagtttgacaacctgcaaaatgatgtaatcagtgtagggtcctgtgttttatgcggtgcctgtgaatatgtctgtccgattggtgctgttcagataaacaacagaaaacctgtatcagtaaaagaatgtgaagaagactgtcatgcatgttactttgcatgtcctagaacatttatcagtgatgcaatatatcctgaaggaattgatgaacagccattaggcgaataccttgaaatttactctgtaaaagcagattcaattatgggacaagacggtggtgtagtatcagctattttagtatatcttcttgaaaacaatattgttgatgaagtttctgttgtcggtgaagataaggatgcaccttggagaccggaatcttatcttacatctaaaatccaggatgttattaaagctgctggaactaaatacagtactacaacaattggatttaaagcattaacaaataagaagtaa

SEQ ID NO: 588 - DNA, 753 bp, Methanobrevibacter smithii
atttatttaggagcgtttattatggctattaataacggagattttgtaagattaaattttactggaaaaattaaagaaaacgatgaaatatttgatactacttttgaagatgtagctaaagaagcaggtttatttgatgaaaacaaagaatacaaacctattccaattattgtaggtggaaatcatttattaccagctattgaagaagctattgttggattagaagcaggcgattccaaaactatcgaaattgatagtgaaaatgctttcggacctagaaacaaacaattaattcaattaatcccaatgaaagaattcaaaagacaaggtatgactcctgtaccaggtatgaaaattacttctgaaggaagcactggtaaaatcttaactgttaacggtggaagagtaaaagtggacttcaaccatgaattagcaggtaaagatttaatttttgatgttgatgttactgaaatcattgacaatgacgaagacaaaattaaaagtatgattgagttacattacgcagctcctaatatggatattaacaaaaccgtaattgatattgacggtgatgttgtaaacataactttagatgatgttgctaaattcgatcaaaaatcttacatggatgtaacctttgctagattcagaatagctaaagacatatgggaaaacatggactttgaaaaagtcaactttgttgattccttcgagaaaaaacaagaagaagatgaagaagaagcagaagaataa

SEQ ID NO: 589 - DNA, 1167 bp, Methanobrevibacter smithii
atgaacacaaatgaacttattgaagctgaagataaatattttattaacacttttgcaagacaaccaattgttttagaccatggtaaaggtgtaaaagtatgggataaagatggaaatgaatatattgatatgtttgcaggaattgctgtaaatgctttaggacatgcgcatcctaaattagttaatgcacttcaaggccaagttgaaaagcttattcatgtttcaaacatttactataatgaaccagctattgaatatgctaaaaaattacttcctttaacagaatttgacagattattctatgcaaacagtggggcagaagctaatgagggagctattaaattagctttaaaatacactggtaaaagtgaaattattacagctaaagactcttttcacggaagaactttattgacattggctgctactggtcatgaagaatatagagaaccttatttaaaaaatctcccacaaggatttattgaagttccatataatgatattgaagctattaaagaagctatcagtgatgaaactgcagctattatgcttgaaccaattcaaggtgaaggtggagtaaatgttccttccaaaaagtattttgatgaaatagcggaaatctgtgctgaaaaggatattcttttaattttagatgaagttcaaacaggttttggaagatgtggaaccctctttgctcatgaactttttgatataaaggcagatatcatgactatagctaaaggtgttgggggaggagttcctatgggagcatttcttgcaactgaaaaagtagctggcggttttgcacctggagatcatggaactacttttggtggaggtcctttagtatgtgctgcggccaatgttgttttagatactattttggatgaagatttattggaaaactccaaaaaagtcggtgcttactttaaagataaattaaatgaactaaaagaaaaacatgataaaatagttgatgttagaggacacggattgatgattggtgttgaattgtctgaaagtggtgctagatatgttgataaattaagagaaatgggattcttaattaactgcactgcaggcaatgttttaagatttgttccgcctcttataattaccaatgaggaaattgataaatttgttgaagctttagacaaagctctttaa

SEQ ID NO: 590 - DNA, 537 bp, Methanobrevibacter smithii
atgaaaagaagagatgcaattgcaaaaataatgagtgcaatcgatgatgaactggtattgtgcaatataggatttccttcaagagaattatacgacatagatgatagaaatgaaaacttttacatgatcggttccatgggacttgtttcctcaataggcctcggtcttgcactggctaaacctaataaaaaaattgtcattatagacggtgacggatcatttttaatgaacttaggatcagtaatcaccacttttgctcaaaatccatctaatttaacatggattgttatcaataacgaagcatacggttcaacaggaaatcaggaaacctatgcaaaaaacttaaacctaaaagaaatggctaaaagtgtaggtattaaaaactgttacaattacgaagaaatagacttaaatgaaataataaacaacaatgaatgtaactttatctgtttcaatacagaacctggaaactcaccagcaccaattatcgatttaacaccaatagaaattaaaaaaaggtttatgaaaagtatataa

SEQ ID NO: 591 - DNA, 1293 bp, Methanobrevibacter smithii
atgaattttaaaaaatatgttaaatatattccttttttgatatttttaatcattttattgtgttatcattggaaattagcagtagttactgcagattatcctactttccagacaatagtttcaaaacatcctttattatcattaactaaaaatggatttttaagttataggtatgcaacctggagttccagatctcttatagaatttaatgtaggggtattggtatctgttcctacagaaatttggagaatattggattcagttatttttgcagctattgctgtgttattaagtaaattactggctaataataatgaaagtcctttcttttataattgtttggcttgtttatttgtaggtttatttatattaactttttctaaaatattggaatctgcaggttggttagcaactacaacaaattatatatggccgatttgttttatattaatacatttttatctacttaaagaatttatatttaaaaataaggacatatctaaatttaaaaggacaataatatatttaattttaattatcacattattggaagctattagctctgaacagttactggttatggttggtggcgcatatttatttattatagtttattgtttatataaaaagattgaacttcctaaattaatttatttatttataatcataattctttttaatttcatttatgatttctgctgtccgggaaatataaatagagtaaaagtagttactaaactgggatttccggattatgctaatttcaacatcataaataaattagatgtagggattaattatttcttaagttggattttaatggcaaaagacttattttcagtaattttcctagctttgcttggtgtttatacttatttaatatctaataagaagaaaataactataattactttaattccctgtttggcagtattattttttgcatcactaagattcgcaaatttcaccactgtttatagttattttgatttaactaacttgaaacatggtttattaagtttaggatttataagaatgctgcgctgtggtgtgatgtatcttataattacattaatacctttatattcaatttatctgatttataaagataataaaaagttaggttattttatatttgtattattaatattgggtttcggatctgtgattatttcaggttttactccttcattaactagtgatggcagaatatatttaaattatttatttgtaatgataattttagattatttgctggttgataaaatattggaatttaaaaataaaaattaa

SEQ ID NO: 592 - DNA, 1083 bp, Methanobrevibacter smithii
atggagattgaaaatttaactaaagaaattagagcccgggcttttgagagaaaagatccaaaaacccccagccaggtagcagccagctggtataatgatgatttgacttatgacggagttgcaaaaactttatttattatattgcctacacccggatgttcctgggcaattggagacagcggcggatgtacaatgtgcagttatgtttcagactgtacattagagccaatcgacagcaaaaccatagtggacatattcaaacagcacctaaaccgttttccggttaatgaagaagataacataactgtaaaactatttgcttcaggaagttttttaaatcctcgtgaacttccaaaagatgcccgtgatgaaattttaaatattttaatggatctgggcaatgttcatgaaattgtagttgaatccagagcagaatatgttaaggaagaatacatcgatgaagtggtagatattattggagatactttatttgaaatcagtatgggtttggagacttccaatgattatacccggcttaaaaaaataaacaaaggattcagtttagatgatttcaacaatgcagtatcattaattcaaaaattaaataacaaaaaaggatataatcttaaatccaaagcatacatttttgtaaaacctattcttttaaatgaaaaagacgctattgacgaagctattgaaactgcaagatactgtgcagaccataatgttgacagactctctttctgtcctgctacaatacatggaggaactttaattgaaagaatgtggagaaaaggagcatatcagcctccttggatttggagctgtattgaaattataaatacagtacgtaaagagttggatattcctgcattacttgacacttcaggtttcggttcaagacgcggaccttacaattgtaaaaaatgcaataaagacttaaaacatatgataatagccaataacttaacacaaactccaattgagtatgagtgtgactgtaaaaacaaatggttagctgaagttaataatgcagatatgaataagtcaactgtacctgcaaaacatctcccattatattaa

SEQ ID NO: 593 - DNA, 1125 bp, Methanobrevibacter smithii
atgaaaacaaacaacaaaacccaagagacaaaaccatctaacccaaaatcaaaaaccgcacaaaaagaaaacactccttttgctgaaagtgtagttttaaaacctgtaggttatccttttgattttgcaatgatggaaaataatcttgaaattatcgataaaacactctttgaagagtatgctcgtgaacaatggttagggttagttgtaaaagaaaattcatatcttttcgatcaaaaaataattcctgattacggttttcaaatagtatctgttagccccaacaactcaataatcgctgaaaacactgaaattaaacttttagatattgaagaaagaaatttggatactgtcaaacgtattaaaacaaatgtcaaaatttcagatattgttggtcaggaaaatgctaaaaataaaaccaaagttctaatcaaatatcttgaagagcctgacaaattcggtgaatgggctccgaaaaacattttattttatgggtttccaggtactggtaaaaccatgcttgtaaaggcactagccaatgaacttgacgttccgctgtatttaataaaagcaacttcattaattggagaacatgttggagacagtgcatctaaaatacaggaattatttgaaaaagctcaaaaaacagcaccatccataatatttattgatgaaattgatgcaattgcacttcacagaagctttcaatcacttagaggagatgttgccgaaattgtaaattcccttttaactgaaatggatggaattaatgacaataaagcagtagtgacaataggggctacaaataacccaaattcaattgattatgctgtaagaagcagatttgaagaagaaattgaatttgtcttacctgatgataacgaaagaaaatctatctttgaaaacaatcttaaaacatttccactcaaatatgatttgaatattgaaaagctagttaaaatcagcaaaaatatgtctggaagagacattaaagaaaagattttgaaaacagctcttcaccatgcgatttcacatgacaaagaaactgtagataacaaagatgtggaatatgctctaaaagcaagcaaaattaaaaatagtgaagtaaaaggaatgtttgaataa

SEQ ID NO: 594 - DNA, 672 bp, Methanobrevibacter smithii
atgaaaccgtatgttattttaaatgcagcaatgacactggacggaaaaatagccactaaaactggcagttccaatatttcaggtgaaaaagatttgaaaagagttcatgaacttagacgtgaagttgatggaataatggttgggatcaatacggttattgcagataatcccagattaacggttcataaaatagatgcaaatcctgaagacaatcctgttcgtgtggtggtagacagcaaatgcagaactccaatagctgcacgcataacaaataaggatgcaaaaaccataatagcgggagctaatgactataaacttgattttattgtaagtgacagatatgccaatttcactaaaaggggaattgacttctttttcagcggggataaaagagttgacctaaaagatttaatgaattatctttatgaaagcggtattaaaacactgatgcttgagggtggttcaactctaaacttttcaatgattaaagagggtttaattgatgaaataagaatttgtgttgctccttttgttgttggcggtaaggattcacatacattatttgacggtgaaggatttgacacaatggatgaaggggtaagactggatctttttgattcatttaaattaggtgatgacttaatactgcagtataaagttttgaataagtga

SEQ ID NO: 595 - DNA, 1215 bp, Methanobrevibacter smithii
atggaaaagaggattgtcaaaaaaacacgagaagaactctcaccaataggctttggagctatgagactaccttcaaaaaatggtaaaatcaactacaaagaatctgaaaagttaatacaccatgcaatagacaatggaataaacattatcgatactgcagctatctataataatggagaaagtgaaaaagtccttggaaaggctctaaaaggagaatatagaaacaaagtcaaaatttctacaaaattgcctgcaatgaacataaaaaagtatgaagatatggaaaaaatattaaatgaacagttagaaaggctgcaaattgactgtattgactattactttctacacaatgttgatttgaaagctatgaacagactgcttaaaaaagatgttttaaaattcttatcaaaggcaaaacaagaggaaaaaataaaatatgtcggtttttcataccacggcactactgaagaatttccattattacttgatgcatatgactgggatatggtgatgatccaatataattactttgataacaatgttcaggcagatattgaaggaattcaccatgcagcatcaaaaggaatgggaatttttgtaatggaacctttaaaaggtggaattttagccgggaaaatgcctgataaagttgaaagtatatttaaaaaagccgacccctcaaaaacaaatgcagaatggagcatatcctggattttaaatcatcctgaaataacctgtgtattttcaggaatgaataacatagctcaaattgatgaaaatatagctattggaaatagtgttgaaccccattccatgagtttggaagaacttgaaacaatcgattatgcaaaaagagccttaaaagaattgcttcaaattaactgtacaagctgcggatactgcctgccctgccccagaggcgtgaatattcctgaatgcatgaaaatatataatgaaaaatatttattcaatcaaaaaggccttttaaatcaaagcttaatcgattattatttaactgtaagcggaattatgatagacagttcaaatgcaggattatgtaatggatgcagaaagtgcttaagaaaatgcccccaacacctggacattccaaaagaacttgataaagttaaaaaagaatttgaaggccatttctttaaatttaaagtattattcgtaaaaagtatcggtatgaaaatatatcagaaatttttttaa

SEQ ID NO: 596 - DNA, 1050 bp, Methanobrevibacter smithii
ataagtgataaaaatatttataaagtgattattatgatgttattcccacaacttccgttgtacgcaatagcaataatttgtggtattttatcttttttagtaacaagattatcaatgcccagaattattagaaaattagaaaaggcagatattgtaggtaaggacctgcataaatcatggaagccgattgtggctgaaatgggtggatttggtatcctatttggatttataataggtattttttcaggaatatgtatgcatgacattcttacatttccgttatgcattgttttaattgtaattcttcttgtagggattataggtattgctgatgatttgcttgtgctttcatcaaaagaaaagctgttcctattgtttttggcaggtattcctttaatatgggcagcacctccaaatgttggaattgtatatcttatttgtattccgatagctatttcaatcggatccaatttaaccaatatgctggcaggtttaaatggaattgaatcagggcttggaataattgcacttacctctttaacaatatcatgtattattttgggaaaatatgatgttacaattatcagtatgagtatgcttggagctttaatagctttcctgtactttaacaaatatcctgcaaagattttcccgggagataccggaactttaattataggggcaacaattgtttcaatagcttttataggtcgtgtaaaattaattgctttgattgtgcttttgcctaacattattgatgcagcccttaaattttacagtgcaggagttatggaaaggcaacagttcaaaccgactcaggtagatgaaaatggaaatctggtaaggcctgaagtcggattcaaatctttaatcaggcttgtactgcgaaaaccgattcctgaaaagcaggcagttaaaataatttgggctattggaattgtttgcggattaatcggtataattgttgcaatagtaatgcctgatgtgcttcaaaaccagacattggctaatttcatgcagattaaggaattcttttatcagttaggatga

SEQ ID NO: 597 - DNA, 660 bp, Methanobrevibacter smithii
atgttatattttagaggatgtactgcaagacaaaaagaaacaggtattgctgatgctacagaaaagctgttgaaattagctgatgttgattatcatgtattggatgatgaaaaatgttgtggttcagtcttgcttagaacaggttttgaaaaggaagctaaaaaacaaatagctaaaaatactgaagtttttggtgatgaaacaatattgacttcatgtgcgggatgttataaaactctgcttcaggattatgaaggtttggatgttattcatatttcagaactgttggctattctgattgatgagggcaggctgaaatttgataaaaaagatttgaacgttacttatcatgattcatgtcatctgggaaggcactgtaaagtatttgatgaaccaaggaaagttatcaaatcagcagctaatttgattgaaatgaaaaatattaaagaagacagcctatgctgtggagctgggggtggagtaaaatcagcttatcctcaaattgcatcggaacttgcagatgccaaaatcagccaggcaaaagatacaaaatgtaatgcacttattactgcatgtcctttttgtaaacttaatttaaaaggtcatgatttggaagttttggatttaactgaatttttaattaaatatgggggagaataa

SEQ ID NO: 598 - DNA, 525 bp, Methanobrevibacter smithii
atgattgaaattcgttttcacggacgtggtggacaagggtccgtaactgctgctgaaattttagcgaaggctgcttttaaagatggtaaatacgttcaatccttccctttctttggagttgaacgtaggggagcaccagtaatggcttttactagaattgatgacaaaccaattgacataagataccaagtatacaatccagactatgtattagttcttgatgatggattaatgaatgtggtggatgtattttctggaataaaagaaaatactgaagtaattatcaatattgctgaagaatttaaaggttcaggtgaacacccagttcatagcattgatgcaaccggaatagcattagatttattaggacgtaatattgtcaacacaattatcttaggatactttgctaaaaaaaccaatgtcgtaagtattgaatcacttattgaagtaattaaagaaacattccctggaaaagttggggaattaaatgcagaagctacaaaaaaggcttatgacatgggataa

SEQ ID NO: 599 - DNA, 720 bp, Methanobrevibacter smithii
aagtatttaatggagttttacatgaaattagaaagtacaaagattcaaagtttttttgcaatatctgatggaatatcactgatgaacatgctatgtggatttatctcaattcttcttgcgataaatcataattttgaattatcagcaattctgatgataatagctatcatgtttgactctgtagatggatgggtagctaggaaaattaatagaaatgataaattaaaatttgggcaaaatatagactccctttcagacgccatatccttcggtgcggcacctgcagtattcctctatactatcagtagtacaatacctcataatctttcaatacttccggcaatcattagtttattaattgtagcttgtggtgtcttaagattaaccagatacaatgcaatagcagattacatccaaacacatgactttataggatttccaattccaggaatagctattatattagctacattctatttaagcggattgttcaatatttatattgctttaatattaatgacaatagtgtctttattgatgattagcaatgttacatacccaaaatttgacaatttaattataatcggaatttctgtagtgctaatagtgttaattatacttccaataagtctaacactcttcggcataaacatacctgcattgatactattgatattttccttatattacctgttaattaatttaattaaaatcaattaa

SEQ ID NO: 600 - DNA, 1110 bp, Methanobrevibacter smithii
atgtcttataaagtcactgttattattccaacatacaatagtgtagaatttttagattcaacaatagcttcaattatgaatcagagcatcggatttgaaaatatagaattaattattgttgatgattactctactgacaacacacaggagctaataaaccactattgtgaaaaatatgaaaatataaaaaccttcgaatcaggtaaaaaaacaggaacgccaggaagagccagaaacataggaatagccaattctacagcagaatatataatgtttattgatcatgacgacaattatctgcctgaaagtgttgaaaagttatacaatgcagttactgaaaattcatgtgatgtagctatcggaaaattccaaacatttggagagcaaaaaatagttcctgaagactggattacacatgatgttgttttaaattcaattgatgaagatttacgctttttttcaataaataatatatggagaatgatatttccgaaagatttccttaataaaaatgaaataacttttccggaaggagtttttgccgaagatttaacttttatgattgatgcttttgtgaatgcctcaaaaatagtctttataaatgatattgtttataatttcagattaagaactggtgataacagctcaacaagtttatctaaaggaatgcattatttagatggattaattgaaggatataataatacagtagatgtacttaagaaaaacaatgcatgcaaatattacgacactgtttttaaccaacatttaagctgctggattagtgatgtggctctaagtgaaacaattgactctgaagataaaagggaactagtaaacaaatcccttaaattatttgatggaataagtgatgttaatccaactcctgaaaataatgcagttaaaaatataataaaacagataagagccagaaatctgaacgaagcttacagtctcatgagtgattatcagctatttagaaatagaattcatcagctagaaattgaattagctcataaaacacaacaagtagctatcttgcaaagtacaaaaggatggtttaagtataaaactaaaaatataaaacagagattgaaaaaagagatttaa

SEQ ID NO: 601 - DNA, 1365 bp, Unknown
  Description of Unknown: Clostridiales sequence
ttgattattgaggagagcagaaaaatgaatttttcaggggaaggtccggcggatgccggaaggaaaaaaagagatttcaatccggatgaggtggtatccattgccctggacatctgcgagctgatgctggaaaacggggcggaggtccaccggattgaggatacagcggagagaatctgtctggcttatggtgccgaaaaggtagaaatttttgccataacctcgctgattgccgcgacgatcacgatgaaggacggcagagactggacccagaccaggcgtgtatacggaagcgcaaacaatatgtacatcgtggaaaagctgaatgctctgtccagaactatatgcagggacacaccggagccggaacgggtcaaagcggagatcgaagatatccgtaaacggcgtgcgatgcccctcccgttgaagtatctggggggactgatgggggcattcggctttgccatgtttttcggcggtacggtttttgacggaatcatggcggtggtggtgggactggtggtttgtcttatggattttaaccgtcccaaatatctcaatcagatcgcctgcacggcgttgatttcggcatttgccggcgttttgatcactctgatttcccgcttttgcggaggatggtttcccatcaacacggcggtggtcagcattgcggtgatcatgctgttgatccccggattggctctgggcaatgcggtgagagacctgctttgcggagagcttgtttcgggcttggtcaaaatgctgcagtgtatccttgttgcggctgcgattgcggcaggcttcaccagtgtgctgatttttaccgggggaagcacggtgccggctccggacgctccgggaccggcccaaacagcgctgtatacagggctgttcacctttgggttttccatgcttttcagcgtgtcgttcaaaaggctgttctacacctctttgggcggtatgctttgtatctccagttatcttgcggccattgaattcttaagcggaaccgaatttccgatcgtatttacggccagcgctgtggcagggcttttcaccacgctgtatgccgaatggatggcccgtgtttgcaaaacgcccacaacggtctttctgattacggggctgattcccttggtaccgggagggtctttatactacaccatggcctatctggtggaagagaacagccagcttgccatggagaatgggatgaagaccatttatacctgtcttggattgtctgtgggcattgtgctgatttcggtgatctcccagattttcataaacggcgggatgcatgcaaagcagagaatcaaaagggtacaggagaacaggcaaaaaagaaaaggctcctcggtctga

SEQ ID NO: 602 - DNA, 1113 bp, Unknown
  Description of Unknown: Clostridiales sequence
gtgaaaaaagacgcaagaaccgcagaaaaatttatgctttttgcaggagtacttacggtaacggtgctggctgccattctttttttcagggatctgctcctgccgttgctgcctttttttcttgcgcttctgttggcttcctttgtcagcgggctgaccaaaagaatgaaaagaagagggcgtatttccgaaaaaatgctgcgtatttttctgttgctttttttcacgctttttttctttttcctctgttggctgtgcatacggaagatcggaaatgagctgtaccgttttgtggcggacgaagaaggaattctggaaaaggcaaacaagctgtacgattcggcatacggatttttgggcagtcatttccccaaattggctatgcggatcgacaagtcggccctctttgcccgttttgaaaacctgctgtccgaaatgtccctcaaagcctccgggtatctggcgaaagctgcgctgaacctgccgggagtactgctttttgtgctggtcacattcctttcggcatactacatggcggtggacagagaaagccttgtgaaaggctttaagacccttttgcccgcaaggcaccgggtgcggattctcaaactgatctatgccctgcgaatgggtttccgcgggtatttgcgggcggggggatggatgctgctcgtgacctttttggaagtgtttgcgggcttatgcctgttgggcttcggttttccgctgctctggtcgctgtttattgccgctgtggattttttgccggtattgggcaccggaacggtgcttgtgccgatggcggtgctgttctttgtgggaggaaatattccgaaaggtatcggacttcttgtattatggggaatcaccgctttggttcgtcagatcctggagccgaaaattctgggaaagagtctgggaattcctccgctgtgcacgctggcagcaagctatcttggtctgaagctgttcggcgtgttggggttgatttttatgccggtgttcgtttcggtgggcacaggcgttgtgaaggaattacaaaaatctgcggtctccggagaagaaaataccgatttccggaataagaatgaaaaattcgacgagaatacttga

SEQ ID NO: 603 - DNA, 1167 bp, Unknown
  Description of Unknown: Clostridiales sequence
ttggaaaacaatgaaaaaaacaagggcggagcttcttccggcaagaaaagcggaactccctccgaaaagaaaaagggaaagaccgcttcctccaagtccgggacttccggagcttcggtaaagggggcttccggaaaagaatccggaaaatcctctgccgtgaaaaaagggggaacctccgcttcaaaaagtccgaaaacggctgcctcccggaattccggttccggaaatcaagctccaaagccctccggagggctttccgccggcacggtttttctggtgctcttaaccctgattgtgctgggtgtgtgtgcgtttgcggcggtgaaattctttacttccgggtcctcctccaccgacctgccgcattccgaagagagcccgacggttcccgattccggggaattttcgtcagacaccccgtccccctcttccggaaattctccgtttggctctttctccaataaggagaccgatccgacggtatcttctgagccggctcctaccccctccgcaacggcttccccttcaccctcccttcagccatcggtatccccaacgccggatacatcctctgaaacctcccccgttcctgcagaacatcatctggtggtggatgtgcccgatgcggaggattatgtaaccaaaagtatcggcaaggtcacactgcgctactggttgccttcggctgaattggacggtaatccggtgccgctggtgaccgaacgggccaaggatttgtttgcattggtctttgatctggtcagcgacaactattccgccgccgagagtaaagcggaattcaatttgaataccgaagtgtatttcgacggtcaggacctggtttctctggttctccgctttcccaccatcgccggtgcctccggcggtacggtctataatgtgcaaagcctgaatttccgcctgaccgatgggaaagccgtgtctttgaccgaaacggccaatcggaataggttgatttttgaaatctacaacgaatgcctgaaccgtaaaatcgagaatctgaatccggctctctttgaggatgacggtaatctttgcgacggttggttccttgaggaaaatacgctcacgctccttttcgattaccattcctttttggacgaccggctcgaagtgctgacgatgcaactccggttggattga

SEQ ID NO: 604 - DNA, 798 bp, Unknown
  Description of Unknown: Clostridiales sequence
atgcttgatatagtaaatgttgaaaaaacatttaaccccggaacggttaacgaaaaaaaggcactttgcggcatcaatcttcatcttgatgagggagacttcgtaacagtaatcggcgggaacggcgcaggcaaatccacaatgctcaatatgattgcaggggtatatcccgtggattgcggaagcattatcattgacggcgttgatgtcaccaggcttccggagcataaacgggcaaagtatcttggacgggtattccaggatcccatgaccggtacggcggcagatatgcagattgaagaaaatcttgcgcttgccgcacgcagaggcgcacggagaggactgcgttccggaatcactgccaaagaaaagaaagaatataaagagcttttgaaaatcctcggcctcggacttgaggacagacttacggctaaagtcggattgctttcgggcggtcagcgccaagcactgaccttgcttatggcaacgcttaaaaaacccaagctcctgcttcttgacgagcatacggcggcacttgatcccaaaaccgccaaaaaagttctgaatatcaccgaggagatcgttgcaaaagaccatttgatgacgattatgatcacgcacaatatggcagacgccattcgcatcggcaaccgtctgattatgatgcacgaaggacgcatcgtggtggacattaagggcgaagaaaagaagaagctcacgatagaacagcttcttcagatgtttgaagcctccagcggaagccaaatgacaagcgataaggtgatgctgtcaaaataa

SEQ ID NO: 605 - DNA, 1146 bp, Unknown
  Description of Unknown: Clostridiales sequence
atgatcgaaaaggaaattgcagaattaagaagaattttaaaagcagagcgcacctccgcaaccagggtttatggctgctatatcaacggagagggagcgatcatcaccgaatttgagcgctctttcggattgatttccgaagaagagaccgagcagtatctttctctcttccgcaggggactgtcgggaacactgcacaagaatctgatggatatttccttttccacggcacaggtggaggaaggaacggagtaccggcgactgcaggagttgaaaaagagccgtttagagaacggctccgccaaaacggagttttaccaagccgtggcttcggcggtaaagatgaaggagaactatgtgcttctgttgctttttaacgggtacgatgttcccttttacggcaaagacggggcggcagacgagagccggggccaggtcttttcctgtatacagggtcttctttgcccggtgaagagcggcaaggcggcattgacctatcttcccaaggaaaaaacctttgagagtgcggcggacggggggaaaatctgccctccggaagcaggctttctgtttcctgcttttgacaacagacaaaccaacctgtacggagcaatgttttacacgagaaaaaccgagggagaacggctcgatttttccgaagcggtcttcggcaaaacagaattgcccatgcctgccgcagagcaaaaccgcaatttcaagaccctgctggccgaatctttaggggaggaatgcagttttgaggtggcaaaaaaagtgcactgtgccatctgcgaccggatcgaggagcacaaggagcagaaggctccggagccgttgcttttggacaaaggagagatcaaggagatcttagaatcctgcggagtgccggagcaacaggtgaagaatttttcctccaactataacgagagcttcggcgccgccaccgatctgccccccaaaaacattgtgaatccctcaaagtttgaagtgcggacgcccgatgtggtcatccgggtggccaagggaaaggaagctctggtcaacaccagagtgattgacggcaaaagctacattctgattgccgctgatgaaggagtggagctgaacggactgagcgtggaaccagaaaaagaaattctgaaatga

SEQ ID NO: 606 - DNA, 1626 bp, Unknown
  Description of Unknown: Clostridiales sequence
atgggtttcaataaaaaactaccggtatgggtcatcattcttttggatttggtattgactgctgcggtggtgctgtcttttgcgtattttcatcatgtgaaggactggggcaagacagaaggaccgaagaaagactataattcgccgtccgccgccggttcaacgatagaggaacatacgcacagctggacggaaaaagaggtaaaaactcctacatgtctgacagagggctatgtgctgtatgtctgtgcctgcggggaagagcagaagaacattctgccggccctcggacattcgtcctatcacctggtgaacgccaaagaggccaccgaagaggaaaacggctataccggcgacaaatactgcgatatttgcaaaaagctggtggaatacggagaagtgataccggccaagaaatacaacggtctgcatctcgtgaactattcagagccgacctgccttgaggaaggttactcgggagattgggtgaatgaacagggaacggtggtgatcaaagggacggtgcttttgcccttgagcgacagccacaagttcgtgctggagcgtaccgaggtacccacctgcacaagcgaaggctattcgctctaccggtgttccgcctgcggcttcgagaaaaaggacgatattcaggaacggctgccccatgaaaacgacggaaacggatactgccggtactgccgcaaatgtctgctggatacttccggggacttcggaagtctgtatcccgaaaaattcattcaggatgacagcgtggtcattctgaaagacgatgcacaaatcagggcctatgccttgcagaaccgtctgaccttggaaaatgcggaaaagggcacctttatttccttctaccgaagccacgatgtgtatatgtccgtgcgccaggtggatgaggtgatgaacggctatttggcaagatgctatgtgtatgacatctatgtgcggaacattgagaatttctatacggtggcgggtaaagccaccagcatggaaaatctgatggaaaaagccgaaaccgaccttggatgtaccgtagttggtgcggtgaacggagattactggagcaattccaaccattgtcgggcggcggtgcgcaacggcatcctgttaagggagccttccaaggtggacagcgatttgtgcgtgctgtaccgggacggaacgatgcgtacctaccagtcggcggatttcgattgggcggctgtggatgcggcaggtccctggcaggtatgggatttcggcccggcgctgttagatgaaaacggcgatccctattcttccttcgagccccggtattacgacaaaaatctgattaccaacacgcacccccgcatggcggttgggtaccatcagccgggtcactatacgctgctgtcggtggatggcagaaaaaaagatgaaaacggaaattatatttacggctgcaacattccctcgttggctcagtatatgaaggaattgggctgtgccgtggcctacaatctggatggcggggacagcgcacaggcgtatgccaacggcgatccgattaggcaggcagagggaagagacactcagcgggtaatcagcgacatcctgtgcgtgggtgaagtcaagaaaggatcgtag

SEQ ID NO: 607 - DNA, 2040 bp, Unknown
  Description of Unknown: Clostridiales sequence
atgaaaaaacagactgtgcgccctgccgaagggctgaacgcccggtttgaaagaaagatgcggaacagctttcttgcccggtttctgctgtttttgggcgggttgcaggattctcttcagaaaagcgcagtgggcggatttttccggaagctgggggaaaggctgaatgttgaaggccggtttctgcgtcctttcaaatatacctttgcaaaagaaattgaacagagcctgattttcaatgccatcgaccgctttttcaagctcctgctgaccctgcccttgcgggtctacggcacctttgctctgaccttctcggtgtacaatctgggcatttccttggtgaagaactatatggagaccggtacgccgtattcggtttccgtgttggtgtctgcggcggcttccattctgatttcgggaatgctgctgtttctgggcagggagcgcaccctggggcgatgggccatcgaaagccggcttgcctccttctttctgtttgacctgttgggcgtgcacaggcagccctttgagcaggagtcctatggaaaaagcggcattttagcggcatttcttgccggcacggttttttcccttctgacggtttttgtgcccggaaggattcttcttgagatcgttctgtgggctgtttttgtctatttggctttttcagagccggaagcgggttttctttcggttctgtttttcctgcccgtgctttcttcggtaaggctgaaagcaatggtgtttcttgtggcgctgtccttcttcgtgaagctcttgcggggaaagagaacgatgcacatgagctttttcgggctggtaatggcggccttcggggtgttggcgtttctttcctcctcgacggccacggagaagcagggaacggccttcggcatgatgttcgtgctgtttctgggcttctttgccggcgccctctttttcgataaggaggagtggatcaaccgggccacggcggtgctgtccttctcggcggtgctttcggctctgtggtgcgtggtcgtttacggtgcggggttcattcctttgaagtatgaattgcttcagaggttcattccggccatgaaatggcctgcgggcttttccggcatggaggaggcaggagtctatcttgcggcggccttctctttgttggtcgtgcggtatttaggcaatcgccggatgcggaaccgtttcttttcgggttgggcgttgcttttcctggcggcaggagctctgctttcaaaatatacctccgcctggcttgccctgcttgtggctgtggtcatgctttttgtcctgcacaagaatataaatatctttgcaggaggcctgctgtccgccgcattggtggtcagctaccggctctttctgcccaagcttctcgtggaaacggggtgggagttctctctgcgcacaacggtggaggggaaaacggtagcaagtcagttttccgagagcttttcaaggctgtttatcggagcgggcgaaggggctgttttaacggaagaaaatttctattcccacttgctcacctccttcggccttttcggactgctcttcttcctgtttgttcttttcggtgctattgcatacagctttaccgcttgcagtaaaaatgtgaggatcaacaaagaaatccgttggctgttgtgcggatgcaatgtggcggtgtatgctcttctgacagcaggcttcttcatggatctgttccgctatgaaaaactgattttcctctttttcttccttctcgggctgattttcggatgcggaagaatgctgaagaccgacggagaacagcaactgcattcctccgaaaccgatgtggatttctattttgtcccggtggttcaagagccgaaaaggaaccgaagccgtttcggaaaaggaagaaagaagcgccgtaaggaagaaagcggggagaaaaggggaagcggatattctgcgaccgtttccgcagaacaggaagaggagcgggaaatccgtatgcttccggaggacgagccggatcgtgaagaggaacaggagtgtgaggacagatga

SEQ ID NO: 608 - DNA, 1530 bp, Unknown
  Description of Unknown: Clostridiales sequence
atggctacgcaaaccgttctgattctggatttcggagggcagtataaggaactgattgcccgcagggtgagagagtgcaaggtgttttccatcgtgaaagcgggagatatcaccccagaaaaaatcaaagaaatcaaccccataggaatcattctgaccggaggacccaacagcgtttacaaagaggattcgccccattgtgacaagagaatttttgaattgggcattccggtgctgggcatttgctacggcaaccagcttcttgcctggtctgtaggcggagaggtatccccctgcgccgtcagcgaatacggaaagaccaagatgaaggtaaataccttttcgcctctgttcgagggcttgaaaagcgagcagatcggtttgatgagccataccgatcaggtcacggttctgcccaagggctttgtctcggtggcaaccaccggtcactgcgtaaatgcggccatagaaaaccgggagcggaacctttacggtatgcagtttcacccggaggtggaaagcactcccgacggtatccggatgattcataacttcctctataatgtctgcggagccacagggaactacagcttgcggaatctggaaggcaagctgatcgagcaggtccggcagcaggtgggcgacagcgaggtgctgttggggctttccggcggagtggattcttcggtctgtgccgcattgctttccaaggccattcccggaaagctgcactgcatctttgtggaccacggtctgatgcggaaaaacgaaggcgacgaagtggaagaggccttcagaggcagagacctggattttatcagagtcaacgccgaggagcaattccttgcggcgctgaaaggcgtgaccgatccggaagaaaaacggaaaattatcggcgcggaattcgtcaaggtttttgaagaggttcgtgccaagcagttgcccgatgtgaaattccttgcccagggcaccatttatcccgatgtcatcgagtcgggcggaagcaaggcggcggtcatcaagagccaccacaatgtgggaggactgccgaagaacatggtctttaccggccttgtagagcctttgcgcagcttgttcaaggacgaggtgcgggcattgggcagacagttgggactgcagaagaagttcgtggaacggcagccgttcccgggacccggcctgggtgttcggatcatcggggaaatcacaaaggaaaagctggagatattaagagaggcggatgccattttcagagaggccgtggaatccagaaaggttcgtgccgaccagtattttgcagttttgaccgatacccgttctgtgggtgtggtcggagacttccgcacctacgattatacggtggctttgcgtgccgtccgcacttccgattttatgacctgcgaatattcccacatatcccaccgcattctgtcggtagtctctgccaagatcgtcaacgaagtgaagggcgtgggcagagtggtctacgatattaccggcaagccgccggcaaccattgagtggtgctga

SEQ ID NO: 609 - DNA, 1797 bp, Unknown
  Description of Unknown: Clostridiales sequence
atggctgaatttttagcacagagcgataaacgaacctgctattgcggcgaagtatcggaagagtatttgggcagagaaatctgtgtaatgggctggactcagcgtcagcgggacttaggctccctcatctttatcgatttgcgggaccggaccggtattgtgcagttggcctttgaccagaacagcgacagagcgatttttgaaaaggcattcggcgtgcgtgccgaatatgtactggtggcaaagggcgaagtccggcgccggggcgagggggcggtcaaccccaatctggccacaggagctctggagatcttcgtaaaggaactgaagattctttccgccgcccagaccccgcccttcgagatttccgacacacggaaggtcaaggacgaaacagccctgaaataccggtatctggacctgaagcgcccggagcttcagagaaatatccggttgcgccatgaaattgcccgggtagccagacagtattactatgaaaacgggttttatgaaatcgaaacgccgatgatgattaagtccactcccgaaggcgcccgggactatctgattccctccagagtacacaagggctccttctatgcccttccccagtccccccagatttacaaacagcttctgatgctttcgggctttgaccgttatattcaaattgcccgctgtttccgggacgaggacctgcgtgccgaccgccagcccgaattcacccagatcgacttagaaatgtcctttgccacccaggaggacattatggccatgaatgagggcttcataaagagagtgttcaaagaggttctcggccttgagatcgctctgcccatgcaacgcatgacctactcggacgccatgaatctttacggctccgacaagcccgatacccgcttcggcatggaaattcagaatgtttccgaaacggtcagagagcttcccgtgcccatgttctctgcggctctggagctcggcgggtcggttcgtgcgcttgtggcaaagaacgccgccacggtcctgagcagaaaagaaatcgacaaattgaccgagcacgccaagggcatcggtgccaagggccttgcctatatccgttggaccgaggacgccccctcctgctccttcggaaaattccttgacgagaatcaattaaactctttgatttccgctctcggcctgcagaagggcgatgtggccctgttctgcgccgacaaaaacaaggtggttttgcctaccctcggcgctatccggacgattctcggcaaaaagctggatctcatccccgaaggaaaattcaacttcctctggatcaccgaatttcccttctttgagtggaatgaggacaccaatcactgggatgccatgcaccatccgtttaccatgcctttggaggaatgcctgccgtatctggagagcgatccgggcaaagtgcgggcactgtgctacgatatggtattgaacggcaccgaattgctttccgggtccatccgtatcacagactggcaattacaggaacggatgttccgggctctgggtctgaccgaagaggatattcagcgaaaattcggatttctggtggaagcctacaaatacggcgctcccccccacggcggttcgggcatgggattggatcgccttgccatggtgatgtgcggggcagacagtctgagagatgtggtggcattccccaaggtgcagaacgcatccgagctgatgtcccagtgcccttctccggcagatccggcggatttagccgctttgggcatcactcttgtgcaagagcaagaaaaataa

SEQ ID NO: 610 - DNA, 2013 bp, Unknown
  Description of Unknown: Clostridiales sequence
atgatcggaaaagaatttttaccggtgaccttggaagagtgcagagaaagaggctgggacagaccggattttgtctatgtgacgggagatgcctatgtagaccatccttctttcggcgtggcaattatttcaagggtgctggaaaaagcaggctttcgggtcgcaatactgcctcagcccgactataaatccgccgcagagttcaaaaaattcggaaagcccaggctcggatttctggtgacctccggaaacattgactccatggtagcgcactacaccgtttcattgaagaaacggacctacgactactatacgccgggaggcgtgatgggcaagcgccccgaccgggcggtgattgtctactgcaacagaatccgggaggcctatggcgatgttcccatcatcatcgggggcttggaagcgtccctgcggcgttttgcccattacgattattggagcgatcaggtgcgccgcagtattttggtggattccagagcggatcttctttcctacgggatgggcgagaagagcatcgtccgcattgcaaagcttttggacaagggcgttcccgtaaagaagattcaggatgtgcggggcacggtctatctgacggatcggcaagacaaggtgcattatccctttatcgagggctgtgaatacgatgacctgaaaaccgacaaggagctttacgccagaaccttcggcattcagtaccggaatcaggatgcgatttcaggcaaggctctcaccgagtattacgaccggaggatgctggtgcagaatccgcctatgcctcctttggagcgggaggagctggacgaggtttacggcctgccctatatgcgggattggcatccgatgtatagggaagccggcggagtgccggcaatcaatgaggtgaaattctccatcacgcataacagagggtgtttcggctcctgcaacttctgtgcgctgacctttcatcagggacgggtggtgcgctccagaagtatgggatcggtggtgaaagaagcggaagaaatcgttcagttgcccgatttcaagggctacatacacgatgtgggcggacccacggccaatttccgctatccggcctgtgacaagcaggtgaaatacggggtttgtccggacaggcggtgtctggcgcccaagccctgcgcccaactgaaggtggatcatagcgaatacggggagctgttgcgccgggtgggggcggtcaagggcgttaaaaaggtctttgtccggtcgggcattcggtttgactatctgatgtacgatccggatgaccgttttttcagacagctcgtcaaggatcatgtgagcggacagatgaaggtggcacccgagcatatctgccccggtgtgctgaaccagatgggaaagcctccggtggaggtttatgaggcattccgggaaaagtatttcaaaatcacaaaggaaatcggaaaagagcagtatctggtgccctatctgatgtccagccatccgggaagcaccctgaaggatgcggtggaaatggcgctgtatctgaaaaaatgggggtattcgccggagcaggttcaggactattatcctacccccggtacggtttcgacctgtatgtaccacaccggtatagacccgctgaccatgaagagggtctatgtggccacagactatcaggagaaaaggcttcagcgggtgctcttgcagtacagccgcccggaaaaccgggatctggtggagcaggcgctgcgaaaagcgggcagagaagatctgatcgggtttggaaaagaatgccttataaagcccggaaaagcaggcgccggacaaaagaaacgggaaattgttccggaaaacaaggggcgtaagacgaatagccgacgcaacggcaggaccgggacggtggaggatttgacgggaatcaagggttcaaaaagagacttccggcaaaaaaagccgcaggtttccccggcaggggattataaaacacacaaaataagcagaaaaggaaagggtttatccaaatga

SEQ ID NO: 611 - DNA, 1284 bp, Unknown
  Description of Unknown: Clostridiales sequence
ctgcgatgccggaaattaaaatcggaaaacaaagaggaaaatcggatgaaaaagaaaactgtaaccgggattttagcggtaattctcggagcttgtaccctgctttcctgtctttgctcctgcgatgctccggcgcctgccggaatgtacgccccggtggatgccgaagagtatgtggaaggcgtggaggatgtgattttctccgtgccggaggaataccgggtcaccatgtcctccaatatgctggcagctgtcggcaaggaggacaccttctccctgcaatgccggcactcggactactactatagggacttggagaaaaactatgtggaactgaaaaaggagctggtgggcctttacgggcaatatgaagaggtgcttgaaaaggactgcaccgttgccgagcagaacgccctctgcgcccggtacagtctgaagatttcgggaatagaagtgaagtatgtccaatatcttttctacaagggcaagcaattctacctgtttacctacagcacaaagggcgaaaccaacgaatcccttttggaggaagtgctccaaaccgtcgccttcggcaaggagaactacaaagcccccgagggcttccgggccgtccggaatgcggaagcagatcagataaactcagaccggtatgagctgtactgcccggacgaatggatcctggacaccagtctgggtcagatttccatgcgggtgccctcttccaaggtgatctccggcgtagtgttcaacgaaatagacttgggcgaaaagccccaggactatattgaccgctataaggaaaaggtcgcttccgatttcctgttcggcaccgaagtcacggggctggaggaatatatctgtgcaacggttgctcagttcagcacggaactgaaggatttcaagctccgcaatgtttctcccgacggcagtgagcagatcgttgaaattgaaaagtccaccatcctttcccgcagggaagaatacctgaaagcctacaccaacgaagaccaactgatcttctcctatatcgagtataccgccaagctttcggattttgacagtcacggttcgggcagtcttttccacgatccctccaatgacgaaacggaggattctacaaaagcggagccgatctatgaggactatcgggttagacagtatttccttctcaacggaagatacctgtatctctttacctgcgtttccgccgaagagacctttcagaatcaggaagacgatatggtcagagtcgtgaagaattttgtcttgaaggaacacgcatga

SEQ ID NO: 612 - DNA, 2220 bp, Unknown
  Description of Unknown: Clostridiales sequence
atggcaaagaaaaagacgcaaagtgcccaagcggagatgctgccggatgcgcctgccagaaatcagccgattaccgagaccattgaaaccaactatatgccctatgtgatgagtgtgatcatttccagggcgattccggaaattgacggcttcaagcccgcacaccggaagattctttataccatgtacaaaatggggctgatgtccggcccccgaaccaaatccgcaaatgtggtggggcagaccatgcgcctgcatcctcacggagatgcggccatctatgagacgatggtgcgtctgactaaggatcatgaggctcttctgcacccatttgtggacagcaaggggagctttggcaagcagtattccgccgatgcttttgccgccccccggtataccgaagtgcggttgatgccgatttgcgccgagattttttcggggattgacaggaatgcggtcaatatgatcgataattatgacggcaccatgaaggagccggaattgctccccaccacctttcccaatattctggtgacacccaacaaggggattgccgtcggaatggccagcaacatctgctccttcaatcttgcggagatctgcgacgggaccattgaggtcctgaaaaatcccacggtggatgtggatcggattctggagttggtgaaggcaccggattttgccggaggcggcaacctgatctacaaccgggaaagtcttaccgaggtgtacaaaaccggtgtgggcagtgttcgtttaagagcccggtatacctacgatccggcggcaaactgtatcgatgtggtggaaattccctattcgacttccatagatgccatcatcaaaaaaatcaccgacatgatcaaggaaggaaagctgaaggaggtcgtggatatccgggacgagatcgacctttcgggctttaagctgaccatggatttgcgcaggggaaccgacccggagcagttgatgaacaagctctataaatgcacacccttggaagacagctttccctgcaatttcaatgtgctcattgacaaggtgccccgcacaatggggatcattgacattctcaaggagtggatcaccttccgtatcggttgtgtgcgccgggagcttacctttgatttgggtaagaaaaaggagaaactgcatctgcttctgggtttggggaagatccttttggatattgacaaagccatacgcatcatccgggagaccaagcttgaaaaaaatgtggttccgaaccttatggagggctttgggatcgatgaggtccaggctgaattcattgccgaaatcaaattgcggcatctgaacagagagtatatcttggggaaggtcaaggagatcgaggacctgcaaaaacagattgcagatctggaggaaaccctttccagcgatcagaaggtcaagaagcatatcatcagccaactgaaagagatcaaggaaaaatacggaattcccagaaagaccaagatcatttacgaacacgaaatcggggagtatgtggaggacaacacggtggagaactatccggtgcggttggtgttcaccgcccacgggtattttaaaaagatcaccatgcagtccttgaggggaaatgacgagcaggcttgtaaggaaggggaccgtatcgttctgaataaagacggggaaaacaccgacgcactgctgtttttctcggataaggggagatgctataagtccagagtctcggactttgacacctgcaaagcctcttctcttggcgaatatgtggcggcaaagctgggctttgaatcggacgagcggtgcattttcatgatggatctgaaggagtacagcgaaaaaaccaatctgctcttcttctttgaaaacggcaagggcgtaaaggttccgctcagcgcttacgagacaaagggcgccagaaaaaagcttaccggcgcttattccgccgcttcccccatcgtgggcatcctgcgggaggatgagcccacggacttcttgctgttttcttccgacaagaagggaattcagctgtccagcactcttgttcccctgaaaaccacaagaacggccggcggcgtgacgctgttttctttgaaaaagaacgcaaagctcctggccgtttcctccgacctttcccttgtaaaagaggaaaaatccttgaaaaagatcaaaattccggccaccggtgtgagtctggagcattttgatccggaatttctgaaaatctga

SEQ ID NO: 613 - DNA, 1662 bp, Unknown
  Description of Unknown: Clostridiales sequence
atggcacacattctgaagaaatccgcttttgaaggcgtcaagggaccggtcgttaccatcgtgatggacggtgtcggagttgctccggaaggaccgggaaacgccgtaaagctggcaaatacgcccactttggactttcttatgaagaactatcccctgcgcactctgaaagcccacggcactgccgtcggacttccctcggacgaggatatgggcaactccgaagtcggacacaacgctttaggctccggacaggtctttgcgcaaggtgcaaagctggtatccaactccattgagaccggtaaaatgttccattcggaaacatggacaaatctgatcgaaaatgtaaagaaaaacggctctaccctgcatttcctggggctgttctcggacggaaatgtgcattcccacatagaccacctgaaggccatgattgcggaagccaaaaaagagggcgtgcgcaaggtgcgggtccacattctgctggacggcagagatgtgggcgaaacctcggctttggagtatgttctgcccttcgaggcctttttagccgacctgcgcaccgatgattttgacatctgcattgcctccggcggaggcagaatgcagatcaccatggatcggtacgaagccaactggagcatggtggaaaagggctggcacacccatgtattgggtgaaggacggcagtttgcttcggcagaagaagcgattgaaacctaccggaaggagcttcatgtgatcgaccaggatctgcccgccttcgtcattgctcagaacggcaagccggtgggcaccgtggaggacggcgacagcgtgattttcttcaacttccggggcgaccgggccattgaaatctccaagagcttcgacatgggcagtgaatttgacaaattcgaccgggtgcgcaccccgcaggtgctgtatgccggaatgctggaatacgacggcgacgcccacatcccccacagattcttggtgaatccgcctgaaatcacaaacaccatgggtgaatacttggccgacaccggcgtgacgcaagccgccgtttccgaaacgcagaaatacggtcatgtcacctacttctggaacggaaaccgctccggaaagttcagcgagcagaccgaaacctatgtggagatcgcttcggatgtggtgccctttgagcaacggccctggatgaagtgcgccgaaatcaccgatacactgatcgaaatgatccgatccggcaaatacaaggccatccgttgcaatttccccaacggagatatggtgggacacaccggctccttgaccgctaccaggatctccatggaagcgttggatctgcaattggcccgaatcctgcctgtgatcgacgaggtacagggggtagcactgattacagccgaccacggcaatgccgacgaaatgtacgaggtggacaaaaaaaccggcgctcccaagtgcggcaaggacggaagctacaaggccaaaaccagccacaccctgaatccggtacccttcattgtttacgacaacttctatgccgataagtatatggtgctggaagacggtgaaaaggacttcggcttagccaatgtcgctgctacagcagtcactctgttgggctacgaagcgccttccatgtggaagaagtcgatcattgagctgaaaaaataa

SEQ ID NO: 614 - DNA, 1305 bp, Unknown
  Description of Unknown: Clostridiales sequence
atgatgatcatgaaatttctgaaaaaacagtcccctgcgaggatcatttcctccagcttcgttttggtcattcttatagggtcggggcttctcatgcttcccttcagcataaaggaaggggtgcatttaagctatgtggactccctgtacacctctgccagtgcggtctgtgttacggggcttgtcacggtggatcccggcgatacctttaccgccttcggccagggaattctggcggcgctgattcaaatcggcggcttgggtgtggcggctgtgggcaccggtgtcatctttgccatcggtaaaagaatcgatttaggcggacggaaaatcgtgaaggaagccatgaatctggattccgggaaaggaatcgtgcggtttctgaagagcgtatttatcaccacctttttgattgaaggcgccggagccatcctttgctttccggtttttgtccggcaatattcggtgcctaaagccatcggtctcagtcttttccattccatagcttccttcaacaattcgggctttgatgtgttcggaggcgggcagagcatgattccctaccaggatcatgtgtatatcaatctggtgacctgtgccttggtgattttgggaggaatcgggttcttggtcatccacgaggtgcttaaaaagcggtttcactggaagcagttttccatgcataccaaaattgtcctttcggtcagcgccgtgttgattctgggcggaacgatccttctgaagcttaccgagaatgtttccttcctgggagcgtttttcttcagcgtctcctccagaaccgcaggctttgccagctatcccctgagcggattttcaaaagccggcatcctcacgatcatcgtgctgatgtttatcggcgcctcgcccggttccaccggcggcggcatcaaaaccaccaccttcttcgctcttttgcagggcattaaatccgccgccaccaataaggtggaaaaagcattccactactctcttcctgtttccgcattcagaaaagcggccgtcattacagtgatcggtttaggggtcgtgctgaccagcacctatcttctggtgattctggaaccggaattgggctttatggacgcactttttgaaatggtcagtgctttcggaaccgtgggactttccacaggaatcaccggaagtctgggcacgcaggcaaagctgctgtccataattgtcatgtatatcggccgtttgggtcctctcaccattgcctctctctggtatttcagcagaggagaacgggcacggtatcccgaaggcactcttgccattggataa

SEQ ID NO: 615 - DNA, 1005 bp, Unknown
  Description of Unknown: Clostridiales sequence
atggcccagaaaggaattttcatgaatttttcccctttaaacgatccggaattcaatgagtataaggaacagcgaaagcgttctgccaataaaaagcggcgtcggaagatgcttttgggattggtttgcgtcacggtgattctggcaacgggatttgtcctcctttttctggccgcatgggacacctttcccggacttttccactcctctacggaatccccaacccctacggaagagcttccttccgagccttcctcggtcacttctccggttcctttcctgtccccgacggtgagcacaccggacgatccttccgatacgacttccggcgggaactccggcaccgcctcctccccagtcctacggaaaaccaccatttacttagatgccggccacggatttctcaatgccagcggtgatgccatggactacggatcgggcaaggacaccatttaccagcagttggcggaggaactaaccggtcaaaagctcacggaagccgacctgaatctggcaatcactctgaaggtcgggagaattttggaagaaaagggttatacggtactgctcagccgtacagattatatgcagaagagccttccgatcaacgcccgcgccgccatggtcaaggaggccggagcggatgtgctggtatccatacacgcaaattccgccaatccggcggcatacggcacccggatttactacaacggagacggctcaacctacagtaaggccttggaaagtcagatgtttgcgtcggccatggctcaggcaatcgacgccgcaggcgcttcctctaagaccacccagatttattcgaacccggagttggcaatgctgaacggcaccgggaatattccgtcggtcctggtggaaacctgttttttaaccaacgagaatgacgccaaagcggccttgaccgaggaatggcaggaaaaaatagccggtgccattgcagagacaatcctcaaaaaataccccttggagattcggtatatttga

SEQ ID NO: 616 - DNA, 1389 bp, Unknown
  Description of Unknown: Clostridiales sequence
atgatcgaaaaaagtctttgtgaagaggttttgggcaaggccctttccaccggagcggactatgccgagatctttgccgagcgcagtccggcaaccagcctttacatggtggacaaacggctggaggagatttccgactcggtgaattcgggggcgggaatccgggtgatgtccggaacccgttctgtttacggctccacgaccgacctgtccagagcagggcttctgcttctggccgagcgggtagcggaggctctggggcagggaaagggtgctctgtctatccacctgacacccatgagggtcgggtgctgttcgccggttctgcgcccttcttccgaggtgtccaaaaaagagaagctggaggtgctgaagcgctgttactttgcggcgctggaagcagacgggaggatcaagcaggtcaaggcccggattttggatgtggatcggaatatcctgattgcaaacagcgagggaaaatatattgttgaccggcaggtgcgcacaaggctggcctgttcctcgattgcggaggatcagaacggtatggaaagcggctttgagggtcccggcagacgcatggggatggaaatgtttgaaagggaagtcagccccgaaaaaaccggcagggaggcaagcagagtggcgcttgcccggctgggggcttcgttctgtccggcagggcagatgacggtggccattgagaacggcttcgggggcgtgattttccatgaagcctgcggacattccctggaggcaaccgccgtagcgacggggacctcccagatggccgggaagctgggccagaagattgccggagaaaaggtgacagccattgacgatcccacggaaaagaatgcctggggaagtatcgatgtggacgacgagggaacgccgacgcacaagatcgttctgatcgaaaagggcattctgaaatcctatatggtggatcggctgggctcccgccggatgaacggtatgcctttgacgggcagtgcccggcggcaggactactcctatgagcccacctcccgaatgaccaacacctatattgacaacggtcccgaccggaatgaagacatcatttcctccatggaaagcggactgtattgcgcaaagatgggcggcggttcggtgaatccgatttccggagctttcaacttcagcgttgaagaaggatatttggtcaagaacggccggcttacagaatgtgtgaagggcgcttcactcatcggcaccggcagtgaggtgcttctgaacattgatatggtgggacaaaatcgcttcaacggtcagggaatgtgcggttcggtcagcggctcggtgcccaacgaagtgggtcagccccttatccgcatttcctccattacggtaggcggcagaaactga

SEQ ID NO: 617 - DNA, 2394 bp, Unknown
  Description of Unknown: Clostridiales sequence
atgattcgccgtttccgttctcaaacgatccttcttctgcttgccctgcttgcggctctgcttttttcctgtgcctctccctctgcctccctatttcccgagggctcttctccggattcctccgaagcatcctctgaagagtctttttccgccggttcttcgccgctctcttcctttccggaaacctctccttcctccggacaaaccgacgaaagctccctcgaaccgaccgagccggaaaccgaggagttcagcatcctgtggaacggccgccctctttccgaggatcccaccgggctcccctcggtcctttccgagccccgaacggttcttgccttccggaacaccaccaccaaggaccgcacggtctgcctgcttttcggaaaggagctttcctatgcggaatataccgatgaaaatcggaaaaccgtcgggtcttccgctctttttcagcggacaattcctgcaaagagcactcttttcttagagctttccgccgccgaagccgtccctttggctcttggggcttacgattcctcccttgcctgcatcttttccgaaaagggcgtaaaagctcttgaaaccggggagattgcgccctttgcccgtctgatttttgcgccggactgcatttttacggaaaagcatctgctgtcctttccctgctccttggaattccggggcggagagcttccccctgcttctctgaccgtaaagaccgacgaatcggcccttctttctctttccttgccccgggattaccggacggctctgccggtgctctacgatgcgccgcactgtgccctcaccgttgaacactgtccgctctccttggcagagctggggctttcaaaccgtcttgccaatgtgaacggagaagagttctccccctacatggtgggcggggaggggcaggcgcttttggaggctctgtcgctggatcggaccggaaatatctgtctttccgaaagtgtttccttccggaaaagtccggaaaacgaattccttctggtggcagaaatacgctgtgtaaccaccgaaaacaccctgaaaaatgcccttctctccctttcctccaatgccgccggagcctattttgaaggagaagtccacgaggatggtcgggtaaatctgctttccgaaaaaggcctttatctggttcttttggatgcggaaggaaagagtctgcggtatcttctgaaggtagactacatccccacgaatctgccggttttcgtcattgagaccgaaggcggtcttgcggtggagtccaaggatgcgtacatcaacgctacactttttgccgattgcagcggaagcgacggctttgaatccatccctttatcggaaattgaaatccggggacggggcaactccacctggaaatgggagaaaaagccctacaaaatcaagtttaaagaaaagaccgccgttttggggaaaacgcccgcccgacaatgggttctgttagccaactacgccgacaaaagtctcatgcgcaacactctggccttttcagccgccgcttttttggggcgtatgcccttttcgcccagccagtatccggtggatcttttcatcaatggggaatatgtgggcgtttacagcatcggagaacagattgaagtcaaggaaggacgggtagagatcgaagccggcggggacagcgccgacaccggataccttctggaggtagggggaaccgatgcggacgatgtctatggaaaaaccgcttttgaaacagagcttctgcgctttgtacgcatcaaatcccccgatgaaagtctgcttgccgacaggaaatacgccgcctttattaaagactatgtaaaaaaagccgacgccgccgtgaaggccggagagggctatgaaaactacattgacaccgattcgctgatcgactggttcattctgcacgagctgagctacaatctggattcttccttccgccgctcctgcttcttagtgaaggacgcgggcggaaaactgcaaatgggtcccccctgggattttgacttagccttcggcaactttttccgggacacctgggagaaccagggctgggcatgcctttacgaaaaggacaactatgtgggggacaactggatgacctatctgctccgaaatccctcgtttcttgaaaagctccgggagcgctggaacgaagtcggcccggcactcaccgagcatcttcttgaggaaatcgaccgttatgccgccctgatcgccccctctgccgcctgcaactttaaggtctgggatattcttgacaagcgggcgggctatcagccctggggaatggtcgaatacaacacctatgaattgcaggtggaattcttgaaaaactacatcaccaaaagaagcgcctggatcacctccgaactgaaccgctga

SEQ ID NO: 618 - DNA, 1212 bp, Unknown
  Description of Unknown: Clostridiales sequence
tttgtctatggcaagccggaatttttccaaatcaaaggagcattgaatatgaaaaacaaaaccaccttttccggaaggtgcaaaaacctctggaagcgatttaccacctacgaaaaaatatggttcttcagcattctggtgctggccattgtcttttccttcctgtttcccgaaaccgacgatcctacttacacggtcaagctcgacaaaacagcctatagctccggggctggttccggctacaccgtgttggacttcaccggcacggaggaggatttcgtcatatccggaatcaccgtgaacggcgaagaggtggatttggattatgacgaatacaccgtcacaccggacgaacccgaaactctgaaattcaaccttaaaaaagccgtgagtgcggaggacgagattgaaatcgagtgctatcccgacggagaaggcaccgtgcttcatctccgcctctgcgacggggagggcaacagtctctttgccggctctgtagacctgaccgaaagcggcagcggctacagcgtggcgcagaatcccctcaattacatcgtgccggtgtatgtcatcaccatcctgtatcttttggatgtcatcaccaacattgcctgcgaattgatgatctccaagcaaagcaaatggaatttcatcatttctctggttgtggaggtcattgaaattctcatctgcattctctgcgcttaccgctttgctacgctggcaaccacactgctcttctggatcccctgcgacatcatcagcttcatcgtctggaacaagcatcccgacaaggaagataaagaggtgacggaggtgaaaaagctcaccgtcaagcaggatattctgctgattctgggcattatcgtctggaccgtggcagtgggctacgctttgaccttcattgatgtggagggcggaatctttgccaacaatgtgcggctcaaaaacattgtctgctatctggatgcctgcgcttcggctctgggtattgccaacggcgtgttcatccttctgcgctacagagagcagtggatcgcctggtatctggtggcacttcttgaaacggtcatcaacattcttgccggacagtggatcctgctggtgttgaaggccggatatctgaccaacaccacctacggttacatcaaatggaccaagtacatcaagaaacaccagaccgataagcctgtcaaggcgaccgaaaactaa

SEQ ID NO: 619 - DNA, 1371 bp, Unknown
  Description of Unknown: Clostridiales sequence
atgaatgtatccgacctatcccgttttccgcagaccgccgccggaaaaaaagcggaggtcttaggcatcggggtttccaatctgcctctcgtggactttcttttgcagtgcggcgtgcttgtgaccgtccgggatcggaaaagcgaggagcaattgggaaatctcccaaaggaactgaaagccaagggtgtatcgctcatcacgggcgagcaatatctcaacgacttagagggggactatattttccgttctcccggcattcgtccggatcttccggaaatccttatgggtgttgccaagggagcgctgctcaccagtgagatggagctgttcttcgctctgtgcaaagcgaaaaccctggcagtgaccggaagcgacggaaagaccaccaccaccactcttgtttccctgcttctgaaggaagcaggacaccgggtatatgtgggcggaaatatcggctctcctcttctgccccttgtaaacgaaatgaccgaagaggattttgcggttctggagctttccagttttcaactgatgaccctgcgccagtcggcagagattgcggcggtaaccaatctttcccccaatcatttagactggcaccgcagcatggaagagtatatcgaagccaaaaccaatatctttgtccataaggagaatcggattctggtcctgaatgccgacaatcccccttcccgccctcttgcacagcaggctcagggggaaatacgcctgttttcttcggaaaaagagcttccaagcggaatgtatgagcaggaaggaaacatttgtctggacggacagcagatcctgaagaacgaagaaatccttcttcccggccggcacaaccggcagaattatatgactgcctacagtatggtgcgggattttgtgccggtggaagcccttcggcgggtggccgagagcttccggggcgtggagcaccgtctggagtttgtccgggaatacaggggcataaagatctacaacagctccattgacagctctccctccagaacagcggcggccctttcctgcttcggggagaaggtgaatgtgatctgcggcggctatgacaagcatattcccttcgcaccgttggccgaagccctgtgtcagaaagcccgcaccgtcaccctgaccggtgcaaccgcccaagctattgaacaggcactctcagagtgtcctctttccgacaagccggtcatcctccgggagccggactttacaaaagccgttttaaaggcgctggaggcctgtcggccgggcgaggttctcctgctttcccccggatgtgcctcctttgatgccttccccaatttcatggtccggggaaacaccttcaaaaaattgatcaacgatctgaagtaa

SEQ ID NO: 620 - DNA, 1206 bp, Unknown
  Description of Unknown: Clostridiales sequence
atgaccaaaatagatattttttctggctttttgggcgcaggaaagaccacgctcataaaaaaactgatcaaggaagcctatagcggagaaaaactggtgctggtggaaaatgagttcggcgagatcggcgtggacggaacctttatgcaggatgcgggcatcaccgtgaacgagctgaattcgggttgtatctgctgttctctggtgggcgattttgcaaaagctctgcatcaggtgatcgaaacctatcatcccgacagagtgctgatcgagccttccggagtgggcaagctttcggatgtgatcacggctgtgcagaaagcgggtgtggtaggtgcagagctgaacaccttcacaacggttgtggatgctaccaaggcaaagatgtatatgaagaatttcggtgaattcttcaacaatcaggtggaaaatgcgtcctgcatcattttctcgcataccgatgtggcaaacgagaaaaagctggaagaggcactggctcttgtgaaagagcacaatcccggagcgaccgtgattctgactccttgggatcaattgtccggtgcggacattctttcggcaatggagcacaaggatacccttgaaatggagcttcaacgcttaaaggaggagcacgaaaaggcgatggcggaagaagagggccatcaccaccaccatcatcatgacggcgaggaggatgaagaaggacatcatcaccatcatgatgacgaggaggaagaggacgaggacgaggaagaggacgagcatcaccatcaccatgaggacgaagacgaggaccattgctgctgcggacatcatcaccatcatcatgacgacgaggatgaggatggggaagaacatcaccatcatcacgacggcgacgaagacgaggaccatggttgctgcggacaccatcaccaccatcatcatgcggatgaagttttcagaagctggggcgtgcagaccgggaaaaagtttgaaaaggagcatttggaagcctgcctggaattcttagcggacgaaaagaagtacggaacggttttgagggctaagggagtggttgcggcggcagacggcggatttttccattttgactatgtaccgggaacctccgacattcgtcggggctcggcggctccggtgggcatgctttgcgtgatcggcaaagacctgaaggacgaggcgctgaatgcccttttcggcgtgtaa

SEQ ID NO: 621 - DNA, 930 bp, Unknown
  Description of Unknown: Clostridiales sequence
atgagcctgcggcagatgatcgaatatctttcatcccttggcgtgcagagtctggagttggggtgcggcggttaccccggaaaggcacactgcgacgctgcggactttttggctcatcccgaaaagattgaagaactgaagcaaatgcttgcggaaaaccatatggatctgccggcgcttgcctgccacggcaatcctctgcatccggacaaggcgattgcagggcgttttgaaagcgattttgacaacgccgttctgctggccgagaagctgggcgtaaagaccctggttgctttttcgggctgtcccggcgactgccccgaatccaaataccccaactgggtcacctgtacctggcccaacgattataagaaaattcttgagtggcagtggaacgaggtgctgatcccctattggaaggaaaaggccgcattctgcaacgctcacggcgtagagcggatcgcctttgaaatgcacccgggctttatggtgtacaaccccaagtctctgatgaagctgcgggaggcggtcggccccaccgtcggcgccaactttgatccttcccatctgttctggcagggagtggatgtatgcgccgccatccggtatctgaagggtgccatttaccatttccacgccaaggatacccggatcgaccccctttcctgcggtgtgaccggagttctggacacctccggctacggagatctgctgggccgctcctgggaattccgcaccgtgggctacggtcacggaaagtcgctctggaacgatatgatctccaccctgaaagccaccggatatgagggcgtgatttccattgaacacgaggacccgctcatgtcccccaaagagggcttggaaaaggcggttgccttcttaaaggatgtgatcatttttgaagacccggatgccatgtggtggacctga

SEQ ID NO: 622 - DNA, 2136 bp, Unknown
  Description of Unknown: Clostridiales sequence
atgaaacaaaatctcaaaggaatcctgttttatgcagttttcatcatcgccaccgtcggaattatcctttttgtgatgaattccatggagggagagtcccttgtcaccagtgatctggttgagatggtgagaaacggcgaaatcgttgagtatgagagagatacctacaacgacaccatgaccgttctgaccgagaagggcgagaagatcaaatttacggccattgatgaaaataccttcagggacatcattatgccggcctttaaacaagcggaggaagaagggaaaagaaacttttcggacatcaaattcaacaacaaagagttgaagacgatgcctgtttgggtcagctttttgccctatatcatcctgctgattgccgtgatcgccgtatttgtctttgccagaagacaaaccaacggaaaggacggtgtcaggggctttggaaaagccagagccaaattgggcagtgaagagaagaataaggtgtattttaaggatgtggccggttgcgatgaggaaaaagaggagcttaccgaaattgtggagtttctgcgggatcctgccaaatttgcccggttgggagccaaaattccccacggtgtgttgcttgtaggccctcccgggaccggtaaaacacttttggcaaaggcggtggcaggagaagcaggggtgccgtttttctccatttcgggctccgattttgtggagatgtatgtgggtgtgggcgcctcccgtgtgagagacctgtttgaaaatgcaagaaaatatcctgccagcattattttcatcgatgaaatcgacgctgtgggcagacaccgcggtgccggcttaggcggcggacacgatgagcgggaacagactctgaaccagctgttggtggaaatggacggctttggcggaaacagcggggtcattgtgatggctgctaccaaccgtcccgacattctggatccggcgctgttgcgtccgggacgcttcgaccggcaggtaacggtcaactatcccaaccagaagggaagagaagagattctcaaggttcattccagaaataagcctttggaaaaagcggtggatctgatgcggatcgcccagatgacggcgggctttaccggtgcggaccttgccaatgttctgaatgaagcggcgctgctggcggccagaaagggcaagaatctgatcggcatgaacgatgtggaggaagccgtgctgaaggtcatggtgggtacttccaagaagtccatgaagatgagcgagcgggagaagagaaacaccgcgttccacgaagcaggacatgcgctgatggattactacctggaaacgcaggatccggttcgccgcatttccatcattcccagcagcaagggggcactggggtataccctttctcatccggatgaggataagtacagtgtatacaagaccgagttgaaggaacagattgcctcgctcttaggcggccgggttgccgaagaactgaccatgaagggcgatttctccggcggagcctccaacgatattcaaagagccacggcgatcgcccggaatatggttacccgttatggtatgagcgagcttggcccgattctttacggttcggagcacggaaacgacgaggtgttccttggcagagacttctctgcagaaaagacctattctgaagagacggcagccaagatcgatcttgagatcaaaaagatcatcgatgaggcgcatgccttggccacctctattctgaccgagcatttcgacaagctgcagtttgtggcggatttcctggtcaaatacgaggaaatggatgacgaacagttcaagaaggcgatggaagaggagaaccccaccctggagagcatttatgctcttgccgaagagcgccgcagaatcagcgagaaggaaaacgaagagaaagcccggattgacgaagaggaacgcaaaaagcgggaagaagagctgatgcaggatgccgactatcgggaaggtatgcgggatgtaaacgccgaaggcgagcattcagacgaaacaggggacaacaacggcaacgagggcaacgacggcaacgatggggataacggcaacgacgggaacggcggcaatgacagcaacaaggatgactacaacggttggtataggccctga

SEQ ID NO: 623 - DNA, 1713 bp, Unknown
  Description of Unknown: Clostridiales sequence
atgaccagataccggaacgaatatgagcgttggctccagtttgccgacaaggccacggtcgaagaactgaagtctcttgagggtcaggaagaacaactcgaatatcgcttcagcaaaaatttagacttcggcacagccggtttacgcggtgtcatgatggcgggactgaacgccatgaatgtctacaccgtcggcgcagccaccaaaggcttggccgagtatatcaaggatttgggagcggcagaccggggtgtgctcatcggttgcgactccagaatccattcggcagaattttccaaggttgccgcagaggttcttaccgcgaatggcattaaagtctacatttttgacgaactgcgcccgacccccatggtttcttacggaaccagagcctttcactgcattgccggcatcaatatcaccgcctcccacaatcccaaagaatacaatggctataaggtatattttgaggacggtgcccagatttcccccgatcaggcaacaattatttcggactatatccgaaaaacagatgttttctcggtagaaagagacaacttcgatcttgccgtttcggaagggcggatcaccgtggtcggaaaagactttgatgagcaatacctttccaaggtcttggctcagcgggtggattcctcggtcgttcctgccatggccaaaaggctcaaggtcgtttattctcctttccatggcgccggctaccgtttggttcccgaaatcctgcgctgctccggcttggaacagctcttcatcgtccaagaacaggcattgcctgacggctccttccctacagtgaaaagccccaaccccgaaaatcccgaaggcttttccctgggcatcgaactggcaaaagaagtggaaagcgacctgattatcgccaccgatcccgactgcgaccgggtgggcgtcatggccaaaaatgccaaaggtcaatttgaaaccatctccggaaattgtatgggttgcctgcttttggattatattctctccgctcacagtgaaaacggtacgatgccccccgacccctatgccgtaaaaaccatcgtttccaccgatctcgcagaggaaatctgccggtgcttcggcgtgaagctctatgaagtgctgaccggcttcaaatatatcggagaagtgattaaacgccatgaggattcgggcaaaggctcctttatcctgggctttgaggaaagctatggctacttgaaaggaacctatgcccgggacaaggatgccgtggttgcttccatgctgattaccgaaatggccgcctattataaggaaaaagacatgacgctcatcgacgcccggacggctatgtatgagaaatatggctattttgccgaaaaaaccgagaatttccagatcgccggtctggatgctctggaaaaaatgcagaatattatgaaaaatatccgagagtcccaccccaaggaattgggcggaatgcgcatcgtgcgcatcggcgactaccttaccggtattgccgaagatcctcgcagtgagcgtatcgaacccaccggcttgccttcctctaatgtgctttcctttaccacggatgccggttgcaaagtgctggttcgcccctcgggtaccgaaccgaaaattaaaatctacctgctttgccgtgggactgacgccgccgaagccaatgcccgccttgccgcctgtgctgaaaccgtccgttcttggatctga

SEQ ID NO: 624 - DNA, 1602 bp, Unknown
  Description of Unknown: Clostridiales sequence
atgctgaaggttctcttaaaaaaacaactgactgaaattttccagtcctttttcgtcaaccggaaaaagggcactgcccgcagccgggttttcaccgccggactgattgtgctttatgttcttctgatgggcggcgtgatcgggggaatgtttaccctgtttgcggttgcgatctgcgattccctttttgaggtgggatttggctggctgtatttcctgattttttcgggagcggcgctgatgctgggggtattcggaagcgtattcaataccttttcaggcctttaccagtccaaggataacgattttctgctgtctcttcccatcccggttcggtatattctggtggcccggctgctgagcgtctatgtcttaggagcgatgttctccttttgtgtgatgcttcccggaatcgttgtctattttgtccttcgtccggtaacggtgtggtcggttttcggctgtgtgttcctcctgtttttcgtttcggcgctgattctggtgctctcctgccttctgggttgggtggtggccaggatcaatgcccgtctgaagaacaagaacatcctgacggtggcggcatcgctgctcttcctggcggcttactattttgtctatttcaaggcccaggagctgattgaaacgctgatagagaatgttcaggttttgggagagaaagtgaagggtgcggcctatccgctgtatctgttgggcagagccggagagggggatcttctttccatcgggatttatctgttggtcggagcggcgctggtggctctgacctatctggtgctgtccaaaagttttctccggttggcaacatcctcttccggaacggccaaaaagaaatatgtggaaaagaaggtgcaggcgcaaagtatcgaaaaggcactgttaaagaaggagtttggccggtttttaggaagcccgacctatatgctgaattgcgggttggggtgcctgttcctgccgattctatcggttctggtgctgataaaaggaagggatctgttggcctcttttctgaatgtaggggtggactttccttcggaaatcctgttggtattggcgtgtctgatgatctgcttcttggtttgcatgaatgatatgaccgctccgtcggtgtctttggaagggaagaatatatggctggtgcagagtatgccgatagagcccaaaaaggttttgcaggcaaaactgcttttacagctggtgctgacctgccctttgaccctgctttgctcggcggccttcatcgccgtgcttcggccgggcatcgggggaggcgtgttgctggtgattttcccgcaggtgtttgcggtgctgaccgcttcgttcggactgtttctcaatctgaaacggaacaatctttcctggaacagcgaaatgattccggtgaagcagggcttttcagtggttgtggctctttttggtgcaatgagttacctttgcatcctgggaggagtgtatttcgcagtcggaaaatatctggcgccggagctgtatctgacgctcggtcttgtgctgacggcggttctggtggttttgctctatcggtggattttgacaaagggagcaaaaatctttgcttttctctga

SEQ ID NO: 625 - DNA, 2487 bp, Unknown
  Description of Unknown: Clostridiales sequence
ttggatttttccgcggaatggaaaatttctgctttgagagtgttcttggctctgaatctttcgggaggggaaacagacaatctgcacaaaacgggcacagggagtttgtgtgaatcgtcgaaaaagacagaaagaacgcagaatcccttgacagagggaaaaaataagggtatactgaaagcaatcgggttgacggtcagtcaacagttttgttttgggaaaggaatacctatgaaacgcactttgtcattggtcttaacactgctctttgcggtgtcggtaattacatcctgcggcgcttccaccaccgcaaccaatcccagcggagcggcctctacgattaccgaaacgggaacgggagaaaccacgatctcgacagacatttctgatctgttgaatgtgctggcacctgcttccggggcagaaaaggagcacaaaactctggaaactctgccttccagcgcaacgctggtcggaagcgaaactctgcctcctattgataaccagggagctgtgggatgctgtgtatccgagggcgtgacctatatgcagttcaccaacgccgtggcacagtatatgaaaaacaacggcgggctgaacggttggaatccctctgaaagctattccaactgcttttcccccaaatttacctatcagtatgccggagcggcaaccaagaatgtgtacgacattctgaaggatcacggtgctctgaaaaattcggatgaatcctttgccaaggatgccagcggcggatcccagattgaggtgaacggaaagctgtcgaagcagactgccgcatggaatgtggcggagggcatgggagaaaaggctttaagttaccgggtgtcgggctatgagcagacttttgtagtcaacgatccggagtatacggttaccggaaaagagggcttggccatgaccacctcggaagccggtaaggccatgctgaataagatcaaagacgccattgccaccggaaatgtggtggtgaccggcggatatccgaacacctgggtttcctcttccagcgtgaaaaaactgacttctgacggtgtgggaacattgggcaaggtcggagaccggatcattacattttccaccaacgaccgcagcggcgggcatcaggtgtgcattgtgggatatgatgacgacatcacggtgacctcctgcggcgtgacgatgaagggagccttcctcttggccaattcctggggcgaaagctggtatgacggcggtagatgctgggtggcctacgatgctctcaacaccgaatccgaatatgaggatttcaaattccccaacgccctgaaaaacaagggcttgaaaagaggctggacgctggatcagttctgctttatttactgggacagagacattgttgccggactgccgggtgtctatgcggaagtggaagtggaactgaagaaccgggattccctgactatggagctgacgagaaccgatcggaatgggctcacttcgtccattactccttacatctttgaatatgtgggttctcacgataagtacgatcagctttggctgaatgtgaagggagagcctacgggtgatgcggctgtcggattcttcacggtcaactttgaacggcttctggaaagcgttccggagggcagttcggtgaccgactacctctggtcgatcaaggtctccaacagtgccgacgatgaaatgacagtcaagagcatcaaggtgaagaacggtgaccagaaggttctttgcgatgtggacttcaatgacagctttacaaagggctccagaagctatacctttgatttcagcgaaagccacaatgttgcaatgcttgagggcgcagtcaacctggtcaacaaggaaagtgggaaggccattgtaaagggctcctccaccatgcggctcgctctgggcgaggtggatgcggcttctactttgatggtggcgcctcttatggagagaaatacctacagatttgatcgggatgacgagaagtacggccttgccatagacaagaaggaactcaaggacggtgccgagctgctcttccaaaagatcaccgtagatgaaaacaaagctcaggagttctcggtgtcctataacgaagacggtacggtgaccttcttcatgcaggcagaggacagaagctattatgctctgggtgagagggacggagcacttcagatgatccggatgaccgagctgaccgacaatctgaaatggacggtttcctctgccaagtccacagcctatactgccgtggaaaaggacggggagaatctgaaaatttcaggcgaagtgcggaacgccggattggagctccaactggttgtgacagacttgaccggtaaaactcccgtaacggcagacgccaaggttacggcaaagagctttgagggctgtgtgaagagtcctgacgcatcgtttattgtgcgtgtgctggataaatcggactcttcgattgtcggcaacacctatgttcgtattgcataa

SEQ ID NO: 626 - DNA, 1608 bp, Unknown
  Description of Unknown: Firmicutes sequence
atgaagataacttttataggcgccgcgcatgaagtgaccggcagctgcacttatatcgaagtcggcgacaagaagggcattgtcgattacggcatggagcagggcaggaacctctatgagaacgctcccctgcccgtcgccccgggcgagctggatttcgtgctgctgacccatgcgcacatcgaccactccgggatgctgcccgcgctctataagcagggcttccgcggctcggtatacgccagcgccgcgacctgccagctgtgcgacataatgctgcgcgactcggcgaacatccagatgcaggaggcagagtggaaatcccgcaaggccatgcgcgcgggcggcgcgccggtcgagccggtatacgaccttgacgacgtcgcgggcataatggggagaatgatcccctgcgggtacaacaagataattcaggtcaatgactgcgtgtccatccgcctgaccgacgtcgggcacctgctcggctcggcggcaatagaggtatggctgcacgaaaacggcgaggagcgctgcatctgcttcagcggcgatatcggcaacctcaaccagcccatcctccgcgacccgcagtttgtgaagagcgcggactacctcgtgatagaatccacctacggcgacaggctgcactccgccgagcgcgcggactatgtctccgagcttgcaaagctcatccagtcgacgctcgacgccggcgggaacctcattatcccctcctttgccgtcggccgcacacaggagatcctgtacttcatacgcgagataaaggagcgcggcctcgtacacggacacgcggacttccccgtctatgtggacagccccctcgccatcgaggcgacgacggtgttcctccagtgcgacactgaatttgtcgacgaggagatgcaggcggtcatccgctcgggcgtgaacccgctcatgttccccggcctcaagctctcggtatcgaaagaggactcggtcgcgataaacgaggataagacgccgaaggtcatcatctccgcaagcggcatgtgcgacgcgggccgtgtgcgccaccacctcaagcataacctctggcgtccggagtgccgggtgctgttcgtgggctatcaggccgtcggcacccccggtcgggcgctcatagacggggcaaagaaggtcaagctcttcaacgaggatatcgaggtgtgcgcctcgataagtgtgctgcccggcgtaagcggccacgctgacaagaacggccttctcggctggctgcacggctttgaaaagaagccgaagctcgtcttcgtaaaccacggcgaccctgattccgccgacagcttcgccgcctgcctaaatgacgagcagggttacaaggccttcgcgccatacagcggcacgcgctttgacctgctgcgcggcgagttcgactatatcgccgagcccaaaccgatagagaagaagcccattgtctccaaggcgagccgccttgtgtccgagctcatcgccgcggcggagcgcctgctgcgtatctgcaagggcatggacgggaagccgaacaaggtgcttcagggctttgtcagggatataaacaagctgtcggacgatatggaaaaatatacctga

SEQ ID NO: 627 - DNA, 2055 bp, Unknown
  Description of Unknown: Firmicutes sequence
atgaccgacctgaataccgacgccagatacatcaagggcataggagagaaaaaggcgcaggcgcttgcaaagctcggcgtcttttctctctatgaccttgtttcttattttccgcgtaaatatgaggatcgcagcaccgttatgcctatcgcgctgacaagcggcggtgagagcgtctgcatcgaagcgcttgtcgccgacactccgcgcctgacccgcgtgcgccgcggactcgagctcgtgaagctgcgcgccgtcgacgagagcggttcggttgacataacatttttcaatcagccatacgcgaaggacaatctcgtccgcggcgagagctatatgttcttcggaaagatagaaaccgccggcatgcgccgctccatggtgaaccccgtgtacgaaaactccaccggaagcggcaccgtcaccgggcgcatcatcccgatctaccgcgtgtgcaatgggctcaatcagcgcaccatgctgcaggccgtgcgccaggggctggacgcctgccttgaccgcatcccggacgtgctcccgcaggacgtgcgcgagcgctgccgccttgcgcagaccgcttacgcttatgaaaacatccactttcccaaggattttgacgcgcttgagcttgcacggcggcggctgatattcgaagagcttttcgtcctcgcctgcgcgcttggccgcatccgcggcgagcgtgtacgcgaggagggcttaaagctgtctgtccatgatatgagccgcttctgggcgtccctgccgttctcccccaccggcgcgcaaaagcgcgcgatagagcaggcgctgggcgatataagctcaggcgctgtgatgaaccgcctcgtgcagggcgatgtcggcagcggtaaaacgctggtcgcggcggcactgatgtggcagtgcgctgaaaacggatacatgagcgccttcatggcgccgacggaaattctcgccgagcagcattattcgacgctcagctccatgctcgccccgctcggcgtgcgtatcggccggctcaccggcgcgatgagcgcgaaggagaagcgcgagactaaggcaaagctcaaggccggggaatacgacatcgtcgtcggtacgcacgcgctgttcagtcaggacgtcgaatattcaaatctcgccctcgtcgtcaccgacgagcagcaccgcttcggtgtcggtcagcgctcggcgctcatcggcaaggggcagaagccgcatgtgctcgtcatgtccgcaacgccgattccgcgcaccctcgccctcataatctacggcgatctcgacgtgtccgtcattgacgagttgccgccggggcggcagaaggtggacaccttcgccgtcgatgagagctaccggcagcggctcaacggctttatccgcaagcttgtcggcgaggggcggcaggtgttcgtcgtctgcccaatggttgaggagaatgaggagctgcccgtaaagctcaagtccgcacaggagcacgccgctgagcttgccgcgctcttccccgatctcaccgttgcctgcatccacggcaggatgaagcccaaggaaaaggatgccgtcatggccgccgttgtcgcgggggaggtcaatatcctcgttgcgaccacggtcattgaggtcggcgtcgacgtgccgaatgcggctctgatgataatcgagaacgccgagcgtttcggcctgagccagctgcaccagctgcgcgggcgcgtaggccgtggaaaacacaagagctattgcgtcctcgtctcggataacgacagcgaggatgtgcgcgcaaggctctcgatcatgaccaaaaccaacgacggcttcaagatatccgaagaggatctgcgtctgcgcggtcccggcgatttcttcggctcccgtcagcacggcctgccagagatgcacgtcgccgatctcggcgcggacatgaacgtgatgcagcgcgcgcagagcgaggctcagctgctgcttgcatctgacccggagctttccgctccagagcacgccgccctgcggcagagcgtcgagcgcatgctgcgcgtgaacgccgacagcttcaattga

SEQ ID NO: 628 - DNA, 1101 bp, Unknown
  Description of Unknown: Firmicutes sequence
atgataatcaggaagatcgcgctcaacggctttcgcaattacgagtttgagaccgttgagtttgcgccggggacgaacgtgatatccggccagaacgcgcagggcaagaccaatctgctggaagcggtgtatatgctctcctgcggcaggagcttccgcacgcgctttgaccgcgagcttgtaggcttcgggtattcgggcgcggatatattggcggacgtttacagccatgagcgggagcagacgataaacatacagctgcgccccggtcagggaaaaaagatacttgtaaacggcgtgaagaaaacagcgggcgagcttgccgacacggtgaacacggtgctgttctgtccggacgacctgaacctcataaaggacggcgcggccgtgcggcggaggctcctcgacaacgcgataagtcagatacgcccaaggtacgcggagtatcttgctgagttcaaccgactgtatgagcacaagacgcgcatactcaaggactggcgcgataagccctcgctgctcgaaacgctggatgagttttccgacgggatgtgccgcgcgtcggcacagctcatacgctatagagcggctttttccgcgaggctcgatcaggccgcggctccgatacacaaagatttctcgaactcccttgaggagctggagataaaatacaagaccgtcagcaccgtgaaggatccgtttgcaagcgcgagggagatatactatgatatctgcgagcatcaggagaagcaccgtcaagcggagcttgagagcgcgcagtgcctcaccggcgcgcataaggacgaccttgagatattcataaacggcactgccgcaaggagctttgcctctcaggggcagacgaggacggcggcgctgtcgataaagcttgccgagcgcgaaatattcttagcggagaccggagagtacccggtgctgctgctcgacgatgtgctctccgagcttgacacaaagcggcaggagttcgtgctcaaccgcataggcggcgggcagacgcttataagctgctgcgaggacgagggcatatccaagcgcacaggcggcagagtgctgtttataagcgagggaaccatcaagtga

SEQ ID NO: 629 - DNA, 1947 bp, Unknown
  Description of Unknown: Firmicutes sequence
atggaaaagaaaaaattctatatcaccacacccatctactacccgtccgataagctgcacataggccatgcctactgcaccgtcgcgaccgacgccatcgcccgctacaaaaggctcgcaggcttcgacgtgatgttcctcaccggtaccgacgagcacggtcagaagatcgaggaaaaggccaaggccgcgggcgttacccctcagcagttcgttgacaacatcgtcgacggcaagggcggcatcaaggatctgtggaagctgatgaacatttcaaacgaccgcttcatccgcaccaccgatgattatcacgtaaagtccatacagcgcatcttcaagaagatgtatgacaagggcgatatatataagggcgcatacaagggcaagtactgcaccccctgcgagagcttctggaccgagagccagctcaaggacggcagatgccccgactgcggccgcgaggtccacgacgccgaggaggaagcctacttcttccgtctctccaagtacgcaaagcccgtgcaggagctgcttgagagcggcaccttcctcactcccccgtcccgcgtcaatgaaatgataaacaacttcataaagcccggccttgaggatctctgcgtctcccgcacgagcttcaactggggcgtgcctgtggactttgatccgggtcacgtcgtatacgtctgggtcgacgcgctcttcaactactgcaccgcgctcggactgctcaacgacaagtatgacgatttcgacaagtactggccggcagacgtacacatcgtcggcaaggagatcgtccgcttccactccatcatctggccggcaatgctcatgagcatggaactgcccctgcccaagcgcgtatacggccacggctggctcgtcattgacggcggcaagatgtccaagtccaagggcaacgtcgtcgatccctatgtgctggcggatatgttcggcgtcgatgcgctgcgcttcttcctgctgcgcaccttccccttcggctccgacggcaacttctccaatgagctgcttatcagcaccatcaataccgaccttgcaaacgacctcggcaacctcgtcagccgcaccacggccatggtcgagaagtatttcggcggcagcgtccccgcggagcgcgaagctgacgcgatggacgatgagcttgtcggcatgataaagtccgtgcgtgataagtacgccgcgcagatggacgagttccagctccacctcgcgcttgaggaggtcttcaggctcatccagcgcgcgaacaagtacatcgatgagaccgccccctgggtgctcgcaaaggacgagagcaagaaggctcgccttgccgcggtcatgtataacctgcttgaggcgctgcgcgtctctctgatcctcctcagccccttcatgcccgagagctgcgataaggcttttgcgcagatcggcgcggacaaggccagccgcagctgggacagcgccgcggtctacggcgtgctcccggcaggcacgaaggtctgcaagggcgagacgctcttcccgcgcatcgacatggccaaggctctcgaagcgcttgagaaggccgagggcaagaaggatgagccgaaggctccccccgtgctgcccgatgtgacgatcgacgactttgccaagtgcgacatgcgcgtgtgcaaggtcctctcctgcgagaccgtcaagaagtccgataagcttcttaagttctccctcgacgacggcagcggcactccccgccagatcctctccggtatccgcaagttctatgaaccggagcagctcgtcggcaagaccgtcgtcgctatcctgaatctgcccccgcgcaagatgatgggtcttgagtccaacggtatgctgctctccgccgtgcgcgagatagacggcaaggaggagctgcaccttatgatccttgacgactccgtccccgccggctcccagctctgctga

SEQ ID NO: 630 - DNA, 2607 bp, Unknown
  Description of Unknown: Firmicutes sequence
atggcacaagctaagaaaaccacaaccaaaaagaaaacctcgtcctcaaaaaagacgagcgcgaaggcgcagccgactcagccgccggatcctgtggtgccggtcaggcgcgaggtaggcgcggtactgtccctgttcctcgcgctcttcgtcggcatcagctattttatgaatgagggcgcgttcatccttttcttctcgaatctcataaagggactgatcggctggggctattggctcacagcaccggtgttcctgctcgtcgcaataattctcggcttccaccgcggccgtcccgtggcgctgcgcgttttctgcgcgctgatgataccgatcctcgccgcgtctgttatgagcctgatgatgtataagtaccagcttgacggcggggatatcaaactcatgtgcagcctcctgtttgagcaggggcagcggctcgactcggccggtgtgttcggcgggctcattgcctatgcgcttgagaagtcattcagcatatacggcgcgctgccggtgctgctggtgtgcctcgtgtttgccgttatcgtctctgtcaatggcagctttaagaaagtcgcggacaaagtcaagcttcaggtcgaggcaaaatacgacccgtccatgtatgaggatgcgctcaagcccgtgaactctgttgcaggcagagtgccggtaagccgtacgcccagcaaaatcgagcgcataagccgctcttcctgcccgatagacatacctctcggtgacgacgatgaagcgcttgagttgcttgacgggcgcagcgcaaagcccaggcgcggcgcaaagaaccagaagcccgataccgcgctcgcgactgacggtgttgctccgctttcgatgaaagaggccgcggcgctcgccggtgtgcagctcgcggagcctgagagcgcgaagcctgaggtgaagaagccttccggaaagtcagtcaccgtctcggctgagatatccgatccgccgaaaatcaagagaatagaccgcgcggaggtcgaggcggaggcgcaggctgtcgccgaggcgataaacgcgaccgaggacaagcccgactatgagttcccgccgctgtcgttactcaggagcggcggcgtttccacggtggattcgcgcgaggaaataatcacgaataaggaacgccttgagggcgcgataagaagcttcggcatcagcgcaactatcgtcggcgtgacgcgcggcccgacggtcacgcgctacgatatagagcttgaccagggcgtgaagctcgcaagagtcacgaaccttgcgggtgaccttgcccttgccctcggcgttgtgaacgtgcgcattgcgccaattccggacaagatatccaccgtcggcatagaggtgccgaacaagatcgtcagcaccgtctacctgcgcgatataatcgaatcgccgaagtttacctcggcaaagtcgaagctcagcttcgccctcggtaaggacatcggcggcgactgcattgtcggcaacatcgcaaagctgccgcatatgctcattgccggtaccactggctccggcaaatccgtctgcatgaactcgctcatcctgtcgctgctgtacaaggcgcggccggatgaagtcaggctcattatgatcgatccgaagatggtcgagctcggcgtctataacggcatcccgcacctctatgtcccggttgtcaccgacccgaagaaggcggcgggcgcgctgcaatggtcggtcgtcgaaatgctcaaacgctataggcttttctccgaggtcggcgtgcgcgaccttgagagctataacaagcactgtgtctcagtcggggagcagaccctgccgcaggtcgtcatcgtcattgacgagctggcagacctcatgcttgtcgcctccaaggaggtcgaggagagcatctgccgtgtggcgcagatgggacgcgctgccggtatgcaccttgtcatcgcgacacagcgcccgtcagcggacgttatcaccggccttatgaaagccaacatcccgtcgcgcatcgcatttgctgtctcatccgcgatggagagccgcatcatccttgaccagggcggtgcggaaaagcttgtcggcatgggcgatatgctgttttctcccgtcggctgtggaaagcctgtacgtatccagggcgcgttcgtttccgatgaggagcgcgaggatgtcatccgcttcatcaaggagggcgcgggcggtacggcgcagaacaacagcgagatcgaggagtttatgaacaaggccgcggaggacaagaattccggcggcgacggcggaaagtcctccaaggaggagaagggcggtctcggcggctacgatgagatgctgccgcaggcggtcgaggtcgtgcttgagacaaagtcctgctccgtctcgatgctccagcggcgtgtcaagctcggctattccagagctgcgcgcatcgtcgaccagatggaggagctcggcatcgttggcccgtatgagggcgcaaagccccgtcaggtcgtcattgaccgcgagggctggaacgagattcagcgcggtctcggccttgcgcaggacagtgatctcagtcttgcggcggacatgagtcaggataatgacagactcggctacgatgaatga

SEQ ID NO: 631 - DNA, 2403 bp, Unknown
  Description of Unknown: Firmicutes sequence
atgacagatcaagaattacttgcacaaggctatgttgccctgccaatgctgccactgcgcggactgcacgttttcccgggcatgatgctgacctttgatgttgagcgcccggcttctatcacggcgcttgagagagctgtcaagaataatcaggtcatctttctgactgcgcagaaggatctcactgcggatatgccgcaggaggatgagctgtaccgcatcggcacggtctgccgcatcagacagcagctgcgtcagccgaggggcaatgtctgccgcgtcatggtcgagggtgttttccgcgccgctgccggcagcctcaatacagatcccaagggctataccgcaatagtcacgccgcttgaggataagaaagagcgtgtcagccccgcgcgccgcgaagcgctgctgagaagctgccttgcccagtttgatgaatatatcaagtatgagcctgaaatgcccaatgagcagatcctcaatctgcttgcaaatcccgagccaatatatgtttcaaactacatcgcgcagaatgtacacttttcgatagaagacaagcaggcaattcttgaagagctttaccccacgcgccgccttgcgctcatcaacaagctcctcaaccatgagctggatatcctcagcatcgagaaggaactgaacgacagcgcgcttgagtcgatggcgcgcaatcagcgcgagtattatctgcgcgaggaaatgaaggccatccagtccgagctcggagaggatgacgatatcgagcagtaccgcgtaaaaatccaggcgctcccggtgagcgatgagatacgcgaaaagctcctcaaggagcttggccgtttgcagaagcagcctttcggctcctctgaggccgcggtcctgagaaattaccttgacgtctgccttgagataccttggggcaagaccacgaaggaaacggtaaatatcgccaaggcgcgcaaaaagcttgacgacgatcacttcggccttgacaaggtcaaggagcgtgtgctcgagtacctcgccgtaaagcagctcagccccgatatcaagggcgggcttatctgccttgtcggccctccgggcaccggcaagaccagtatcgcccagagcatcgccgcggcgacgaaccgtaagctcgtgcgcatctctctcggcggcgtgcatgacgaggccgagatacgcggccaccgccgtacatacataggctctatgccggggcgtatcatcagcggaataatccaggcaggctcctgcaacccccttatggttctcgacgagatagacaagcttgcctccgattatcggggcgacccgtcggctgcactgctcgaggcatttgacggcgagcagaacggcagcttccgcgataacttcctcgagataccctttgacctgtccggtgtgttcttcatcaccactgccaacacgactgataccattcccagggcgctgctcgaccgtatggaggtcatcgagcttcccagctataccgacgaggaaaagctccagatagcaaagcagcaccttattccgaagcagcgccgcaagcacggcctgaaagcaagccaactcaagcttgacgacggcgcggtcagggagatcatcgcctcctacaccagagaatccggtgtcaggaaccttgagcgcgagatcgcgaatatctgccgcaagacagcaggcggtattgccgaggaaaagttcaagtccgtttccctgcgcgcgggtggcgtggcggagctgcttggccctgccaagtttaaacccgaggccatgcgccgccgtgacgaggtcggccttgtccgcggccttgcctatacctctgtcggcggagaagttctggatgttgaagccgccgtagttgacggcaccggccgccttgagcttaccggcaatctcggtgatgtgatgaaggaatcagccaaggccgccgttacctatatccgcagccgcgcgagagcgctcggcatcgatccggatttctataaaaacaaggatatccatatccacttcccggagggagctgtcccgaaggacgggccgtccgccggcattaccgtgaccgtcgcgctcatctccgcgctgtcgggtctgcccgcgcgccgcgacgttgccatgactggcgagatcaccctgcgcggccgcgtcctgccgataggcgggctgcgtgaaaagaccatgggcgcgctgcgcgccggggtcaagaccgtcatcatcccggcagacaacgagagcgaccttgagaatatcgaccagaccgtccgcggtaagctcagcttcctgactgccgagaacgtagattcgatactcgagttcgtccttgtccgccctgccaaaaaagaaacgccgctccagccgtccattccgctccagtctcaggagctgtgcggcacggtacgtcagtga

SEQ ID NO: 632 - DNA, 1014 bp, Unknown
  Description of Unknown: Firmicutes sequence
atgcagaagctcagagagtcatcggtaaaggaaattctggattgcgacagcgcggagcgccttgaggcgatgcgcgtcaggtacctcggcaaaaagggcgagctgacggcgatactgcgccagatgggcagcctctcggctgaggagcgccccgcgatggggcagctggcaaaccagctcaggagcgagattgaagaagcgatagacaagcgccgtgaggagctttcttccgcgatgatggagctcaagctcgagagcgaagccgtcgacgtgacgctgccgggcaaggatatacgcatggggcacaagcacccgatgtacaacgtcctcgaccagctcaaggatatattcatcggcatgggctttgagatactcgacggccccgaggtcgagcttgcggaatataacttcacgaagctgaacatcgacgaaggccacccctcccgtgactggacggacaccttctacttcaccgaggacggcaagatacttctgcgcacgcagacctccccgatgcagatacacgccatggagacgcgccagccgcctattcgcatcatcgcccccggcagagtctaccgcaaggacgaggtcgacgcgacgcactcccccatgttccaccagattgaaggcatggtcatcgataagggcataaccatggctgacctcaaggcgacgctcaacctcgtcgtcgagaagatatacggcaagggcacggtcacgcgcttccgtccgcaccacttcccgttcaccgagccgagctgcgagctggacattcagtgccacaagtgcggcggtaagggctgcccgacctgcaagggcgagggctggattgaagtcctcggcgcgggcatggtacaccccaaggttcttgagggctgcggcattgatccggacgtgtactccggctgggccttcggcatggggcttgagcgccttgctctcggcgagtacaagatcaccgacatgcgtctgatattcgagaacgatgtcagattcctcgaacagttctga

SEQ ID NO: 633 - DNA, 2112 bp, Unknown
  Description of Unknown: Firmicutes sequence
atgcacaacagacttgtaaaaccgggcagagttgcggggcttgttatcctcatcctgctgctcctgacggtgtatctggtggcgctttataagctccagatcatagagggcgaggcaaactacaaccgcagcagcgagcttacgaataccgagcgtgtagtgaccgctgcgcgcggcaatatctatgaccgctacggccgtaccctcgtcagcaatgaggagacctacaacctgaagatagatacggacaagctctttgcaaacgatgacccgaactcggtcatcctcgagcttgtgcacatggtccagggctacggcgatgaatataccgacgacctgcccataaccatgaccccgccgttcgagtacgacccggacatgacggctatccagcgcacgatgcttgacgcgtactatgtccgtcaggagatagacccgaactccacggcggtcgagctgatgagctatatgcgcacgagatataatatcgacaacagctactccgccgaggagatgcgcatcatcgccggcgtgcgttactcgataaacgtccgctacgccgtccccactgccgactatatcttcgtcgaggacgcgagcatgaagctcatctcgtcgatcatggaaaacaagctcgtcggcatcgaggtcgagcgtgcatacagccgtaagtacggcacggaatacgccgcgcatatccttggctacaccggccttatgactcaggaggagtatgagaaatactccctgctgaactattcgaccgacgccatggtcggtaaggacggcgtcgagtacgcctttgaaaattacctccacggcaaggacggcaaggtcatcgagacgcgaaattccgccggtacggtgctcgcgacggtatacgaggaggagccggagcccggcaaccacgtgtacctgacgatcgacagcgtcctgcaggagcagaccgagcgcatccttgcaaacggcgtgtccatactcaagcagaacattgcccagaagcgcgccgagggcacggcgcgaggcgactataacgtcgacctcaaggatgagattaccggtgctgctgccgtggtcgtgaacgtcaagaccggcgagccgcttgcgatggcgagctggccgacctacaatgtcgcgacgatactggaggactatcaggagctgctcgaagcggagaatgccccgctctttaaccgcacgctgatgggcacctacgcccccggttctactttcaaaccctgcacggcaatagccgcgctcacaatgggcatagtaaatactgaggacaaaataaagtgcgagggcgtctacacaaggtacgctgccgaaggctacgcgcctgagtgctggatctggaactcgacgaaggatcacctgacccaccccgaggaaaacgtcacgaccgctatccgcgactcgtgcaactactatttctactccatcggcaactacctcggcgtcgacgacctcggcaagtttgctgcgaacttcggtctcggcgaatattcgggcattgagcttgttgaagccaagggcaatatgtccaatcaggcaaaccacatggactatgccggtaccgagtggcgaataggcgataccctgcaggccgccatcggccagtccgacagcgttttcaccccgatacagatggccgaatactgcgcgaccgtcgcaaactccggtacgcgctattccgcgtccatcctcaaatccatcagaaactatgattacagcgaaaagctctatgaccgcgagcccactgttatgagcactgtcgagtccgccgagtataactgggcggcggtgcacgagggcatgtggcaggtgcttaacgactatataaacgagaagaatgtcaacgtctgggtcgactgccagtggcgcgtcgccggcaagaccggtaccgcacagaagggcgaaggcatccagaacgacggtatcttcatgtgctatgccccgtataaagatccagaggtcgcgatattcgtcgtcgtcgagcgcggcggcgccggtgctgacgtgcagttcatcgcgcgccacatcatggacgcctacatcaccataatgggctacagcgacacctccgagacggaaatgacgcttcttaaataa

SEQ ID NO: 634 - DNA, 1998 bp, Unknown
  Description of Unknown: Firmicutes sequence
gtgcgcggcttgaacaagaatctcaggcgtcttgccgaacccggcaagctgccgctgatcctgcttgtcgcatttgccgccgcaacgctgtggtacggcatgtacacgcttgcggctatagagggcggagccattctgctgctcatgatcttcttcttcctgtcaaagcgcagaagagagaaacagctcagggcgtatatcgaatccgtgacctacgagacggagaacgccaagagcagcacgctgacgaattttccgctgccgatcgcggtgttcgggctggacgattcgcgcattatctggggcaacgaaatgttcttcaaaatgtgcggcgagaccggtacgcggctcgacgcgaacctgacggagcttgtgccgcagttctcgggtaagtggctgctcgagggcaagacccggtacccgacgctgcttgaggtaggcggccggaaatatcagctgcacggcaacatcatccgctccgataaggataaggagaaaagcccgttcatgggcataacctactgggtggacgtcacggactatgacaacatccgcatcgagtatgagaacagccgcccgatcgcgggcgtcgtcatcatcgataaccttgaggagcttaccaagaaccagccggagcgtataaagaacgatatacgcgacgcggtggaggacaagctcggccagtggtgcgcgtcctttgacggcatcctgcgccgctatgaccgcgacaggtacattgtcctgatggagcggcgggaccttgagtggctcaaggccggcaagttcaagatcaccgaggagatgcacgaggtcgaaagccccagcggcattgccgcgtccataagcattggccttggcgcggatgcggacaccttcggcgaggcgctccagtttgcggacatggcaggggagcttgcgctctcccgcggcggcgaccagaccgttatcaagaacaagatgagcttcgagttctacggcggccgcggcttcgagatagaaaagcgcaccaaggtcaagtcccgcgttatggcaaacgccttctccgagcttataaaggactcctccaaggtgctcgtcatgggtcaccgcttcggcgatctggacagcatcggcgcggcggtcggcgtatgctgccttgcgcggcagctcggcgtacacgcctccatagttgcggacacgaagcactgcgccgcgaccccgcttatagatatggtacgccgcgagccggagtataaggacatattccttaccccgcaggaagcaccctccaaggtcgatgcgcacacgctccttgccgttgtggacacgaaccgcccggagcaggtggagtgcccggatcttctgaacctgtgcaagcgcgtcgcggttatagatcaccaccgcgttgccgcgacctatatacatgacgccgcactcggctttatcgagccctacgcgtcttccgcgtgtgagcttatgaccgagatcatccaggagcttcccgaagcgacagatatgctccgctgcgaggccgaggcgctgatgtccggcatcgtgctcgataccaagagcttcaccatccgcaccggcgagcgcacctttgacgcggcggcggtgctgcgccgtcacggcgcggacacggcggcggtcaagcgcctgttccagtcggacatggaggacaccgtcgcaaagtataagatactccagagcgcgaagctctaccgcaaggtcgcggtcgccgcgccggaggaaccgcaggagcgcgtagtcgccgcacaggcggcggacgagctgctgaatgtctccggagtggatgcgtctatcgtcgtcgcgccagacggcaagggcggagtgttcgcctccgcgcgctcgataggcgaactcaatgtacagctcatcatggaaaagctcggcggcggcggcaacagaagcgccgcagcggtgcagttccagcagggcgagaccctcaaagaggcggtaagcaaaatatatgccgccatagatgattattttgcctga

SEQ ID NO: 635 - DNA, 3021 bp, Unknown
  Description of Unknown: Firmicutes sequence
atgaaagatttcagtctggacttcgaccccacaactgaatcttataccgacatgtcgtttgacagcatactgtcgcaatacaagctggagtcgtaccaggacgcttcgtccgggtcgggtgactccagctattccccgttgtacgacgacgaggacgacgatgtgcgtgtctacacacccggcgcagcctcatctcgcaaaaacgcagagcctgagagcacggacagcggcgatgatgactacgccgatgaaggttacgatgcacaggactacggctatgacagcgccgtatcatcccgcgctgacgattacggtgaggaggacaacagtaagcccttccccacgattcccggtatcgatcatctgaagagctttctcaagagcaagctgaagccgaagtccgaaaagcatgctgcgggcagccggagcaagacagagcctgccgacgactatgacgatcccggttattccgatactgccgacgggcaggactatgcttcggaatataccgacacatactacaccgacgaagactatggctatgttcccgacggcagcggtgcttatgactccgcgcccgcgcagagcacatggcagtatgacgacggcggctacgatgagccgcaggcggaagaggaaccggaatacactgctcccggcaccgaacactcaggtgcgcgcggtgcgatggagcaggaggcgcgaagatatatcgcgcagatgcaggcgggctatgagcaggactatgcagagcccgaggtcgaggaggatctgccctacgatccgagtaccgacggctatgatgcagacccgacgcgctattccgccgaaggcggcagcaccgtatacgctgccgattccgacgacggtgacgaaatagacagccgcttcaatctcagcggcaagcgcgcggcgagccgtatgcagtacggcagcagggcggtcgacctgagcgctgacgaaaactatgagccgacgccgcagacggggtacagcccgtcgcagtggacgccggattacgacgatcccgcaaacgacggctccggtgaagaggagccggtacgcaaaaagcataaattcggcaagaagaaaaagaaaaaagaaaaggccaaggccgaggtcacagagaccgaagccgacgtctctgacaaacggacgcccatctacagcggctttgacgataccgccgatgaaagcggcagctacgctgaggaggacgactacggcttcgacgccgaaggtgacggcaagaagttctccgaggaggacgcttacttcccgccgagcttccgtgaatatgtgctctcgctctttgcgtcgctgttcctgcgcgtcaggggcacggcacgcggcgacaccgccgctacgatgagcgacagcgaggaggatctcggaagtgaggtcacgcccgccgccgcgtcaaaatactacggttcgttcacgcgttcgctgtcactgcgcattaaaataagtgcggggctgctggcactgctgtgctatatatcgctccagctcccgctgcccggtatgctgcgcactctgcccgtttccgccgccgcatgcttcgggctccaagcggcgatcatgctgctgagccttgacgttgtaacgacggctgtgctcaaggtcacgcggccgcgcttcggcattgacacacttgcggtgttctcctgccttataagcggtgcggacgcgctgatagttgcgctgtccgacacggcgagggcgcacatcccgctgtgcgcgctgacaagcctctcgcttttcggcatactgatatcgacatacctcagcgtcaaggggctgcgcaaggcgacgcgcgtcccggccatcggcaagcacttctattccgtgacaggtgaaaacaagctcggcaaaaaggagcttacgctcctcaagtcccagcgcccggcgacgggctttgtccgccgtgccgaggaagcgccgcccgatgagacgctgtttctccggctcgcgccgatccttgccgtgctggcgctgctgctggccgtaatagtcgcggcggtctccggctgcggttcggactttgtctacatattctccgcgctgctcgcaccgtcggtgccgttcatggctctgtcagcctttgcgctgccgtatttcctcggcacggcgcgcgtgttcagagtcggcggcgctatcgcaggctggtcggggctgtgtgacctcggcgtgagcaagagcatcatcgtcaccgaccgcgacctcttccccgaggagtgcgtgacgatggagagcgtacgcatattcgccgacggcgacgcacagaatgttatctcctatgccgggacgatgattgcagcggtcggctcctgcgccgcgggctgcttcggaaagctcatggaggaaaacggctgctctctcaagcatgtggagaactttgaatgtctccccggcggcggggcaagcggcattatcgacgggcgcaccgtcctgtgcggcagcaccgatctgatgcggctgatgaacgtgcgcatccccttccgcctgacagacaagacctccgtccttctcgcgatcgacggcatactttacggcatcttctccctgcattatgagccgatgccgcaggtgcgccgtgcgcttattgaccttgtgcgctccggccgtcacccggtcttcgcgatacgcgacttcaacattaatcccgagcttctgcacaacttatttgacattgcgaccgacggctacgacttcccgccctatgtggagcgcttcgagctgtcgaccccgtcctcaggcaaggacagccgcatcgacgcagtcgtctgcaacgaggggcttgggccgctcacggaggtcgccgacgtcgggcacaagatatatatgtccgtgcgggcaaacctgctgctggcaacgctcgcagcggtgatcggcgtgttcaccgtgtttgtgaagttcctgaccgtgggaagcgtcagcctcggctttatactgctgtccatgctgctgtgggcgctgcccgcggcggcggcaagcctgtatgtcaatacgaagtga

SEQ ID NO: 636 - DNA, 609 bp, Unknown
  Description of Unknown: Firmicutes sequence
atggcaaagaatacacagcccatagttaagcgcgcaaaggcgctgggcgtcacccctgcctctctgggttataccggcaagagcaaggtcgacaccatccgcaaccccaaggctcaggttcgcaaaaagcagagcgagtacggcatgcagctcaatgagaagcagaaggtcaagttcatctacggcgtcctcgaaaagcagttccgtctgtactatgagagagccgagaagatgcccggcatcaccggtgaaaacctcctggctatccttgagcagcgtcttgacaacgtcgtgttcagacttggcttcgccatgacccgccgcgaggctcgtcagctggtcaaccacggtcacgtcaccgtcaacggacgcaaggtcaacatccccagcttccaggtcaagcccggcatggtcatttccctcaccgagaagggcaagagcatgcagaaggtcaaggagaacattgaggataacgccttccgtcccgcgccgaagtggatcgagtatgacaagaacaatatgacggcaaagatcgttgcagttcccgcacgcgatgacattgatatgcctatcgaagagcatcttatcgtcgagttgtactccaagtaa

SEQ ID NO: 637 - DNA, 2643 bp, Unknown
  Description of Unknown: Firmicutes sequence
atggaaaaattcggtcttaaccaactgcgtgaaatgttcctgagcttttttgagtccaagggtcatcttcgtctgcccagcttctctctcatcccgcagaatgacgcaagccttctgctcattaactccggcatggcgcccatgaagccctatttcaagggcgagcaggagccgccgcgccgccgcgtctgcacctgccagaagtgcatccgcaccggcgatatcgagaatatcggcaagaccgcccgccacggcacttattttgaaatgcttggcaacttctctttcggcgattacttcaagcgtgaggccatcgcatggagctgggagttcctgacttctcccgactgggtcggcatcgatcccgaccgtctctatccctccatctacgttgatgacgatgaggcttttgaaatctggaacaaggagatcggcatccccgccgagcgtatcttccgcttcggcaaggaggataacttctgggagcacggcgcaggtccctgcggcccctgctctgagatatactatgaccgcggcccggagtacggctgcggcaagcccggctgcaccgtcggctgtgactgcgaccgttacatggaagtctggaacaacgtcttctcccagtttgataatgacggcgagggtcactataccgagctcaagcagaagaatatcgacaccggcatgggtcttgagcgtctggcagtcgtctgccagggcgttgactccctctttgatgtcgataccgttatgaacatcacccacaaggtcagcgagatgaccggcgcttactacggcaagagccataagatggacgtctccctgcgtgtcatcaccgaccatatcagaagcgccacctttatgatctgcgacggcgtcctgccctccaacgagggccgcggctatgtcctgcgccgtctgctccgccgcgctgcgcgccacggcaagctccttggcgtcaatgagccgctcctttacaaggtcatcgataccgtcatccatgagaacgagtgccagtacccggagcttcgcgagaagcaggcgtacatcacccgcgtcatcaagaccgaggaggagaactttgcccgcactatcgacgccggtatggctatcttctctgatcttcttgctgagcacaaggcaaagggcgagaccgttttctccggtgccgacgctttcaagctctatgacacctatggcttcccgcttgacctgacgatagagatgtgctccgatgagggcatgaccgttgatgaggacgctttcaagacccttatggaggagcagcgcgtcagagcgagaaaggcgagagaagctctcggcgatcttggctggacgggtataaacttcggtcaggaaatgccggagacccagttcgtcggctatgatcagaaagaaaccgatgcagagatactcgccatcgtctccgaggacgagatgcagcaggaggtcgcctccggtgccgaagcaataatcgttctcgataagactgtcatgtacgccgagatgggcggccaggtcgccgaccacggcaaaatcgtctgcggcgactgcgtgtttgaggtcaacaacgtccagaaaaacaagggcggcaagttcatgcattacggcgtggtcaaatcgggtcattttgcggtcggcgaccatgttaccgcaagctactgcgaggagcgccgccgcgccatccgccgcgcccacagcgcgacccatctgctccaggcggctctggtgcaggtgctcggcgaccatgtccatcaggcgggctcccttgtcgagcctgaccgcctgcgctttgacttcacgcatttctccgctctcaccgcggaggagatcggcaaggtcacggctctcatggccgatatgatccttgacggcgctgatatcgagaccaaggtcatgccttacgacgaggccaagaagctcggcgcgaccgcgctcttcggcgaaaagtacggcgataccgtcagagtcgtgaagatgggcgactattccacggagttctgcggcggcacgcatcttgacaataccgccaaggtcggcatgtttgccattatctccgaaggttccgtcgcctccggtgtgcgccgcattgaggccatcaccggcaaggaggtcatcgagcgctatgccgcaatgtccggcatgctcagccgcgtcgcggataagctcaagaccagacctgtcgagataatggccaaggttgagaacaacctcagcgagatccacgacctgaagcagaagctcgataagatgaaggatcagctcatgtccggtgaggcggagcgcatgctctacggcgcaaaggacatcaagggtctcaaggtcatcaccatcacgaacggcccggtcaacgctgccgatatccgcaagatgggcgaccagctcaaggatcgattcccgaacatcgtcgcagtcctcgcggcgaccgctgaggacaaggctaccatgcttgccgtctgcggcaagaacgccgttgcccgcggtatcaaggccggtgacctcataaagaacatcaccaagctctgcggcggttccggcggcggcaagcccgattccgcaatgggcggctgcaaggaaatcctcaagcttgacgacgccatggcggctgtcgacgatttcgtcaatgcaaacgccaaggactga

SEQ ID NO: 638 - DNA, 843 bp, Unknown
  Description of Unknown: Firmicutes sequence
atggatatccgttattcagcacatcccgaagatgtgaagcgttataccacagaggagctgagaaaagagttccttatccaggacctttatcagcccgataccgtgcaggctgtttactcccatgttgaccgcatggtcgttctcggcatcatgcccgtgaatgaggctctgcctatcgacaagggcatcgacgtctgggcgaacttcggcacgaacttcttccttgagcgccgtgaagccggtgtgttcaacctcggcggcgcaggctggatagaggccgacggcgtgaagtacgagctcggctttgaagactgcctgtacatctcacgcagcacgaagtccgtcgtgttcggcagcagcgacaaggagcagcccgcgcgcttctacctcgtctccgctcccgcgcacaaggactgcaagaccacctttatctccattaaggacgcaaacaagcgtccctgcggcagtaaggaaaactccaatgagcgcgtcatcaaccagttcatccaccccgatgttctggagacctgccagctctccatggggcttacccagctcgctccgggcagcgtgtggaactccatgcccccgcacacccatgagcgcagaatggagatatacacctacttcaatctccccgagggagaggtcgtcctgcacctgatgggtcagcctcagcagacccgccacctcgtcatgcagaattacgaggccgtcatttccccgtcatggtcgctccatgccggctgcggcacctcgaattacaccttcatatgggcgatgggcggcgagaaccaggccttcgacgacatggacacctttggtgtaaataagctcagataa

SEQ ID NO: 639 - DNA, 693 bp, Unknown
  Description of Unknown: Firmicutes sequence
ttgtttagaggaaagaattataaagagagctcaaagctcatagataagcaggcactctatgatccccaggaagcgctgaagctcgttatcagcgcaagcaaggcaaagttcgatgaaaccgtcgagctgcacgtcaagctcggtgtcgatggccgtcacgctgaccagcaggtccgcggcgctatcgttctccccaacggcaccggcaagtccgtccgcgtcctgtgcttctgcaagcccgagcgcgttgacgaagccctcgaagccggcgcagattacgcgggcggcatggatctcgttgagaagatccagaaggaaaactggtttgaattcgataccgttatcgccagccccgacatgatgggtactgttggccgtctcggtaagatcctcggacctaagggcctgatgccttctcccaaggccggcaccgtcactcccaacatcaagcaggctatcggcgaagccaaagccggtaaggtcgagtatcgtctggacaagaccaacatcatccactgccccatcggcaaggtcagcttcggtgcggacaagctctatgagaactatgttgctctcatcggcgctatcatcaaggcaaagcccgcttccgcaaagggtcagtacatcagatcctgcgtgaccgcttccaccatgggtcccggcgttaagatcaacgctcagaagcagctgtaa

SEQ ID NO: 640 - DNA, 1455 bp, Unknown
  Description of Unknown: Firmicutes sequence
atgcctactacgtggaaccgctcctccgaggattttcataagatatactccgccaataccgacgccttctaccgcgtcggcggcattgccatggcaaaggagttagatgagtttatgacccgctgcgcgcttgggctgtggagccgcggcggcgggatcacccagcgccatgtcgacatggcgaaccagatatattcccgcaaccagccgcagccgaaatggatgctctggtcactgacaagctccgtgtgcgaaagcgaggtcttcctcccgccggtgttctattggaacctcgccgagaccgatgccaagcgcggcaccgaggcttcccgcacctttatccgcatgctcacaaatattctgctctacctcgccgcagtggacgacgacgtcagctacgacgaggccgcctacataaccgagtgtaccgaaaagctcaccgcgatatgcgacacgagcggcgtgcgcaagagccgcgaggcgctcaatccccttgactatgtcacaagctccgagccgggctttcaggaaaagcatcgccttcaggagcagactgcgggcggcgaaaagtccaaagcgggcgacgctgaaaagcctgacgccgaggagaaaaagccggactttgacgagctcatggcgcagctcgactccctcgtcgggcttgacgatgtgaagaaggacatcaagaacctgatgaaccttgtcaaggtgcgcaggctgcgcaaagagaacgggctccccatcccgccgatgagcctgcacatggtgttcatgggcaaccccggcacgggcaagaccacggtcgcgcgcatcataagcgggctgtacgcggcgataggcgtgctggaaaaggggcagctcatcgaggtcgaccgctccgggctcgtcgcaggctacgtcgggcagaccgcgctcaagacgcaggaggtaattaaatccgcactcggcggtgtgctgtttattgatgaagcctactccctcgcttccggcggtgagaacgacttcggacgcgaggcgatagagacgatactcaaggcgatggaggatcaccgcgatgagcttatcgtcgtcgtcgcgggctatgacgggcctatggagaagttcatcaactccaaccccggtctccagtcgcgcttcaataaacacttctacttccccgactataacggtgagcagctcctgtacatcttcaagggtcaatgcaaaaagaacggctacgccctcacagaggaggccgaagccgaggcaaaggcgatgtttgaagagctgtacgagaaccgcggcgagaacttcggcaacggacgcgatgtgcgcaacgtgtttgaagacacggtcgtgcgccagtcaaaccgcgtcgccgcgctggacgcgccgacgaaggacgacctcatgcagttcctcccggaggatctcagggacgcggatgagacctgcgagacagacgctgaagaataa

SEQ ID NO: 641 - DNA, 1077 bp, Unknown
  Description of Unknown: Firmicutes sequence
atgaacagacaattatccggcgagaacgccacattcatggacaggctcaaagctgctgtcaactccttcggcctgccgagactcatcatcgcatgcttcctcctgctcctgtttattgccgctccctttgtcggcgcggactttgcgacccagatcaccaacaccgttaaccgcttcagctggaacgcgatcctcgtgctcgcgatggtaccgatgatccactccggctgcggcctcaacttcggcctgcccctcggcattatctccggtcttctcggcgcgacgctctctatagagttcggcttcaccggagccatgagctttgtcatggccattgtcattgccactccctttgccctgatcctcggcgcaggctacggctggctgctcaataagatcaagggcggcgagatgatgatcgcgacttacgtcggcttctcgtccgtctctttcatgtgcatgatgtggctgctgctgccgtataaaagcccgacaatggtctggggctttgccggcaagggcctgaggaccacgatttccctcgagggcttctatgacaaggtgcttgcaaacttcctgcagatcaacatcggcaacctctccatcccgaccggcactctgctgttcttcgcgctgctggctttcctgatgtgggctttcctccacaccaagaccggcaccgcaatgaccgccgtcggctcgaacccgaccttcgctaaggccgcaggcgtcaatgtcgacaagatgcgtatgctctctgttattatgagcacatggcttgccgccgtcggcatcctcgtctatgagcagggcttcggcttcatccagatctacaccgcgcctttctacatggcgctgcccgccgtctccgccatccttatcggcggcgcatcggtcaacaaggcgtccatcgcgaatgtcatcatcggtacttttctgttccagggcatcgtcaccatgacgccgaccgtaatgaactccatgatccacatggacatgagcgaggtcatccgtatcatcatctccaacggtatgatcctctacgctcttaccagaaaaacggagggctcgaaatga

SEQ ID NO: 642 - DNA, 1413 bp, Unknown
  Description of Unknown: Firmicutes sequence
atgccttacgaaagaaaaacgatagatataagcaggatacatgagcaggaggatatctgccggcagatattcgaccgcgtcaccgccgacgggcagcgcccgctcgcaatggtagacacctacggctgccagcagaacgaggccgacagcgagaggctgcgcggctatctcagcgagatgggctacagcttcacgcaggacgagttccaggcggacgtgatagttgtgaacacctgcgcggtgcgcgagcacgcggagatgcgcgtgctcggcaacgtcggcgcgctcaaccacacgaagaagaacaagcccggccagataatcgccgtgtgcggctgcatggtgcagcaggagcacatggcggagaagataaaaatgtcctaccccgtggtcgacctcgtgttcgggccgcatgagctgtggcgcttcccggagctgctgctgcgggtgatggacagccacaagcgcgttttcgccacggcgaaggacgacggcgcggtcgccgagggcatcccgctcaggcgcgacggcacggtcaaggcgtggctgtcgatcatgtacggctgcaacaacttctgcacctactgcgtcgtgccctacgtgcgcgggcgcgagcggtcgagaaagccggaggacattctcgaggaggcgcgccagctcgtcaaggagggctacaaggacattacgctgctcggtcagaacgtcaattcctacggcaaggatctcggcagcggggtggattttgcagatctgctgcgtatggtgaacgatattccgggtgacttcctcatccgctttatgacgagccacccgaaggacgcgaccgagaagctcttcaaaacaatggccgagtgcgaaaagtgcgcgcatcagctgcacctgcccgtgcagtccggcagcgacaggatactcaagctcatgaaccgcagctataaccgcgagaagtacctgcatcaggttgctctggcaaagcgctacatgcccgacctcgtgctcacgacggacataatcgtcggcttccccggcgagacggacgaggacttcgaggacacgataagcctctgcgaagaggtgcgctacgacgcgatgttcaccttcatctactcaaagcgcgtcggtaccccggcggcgtccatgcccgacccatacacgcgcgagcagaagcagaagcatttcgaccggctcaccgaggtatcgaaccgcatctccggtgagaagcacaaggaatacgagggtaagacgctgcgcgtgctcgtcgacggcgagaccgggcgcgacgaatataatctctccagccgcacaaacggaggcaggctcgtccacctcaagggggagatcagccttataggaaaattcatcgacgtgaagatcaccgccagcaacacctgggcgctgtacggtgagatagtttaa

SEQ ID NO: 643 - DNA, 1449 bp, Unknown
  Description of Unknown: Firmicutes sequence
atgtccaaaaaggcaaaaagatcgatcagtacatttgcgatcctgctcgccgttatgctccttgtgtcaatagccacatggatagcagcgggcaacacctacaccgacgctgacggcaataccgccgaagtcgtcggagcaacctccagcgatatctttatggctcccgtcaacggcttcgctgacgcagccgacgttatcaccttcgtgttctgcctcggcgcgttccttgcgatcgtgacaggcacaggcgctcttgagaccggcatccagtccctcgtgcgcaagctgcacggcaaagagcttgtcctcgtatgggttctgatgttcgtgttctccgtcggcggtaccacctacggtatgggcgaagagaccgtcggcttctacatcctgcttgcagcgaccatgatggccgccggctttgacccgatcgtcggtgcggcaacggttctgctcggcgcaggcaccggtgttctcggctccaccatcaaccccttcgccaccggcgcggcggtctccgctgcggctgacgtcggcgttgaggtcaacatgggcaccacttatgtcattgccatcatcctctggctcgttgcctatgttacctccgcactgtttgtcacctcttatgcaaagaaagtccgcgccaataagggctccatcctcactgctgagcagctcagcgagtgcaagctggcctacggcggcaaggacgatatcggcgatgtcaagctcaccggccgtcagaaggctgttctgtggctgttcgccctgtccttcatcgtcatgatcctcggcttcattccttggggcgatctcagcgaaggcgcttacaacttctttgcccccatctcctcctggctcaccggcgccggcttcggcgattggtggttctatgacgcggcaacttggttcctgctcatgggtatcatcatcggcattgtcggccttgaggataagggtcagctcatgaaactcatcatcgtcggcttcggcgacatggtcggcgttaacctcgtcatcgcgatggcgcgcgccaccaccgttatcatgagcaccaccggcctcggcacttggatcgttgaggcttccgtcaccgcactgagccagtccggcgtttccgctggtgtgttcggtatgcttgactacgtactgcatgtcggcctcagcttcctcgttcccagttcctcgggccttgcgagcctgtccagcccaatcgtatccccaatcgttgcgggcatgggctggagcgtagagactgctgtcatgataaacgttgccgcgaacggccttgtcaacctctttactcctacctgcggcttcatcatgggcgggcttgcacttgcacgtgtcccctatgagacctgggtcaagtgggcatggaagcttctggtcactctgtttgtcgtcgtcggcgttatcctcacgatagctatggcggtgctgagctga

SEQ ID NO: 644 - DNA, 1695 bp, Unknown
  Description of Unknown: Firmicutes sequence
atgaagaccccttggacagacagcgttgatatcaacgctccgcttcccgaatacccgcgcccgcagatggcgagacgcagctggctgaacctgaacggcccgtggctctatgcctttacggacagcagcaggagaccggctgagtatgacggcgagataaccgtgccgttctccccggagacggagctgtccggagtcggcagagcgctgaggagcggggagtacctgtggtattgcagagaagtcgagataccggcggagttttccggtaagcgtctgctgctgcacttcggcgcggtggatcagtgcgcggcggtgtgggtgaactccacgcaggtcgtgcggcacaccggcggctatctgcccttcgaggcggatatcaccgacgctgttgaggacggctatgcccagatcaccgtcagagtgaccgatgataccgacagaagcttccagtcccgcggcaagcagagctcgaagcgcggcggaatatggtacactccgcagagcggtatatggcagacggtgtggctcgaggccgtaccggagacgtatgtgcgctcgctgcgcatcaccccggatattgacaaggcaacggtcacagtcgaggccgacataagaggcgacgagcaggcttatgcgcattttggcgggcaggactatccgctcccggcggagatccctgtaccgggctttgaaccttggtgcccggagaacccgaagctctacggcttcagcgtaagctgcggcgaggacgaggtgttcagctattttgccatgcgcaagatagccgtcgcaaaggataaaaacggagtgccgcgcctgtttctgaataacgagccgtacttccagaacggtctgctcgatcagggctattggcctgacggactctataccgcaccgacggatgaggcgcttatctacgatatcagcaccgccaaggcgatgggcttcaatatgctgcgcaagcatatcaaggtcgagccgctgcgatggtactaccattgtgacaggctcggtatgctcgtctggcaggatatgccgaacggcggtcggcgctataatccggtcataatatccgcgccgctcgtgacgggcatacatctgaacgactcgacgcatgcgctctttgcccggagcgacagcgaggggcgcgcacagttcaagtcggagctcggcgaactggtgaaccatctgtacaactgtccgtgtatctgcatgtgggtcatcttcaacgagggctggggtcagttcgacgcaagaaaaatgtacgactttgtccgctctatggacaagacccgcgttatcgaccacgcctccggctggcacgatcagggcatcggcaatgtgcagagcctgcacgtgtacttcaagaagtatcgcttcaagcccgataagaaaggccgcgcggtgctgctcagcgagttcggcgggtacagccatcaggtgccggggcactgctacaataataaatacttcggatataagaagttcgagatgccgttccagcttgaggcggcgcttgaggacctttatcagacggagatcggcccggcaaagctgcgggggctttcggcggcagtgtatacgcagctgagcgacgttgaggatgaactcaacggcctgctgacatatgacagaaaggtcgtaaagatcgcgcctgaaccgatgcgcaagataataaatgttggtaaataa

SEQ ID NO: 645 - DNA, 2217 bp, Unknown
  Description of Unknown: Firmicutes sequence
atgaagaggatcgctttttttcaggacaatctggacgtcggcggtattcagaaatcaataatgaacctcctgaggaacttcgactatgagggctatcaggtcgatctatacctttccgacagaaagagcttctggcacgtcgattttccggagcagctcaccattaagtacctcccgcatataccgcggatatattccttcatgccctttgacacggcgaagaagctcgtgcatctggatttctccgactgcggggagtatgacctcgcgatagacttcaactcctatcagttttcctgtgcgctcggcgcactcaccgtaccggcaaagcgccgcgtcatgtggatccacaacaacgtcagcgtgaagctccagaacgagtggaagtaccgcgtgctctggtcgaacttcaaggataagttcaagtattatgatgaatttgtcggcgtctcggagggcgtcatcaggccgttcaaggagtgcagcggtgtatacgacaagccattcaacgttatccagaacgttatcgacacaaacgagatataccagaaagcggaggaagagaccgattttgaggtcgacagcaacaagatgaacttcgttgccatcgggcggctgtgccaccagaagggctatgacatcatgctcaatgacttctgtgaagcgtcgaagtaccgtgacgatctgcacctgtatatcatcggcgacggcgacaagcggctgtcgcttgaatatatgcgcgacagtctcggccttaccgataaggtgacgtttttagggcagcgcgcaaatccctttgtgtacatggacaagatggacgctttcgtctccacctcccgctacgaggggcagccgctgaacatcatggaggcgcgcgcggtaggtctcccgctctactgtacgaagaaccttgagatatacagtaaaggtcttgagggacgcgaggatattgtcgacgcgatagtccacgcccagaaagagccgaagcaccgggacgacctgcatgaatacaataccgagatcataaacggcataaaggctctggcggagcacacggacgcacccgaaccggagacacagaaaaagcgcgtgagcatcattgcgctgcacctcggcatgggcggcgtggagaaagcaatcatcagcatggccaatctctttgccgagcgctatgatgtgtatctatacagtgtgtataaaatgcccggctcgccgtccgttccgcttgacgatagggtgcgcttgcaatacctgctgcatgacacgccgaaccgcgaggagtggaaagccgcggcgaggaaatttgccgtcgtgcagtttataaaagagagctttcgcagtgtcaggatactcatcgggaagaagcttgcggtcataagaacggtcaaggccgtcagggatggtgtgctcatctgcacccggcatgaggataacctgaagctttcaaaatacggcaatgcgggcgttataaagattgcccagctgcaccatgaccatgacttcaagcgcaaatatgtgcgcggcttcagatacggctataggaatatagattaccttgcgatgctcaccccgaagctcaccgaagaagcgcaggagctgatgcgcggctataacgggcataccgaggtcgtgtatatcccgaacttccttacccgtttcccggaaaatgtcagcgctgcggtcagagagaagacggtgcttgccgcgggcagacttactgaggtcaaacgctttgacctgcttattgagcagttcgcgcatatccatgagcgtgaaccggaatggaagctgcgcatactcggcgaaggcgaagacagggcaaagcttgaagagcagataacaaagctcggagcgggagattacatcatgctcaccggcagaaagaacggggacgaggtagagcgcgaaatgctctcagcgtcgatatttgccatgagctcgcgctccgagggcttcccgttcgtgctcatggaggcgcagagctgcggcctgcccataattgcatacgatgtccgcgtcggccctggagcggtcgtacacgacggcgaggacggtgtgcttgtaccggagggtgagcggcggcagtatgaggataagctctgcgagcttatggatagcccggagctgagagaaaaaatgtcggcaaacgcgacggcggcgatcagagagttctcagaggagaaggtcgcggaaaagtggtatgaggtgatagaatga

SEQ ID NO: 646 - DNA, 1164 bp, Unknown
  Description of Unknown: Firmicutes sequence
gtgacaggtatcacaaagacaaagaaatatataaaacagttctttcagagggcggatatatttctgcttataatgtgcatcatatgctcgatatacgggatatactcgatcgatatcgcggtcacgggtatgtcggagggcggctgggacatgtccgctccgtcaaagtacatcgcggtccagaccttttcgctgttcctcggtatcgccggttttgtgctctttacggtaattgacgcggatatcctcggccagcagtggaagatactgtgcgcgataaatgtgctgctgctcgttgcactcgtcatcttcgggcaggacgacggcaccggcaacaagagctggatacgtttcgccggtatcggcatacagccctcggaggtcatcaaggtcctgtacatagtcgtcgccgcaaagcagatgacttatcttaaagagtaccgggatatcaattcgttcctgtcggtggtgcagatggcggcgcatttcggcatcgtgttcttgatgatcgtcggcgtttcctctgaccttggaagcgcgggcattctgctcggcgtctttctcgtaatgttctatgcgctgggcgtgaagctttactggttcgcgataggcggggcacttgttgcctcggcgataccgctgctgtggaactacttcctgaaggactatcagaagcagagacttgtcgccccctacgatgcaagcgtcgaccccgatggctggggcatcagatggcagaccacgcagagcaagatgagccttgcatccggacgtctcaccggagttgacgatgagcacagcaccacggtctttaccggcaagcataccgacttcatcttctcctgtatcggcgagcatttcggcatgatcggctgccttatcgtcgtcgcgctgctgctgataatcataatccatatcctcaggatcggcctgcattcgagccgcacctatgatatgctgatctgcttcggcgttgccggggcaatgctgttccagatgttcataaacatcggtatgtgcatcggtattacgccggtcataggcataacgctgccgttcttcagctacggaggctcgtcgatggtgacgatgttctgcgcgatggggcttgtttcgggggtcaaatacaagcccaaaccagagcatttcgcgctcgtgttctga

SEQ ID NO: 647 - DNA, 1257 bp, Unknown
  Description of Unknown: Firmicutes sequence
atgtcgacgagaagcaggatgaagaaaatttataacagcaaggcgttctggatgatcgtgtcgctgctggcgtcccttgcaatatgggtgtatgtaaccagtgtcgagacggacgagtccaagaccacgtttaggggcgtcaaggtcgagcttgtgggcgaggatatccttagggattcaaagaaccttgtcgtgaccgatatggacacgagcaccgtgacggtcgaggtcgtaggaccgcggcgcattatcggctcgctcagctcggatcagctcgtcgcgcaggtcgacgtcagcaagctctcacgcgcggcgtacacctcgcagcagtacacgatagtttaccccgacggcacggatacgagcaagctttccgagagccgccggacgccagagacgataaacttcatggtctcggcgcagacctcgaagtccattcaggtgcgcggcagctttgacggctctcttgccgaaggctacacggctgagatgccggtgttcgagccgtcgacgatcacgataacaggctccgaggcgtatctgaaagacgtcgaatacgcatgggtgactttcggcaaggagaatgtcgacagcacctattctgtggagacaggcttcacgctgatggatgcgaacaacgagccgtgctccacgaccggcatcagcttttcgacggacgtcgtcactgcgacgctcccgctgctgacgctcaaggaagtgaacctcgatgtgaacatcatcgagggtgcgggcgcgacaaaggcgaatacgaagatcaccattgatcccgtgtccgtgacgcttgcgggagactcgtcactgctcgcgggcatgaacaagatcatccttgcgacgatagacctgacggacttcagctctacctttaccgagacctacacgataccgatagataacgagcttaagaacaccaccggcgtcacgaaggcgacggtcacggtcgagatagtcggccttgagacgaagactttcagggtcacgaacttctcctgcatcaatgccaccgagggctacgaggcggatataatcaccgagagcaaggagataacgctgcgcggcacgcccgaggcgctggcgcagataaaagctgagaacatccgcgcggtcgcagaccttacggattacaaggagtccacaggcacctatatgccgcaggtcagggtatatgttgacggatttacggacgtcggcgcgataggcgaaaacacgatatcgatagagatcaggaaggtaagctga

SEQ ID NO: 648 - DNA, 522 bp, Unknown
  Description of Unknown: Firmicutes sequence
gtgaaggtattcgacaaaataaaattcatagtcgacaagatactcgaagtgctcggcacggcgactcttggcattatgacagttctggtctgctaccaggtcatcgcaagatacgtattcaacgcccccagcgcaatttccgaagctctctcccagtacctgttcgtttggatgattatgtttggcagcgcttatgtctacggcagccgtgagcacctcgccattgatatattgaaagacagattctccccgaaaatgtacatgatcgtcgaggtcatcaccaacattttcctgtttgtgttcattcttctcatctgcgtgtggggcggctggctctacaccgcaaagcaggctgtccaggtcgacccgtccctgcacgtttccaaggcgatcctgtacgcctccgttccctttaccggcgtcatcaccctgtactacgcggtctataactgcgcacgtgccatcaacaactacaatcatggcacccgtacccacggcgatgagctctccggtaccgcatga

SEQ ID NO: 649 - DNA, 1284 bp, Unknown
  Description of Unknown: Firmicutes sequence
atggatgatggcagtcgattgccttggataattgccgcgctgctgcttgtatgcgccgcattttttgctgttacggagacttcgatggcctccgcatcgcgcagccgcattaaggcgtctgccgaacgcggcgacttccgggcaaaaaagactctctatgtgctggataattttgatctggccatcagcaccctgcttatctgcaccaatatcgtacatatcgccgcagcctctatcgtcaccctcgcggtaacaaagaagtggggcgtgagcgccgtgtcgctcagtacgatcattaccacgatcgttgtgttctttgccggcgagatgctccccaagagcgtcgctaagaagtacagcgatactctcgcgctctcctgcacgccggtgctctgcttctttatgaagcttttcgccccgctctcgaagctcttgacatggataggtcaggcagccgcgaagctcacccccggcgacagccagatctccgtcacggaggatgagctgtacgatatcatcgaggacatgaccgaggagggcagccttgacgaggatcagggcgacctgatatcctccgcgctccagttcggcgacgtcaccgttgagagcgtgctgaccccgcgggtcgatatagtggccataaacataaacagcagccatgcagagctgctgagccttatcaaatccacgaaccacagccgcctgcccgtctacgagggcagcattgacaacatcatcggcgtgctccagatacgcaaatatatcaaggcctacctccgcctcggcgagaaccttgatataaagcccatgctcgacgaagttctattcgtccaccagagcacgaatatcgatgagctgctccccatcctttcaaagcgcaagctgaatatcgccgtcgtcaccgataactacggcgggacgctcggcatcgtgacggtcgaggatatccttgaggagctcgtcggcgagatctgggatgaggacgacgtcattgaagagccgatggtcgagatcggcgacggcgtatacgaggtcggcgcggatgagaccgtcagcgacgtgttcgatcagcttggctatgaggaccctgagaacgatgaggagcttgtgaacacgctcatgggcgaatgggcctacgaaaagtttgacactatccccaagcccggcaacagcttccgctatcatcaggtgcttgtcacggtgaaggatatgaaccacaaccgcataatgaagcttacagtcgccctgcttccggaagaagaggaaggcggtgaggcgcagtga

SEQ ID NO: 650 - DNA, 2166 bp, Unknown
  Description of Unknown: Firmicutes sequence
atggcatctttgccgatttttatttttgatcccgccggcgctgcgccccgggaagaaagacgaggtaagttcatgagcacagtcactgagattttcggctgcaatgtattcaacgattccgttatgagagagcgtcttcccaaggacgtgttcatgcaggtgcagcgctcgataaacgacggcaagcgccttgacagtgccgccgctacggtcgttgcaaacgcgatgaaggattgggccattgagaaaggcgcaacccacttcacccattggttccagcccatgaccggcatcaccgccgagaagcacgacagcttcatttcccctgtcggcggcggcaaggtcatcatggagttctccggcaaggagcttatccagggcgagcctgacgcctccagcttcccctccggcggcctgcgcgcgacctttgaggcccgcggctacaccgcatgggacccgacctcctacgcatttataaaagacggcgtgctctgcatcccgaccgctttctgctcctacggcggcgaagcgctcgataagaaaaccccgctgctgcgctcgatggaagccatcaacaagcagggtatgcgagtcctcaagctcttcggcaacaccgacgccacctccgtcagaacgaccgttggtcccgagcaggagtatttcctcattgataagtcaatccttgataagcgcaaggatctgctctataccggacgcacgctcttcggcgcaaagccgcccaagggtcaggagctggaggatcattacttcggagctatcaagtcccgcgtgtcctcctttatgaaggagctcaatgacgagctgtggaagctcggcgtactcgcaaagaccgagcataacgaggtcgctcccgcacagcacgagcttgcacctatcttcaccacgactaacatcgccgccgaccacaaccagcttaccatggagctcatgcagaagatagcgaagaagcacgacatggtctgccttctgcacgaaaagccctttgccggcgtcaacggcagcggcaagcacaacaactggtccatgtgcaccaacaccggcgtgaaccttctcgagccgggcgacactccctatgagaacgctcagttcctgctgatgctctgcgcggtcattcaggccgttgatgattatcaggatatgctccgcatctccgtcgcttccgccggcaacgaccaccgtctcggcgcgaacgaagcgcctcccgctatcgtctccatgttcgtcggcgatgagctcggcgcgatcctcgatgcgatagagaccgacaccccctacggcagcaaggagaaagagcttatcaaggtcggcgtccacgtcctgccgaagttccccaaggacaccaccgaccgcaacaggacttcgccctttgctttcaccggcaacaagttcgagttccgtatgcccggttcctccgcatccatttccggcgtgaacgtcgttctgaacaccgcagtcgccgagtccctgcgtcagtacgccgatatcctcgaaacggccgacgactttgaagccgctctgcacgaccttatcaaggacgttatacataagcataagcgcatcatcttcaacggcaacggctacgatgagagctgggtcaaggaagccgagaagcgcggcctgctgaacctgcgctccacgcccgactgcgtgccctattatctcagcgagaagaacgtcgagctcttcacccgccacaaggtctacaccgagaccgagctgcacgcgcgctatgagatcaagctcgataactacagcaaggtgctgcacattgaagcgcagacgatgcttgacatggtctggaaggatatcctccccgctgccagcgcctacaccaaggagcttgccgagactgttgctgcgaagaaagccatcggaggcggtatcgacacgagctatgaagagaggctcgcaggtcacgtgagcgtcctgctcgcctccgccacgaagaaagccgaagctctcgaatacgctctcatgggcgtcaaggacatcaccgataccctcgcgcttgcccgctattacagagacacgatatttgccgcaatgaacgagctgcgcatcatcgtcgatgagatggagacccactgcgccgcgaagtactggccgtacccctcctacggcgatatcctcttcagcgtaaaataa

SEQ ID NO: 651 - DNA, 1113 bp, Unknown
  Description of Unknown: Firmicutes bacterium sequence
atgaaaatgggtaaacagatctaccgcgtcgtgctcaccggaggccccgcctcgggcaagacgacgcttataagccgcatcctcaaggaattcaagcaggatgacggctggcgcgttataaccattcccgaaacggcgaccgagcttatatcgggcttcggaataaacccattcggtgtttgcatgtcgatgctgaagtttcaggactttgtcattgccgaccagatccacaaggaaaagcttgccctccaagcggcagaagtcgtgccggaggaaaaggtgctcatcgtttacgaccgcgcgcttttggacgacaaggcatacatcaccgacgaggagtttgccgaaacgctttatcgcgtcggcggcaagaccgaggccgaggtgctcgcaggctacgacgcggtgctgtatctcgtcacctgtgccaagggcgcggagtttgcgtacaacctcggcaacaccgcgcgcagcgagtcgatagagtacgcgcgcgagatcgacgatcgaacgctgaatgcctggagcgcgtatcagaacctgcgcattattgataattcggtcaatttcgaggataagatcaaccgtgcgatacgcgagatctatcgcgtcatcggcgaacccgagcctatggtcaaaaagcgcaagtacctcattgccatgccggatatcgagctgctgaagtcgcgctaccgcgccgtcggcatcgacatggtgcagacatacctcgcaatgacgaacccggccatagaacgccgcgtccggcggcagaaaaacggcgaagaggagctgtatttctacaccgagaagcattttcgccccgacggcacgaagtgggacaccgaaaggccgatcaccgaaaaggaatacggccgctatatgctcgaggctgacccaacgctcagcagcgtgagcaaggtgaagtaccgctttgtgtatgacagctgccggtttgagatcgacgtttacccgttctcggccgagcgcgcagtgctgttttgttattccgaaaagccggagtgcagcgctccgccggagcttgagatcatcagcgacgtgaccggcaaagccgaatataagaataagcagcttgcaaaatcacaaactctgtga

SEQ ID NO: 652 - DNA, 1629 bp, Unknown
  Description of Unknown: Firmicutes bacterium sequence
atgattggaggccttttggtggcaaaagcaaaacagcagaattatctgcacggcgcagctataatgaccgccggcgttataataatgaagatcctcggcgcattgtataagatccccctgggcaatatgctcggcgacgacggatacggtctgttccttcaggcttattatgtttacagtctgtttctgacgcttgcgacggcgggctttccggtggcgctttcgcgcatgataagcgcggcgcagactcgcggactgcagatgcaggcacgccgtacatatcgtgtggcatggtggacgttctttgtcctcggcgcggtctgctcgacggtaatgttcgtgttccccgactggcttgcaaacactcttataaacagtcccgatgccgctttcagcatccaggctctcgcaccggcggtgctcctgtgctgcatcaccgcaacctacagaggactgactcagggctacggcaacatgaccccgaccactatcagccagatactcgaggtcctggccaaggtcgcggcaggacttgctctcgcggcatacctgataaaggcaggctatgataagcccgttgcggtcgcaggcgccatattcggcgttacagtcggctcgcttgccgcactgctgtacatgctcatatacaaaatgcgcaactaccgctttgacactgtttcgcagcccgatgttccggaaagtgcaggaacgatatttaaaaatcttttgagcataggtatccctattgcgctcggctcagttgcgctgtcgcttattaaccttattgacgcagggctgtgcatgacaaggcttcagagcgctgtcggatacacttactcgcacgcaaaaacgctctacggcgtctacggaaaagctcagacgctgttcaatcttcctgcggcattcattactccgctgacggtgtccatcgttcctgcgatctccgcaaagcttgtaatggacgcaaggggagaggcaggcaaaatatccgaagattcactgcgcatagcgatggctattgcactgcctatgggcgtcggacttgcagttttgtgtgagcccattatgaacgttatctacccaaatgcccatgagtccggcccgctgcttctgtgcctgctgggtgttgcctcggttttcgtttgcttttcgcttatgagcacggctgttctccaggcaacgggcaaggagcgtctcacgctttattccatcgttgccggtgggcttgtgaagatcacaataaactggtttatagtcgcgatcccgtcaataaatatctacggcgccgcgatcggaacgatctgctgctacgtaacaatgtgcgttttgaatcttatattcattaaccgcagctttgaaaagggactgtcaatgaagaatattttcgtccgtcctgccgtgcccagcgctatcatgggtgtcatagcgcttgcggtatattacggcgtaatgaatctgctgctttcgtccgacagcagactcatgatggcgcttgttatgtgcattgccatcggtgttgccgtaatagtttacgcggtgtcggtcataaagcttcgcgtaataaccaccgaagatatgaagctcattcccaagggggagaagatagcaaagcttctgcatatggcctga

SEQ ID NO: 653 - DNA, 1197 bp, Unknown
  Description of Unknown: Firmicutes bacterium sequence
atgaaagacttgaagcacctcatctactttgaggacctgctgaccgaggcgaacaacgcgcttgtcaagcaggccacggcggatgggaaaaaggcgctgggctacacctgctattttgtccccgaggtactgctcaacctcggcggctgcttctcggtgcgcctgcgtgcccccggcacgagcaacaccgacatcggtacatactacatgaccaacaagacctgcccgttcacgcgcagcatccttgagcgcagcatggagggcggctataacttcctgtcggccatgctctcgtccgaaacctgccagatgatgcacagggcgcatgagtatttcgacatcatgggtcttgtcaaggagcagaaccccgactttttcctgagcatgatggacgtgcccttcgtcactacgaaggccgcctacgagcactatgaaaatcagctgcgcaagcacatactcgagccgctcgagaaggtctgcggcgttgatatttccgacaaggctatccgcgcggcgatcgaggagcacaacgatatatgcggcatcataagcgagcttggcgagctgcgcaagctgccaaatcccccgataacgagctacgagttccacgttttgcagctggtgagcgagtgctgcccgcagtatctgataaaggataagctgctcgaaacgctcaaggaggtcagaaagcgcaaggtcgatcccaagcccaattaccgcgcgcgcttagtcgtgaccggctccgaggtcgatgacccggtgttcacaaagctgctggaggattgcggcgtgtatgtcgttgccgaccgctactgctacggctcgctgcccggcagggagcagatcgagatccgcgagggcgaaagcgcgcttacggccgttgcgcggcactatctgagcacgagcgagtgcccccgattcatgaacaaggaaaagcaggtgcagcgccgcagctatctcaagcagcttgtaaacgactacgacgccgacggcatcctgtatctccagatgaagttctgcgaatattggagctacgagcgcgtcatgggcgtgcacgacatgaacgaggtcgagggcataccctgcatcggcgtcgagaaggaatacacgatggcttcggccggccagctccgcacaaggttccaggcctttgtcgaaagcatcgagataaagaagctccagggaggtaaaatgtga

SEQ ID NO: 654 - DNA, 1926 bp, Unknown
  Description of Unknown: Firmicutes bacterium sequence
atgtcacttgtaatcctcgccgcggtttgttatactgtaaaacagtatattttacgaatatttagtcaaatacgaggttttgttttgaatatcctgaataaagtcaattcctctaacgatataaaacgcctcaataaaaacgagcttcctcagctttgcgccgagcttcgcgagtttattattgaaaacgtttccaaaacaggaggacatcttgcatccaatctcggcactgtcgagcttaccgttgcgctgcacagagtttatgacagcgcggtggacagaatcgtgttcgatgtcggccatcagagctatgctcacaaaataataacaggccgccgcgatgcattcggcactctgcgctgctacggcggcttatccgggtttcccaagccctacgaagccgatgacgacgctttcatcgccggccacgcttcaaactcggtgtcggtcgctctcggcatggctcgcgcgagaaccataaagggtgaaaactacagcgtttgcgccgttataggtgatggcgcgctgaccggcggccttgcctatgagggccttgccaatgtcggcggaagcagcgagccgatcgtaataattcttaacgataacggcatgagcatcaacggcaacgtcggtggtatggcaaagctgctgtcaaaagaacgcgtaaagcccgggtatatcaacttcaagcggtggtacaggcaggctgtcagcggaatggacggcatttataacgcaagccacaagctcaaagaagcacttaaaaagtcgatattgccgtcaaatatgttcgactctatgggcatatattacctcggccccgttgacggacatgatgttgaccagcttgaaacggtcatccgctgggccaaggaaatgaacacgcccgtgcttgtgcatgttataagcaaaaagggaaagggctgctcatacgccgaggagcaccctgataagtaccacggagtcggtagatttgatcccgttaccggtaaaatgcctgaagcaaagccgtgcttttcgtctgttttcggcaataagcttacgcagcttgccgagacaaaccataatattgtagccataaccgccgcaatgtgcgccggaacaggtcttaccgggttttccgagcgatttccggatagatttttcgatgtcggcatagccgaggagcatgcagtttcaatggctgccggcatggcgaagcaggggcttttgcctgtcgtcgcaatatactcgggatttctccagcgcgcatatgatatgctcatccacgatgtttcgcttcaggatctgcatgtcgttttctgcgttgacagagcaggccttgtcggaaacgacggcgaaactcaccacggcgcttttgatatcagctatctgcgctcggttccgcacatgcaggtgctgtgtccggcaaactttgccgagcttgaagctatgcttgacgaggccgtaaaccgtatgtccggccctgtcgcgatcagatatccgcgcggcggcgaaggccgatacaccgattgccatacagaaggctgcactcatctccgcagcggaaacgacataactatcgccgcatacggcacagatataaacattgcactcaatacggcgtacatactcgccgataagggcatccatgccgatgtctataagctttcgcgccttgacagcggctattatgccgatattattgactctatgcgggaaactgggcgctttcttatgagtgagcaggtttgccaaaccggatgcattgccgatgagatcctcgcctatgccgagcgcgcaggtgttaagatagaatgcgcatatactccgaatctgggcagcggcattgtcgttcagggtacagtgcccgaactgataagacactgcggacttgatgaaaacagtcttgccaaagcagccgaaaagctggtcaggggtgaataa

SEQ ID NO: 655 - DNA, 837 bp, Unknown
  Description of Unknown: Firmicutes bacterium sequence
gtgaagaatttcaacaaggtctttactgtcatcgtgctgctgttcctgtacatcccgatgatagttcttgcagtaggctcgtttaacagcggcatggatattgccgttttcaagagcttcacctttgataactacaaggagcttttccgcgacagcgttcttttgccgctgctgttaaactccgttatcgttgcgcttttgtcctcgatattcgcaaccatcctcggcacctgcgcagccctcggcattcactcgatggggccgcgtcttcgccgcttcacgatgggcgttacgaatattccgctgactaaccccgagatcgtcaccggcgtatcgcttgcgctgctgtttgccttcgtcggaacgatgatgaagataaacaacatcctcggctttgcaacgctgcttattgcgcacataaccttcaatctgccgtatgtaatactctctgtaatgccgaagctcaagcagatggatccgaacctgcgcgaggcggcgctcgacctcggctgcacgccgtggcaggcgttttacaaggtcgttatccacgagataacgccgggcatcgtttccggcgctctcatggccttcaccatgagccttgacgattttgtcatcagctattttgtttacggtccgcgatttgtcacgctgccggtggagatatataactacaccaaaaagccgctccagccgaagatatatgcgctgtttacgctgctgtttgccgcgatactcatagtcatggtgctcatgaatctcctgcaggagcgcgacgcaaagcgctcgcgcgaaaatcgccgtgcgttccgccgcggaaagaaggtgggcgcatga

SEQ ID NO: 656 - DNA, 1431 bp, Unknown
  Description of Unknown: Firmicutes bacterium sequence
atgataataaattatatacccatacagtcgtttttacaagttgcgcatattgataaaatatgcgataataagggcattaaattcgggaggtctgtcatgggctttttaagtgaatacaacgcaaagctcacaagcgccgaaacggctgtcaagtgcgtcaagagcggcgactgggtcgaatatacgtcaaacctcggctttcctgccgcctgcgatcttgcattatcgaagagacgcgacgagcttaagggtgtgaaaatacgtggggatcttatcttcgggccaattcaggtcattgagtgcgaccccgaaatggagcattttgtttataacacctggcactgctcgggctacgagcgtaaaatgtgcgacaaaggcagagctttttttgaaccgatggtgttcaggaatctcgcctggtattacaaaaattttctcacctccgacgtctgcatggtcacggtctccgggatggatgacgatgggtatttctacttcggtccctcgctcggcatgtcaaaatgcatagcggataattccaagatcgtcattgtagaagtcaaccgcaacataccgcgcataaaaggcagcgaggaaacgaggatacacatatccgaggttgactacattgttgagaccggcgatcctccgctgtttgagatgccgaatcccgcgccgacggaaacggacgttaagatcgcaaacctgctgcttccgtacattaaggacggagcgtgcgtgcagcttggcatcggcggtatgccgaacgccctcggcgagcttatcgccgacagcgatctcaaggatcttggcatgcacacagagctgtgctcggatgggtatcttgccatgttcaaatccggaaagctcacgaatgcaaagaaaacgctgcatccgggcaagggcgtactcggccttgcgatcggaagccacgaatttaatgagtggctcaacgataatccgggctatgtcggctatcccctttcgtatgtaaacgatccctatgtcatatcgcagaacgacaacatggtgtcgataaacgcctgcatcggagccgatctctacggacagataagctcggaaagctccggcacgaggcagataagcggaacgggcggccagctcgactttgtgtgcggcgcgcagatggcgtgcggcggcaaggcgtttatatgcatgagcagcacccacaccgacaaaaacggcgttatgcacagccgtatagttccgacattttcgggcgatataatcaccactccgcgctctcttgcgttttacgttgcaacggaatacggcgtcgttaatctcgcagggctgaccacatgggagcgcgctgacgcaatgataagcattgctcaccccgatttccgcgatgagcttataaaggcggccgaggctaaccgcatctggctgccgtcaaacaagaggtaa

SEQ ID NO: 657 - DNA, 1284 bp, Unknown
  Description of Unknown: Firmicutes bacterium sequence
atgaagcttacacccgaacagcaggcgatgctaaacggtgaaaagggggagactatggcgaaggtcgttaagacccttgtcatgtacggcgacacgttcggagccgagcggatggtaccgatcagctcgaaatacggtcacacggtcatcagcttcggcctgaaggtaatgaagcccgtgtacgatctgtatcaggagatcatcgacgccggacttgtttccggccagaaattcacggccgacccgaagccgctggacaagcacgtccccagcagcctgatagaagaccttgtgttcaaaaaattcatgtacacatatcaggacagctacgagcagcagctgcgtgagcttggcataacaagcgacgatgattatacctgcacctgctatctcgaccaggtcggcaacaagcccggcaagggcgaggtgctctcgtgggcggagtcgtctgccgtcgtgtacgcaaactccgtgctcggagcacgctgcaaccgcaactccggcatgatagagcttatgggctcgatagccggctttgttcccgagttcggtctgctgctggacgaaaaccgcaaggcgacgtggatagttgagctaaagtgctcgaaaaagccggacgcgcagcttctcggctctgccatcggcatgaaggtcatggaagaagtgccgtatgtcaagggacttgacaagtggctgggaacgacgctcgacgaggaagcgtgcacatatctcaaggacttcggcgcggcgaccgcgtcaaacggcgctgtcggcctgtatcacatcgaaaatctcacgccggaggccgtcgagcagggcgagagcatcattgccgagggcgccaaaacctacgtcatcgacgatgccgagcttgagcgcgtcaaggcaaactacccggtgatctggaaaaatcccgacgcagagccgcagctgtgctttgtcggctgcccgcacatgacgctcaggcagcttatcgactggacaacggccgtcggcacggagcttaacaaaaacggccttaaaaaggtcaccgttcccacggtattcacggcttccacgcccgtcatcaaggaatttgagaaaacgccgtactataagcaactcaagcgtcagggcattatcctcagctatatctgcccgcttatgtacatgaacaatcctctgtgcaagaagaaggcggtcatcacctcgtcgaataagctgcgcacctacaccagcgcgagatattacaccgaggccgagatcctgcataccatcacaacgaagagggagggcaaaaaatga

SEQ ID NO: 658 - DNA, 786 bp, Unknown
  Description of Unknown: Firmicutes bacterium sequence
atgcgtatagtaactttcgccagcggctcttcaggcaattgcagcctcgtttctgagggcaaagcgaatatacttatagatgcggggatatccatgcgcaggaccgttgcggctcttgcgcagctcggacttgctccgcaggatctgtgcggagtgctcataacacatgagcactccgatcacatttccgggctttctatgctcattaagcatcatgacctgagtatatttgctccaaagcccctgtgcgaggagctttgccgggtaaaaccggagataaaaagcaatttaaactacatacccgaagatgataggctctccctcggcggcgttgaggtaagctgctttagaaccatgcacgatgccgcttacagcgtcggctatcgctttgaaggcgaggaaaccttaggctttgcaaccgataccggcagcataaacgatgagcttattgccgggcttgaaggcgcggatactgcgcttattgaggcaaatcatgatattgcaatgcttaaaaacggagtgtatccgtattttttgaagcgcagaatacttgcgcccacagggcatttgtcaaatgacgacagcggaattttggctgaacatcttgcaaaacacggaacaaagcatataatattagggcacttgagccgcgataacaatacgcctgagcttgcgtacggcactgtcagcaccgccgtttccgttaaaaacgtgcaaataagtgttgctacggcaaataatatgcttgcagtcgaggcgggagagaggttaaaatgcttagcataa

SEQ ID NO: 659 - DNA, 2124 bp, Unknown
  Description of Unknown: Firmicutes bacterium sequence
atgttataccccaatgcacgaaaggcggatctgctaatgaaaaatgtaattgaattgtttggctctatggtgtttaacgactgcgtcatgcaggcgcggctgccaaaacaggtatataagcaggtccaacgctcaataaagctcggcgagcggcttgacggcgaaacggccgagatagttgcaaacgcgatgaaggactgggcgatagaaaagggcgcaacgcactttacgcactggttccagccgatgaccggcatcaccgccgaaaagcacgacagctttatttcacccagtgataacggcagaataatcatggagttttccggcaaggagcttatccagggcgagccggatgcgtcaagcttcccgaccggcggactgcgcgcaacgtttgaagcgcgcggctacaccgcgtgggatccgacctcgtatgcgtttatcaaggataatgtcctttgcataccgacggcgttctgctcttacggcggcgaagcactggataagaaaacgccgcttttgcgctctatggaggcgctcaaccgccagggactgcgcgtgctgaagcttttcggcaacgatgatgtgaccgcggtcaagaccaccgtcggcccggagcaggagtattttctcatcgacaaaagcgtttatgaaaaacgcaaggatataatgtacaccggcagaacgctcttcggcgcgcagccgcccaagggtcaggaactggacgatcactattacggcacgataaagccgcgcgtcgccgcgttcatggaagagcttgacgaggagctgtggaagctcggcgttcttgcgaaaaccgagcataacgaggtcgcgcctgcccagcacgagcttgcgccgatctacacgacgaccaatatcgcggcagaccacaaccagataacaatggagcttatgcaaaagcttgcccgtaagtacgacatggtgtgcctgctgcacgaaaagccctttgccggcgttaacggctcgggcaagcacaataactggtctatgacgaccgacacggggttaaaccttctcgagccgggcgagactccgtatgaaaacgctcagtttctgctgatgttgtgtgcggtcttgcaggcggtagacgattatcaggatatgctgcgcatatccgttgcaagcgctgcaaacgaccaccgcctcggcgctgccgaagcgcccccggcgataatctcggtgttcctcggcgaggagcttgaggagatactcgaggcgatagaaaacgacacgccctacggcggtaaggaaaaggagcagataaaggtcggcgttcacgttctgccgaagtttgcgcgcgacacgaccgaccgcaaccgcacctcgccctttgccttcaccggcaataagtttgagttccgcatgctcggctcgtcaacgtccatatccggcgcaaacgtcgttctcaacaccgccgttgccgagtcgctgcgcaaatatgccgacattttggagaatgccgataattttgaaacgagtctgcacgagcttatccgcagcgttataaaaaagcataagcgcatcatattcaacggaaacggctacggcgaggagtggctcaaggaagcggctgcgcgcggacttaaaaacttccgcacgacggtggactgcgtgccgtattacctcgacataaagaacgtcgatcttttcgcgcgtcacagagtgtattccgagatagagcttgccgcgcgctataagatgaagcttgacaactattgcaaggtcattcgcatcgaggcgcagaccatgcaggagatggtctggcaggatattctcccggcggcaagcgcttactcaaagcagctgagcgatactgccatagttaaagcgcagctcggcatcgacaatagctttgaaaaggatcaggcagccaagataagcacccttatgagcgaaacggtcaaaaatgcgcaggcattggccgacgcggccgaatctgccgacgagtattcggataactacacaagagcatccgttttccgcgacaaggtgcttcctgcgcaggaggcgctcagagcaagtgttgacgagcttgaaatcaatacggcaaagcagttctggccgtatccgacctacggcgatatcctgttcagcgtgcagtaa

SEQ ID NO: 660 - DNA, 1287 bp, Unknown
  Description of Unknown: Firmicutes bacterium sequence
atgattttagttctttctgcgaggttttattatatggcaatatggcattgcagcggagaaaaatgccttgagggagcatgctttgtgcagggcgcgaagaatgcggtcctgccgatccttgcggcttcggtcgtatgtccaacagaaacagacctgctgaatgttccgcagctgagcgatgttgaaatgtcgctgagaatactgcgcagcctagggtgtacggctcagcagcaggaaaacgacgtttacatagactcgcgcgcattgagttcaaacgtcatacctcagagcatgatggagagcatgcgatcttcggtacttttcatgggcgcgcttttggcgcgctgcggcgaggtacatcttacgctgcccggcggatgcagactcggcgcaaggccgatagatatgcaccttgatgcaatgaaagctctcggcgcaagcgttgaggaatccggatgcgagatagtatgcagagccgaaaagcttacaggcgcgcacataaggcttccgtatccgagcgtcggcgcaacggagaacgcaatgatagccgcatgcggcgcggaaggggagactgtcataacgggcgcggcaaaggagccggagatcgaggatcttcaggagtacctgcgcaaagccggcgcgtatatatccggagccggaacgagcacggtgaagatctcgggctttgagcgcgaaagccatgtcggccaccgcatcattccggataggatcgtatcggcaacgtttttgtgcgccgctgccgcagccggcggcgatatcgagctgcgcggagttgatttaaggcaattttcgcgccttgagcacttcctaaagcgagccggctgtgatataatatcgtcgcgcaggagcgtaaggttaatatccgacggtaagctgaacgctgtcggacgcgtttcgaccgggccgtatcccgaatttcctacggatatgcagccgctgcttatggcggcgcttctcaaagccgtagggcgaaccgattttatcgaaaacgtttttgactcgcgctttggacacgcaaagcagcttagccgcttcggtgctgatatctccgttgaggggaggcaggcgtctgtgtggggtgtgcgcgatctcaggggtgctgttgtcagcgcaggcgatctgcgcggcggcgcagcaatgataattgccgctctttctgccgagggtgaaagccttatcgtagatcctgggcatattgcccgaggctatgagcatcttgatcataagctccgctctctcggagcagatatatttttggagttgtaa

SEQ ID NO: 661 - DNA, 585 bp, Unknown
  Description of Unknown: Firmicutes bacterium sequence
aaaatgagcttagtaccctatgtagtagagcagacaagccgcggcgagcgctcgtatgatattttttcaagacttctcaacgaccgcataatcatgctgtccgaggaggttaacgatacgaccgcaagtctgatcgtagcacagcttctgtaccttgaagcgcaggatcccgataaggatattcagttttatatcaacagccccggcggcagtgtgacctccggcatggctatatacgataccatgcagtatataaagccggacgtatccaccatttgcatcggtatggctgcgtcaatgggtgcattcctgctctcgagcggtgcaaagggcaagcgccttgcgcttcccaatgccgaaatcatgatccaccagccgtccggcggcagcaagggtcagtgtaccgatattcagatacaggccgagcagatcctgaaaatcaagagaaatctgaacaggatcctcgctgaaaacaccggtaaggatatcgccgttgttgaagcagactgcgagcgcgatcacttcatgtctgcacaggaagccctggaatacggccttatcgataaggtgataaccaagcgataa

SEQ ID NO: 662 - DNA, 1479 bp, Unknown
  Description of Unknown: Firmicutes bacterium sequence
atgaaaaagcagttcagaagcattctaaatgaaaaaggccgcaaggagctacccaatattctgcttgcagcggccgagtgcgcaccgctttcaaaaacaggcggacttgccgacgttgtcggaacgctgccgaaggcgctcaaaaagctcggctttgacgcaagggtcatcactccgtatcaccgctgcataaaggataagtacgcatctcaggtcgagcacatgtttgatttttatgtaaacctcggatggcgcacgcagtactgcggcatagagcgccttgagcttgacggcgtgtgcatctatcttgttgacagcgagttttacttcggcgacaagatctatcgcggcggtcaggccgagggcgagcagtacgctttcttcacacgcgccgtgctcgacgcgataccgaacctcggatttaagccggacatcgtccactgcaacgactggcacacggcaatgctgcccatgctcgcaaagactcagtacggcggcgcgatgcagtcgtctctgcgttggcttttgacgatacacaacattgcatatcaaggaaaattcggctttgactacgttcaggatcttctcggagttgaggataaatactacacctccgagttcatggagctaaacggctgcgccgatttcctcaaggcaggctgcgttttcgcagaccgcataaacaccgtcagtccgacctacgcaaacgagataaaaaccgcctacttcggcgaggggcttgagggcattctcgacgcaaggtcgcacgagctgtccggcataataaacggcatcgacaccaaggtgtttaacccctacaccgatcctgcgctcccgacgcggtacaacaagggcagactgaacggcaaaaaattatgtaaacttgcgctccagcgtgatttcggtcttgagcagcgcgaggatgttcccgttttcgcaatggtcacgcgcatgaccgagcaaaagggctttgaccttgtagaacgtatgctcgacgagctgatgcagtataacgacatgcagtttttcatgctcggcagcggcgacaaggaatacgaaagcttcatgcgcgaagctgaggcacgctacaagggcagactgtgcgcatacataggctataacgaagagttatcgcaccgcgtttacgccggagccgattttctgctcatgccctcgcgctttgagccgtgcggcctttcgcagatgatcgcaatgcgctacggcactctgcctatcgtgcgcgagaccggcggccttaaagactccgtgaagccgtacaacaaatacaccggcgagggcaccggcttctctttcgccgattttaacgcgcatgagatgaaggacgcaatgcttttagcgctcgattgctataaaaatccggtggtcatgtcctcgctcgtgcgtcaggcaatggaggccgatttcagctttgaccgctcctccgaggaatacgcaatgctttatctatggatgctctga

SEQ ID NO: 663 - DNA, 1227 bp, Unknown
  Description of Unknown: Firmicutes bacterium sequence
atggatatcaaaaaactcgaaagctacgccgagcttatcgtcagagtcggcgcgaatgtccaaaagggacaggatgttgtcatttcggccgagcttgatcagccggaatttgtcgaaatgctcgttgagcagtgctatcttgcaggcgctgccgaggtaagagtcgagtggacgcatcagccgctcaggctcaagcatgtaaaataccagaccgtcgagcgcctcggcgagataaaagattgggaaaagcagaagcttctgaacagagccgaaacgctgccggccatgatctatatagagtctgccgacccctcgggtcttgacgggctggatcaggaaaagtggggcaagagcgtccagatgcgctggaaggtcataaagcccatccgtgactcgatggagaacaaataccagtgggtcattgcggcggcgccgggcaaggcgtgggcaaaaaaggtgttccccgagcttggcgaggccgaggcagtcgaaaagctttgggaggcgatactgtacacctcgcgcgccgagggcgacggagtgaaggcatggcaggagcacaatgccgatctcaagagccgctgcgagtatctcaactcgctcggcctgcgcaagctgcactataaaagcgcaaacggaacggatttcaccgtcggactcattccgcaggcgcagtttctcgccggagcggaggatacgctcgggacaaacgtgcgctttaatcccaacatccccagcgaagaggttttcacaagccccatgaagggacaggccgagggcatagtgtattcgacccgaccgctgtcctaccgcggcacgatgatcgaaaacttcagcatccgctttgaaaacggcaaggtgacagaggtcaaggcccaaaagggcgaggatgcgctcaagacgctcgtgaacatggacgaaggctcgaaaatgctcggcgagtgcgcgctcgtgccgtttgacagtccgataagaaacagcggcataatgttttataataccctttttgacgaaaacgccgcatgccacctcgcgctcggcgacggatttgctaactgcataaaggactttgaaaactacacgctcgagcagtgccgcgaaatgggcataaattcgtccatgatccatgaggatttcatgataggttccgaggatctcaatatcacgggcgagaccgaaagcggcgagagagtgcagatattcaaaaacggaaactgggcgttctga

SEQ ID NO: 664 - DNA, 1278 bp, Unknown
  Description of Unknown: Firmicutes bacterium sequence
atgaagcataaaagatatgaaaagatcggcgaggatctgtacttcggccagctgcgcaacggtcttaacgtaaacgttgtagcaaagcccggcttccggctgtcgtatgccgtttttgccaccaattacggcggcgcgcacaggcgcttctccctcggcggaaagatgcacgacacgcctgccggagttgcgcactttcttgagcacaagatgtttgacatgcccgacggcgacaatgcgctgagcgtgctttccgcaaacggcgcgcagccgaacgccttcacctcaagcggcatgaccgcgtactttttcgactgcacctcgggctttgaggaaaatctgcgcatgctgctcaagttcgtttcgacgccctactttactcaggagaccgtcgataaggagcagggcataatcgggcaggagatatgcatggtcgaggataatctcggctatgtcgtgtataaccgcctcatgcgcatgctgtatgagtttaaccccatccgcgatcaggtcgccggcagcatcgagagcattgcggagataaccgccgaaacgctctataactgccacaaggcgttttacgcgccgtcaaacatgacgctgtgcgttgcaggcgactgcgatcccgaggaagtcttcgccatcgcagacgagcttctgccgcgcgaaaaggccgagatcccaaaggccgacatgggtcaggccgagtccgaaaagcccataaaaagctacaacgaggagcagatggaggtctccgcgccccagtatcttatcggcgcaaaggtcactcctgcgcgcgacggagacgcgcttctgcgccagaagatagtcgcccagcttgctctgcgcacggtgttcggcacctctgcgaagttttacaaccggctgtactccgagggcgtgctcaaccgcgactatgattacgagatcgactacaccgccggaacggcaacgatcatgctcggcggcgaaagccccgatccgcagcgcgtcctgagcgagataaatgccgagcttgccgaggtgttcgcaaacgggcttgacaaagagctgttcgaagcggcaaagcgcgcctccttcggctcgcgcctgcgcggacttgaggacttcgacagcttgtgtctctcccttgccgacggtgtgttcggcaattactgcgcgctcgatgcgtttgaagtgctcgggagcgtttcaaaaaacgagtgcgaggatttcctcaaggcattcatgactcccgacaggctcgcaatgagcgtcatttcccctgtaaaggcgtga

SEQ ID NO: 665 - DNA, 2382 bp, Unknown
  Description of Unknown: Firmicutes bacterium sequence
atgtacaagatcattaagagagacggaaaaatcgtagattttgacatcaccaagatcgcaaacgccattaaaaaggcgtttgaggccaccgacaccgagtacaccgatgatatcattgatttcatcgcgctcaaggtctcggctgacttcctgccgaagataaaagacggctatgttgcggtcgaggatattcaggacagcgtcgaggcggtcctgtcgcgcggcggctatgagggcgttgcaaaggcatatatactttatcgtaagcagcgcgagaagctgcgcaatatgaaaaacacctaccttgactataaagagaccgtcaacagctatgtaaacgttcttgactggcgcgtcaaggaaaactctaccgtcacctattcagtcggcggccttatcctttctaactccggagccatcaccgcaaactactggctcagcgagatttacgacgaggagatcggcaatgcccaccgcaactgcgacctgcacctgcacgatctgagcatgctcaccggctactgtgccggctggagcctcaagcagctgatccagcagggcctcggtattcctggcaagatcaattcctccccggcaagtcacctgagcactctgtgcaatcagatggtgaatttcctcggcatcatgcagaacgagtgggccggtgctcaggcgttttcgagcttcgatacctaccttgcgccgtttgtcaagatagaccacctcacctacaaagaggtcaagcagtgcatccagtcgttcatcttcggcgtaaacactccgtcgcgctggggcacacaggctccgttttcaaacatcacccttgactggacggttcccgccgacctcaaggacatgcctgccatagtcggcggcaaggagcaggacttcacctatggcgactgcgtcgaggaaatggcaatggtaaataaagcgtttatcgacatcatgatcgagggcgacgcaaacggccgcggcttccagtatccgatcccgacctactccatcacccgtgacttcgactggtctcccaccgagaacaataagctcctgtttgaaatgaccgcaaagtacggtactccgtacttctccaactacataaactccgatatggagccttcagacgtccgcagcatgtgctgccgcctgcgccttgacctgcgcgagcttcgtaagaagtccggcggctacttcggctccggcgagagcacgggttctatcggcgttgtcaccatcaatatgccgcgcattgcgtatcttgcgaccgacgaggccgacttcttcaagcgccttgataagatgatggacatagccgcgcgctctttgaaggtaaagcgcaatgttataacaaagctcctcaacgagggactttacccctacaccaagtattacctcggaaatttcgataaccacttctcgaccatcggccttgtcggcatgaacgaggccggactcaacgcaaactggatccgcgccgatatgaccaccgaaaagtgccaggagttcacaaagaaggtactcaaccacatgcgcgagcgcctgtcggattatcaggagcagtacggcgatctgtacaacctcgaagccactccggcagagagcacctcttaccgccttgcaaaacacgatgttgagcagtatcccgatatcatcaccgcctctcagggcgacactccgtattacacaaactccagccacctgcccgtaagctacaccgacgatatcttctcagccctcgatattcaggacgagctccagacgctttacacatccggcactgtattccacgcattcctcggcgagaagctgcccgattgggaagcagccgcaaaccttgtccgcaagatagccgagaattacaagctgccttactacaccataagcccgacctactccgtatgcaaaaatcacggctacctcaccggcgagcagtttacctgtcccgagtgcggtgagagcgccgaagtttacagccgtataaccggctactaccgccccgtgcagaactggaacgcaggcaaaactcaggagtataaggagcgcaaggagtataacatcggaacctccgtcctcaagcacaaaggccccctgcaccccgaggcaaagcccgagcaggagcctgccgttgaggaggagctctgcgaaaactccaccggcaagcgcaagatcctctttacacgcgaaaactgccccaactgccgcatagtgtacagctatctggacaaggcaggctttgactgcgagaagatcatggcagaagaaaatgttgaccttgcactgtcctatggcgtaaagcaggctccgacgcttgtcatcgttgacggcgagcatgtcgagaaatttgccggtgccggcgcgataaagaactatcttttcaagtaa

SEQ ID NO: 666 - DNA, 2313 bp, Unknown
  Description of Unknown: Firmicutes bacterium sequence
atgtactataataatatagctataatggatatctatgcggattttgttccgcaggaaagagagcagcaaatgggagtaataagcaggataaggcgtgaggcttttatccgcccgtggcttaaaaaaggctattcaagacgcctggccaatttatattacaaaaaggtgcgcgctgatctgcaggaagataacggcgtgtcggcggcggacaaaaagtgggcgcacagcctcggctatctgtccgacagcattgaaaaatacgatctgaaaaatacgccgggtaagtacataagcgatgttgactacatgtatctcaagccgtttaacaacagcttcaccaaatgggtcggcgaccttgtgacggaaaacagggtgctcatcaaccaccgcgagcacctgccggagctgtatttcaacatcatcgagcgagaggaaaagaaggtattcctgccgatcgacacggtggacagaaaattcggcgagaactatgacgatttcatccggcttcttgatgagcgcggcgagcttgtcattcgccccgaccgcacctcggcgaatcgctgcgcgtatgtcataaagcgcacgggcgaggatcgctatgagcttaaagaggacacggcatgcaaagcgcgcatgagcattttcggcaatcagtacgatgcggcgtatctattgagcgactatcccgacgacctgcccgaggattttgagaaaaatccgtgcaagcgcgagtattacgacaaaaacagcctgtatgagcttatttcgaccttcaaatacggctatgttatagccgagccttataagataagcggcgagccttgccttttgaggatatacgccgcaaacgaaaagctcaaagaaacaaagctgcttgactattactgcacggatcttgacggtgagaatgtccgctgccgcgcggttacgccctcgggcgagcttgacgggcataagatcggctgctgggacgagataataaaaaccgtcaccggtatcgccggatacataagcgagatcgagtatttcaccgtgagcatcatgctaacggaaggcggctttgtcatcgactctatcgacacaaaccccgacctgccgccgatcgcgcacagcgatgcgctcaacagcttcctgctcgacaggcttgaaaaaaagcgcgaaactgtagtagtcacgcgcgaaaagtggtggacggcgtttaaggataagcgctttaagcgctttgtgcgccgctgctgccgccccggcataaggccttatatgcagaagctctggatgagctcggtctgggacgacttccggcacaataagggcacaacgctttcacagaagctctggtgctataagcgaggcttcctgtcgttcagaataaagcaatacgggcttactaaggataactataaaagcttcctgtccgactatcagtaccactggctaaacagaataaacaacagctatcaaatatggataaacgacaaaacgacgacgcgatatgtctttgagccgtacaagcagtatcttgcaaagtattactacgacataattaaaatggagggcgagacctgcataaaggcgcttcaggatatccccgagggctttgacgcgtcgttcgacggaatattcgccctgctgcgccgggaaaagctgcttgcgctcaagccctcgtccggaacccacggcgacggattttaccgcatggagtatgccgacggcaaatatctcattaacggcgacgagatgaccgaggatgagataaaaagcatgatagaggggtttaagtcgatctacgtcataacggaatacctcttcatgcacaaggatctgaaaaagatatatccgtactctgtcaacaccatccgcgttgcggtcgtaaaccagtcggcgtacgagccgaagatcatgcagacgtatatgcgcatcggctcgtcctcaacgggttttaccgacaatgtcggctacggcggcatatgcgccaagatcgacattcccaccggccgctactactgcgccgagaagataatcgaccataagttcacgccgtgcccgatccatcccgataccggcgttgagatcgagggcatagttcccaactgggagcttatgaaaaaaggcataacggacatctgccgcttcatgcccgagcttgagtatctcggctttgatatcgccatcacggatgacggctttaagataattgagataaacatacatcaggatctgcacaaggtcgccgagcactccgaggaattcaaggcgttcttcagggataagctcgcgctcaaggcaaggcagtatgacctgaaaaaatattaa

SEQ ID NO: 667 - DNA, 483 bp, Unknown
  Description of Unknown: Firmicutes bacterium sequence
atgcttagcataagactcatatgcgtcggcaagctcagagagcagttttatgttgatgcattcgccgagtattccaagcgcctgtcggcctactgtaaatttgaatgtattgagctgaatgaaacaaagttgggtgcttctccgtcagataaggagatagccgcggcgctggataaggaagccggagatattgagcgtgcaataggtaaggacgcttacgttattgcaatgtgtgtcgagggcaggcagcttaaaagcgaggattttgcgcggaggataaacgaacttgccgtttccggaaggggaaggctgtgctttgtcgtcggcggctcgttcggcctgtcgcctaaaataaagcagcgcgcggacatgcgccttggcatgagcgaaatgacctttccgcatcatcttgcacgggttatgctcgccgagcagatctaccgcagcttcaaaatcctcgaaggatcgagatatcataaataa

SEQ ID NO: 668 - DNA, 1029 bp, Unknown
  Description of Unknown: Firmicutes bacterium sequence
atgatcgccgcggtgctctgcgtctgcatggtgctgccgctttgcgcctgctcaagtgacaagcccgagcagaagcagatattcgcaatggacacggtgatgacgctgaccgcctacggcaaatatgccggcgaaggaataaacgcggcagtcggcgtgataaacgccatggacgatatgctcgatcccgataatgagggcagttacacgtcgcttattaacaacgccgagggtaaggacgtcatagtaacgccgcaggtaaacgagatgctgtctaccgcgctgaacgtgtatgatctctccggcggcgcgcttgatctttcggtgtatccgctgtatgaggcatggggcgagttcaaggacgaaaccggccgcatcccgtccgatgacgagataaaggagcttcgcaaaaaccttggcttcggcagcaccgagatcacaaactttgagggcgaggctaactactcggtgcgcatgcctgccggaacgcagataagctttggcgccgtcgccaagggctgcgcgtcaaagtacgcgatcgacgctatgcgcaaaagcggcgttacaagcggcatagtttccctcggcggaaatgtgcagactttgggcacaaagcccgacggctcgaattggatcgtcgccgtcgaggatcctaacgatacaagcagctatgtcggaacgctctccgtcggcgagacagcaataataacaagcggcagctatcagcgctatttcgtcgggccggacggcatgaagtatcaccacatcatcgacccgagcaccggcagacctgcggataacgaccttgtttcggtcacgatagtctgccccgacggtacgctggccgacgcgctgtcaacggcgatgttcgtcctcggcgaaaatgccgcgctcaaatactggcgcgaaaacggcggatttgagatgataatgataaataaggataacgagataatgtgtactaccggtctgatcgaggtgttcacgctcactaaccgcacagattacacgctcaaaatggtagagtga

SEQ ID NO: 669 - DNA, 1782 bp, Unknown
  Description of Unknown: Firmicutes bacterium sequence
atggaggaaaagatcatgaaactgaccgataatgtccacattctcaagtgggtcgacgaaatggccgcacttacgaagcctgaaaagatcgtttggatcgacggctctgaagagcagctcgagcagctgagagccgaggctatgggcacaggcgagcttattaagctcaacgaagagaagctccccggatgctaccttcaccgttcggacgtaaacgacgttgcgcgcgtcgaagatcgcacctttatctgctccaagcgtcaggaggatgcaggtccgaccaacaactggatggatcctcaggagatgtacaaaaagctgtacgagatattcgacggttcgatgaaggggcgcacaatgtatgttatcccctattcgatgggtgttatcggctctgattttgccaagtacggcatcgagctgaccgacagcatctatgttgtcgtttcaatggccatcatgacccgtatcggcaccaaggcgctcgatgctatcggcgacagtgccgactatatcaagggcctgcattccaaggctcagctcgaccccgagaagagatatatcgtccacttcccggaggacaacaccatcatgtccgtcaactccggctacggcggaaacgttctgctcggcaaaaaatgctttgcactgcgcatagcctccaccctcggcaggaaagaggaatggatggcagagcatatgctcatcctcggcgttgaaaacccgcagggtgagattcgttatgtttgcggcgcattcccgtctgcatgcggcaaaacgaacctcgcaatgctcatcccccccgaggcctaccgtgaaaagggctggaagtgctggacggtcggcgacgatatcgcatggctgcgcatcggtcccgacggccgactgtgggcagtaaaccctgaaaacggcttcttcggcgttgcacccggcaccagcgcaaagtccaatcccaacgctcttgccgcaaccaagaagaacaccatcttcaccaacgttgttcacaatcttgacgacaacaccgtgtggtgggaaggcatggacaagaatcctcccaagaacgcggaaaactggaagggcgaaaagtgggactgcaccgacggcagcaagggcgcacaccccaactcccgcttcaccgctccggccgtgaactgcccctgcatcagccccgagtttgaaagcaagaccggcgttcccatctccgccatcatcttcggcggccgccgcgcaaagaccgctcctctggtctatcagtcccgcgactgggatcacggcgtgttcgtcggctccatcatggcaagccagaccaccgcagctgcaaccggcaaggtcggcgttgtaaggcgcgatcccatggcgatgcgtccgttctgcggctacaatatgggcgactactggcagcattggctcgacatgggcgcaaagctcaccaatcccccgaagattttcaacgtcaactggttccgtaccgatgacgagggcaatttcgagtggcccggattcggcgacaacctgcgtgttgtcgagtggatactcggccgctgcttcggcgaaaaggacgcagtcgagaccgagcttggctatgagcccaagcccgaggacatcaacctcgaaggcgttgatgtcactctcgacaccgttaaggatatcctcggagtcgataaggagctgtggcttgaggaatgcaagggcatccgcgagtattacgcacagttcggcgataagctgcccaaaaagcttgcacaggaactcgacgacctcgaggcaagacttaaaaagtaa

SEQ ID NO: 670 - DNA, 1383 bp, Unknown
  Description of Unknown: Firmicutes bacterium sequence
atggctgagatcagagacgaactattttacaagcagaaaaacggttatgatactatgagcacgcagcagcgcatcgatatggaggattactgccgcggctacatggcgtttttgaacgaggcgcgcaccgagcgcgaggcggtgaagatcgcaatagagatggccgaggataagggctttgtcgagtatgttgacggtatgaagctttccccgggcgataaggtctactgcaacaatcgctcaaaggctcttatgctcgccgtcatcggccggaaaagccttgaggaaggctgcgttattgccggtgcgcatgtcgattcgccgcgcatcgacctcaagcagaatcctctttacgaaagcgacgagcttgcgtatttcaagacccattactacggcggcataaagaaataccagtgggtcaccattcctctcgagctgcacggcgtggtcgcgctcaaaaacggcgagacgatcgacgtgagcatcggccacgatccttccgatccgcagtttgtcataaccgacctcctgccgcatctcggcaaggagcagatgagaaagaccatggaagagggcatcaccggcgagggtctcaatatcctcatcggcagcatcccctacgccgacgagggcagcgacagagtcaagcttgccgtcatgagcatcctcaacgaccgctacggcatcgtcgaggaggacttcctctcagcggagctgaccgccgttcctgcatttgaagttcgcgagatcggccttgaccgctcgctcatcggcggctacggccacgatgaccgcgtgtgcgcatacgcagagctaaaggcgatactcgaacttgacgaggcgcccgaaaagacggcagtctgcatcctcgcggataaggaagaaacaggctctgacggcgtcagcggcatgcagagcagcgcattcgagtgcttcgtggaagagctgtgcgccggtcagaacgttcctctgcgccgctgctttaaaaacagcttctgcctgtcggcggatgtcacagcggcgtttgatccgaatttccccgaggtaagcgaaaagcgcaacgatgcaaagctcaactacggcatgggcatctgcaaattcaccggcgctcgaggcaagagcggaacgagcgacgcttcggccgagatcgtcggctacctgcgcagaatatttgccgatgcaggcgttgtctggcagatgagcgagcttggcaaggtcgatcagggcggcggcggcaccatagcaaagtacatggcaaaccgcaatatcgacacgatcgacgcaggcgttcctgtcatgagcatgcatgctccgtttgaggtcgttgctaagtttgactgcttcatgacctaccttggcgtgcttgccgcatataaagcataa

SEQ ID NO: 671 - DNA, 2022 bp, Unknown
  Description of Unknown: Firmicutes bacterium sequence
atgcaagcaaaaaacttattggcatttgccctgccgtgctttataatacagtataaagtattgtttttcatacggagtgctgatatgaactattcggagcttatagataaatatgttccggcagacgatgtttttcttttcaacaccggctgcgcgcagaaggcgtggctgctgctcggctgccgatatatggacgagatcaaaatgcaccgatttgcagtctgggcgccgaacgctcagagcgtttcgctcgtcggcgacttcaacggctgggatccggcgaaaacgccgatggaaaagcgcggcggcatatggtattgctttgcctccgggcttaataacggcgatctgtataaatactgcgtaaccacttccgccgggaaaactgtgtggaagtccgatccctttgcgcagtggtcacaatcaggagtaaatacggcgtccatggtttggacaggctctcatatttggcgtgacgaggtttttatgcgctcccgtgcggagaaaaactgctttgcaagccccatgtcgatatacgagctgcacctcggctcgtggaaaacgcccgagggcggcgtgaactatgccgccattgcgcccgagcttgcaaaatactgcacagagatgggctttacgcacattgagcttcttccgctgaccgagtacccataccccggctcgtggggatatcaggtcaccggctactatgctccgacgagccgctacggaacgcccgacgagtttgccgagtttatcgacgtcatgcacaatgccggcatcggcgttatcatggactgggtcccggcgcattttccgcgcgatgagcacggccttgccgagtttgacggcacacgcctttttgaatgcaaggaggagcgcatggcctcgcaccccgagtggggcacgctgatatttgactacgacatgcccgaggtgcagtcgtttctcatctcctcggcctgctttttctttgaaaactaccacattgacggcatccgcgttgacgcggtgtcctcgatgctgtatctcaactacggccgcaaggatggcgaatacacaaaaaatcgcgagggcggcaacataaacctcggcgctgtgagcttccttagaaagctcaatacctcggttttgtcaagctaccccggtgcagtcacgatagcagaggaatcaacggcgtatccgatggtgactatgccgccctccgtcggcggactcggcttcagcttcaagtgggacatgggctacatgcacgatacgctcgactatttctcgaccgatccgctgttccgcaagggctgccacgataagctgacgttttccatgatgtacgctttttcggaaaacttcatcctcgcctattcgcacgacgaggtcgtgcacgggaagaaatcgatgcttgataaaatgttcggcagctacgagcagaagtttgcgactctccgcgcgctgtacggctatcagttcgcgcatccgggcaagaagctgtgcttcatgggctcggagttcgggcagtttatcgagtggaattatcagcaggagcttgactggctgctgcttgactacccgatgcacgaaaagctgcgcgaatactatgcagcgctcaatcatgtatacggctcatacccggcgctttatgagatagataactcatgggacgggtttaagtggctcaatgtgaacgataatgcgctcagctcgatcgcgttcctgcgctcggcaaggccggagcagaacagttatctcatctgcgcgtgcaacttcattccaaacgagcataagaatttcatcatcggcctgcctatgcccggcaggctgcgcgagatcctctcgagcgatgatgcgaaattcggcggttcaggtttacataatgtcaaaacgctgcgtagccgcaatacaggctttgacgatctgccgtacagtgcatcgatcgatctgccgccgctgtcggctgtatattttgaatacattccggaaaggatgactgaggaaaatgaaaaagcagttcagaagcattctaaatga

SEQ ID NO: 672 - DNA, 2034 bp, Unknown
  Description of Unknown: Firmicutes bacterium sequence
atgaaaagactttacacaccgtttaaggtcaacaagcttgagcttaaaaacagagtgatcatgtcacctatgagcataggccacactgttgatggcttcattatggatgacgttgttgaattttataagcgccgcgcacagggcggcgtaggacttatcatcttcgccaacatgcagtgggataagcttcgctacaatcccaaccacggcgcaatgctcactgacgagaaatatatcccttcgcttaagaagctcaccgatgcaatccatgaaggaggcagcaaggttttcgcacagctcatgcatcgcggcagatgtgcaaatcgcgcaagcattcagggcgagcaggctgttgcaccgtctcccatccccggcagattcacccactttgaaatgcccaaggagcttaccgtcgaggagatcaaggaatttgttgattggcaggcagaggccgcagtcatcgcaaagaaggccggctttgacggcatcgagatcgaaacaaactccggctacctgtacggtcagttcttctctccgctgaccaaccaccgtaccgacgagtacggcggctctctcgaaaaccgctgccgtttcatggttgagactcttgaaggcatgcgcgcggcagtcggccccgactatcccatctctctgcgcgtcagcggcagcgacttcatggacggcggctgcaacggcgacgacatcgcagagatctgcgagctgcttgacaaaaccggctatgttgacggcttctcgatcaccgcaggctggcacgagtcggcagttccccttatcaccatggaagttccccacggcgcatgggcatacctcggccgccagatcaaggctcgcgtaaaggctcccgttgctcagggaatgcgtatgaacatagaaaaggccgaagagctcgtcgatcgcggcgacttcgacgccatcgtaatgggccgcccgttcctggcagatcccgacgttgttaacaaggccgaggccggcaaggcatcaaccatccgtccatgcgtcggctgcaatgcaaagtgcctcgacatggcaatggtcagcaagcccatcggctgcattggcaactacgagtgcaaccgcgaggaagagcttgaggacgaaaacggccttatgcccaccgagaagaagagcgagcatcccgaaaagatcctcgttatcggtgcaggtccctccggcatggagtttgcccgtgtagcagctctgcgcggccataaggtcactatttgggaaaagcgcaaccgtaccatcggcctgtcgctgtatgcagcaactcctccgcgccgctacgatatccgctacttcggacagtggctcgcgcgcacctgccgcgagctcggcgttgagatcatcctcaacaaggaagcgacggcagaggatataatcgcagcaagcaaggactacgaccgcgttgttcttgcatgcggctccaaggcatctatccccccgatccccagagaccccagtgttcccatcgttcatgcatgggatgtatttgaaggcaccgcagagctcggcaagaacgtagttgtcgtcggcggcggtgatgtcggcgtcgaggtcgcaatgtacatcggtgagatcggcactcttacagccgatgagctgagattcatgatgatctataagaccgagccttatgagaagctccagcagctgctcaaccacggtgtccacaacgttgctatcgtcgagatgggcaaaaagtttgctcccgacatcaaccccggcagccgctggtcgatcattgctcgcaccaagcagcttggcaccaagatgctcaaggagaccaaggtcatagagataaccaaggaaggcgttgtggttgaaaacgcagaaggccgccagactctcccggcagacaccgttgttatagcagccggtgcaaagcccaataatgatatgtatgagcagctcgtcggcaaggtcaaaaatgttgactgcatcggcgatgctgtcaaggtagcaagaattccggatgcggtcgaatctgcctacaagctggccgcaagcatataa

SEQ ID NO: 673 - DNA, 1575 bp, Unknown
  Description of Unknown: Firmicutes bacterium sequence
atgaaaacaaaacgacttatcgccatgctgctggcaatgagcatgctgctcacgctgcttgccggctgcggaaaaaagaacgatggaaagcccgagaacactcccgagccgacacagagaccgcagtatgagcttaccgacgccgccgttaacaaagaagaaacggtgtatataaacgtatctcccgacggcgaggtgaaaaaggtcagcgtgaccgacaggctgcataccgacatgccccaggtgcgcatagaggataagagcaacctttcgggcattcaggatgtaaagaccttctccgagcctgttaaggataacgataagctctactgggacatggattcgaccgatctttattattccggcagcacggataacgcgccgccaatgaaaatatccgtcagctacacgcttgacggaaaggagataaagggcgcagctcttgccggaaaaagcggcgatgttacgataaagataagcgcgcagaacacgcttaaaaaatccgtcagcgccggcggcggaagctatgatatatcatgcccgatgctgttcgtgtgcggcatgatcctgccggacgagaatttcagtgaggtttcgaccccgaacggagtgcttttgagcgacggctctcgccagctcgtgttttttgccggcgttcccggaatgaacgacagcctgggaatagataagctcggcatcaacatcggaaccactctcggcggcagcgaatacacgataagcgccaaggcaaaggacttcaagctcggcaacatgatgttcgttgcggttccgttttcctcgatatcctcgctcggcccggatgatatcaagctcggaacggaaagcgtaaagggcatgctcagcgatatcgaggggctgatgggcgcgttcaactcgctgaacctaaacgacatggtgcagatgctctacggcgatgcgcagcagatagagcagcttgtcaactccgtggggcaggcggccaagctttataaggaaaacaaggcgctcattgatgtcttgaataaatacgtcaccgagggtaacctcgcaaagctcgagcagcttctttacgatatgcagcgcatcgacacgagcaggcttcagtcgcttgcgcagttcacgcacctgtccgagcttttggagctgctgggcaaatttgataccaatatcggtgcgctcgcgcagtttacgcgcgattatctcgatatggcgccgacctttgagagcttaaaccgcgacctgtcctcgcccgaggtgcaaaagtcgctggacaatctgccgaatataataagccagcttcaaaatctcgtgaacgtcatgcacgcaagcgagcagatgctcgagcgcatgacgagcatgctcggcggcgagagcatcaacaagatcattgctttcacgcagaagcttgaaaacagcgtgagcatggaaacgctcaccaaggcgcagcagcaggcgctgaccgagcgcatgcaggcatggctcgacttcggcagcagctatgatatcttcacccagcgcaccgaaaaaatgacctcaaccgtcgtattcgtgtataaatccgaatccatcggctga

SEQ ID NO: 674 - DNA, 1083 bp, Unknown
  Description of Unknown: Firmicutes bacterium sequence
atgaacatcctgtacctaataaattatgcaggaaaagcaggaaccgaaaaatacgttctgaaccttatgcacattctgtccgcgcagggcgagacatgccatcttgcctacaatgttcccggccagctttcggaaaccgtgagcagcgagggctttgcgtgcttccggtttgagatgagcacaaaaaaggcgttctcggcggcaaagaagcttgcaggctattgccgcgagaacaagatcgacgttatccacgcgcagtaccccatggaaaacgtcatcgccatcctgtcccggcttttctaccgcaaggtaaaggtcgtgtacacaagccatcttacaatatatcagaacacgaagtggaagatactcaaccgtctgtttactccgtttgaccaccgcataatcgccgtgtgccgccagggagcggacataatggtctcaaacggcgtgaaaaagaaccgcattcaggtcgtttacaacggagtcgaaccgaagcgcgagcgcgtgtatgaccgcagctttgcccgtgagttcggagttaacggcgataccttcgtcatgtccatcatggcgcgctatgccccggaaaagggtctgcccttcctgcttgcctcgcttgcaaagctcaggcgcaagaccgataagccctttgtgtgctttatcgccggcgacggcgaggagtttgacgactttgcggtgatgagcacaaactccggtatgagcgactgcattatccagctcggcttccgccgtgattccgacagaatgctgaaggcctcggatctttatctgaacacaagctcgaaaaacgaggcgatgagctttgcgatacttgaggcaatgaacgccggcgttccgcttgttgtgaccgatgtcggcggaaaccgcgaccttgccgaaacacacaccgtctgcggcagagtcctcaatttcggcgacagcgacggtttttccgacgcgatgctcgagctcatggaaaacgacgctctgcgcgcagagtattcggcaaatgcgttaaagaaggtaagcgaggagtttgacctgcgcaagcttgcactcgacgtgtttgaaacttataaataa

SEQ ID NO: 675 - DNA, 1194 bp, Unknown
  Description of Unknown: Firmicutes bacterium sequence
atgaagaaaagctgcatagcaatgctccttgccggaggtcagggctcaagactctacgcccttacgcaggacgtggcaaagcccaatatgcccttcggcggcaaatatcgcataattgacttccctctgtcaaactgcgcaaattcggggatagacacggtcggcgtgctcacgcagtaccgtccgctgcagctcaacagctatatcggcggcggtcagccctgggatcttgactcgacggacggcggcgtgttcatacttccgccgtatcagacagccggcgagacaggctcgtggttttccggaacggccaatgcgatctatcagaacatcggatttatcgagatgtatgatcccgataacgttttaattctctctggcgaccacatatataaaatggactattccaagatgctccgcgagcatattgagaaggacgcagcctgcacgatagcggtcttgcaggtgtccatggaggacgcaacgcgcttcggcatcatgaacctcggccccgacggatatgttgagcagtttgaggaaaagcccaagcagcccaagagcgatcttgcctctatgggcatatacatatttaactggaaaaagctccgcaagtacctcatcgaggacgagaatgacccgacctcgagcaaggacttcggcaaaaatataatccccaacatgctcaaagccggcgaaaagctctggccgtatcgctttgacggctactggcgcgatgtcggcacgataacgagcctgtgggacgcaaatatggacatgctttcgacaacgctcataaatctttatgacccaagctggccgataaggtcaagaagcgtcgcgcagccgccgcactatgtcggcccggaagcaacggtcgtgcattcgatcgtaaccgagggctgtgagatcgaggggcatgtcgaaaactccgttctctcgtcgtcggcagtggtcgaaaagggcgcaaaggtgctctattcggtgctcatgcccggcgcgaaggtcgaggagggcgcggtcgtcgaatacgccataatcggcgagcagacggtcatacaccgcggcgcacacgtcggcgctccgcccgacggaagcgaggcatggggcgttgccacctgcggcccgagacttgatatacgcgaaaacgcaagcgtcaaagcaggcgctatgatctataaaagcgaggaggtctga

SEQ ID NO: 676 - DNA, 378 bp, Subdoligranulum sp.
ggagagttggcttttcaaaaggaagtgaacaccgtgattaaaagaggagaactgtattatgcggatttaagccccgtggtgggcagcgaacagggcggcattcgccccgttttggttttgcaaaacgatattggcaacaaatacagccctaccgtaatcgccgcggcaaccacgtcgcggctgacaaaagcaaagctccccacccacatagagctgcccggcgacaaatattgcctgcccaaggacagcgtggtgctgctcgaacaaatccgcaccatcgacaaaaccagactgaaagaaaaaatcggagaactgcccgaggacgtgatgaaggaagtgaacaacgcgctgcttatcagtctcggctttttccactga

SEQ ID NO: 677 - DNA, 366 bp, Subdoligranulum sp.
atgaggacgagagaatctgaggaaatgtacctcgaaaccattttgcttttaaagaaaaaaaagggcaatgtccgttccgtggacgtggtcgaggagctgggttacgccaagtcaagcgtatcccgcgcggtaaacctgcttatccaaaagggctacgtaaacatggacagaaacggagacttgacgcttaccgcaagcggcgaagaaaaagcctcctccgtgtttgaaaggcactattatattacgcgcgcgttgataaaaatgggcgccgacgcggctcttgccgaagccaacgcgtgcagaatcgaacacgtcgtttcggacgatatgtttgaattgattaaaaaattcgccgcgtgcgactga

SEQ ID NO: 678 - DNA, 639 bp, Subdoligranulum sp.
atggtacaaaaaaaagcttttttaaatatttatgtgtcgtcttatccctttgaatgtgggagtcaaaatatatcattcgcaccgagagcggaggaaatcgaggcctgcacaaacgaaaatgtccgcaggcaaaagctttatgtatggaagcttttggagcttgccgtcggtgatttgtcgggcatggatttaaatagcttgaacctaaggaaagatgaaaacggaaaatggcagtcggataagatttatatttcgttgtcgcacagcggcaatgttgtcgcggcggcggtgtctgacagctcggtaggcttggatattgaatttttcaatgaaaaaaaattcggaaagtcgcttgcaaacagaattgcaacagagagcgaaaaatctttttttgcaaaagagcgtgctttttcggagcgagtgtgcgccttgtggacgaggaaagaaagcgaatttaagcgtaaaggagaaaaaattttcagaccgttttttacaggcgcgctttcgtcgccgtgcaggacatttttgctcaaatgtaatcatgaaagctatgttttgtcagtttcgggagaaagcgtttcaaaatcgtcatttgtcacgccttttgataatgtcgttgtcttcgaagaaataaaataa

SEQ ID NO: 679 - DNA, 690 bp, Subdoligranulum sp.
atgtcaagcgggcatcgaaaaagagcgttttcaatgaaaaaaattgtgtgcgttgtacttgcggttttgtttgtttttgcttttgtcggctgttcaaacggcggtacgttttccgaaaaaaactatttgtcggaaaacgggcaaataaggagcataattattgacgtcgccgacagggagctgaacataggtttatcctccgacggacagataagcgtaaattacttcgacagcgaaaagcaatatcttgaaatttccgtttcggaaagcaacgagcttgtcatacgcttggcttacgacaggagctggacggattttttcggagtcaaaccggacaaaaaatatcgcggaataacggtgcttgtccccgaaaacctgcttgcctcgctcaatgcaagcacgaccaacggggacataaaggtatcctgtctcgacgtttcggaggaaataaatctctgttccaacggaggcgacgtaatttgcgagcgcgtcggcgcgggcgggaagataagcctcaaagccaaaaacggaaacattcgcggcaccgtcgcgggcggcttggacgaattttccgtttcctgcaaaatcaaaaagggcgactgcaatctgccgttgagcaaggagggcggcgacaaggagttttttgccgattgcaacaacggcgacatatacgtcgaatttgtaaaataa

SEQ ID NO: 680 - DNA, 591 bp, Subdoligranulum sp.
atgaaaatcgttgcaactaacaaaaaggcttttcacgactatttcgtcatcgacagctttgaagcgggaatcaaccttgtaggctgcgaggtcaagtctgtgagagctggagaagtaaacttaaaggacagctatgccgttatacgcggcgggcagcttgtgcttgtttccgcatatataaaaaattacgacaagggcagcttttccaatgtggacagccgccgcgacagaaggctgcttatgcacaggcaggaaattatgcggctgttaggcaaggttaaggaaaagggcttttcgcttgtgccccttaaaatgtaccttaacggttcgcttgtaaaggtggaaataggtcttgtaaagggcaagcagctttacgacaagaaaaaggctattgccgaaaaggatgcggaaagagacaaacagcggcagcttgccgatatgaaacggggaattgacaggaaacaaaaaaaatttcagaaagtgcgtcaaaatccttttcaacccaatcaaaatttgatagaatatataagcgtcgtgcaaacgtctcgtaaacgctactgtggctcagtcggtagagcagctgattcgtaa

SEQ ID NO: 681 - DNA, 807 bp, Subdoligranulum sp.
atgaagctgacgggaaaaacggcggttgtcaccggcggaacaaaaggcataggagccgagctttgccgacttttttcgcaagcggtagcaaatacggtttgtcttgcgcgcagctgcggcgagggcgaaaaaaacgggattttttacatcccgtgcgacgtttgcgacgcggcggcggtggaaaacgccttccgcgcaatcggggaaaaattcggcagagtggattttttgataaacaatgcgggcatgggcatttccggctcggtggaaaatacgtcggagcgcgatttcgacagcatttcggacgtcaatttcaagggcacgtacaactgcatacgcttcggtctgccgctgcttcggcaaagcaagggcaggctcgtcaacgtgtccagcgtggcgggggcgattgccataccctatcaggcgttttactccgcaaccaaagcggcggttctcagtctttcggacgcgctcagaaacgaggtgcgcccctttggcgtaaaggtgcttgccgtcctgcccggcgacgtgaaaacctgcttcaccgagtcgagaagaaaaaataccgacgagggagtttatgccgcatacgcggaaaattcggttaaggttatggaaaaggacgagcagcaggggatgagcgccgcctacgccgcaaaaaaaatctttgcctgcgccgtcaaaagaaatatgccgcacgtcaaggtcataggcgtgaaatacaaatttttgtattttgcggcaggcattttgccgaggcggctcaaagattggctgctgttcaaaatttacggcggagagagctaa

SEQ ID NO: 682 - DNA, 396 bp, Subdoligranulum sp.
attatgagatattcggaacagagagaaaaaatacttcttgcggtcaaaaactgttgcgaccatccgaccgcggaggtcatttattcccgagtcaaggcgcagatgcccgatatttcgatgggcactgtgtacagaaatttgcgtctgcttgcggaaatgggcttggttgacacgttggagacaacggacaaaagcctgcactacgacggaaacacggaggagcacgttcattttatctgtacgggctgcaacaaaataaccgatgttttcgtcagagcgaaaattcccgcgccgttgaaggatgacggttatcacgtcacaggcagcaagcagatgatttacggtctttgtccggaatgccggaaagaaaataaaaaatttttacaaggagattaa

SEQ ID NO: 683 - DNA, 1167 bp, Subdoligranulum sp.
atgcttggaaactttacttactgcaatcccaccaaactgtatttcggaaaaaatgctctcgacggactgaacaaggagcttccgcgttacggcaaaaacattatgctcatttacggcggcggctccatcaagaaaaacggaatatacgacaaagtggttgacattctcaaacgcaacggcaaggaaattttcgaggacggcggcgttatgcccaatcccacggcggaaaaactcagggacggagtagagaaggcgcgcgcggcaaaagccgacctgctgcttgcggtgggcggcggctcggtgtgcgactatgccaaagcggtgtccgtatcggttttctgcaacgaggacgcttgggacaaatatttcgacagattcgaggacgttgacaatcccatagtgcctgtcggatgcgttttgaccatggcgggcacgggcagcgagatgaacggcggctcggtcatcaccaatcgcgagaaaaagctgaaaataggtcacgttttcggagaaaatgtttttcccaaattctccgtgctcaatccggagtttaccatgacggtgccccgctatcagatgatttcgggcatttacgacatcatgtcccacatactcgaacagtatttttcggggacggacgacaatacgtcggactatatcatggaaggtcttttgaagtcgctgataaacagcgccgaagcggcggtgaaaaacccgttggactatgaggcgcgcagcaacattatgtggacggcgacctgggcgctgaacacgctggtggcgaaaggaaaatcaaccgactgggaggtgcatatgctcggacaggcagtcggcgcgcacacggacgcggcgcacggcatgacgctttcggcggtctctctgccttactaccgccatattctcacttacggtctcgaaaaattcagaagatacgccgtcaacgtctggaacgtcgacacgcagggtaagacagacgagcagacggctctcgaaggcttggaaaaaatggagagctggatgaaaaaaatcgggcttgtgatgaacataaccgagctgggcgcgtccgaaagcagtataaacgatattgcggacagcgtgctgattatggacggtggttacaaaactctggacaaaaacgaaatacgcgaaatactcaaaaagagtctttga

SEQ ID NO: 684 - DNA, 396 bp, Subdoligranulum sp.
atgcttaaattgaaacaggcggagcttgaagaaataaaggaagtgcgaaaaagcgttttcggcgacgctgattttgacgacgaggggctttgtctgcacgttttggctcgcgacggcgacgaaaaggcgggatgcgtttcgttgaaaaaggacggcgatttcgtccgtatttacgcgttgggagtaaaagaaaacctgcgtggaaaaatgacgggagaggcgttgcttaaaatggcggagtttctctctctcaaccgcgattgcagggaaacgtatgtgactgtcgggcaaaacgagggattttttgaaaaattcggctataaaaaaacatcgggaaaccgtatggagaaaagcctgtttgacggctgcaactgttgttctcacaactccgattga

SEQ ID NO: 685 - DNA, 1122 bp, Subdoligranulum sp.
atggacaagaagcgacgcaacaaaatcagcttcgtcaccacgctgttcggattgattgcaaacgccttgctttgcgcgggtaaatttgcggtggggcttttgtgcggcaacattgccgtcactgccgacgcggtaaacaatctttccgacgcgggcaacaatgttgtcacgctgatagcaatcaaggtggcgggcaagcctgcggacaaggagcaccccttcggacacgaaagggtagaatatgtttccgcgctggtcgtcgcttttattatactttttttgggcgtggagctggcggtgtcttccgttgaaaagataatactcaatttcaaagagccatatctgcccgaatttgacgcgtggctggtttacgttttgtcgttttccgttgtcgtcaaggtcgtcatgtttttcgtttacaggacaaacggtaaaaaagcgcagtctcccgtgctaggagcaatggcgttggacagcattatggacgttgccgccaccgccgccgtgcttgcggcgattcttatcggcagattggcgagcgtcaatcttgacgggtacatgggacttgccgtatccgttctgatatttgtcggcgggataaagatagcaaaggataccgtgagcggtttaatcggggttgcacccgacaaaaagctcattgccgagctggaagccgaaatcgcggcttacgacggcgtactcggcgtccacgaccttttggtgcacagctacggaccttacaatacattcgtcacggtgcacgccgaggtggacgcaaaagccgatatgcttgccgcgcacgagcggatagaccgaatagaaagagattttctcgaaacacgaaacatacatctgttggttcatcttgaccccaccgaaaaggacaatcccgaaatcgaggcggttttgccgtcgataaaggaagttttgtcgtccgttgccgacggtcttaatttccatgacgtgcgacttgtcaggcagggcggcgcggaaaaaatatttttcgatatggttgcgcctttcgagctggaaaagtcggatgaagagcttaaaaatcttgccgaaagccgcctttttgaaaaaacaggcatgagcttttcggttacggttgacagagagtga

SEQ ID NO: 686 - DNA, 927 bp, Subdoligranulum sp.
atgcgcgaatttttcctgaattcgggaatttattttgaagaaaacgtaccgctcaaaaaactcacaaccttcggaacgggaggccccgcgaggtacgttgttcagcccaaggacgagcgcgaaataagcgccgttctgacttacttgaagcaaaacgacgttccttatttctgtctggggggaggcagcaacgtgctggcgtcggacgacggtttttcgggcgtggtgattgttgtcggacggtttatgtctcagatattttttgaaaacggcttgcttgttgcgcaggcgggagccaaggcgtgtcaggtggcgcatttcgcctgcatcaacggactttcgggtgcggagtttcttgcgggaatccccgcgtgcatgggcggagcggcgtatatgaacgccggctgcttcgacagggagatgtccgacgtcgttgcgggagttaaggctgcggacgaaaacggagaaaaggaattcggtcacgcgaggtgcggctttgcgtacagaaaatctgtctttcagtcaaacggaatgattgtcacccgcgttttgttggctctcaaaccggaaaaaccggaaaaaataagggcggcgatgaaggagattttggaaaaaaagaagcttacccaaccattggaatatccgagcgcgggcagcatattccgcgccgagggcggcgcgcccgcgggacttttaatcgacagggcgggtttaaaggggctgcgcgcgggaggagcggaaatttctctcaagcatgcaaacttcattgtgaacaagggcggagcaaccgcaaaagacatactcgagcttatggacgcggcgggcagcgcggtcaagcgcaagttcggcgttgtgctgaggcctgaaataaaatatcttggagacaccgatgatatcgggagattatcatattcattcacgttatag

SEQ ID NO: 687 - DNA, 606 bp, Subdoligranulum sp.
atgaatttacccaacagattgtctttgctgcgaatagctcttgtgccggttatggcggtgtgtttttacataaatttcgactacggagctttgcttgcggtagcggtgtttcttattgctgcatttaccgattttctcgacggttacattgcaagaaaaacaaatcagattaccgaacttggaaaattgcttgaccccgttgccgacaagcttttggtggcggtggcgctttttatggcaacaggcgctcgcgtgcttgaaaatgagtttattccttattatattacggacatctgcgcgtcaattattatcggaagggagctttttataagcgttttcaggcaaattgcagcagctaagggctttgtaatgcaggcgaatgtttacgggaaaatcaaaacagttgtgcaagatattgcattgccgctgatgttgtttcttaaaatgaaggatgtgattatcggatggtcgcagactttttacgacgttgtattctacaatgcattgggattgttgattttggcgacaatattaactattatttcaggcatagtatatatttgtcgcaacaaaaatttgctgagagcggaagataaaaaatgttaa

SEQ ID NO: 688 - DNA, 369 bp, Subdoligranulum sp.
atgaagtcgttacaagaactcaacgcaatcagagagagaatgcaaaaacagacgctcaacagagacgccgcgacggaaaattccacgcgcgtggtggtgggcatggctacctgcggtatagccgccggcgccaagccggttatgagcgcgtttctcgaagaggtttccaaacgcaatttaaagcacgtcgttgtgagccaaacgggctgcataggcatgtgcaagctggaaccgattgtagaagtgttcgtaccgggacaggaaaaggtgacttacgtcaaggtcacgcccgaaaaggtgtcgagaatagtcgccgagcatattgtcaacaatcagcctgtaaaagaatttacagtagatgagaaataa

SEQ ID NO: 689 - DNA, 747 bp, Subdoligranulum sp.
ttgctttttctccgattttgtgttaaaatcaaagaggagaaaaatttattgaaagtttttgcaatcagcgatttacatttgtccactacggtaaacaaacctatggatatcttcggacctaattggagcaatcatttccttgcaatcaaggaggattgggaaaaaaaggtatccgacgaagacgtagtgcttatgccgggtgatttcagctgggcaatcaaatcggaggacgccgaaagcgatttcgcattgttcaaggagcttaaaggcaaaaaggttattctcagaggaaaccacgatttttggtggaacacgataagtcaggtaagagcaattttaccggaaggctttttcgccatacagaacgacgcgttaaagttcggcaacctgattgtttgcggttcgcgcgggtgggttttgcccgagcctaacagaccgcttaatgaacgcgacaacaaaatttatttgcgtgaaatcgagagaatcaagctgtcgcttgccgctatggagaaactgcggcaggagggtgaccgtgtgatatgtattatgcattatccgcccttcaacggcaggcgcgaggaaagcgaatttgtcaggcagttgatactgcacgacgtggacacggtcgtatacggacatctgcacggcaaggaagtcagaagcgacttgtttgtcagaaaattcaacatgaatttctggttgacttccgccgatttggtggatttcaaattgaccgaaataatttga

SEQ ID NO: 690 - DNA, 312 bp, Subdoligranulum sp.
atggcaaaagctaaaaaaactcagaaggcggccgaaccgagaattatgaacggtcaccttgtgaaggaagccaaagctcctctttacaaggtcaagcacgccaaaggcgacaagccttaccaactcagcgacaaaaaaatcaaggtcacgcttgtaaaaagcactatcggctgtttgaaggtgcagcagaggacggttgaagcgttgggactcaaaaagattcgctcttttaaaattctcaacgacaacgacgccgttcgcggcatgattttccgcgtgaagcatcttgtgaccgtcgaggagcttaaatag

SEQ ID NO: 691 - DNA, 855 bp, Subdoligranulum sp.
atgcacatacagtggtttccgggacatatgaccaaatcattgagaatgatggaggagagcgtaaaggttgtggacgcaataggttacgtccttgactgccgtgctcctttttcttgtttcaatcccgctttcggtcagtacactgaaaaaaagccgtgcgtatttctgttaaacaagtccgaccttgccgacgaaaagaccaccgacaggtggcttgcatattttgcttcaaagggagacaaggcgattgccttgaacgcaaacgaaaaggggtgcgcaaaacaggtggtaaaggcattcgattcgctggaaatgaaaaatgttttgcgtttaagacaaaaaggagtagtcagacccgtcaggataatgattatcggcgtgcccaattcaggtaaatcaagcatcataaatcttttgagcggcaggaaaagcgccgttacgggaaacaagccgggcgtgacgcggggaaagcaatggattcgtctcggcgacggcttggagctgcttgatacgccgggcacgttgtggtcaagattcgagaaccaatgcgtagcgcagaatctgttttttatcggaagcataagcgacaatgtcgtggatttgtgcgagggggggcaagcccttctcgacaggctcacagaggtggctcccgacgctttgaaaaaccgttacaaattgacggacggggatttgagagacgaaggattgatggataaaatttgtatcaagcgcggctgtctaaacaagggagagcctgacagggaaagatgcgccgccgcgattatcgacgatttcagaaaaggaagaatggggcgcgtgtctctggaagcgccgcaagcggaagatgaagcttaa

SEQ ID NO: 692 - DNA, 1254 bp, Subdoligranulum sp.
atggagtttatgaactgcctggcaaccgctgccgaaaccatcggacaatggggattttccgaaggatttgcgagtatcatgtcggaaatcgaaaatcccacgtttgtcggctggctggtcaaagggttgctcgacgcggtggggaattacggctgggccgtggtgctttttaccgtaatactcaaaatcattactttgccgctggatttctggcagcgtttttccatgaagaaaaacgcaaaaatgatgtccgagcttgcgccgattatggcaaagctggacaaggcttacgccaacgacaaaaacaagctcaatcaggaaaagcagaagctttacaaaaagcacggctacaatatgctttcgggctgtctgcccatgattgtgacaatgacaatcttttttgtcatgttcggcggtctcaatcaatgttccgcttacgtcaacctcaaggtttacagcgagcttagcgtgcactacaccgatacgctttctgccgagctgtcaaagcacacggaggaatacgaaagcaagcgctatgacattttgctttcgggaaaatcgacggcaatcgaggattacaagacgtggctgggcggtcagggcgttgcggaaagcgctttcgacgcggaaataagcgcggcgacaagccgtatttcccaaatcaaggcggaggcacaggcggaggcgcgcaaagcggtgggagagttctatctcgaagcaaaggagggctttttgtggattaccaacataagccgtcccgacacttgggttgagtcctttccggaaacggcggaaaagtttaccggcacgctcacaaagaaatacagggcgtacaaggacgaattcgactccgagctttacggcgaaatctacaagggcataagcgaacagggcgtaggctacaaggtgggcgacaagcattggaacggtcttatgatactgcccgtgctgtccatagctctgagctttctttccacgtttatttcaaacaaaacgagcaaaaagaaaaacgaggaggaacagcagctcgaccccaacgcggcggcggctcagagcagcaacaaggtgatgatgttcgtcatgcccgtcatcatgggtgttttcggctttgtttatacggctacgtttgcgctgtatatggtttgctcgagcctgctgtccattctgtttacgctggcgatgaatcccataatcgacaggcggattgcaaaaatagagtccaaggtggaaaaacccgattacaggagaaaataa

SEQ ID NO: 693 - DNA, 711 bp, Subdoligranulum sp.
atgcaacggctgcggactgcaaaaggagggattgtgcaaatgatagcaatcaaatacgccaagcgttatcctttgtctatgatttcacagtccgatatgctcaacgtaataaaaagaattttgacgcgggcgggcgtaaaggtcgaatattcggcgggcttcaatccgcatatgcttctgtatttttcgcccgcgctttcgctgggcatagaaagcgagtgcgaatacgtttgcgccgccgcggggtacgcgcccgatttgaaagaaaaactcaatgacgcggctccgtcgggtttcgagtgcctcaaagttttttctttgccctgtgaacccaaccttaccgcgaggtcttacgccgcgcattatgtgttcaaagcgcgcggacttggaaagcaggaactttcttccattgcgggaaaccccgattttaccgtcttgttcaaggacaagaacggagaaaaagtcaaatccgccggcgaaaaaatctatatgctcaaagctgtcggcgatgatgccgcggaagccgtccttgcctgcggcaacgacaatctgcgcgcagacagagtgttgaagcagctgtgcgcggatttttctctcgattgggacgccgcaacgataaccaaaatcagactgctgcttgacggagcggaggacgcggacgaatttcttttgaagctgcaaaaaaacgcggccgcagcttgcaaaaattga

SEQ ID NO: 694 - DNA, 675 bp, Subdoligranulum sp.
tctgagacagctgtcgcacatttcttcttctatcggaatgtaatttcttttgcagacagggcaaagctttgtttcctcttcgaggtcgaagtcgtcgtcgaggagtatgtctttgggcataagccccaactcggctttgcatatatcgcacatttcctgcctgctgtcgatataattcaaatcgcagcgggggcatttaatgtaagtaattttgctcataaacctaaaaaacctctgttctcggatttgcctgcatattatatattcaattatccgaattgtaaactgtttaaggcgaatttttttcaaaaaaaatatacggagtatcggaggcaaccgacggcggcgcaaaagagtgtaaaaacgtcgtttttgggcacaattctgaaacaaaactcttttttcgcatatactacatatagaggtgaaaaattgcgaaaagtaacgacggacatcaacattgcgaaaaaaagagtggatatgttaaagggcaaggatttgcttgtgagatacaacaaggggcgcaacaaaatcagttatttcaagggcagaataacggaggcgcacagaaacgtttttgtaatcatggttttcgacgagatattcgacaggctgagctgttcctactccgaccttttgtgcggggacgtggcgtttaaggaaatcaaaagttaa

SEQ ID NO: 695 - DNA, 1116 bp, Subdoligranulum sp.
atggctaaatttaaaaaaactcttgccgcttttgctatgcctgttgtcgcgatgattgccgccgcagtcacctgcttttttgtaccctttgacaagcagtatcttgattatttcgattttcgtacccttgcgtgtctgttctgcacgctagcggttgtgtgcgcttttaaaaatataagatttttcaggtggctcgcggatgtgattgtgcgcagattcaaaacggtcaggggagccgtaatcgcgcttgtgttcgtaacttatttcggttccatgattatggcaaacgatatggcgctcatcacctttttgccgttgggctttctcgtgctggaatcctgcgcgcagagaaaatatcttgcttttgtttttgtcatgcaaaacgtcgccgcaaacctcggcggaatgctcactcccttcggcaatcctcagaatctgtacctgtattccttctattcctattcggcgggagagttttttcgcgttatggctgtgccctttgccgttgcctttatactcattttggcgtcctgtctgtttgtcaagccgttgaaaataaaggctgtttcgacgcaggtgccgcgtccgccgttgttcaagactgttgcgtattccgtactgtttgcagtgtcggtgctcatagtttttcgtgtttttccctattggtgggggctggcagccgtcgttgcggcgttgttgctccttgacccggcaagtctggtcaaggtggattacaagcttcttgtcacctttgccgcgtttttcgtttttgcaggcaatatggcgcgcatagacgcggttaaggaatttttaagctctttggtggcggcttctcctttgcttgtgggagtcgcgtcctgtcaggtgttgagcaacgtgcctgcgtccatgctgctttcccgttttaccgccgacaaaaacgccttgctgattgccgtaaacataggcggactcggcacccccgtcgcgtctcttgcaagtctgattacgcttggagaataccgctccgcaaacggcggcggcgctcggcgttatctcggtttgttttccgcaatcaatttttcgtttcttgcaatcctgacggcggtttcgctgttgattttgccgctgctctaa

SEQ ID NO: 696 - DNA, 882 bp, Subdoligranulum sp.
atgacgacgttaaacaaaaaaaattcttttgcagaatatataaagatatatgccatgctgacacttgcggggacgcttatggcgctgggaatctatgtcttcgtgctgccctgttccgttgtggcggggggaataggcggactgagcaacatcctgtattatacctttaacatacccgtgagcataggcagcatagcgctgaacgcgccgctgctgattgccgcgctgttcaaactcaaaaagtcctattcagtcaggacggttttcgcctgcgtggtttattcgtcggtgacgctgctctttgaaaaaataaatttctttcagttttcggacagcaggattatcggcgtggtaatggggggagcgctttcggctgcggccataacggttgcttactttgccggcggcagcaacggaggcagcgaaatcgtaaccggactggtcagcgtcaaaaatccccacgtggaaatgggcaaggttctgcttatcttcaatctgggagtttacgcgctcgcgtttgcgctgcaaagagaattgatgcaggtgctttactcgctgctgatgtcatacgtgacctccttctgcgtcaaaatttttatgaacgggatagaccccgtgctgaaatacacggtgataaccaaaaaatcgcaggagcttgacgcggaacttttcaaggttttcaagagaggcgccacgaatatagaggtagtgaccgaatacggcgagcctaccgacagaaaggttgttatcgtcgtcatacagtaccgacagaatcaggtgttcaagcgaattttgcgcaaggtggacgaggagtgtttcgcattttgcacttcgataaacacggtgttgaacaagcccgatttcaataagagatacaaataa

SEQ ID NO: 697 - DNA, 378 bp, Subdoligranulum sp.
atgtccaacgcagcggtaaaaagaagtaattcgggcgaaataatcaggggcggactgttgagttttgttttcgccacaatacttgtgcttgtcttttcactgattgtcaagcttacgaatatgtcggcaaccgccgtgccgatagtaaatcaggtaataaaaattttaagcgtatttctaggcgtgtttttctctcttaaaaacaaggaaaaatgctggctgaaaggcattttgtccgctttgcttttcgccgtgctcagctttgtggttttttcccttctcgcaaacagcttcaattgggcgggattcggaattgacctggcaatcgacgcggttgtaggggcgattgcaggcattatttgcggtttgagaaaataa

SEQ ID NO: 698 - DNA, 459 bp, Subdoligranulum sp.
gccgcatattcaattattgcggaaaaatacttgcaaaatttttgtctttgtgctatactgccaaagcattgtattggaggtcaagatgatttcaaccttgttggcggcttctgccggacttattttgggcatcagaataacattgatggcgttgatgctaatctgcgccgtctgtataatagttttcgtaatgcgtcagcacggcgaggaggacggtcttggagcaatcagcggtcagaccgaaacgcaggacagcttttacggcaaaaacaagtccaagagaaaggaaagcagactcaagctgtggaccatgatttgcggcatagtgatagccgttttgagtatagcttggtttgttgtggaattgctggtttgacaacgtacctgacggcagagcttggtttctgccgtttttttattgaaaaaggaaagttcttaaatgaaaatcgttgcaactaa

SEQ ID NO: 699 - DNA, 888 bp, Subdoligranulum sp.
atggaaatttacgacaaaaagtttgtggaactcggcaacggagaaaaatacgcgttcatcgaaacgggaaagggcgcgccgttgctgcttattcacggcaacatgtcaagcggcgtgcatttttcgcctatcttgcccgcccttgccgaaaaatttcattgcttcgcacccgatttgcgcggcttcggcgacagcagctacaacaaacccttcggcagcctgaaagagcttgccggggacgtaaagctgtttgccgacagaatgggcttgaaggaggcatacgtcataggttggtccaccggcggcggagtggctttggagcttgcggctgccgagccgcaatttgtcaaagccgttttttccattgagggagcgagccacaagggatatcccatattcaaaaaagacgaaaagggtatgccgatagtaggcagtctttattcctctcccgacgaaatgggagaagaccccgttcaggtcaagcccgtgagtctagcctttgccgccaaaaactttcaggcgacggacgctctgtggaaagccaccatatacgttgtgaacaagccctctcagaaggacaacgaaatacttataaacgagaccatgaagcaggtttgtctcaacgagctggattggtcgcttgcaaacataaatatgtccgactcgcccaatttttatcagaagggcgacgacacaatcaaaaacgtcgtgtgcccctgcgcgttcacaagcggagagctggacatggtagttccgcgctacatggtcatggaaaacgtaaacgcggtgaaaaacagcaagctcttggcttacgaaaagtgcggacattcgccgcttgtcgattgccccgacagactgataaaggacataacggaattttttgcctga

SEQ ID NO: 700 - DNA, 573 bp, Subdoligranulum sp.
gtgtggactttttgctgttcacacttttttattttttcggaggtaaaggttatcaaagatttacagaccaacgagcaaatcagagacagagaggtgcggctcatcggttcggacggagcgcagctcggtatcatgtctgcgcgacaggcgcagcagattgcggatgacgctcatttggatttggttaaaatttcaccgaattctgttccgcccgtctgcaaagtgatggactacggcaagtatcgttacgagcagaacaagcgcgaaaaggaagccagaaaaaatcaaaaaatcgtggagctgaaagaaatcagactttcgatgacaatcgacgagggcgacattgccacaaaggcgaaaaacgccgtcaaatttttgaaggacggcgacaaagtcaaggtaagtctcaggatgagaggcagacaaatggcgtttgtgggcaacggaatcgaggtcgccaacagcttttacgaaaagataaaggactacgccacgatagaaaagaagcctttggcggaaggcagattcatcaccatggtgcttgctcctgtcgataacaaaaatacgaaataa

SEQ ID NO: 701 - DNA, 930 bp, Alistipes sp.
atgaaaaagatctcttatgctgagtctgaaagaatgtgtgaggctacattccttggctgtgatacctggtggcatctttacactgccgggaaaatgtcatcgatattgtttgttgacgatgacgattatcgttatgcgatgaatctgctggccagatgtcataaggaaaccggctccatcaccatcgtcgcctttgagattatgagcaatcatattcatatagtgttgtgtggaagtgaacataacgcaaggcatcttttcgatctttttcggcggagactctgccggtatctcacaaaaaagaacagcggcgcggatatgaaatcattccggatgagcctgaaatctgtctgtgatctgagaacactcagaaacacaatcgtctatgtgaaccgtaacgggtacgtcgtgaacccggcgtacactcctttctcttacccgtggggtacagggaggtattatttcaatgactttcctttggaaaaaaggctggaggatctgggctacattcaaacccggaaaatgttaagaagccgtagccctgaactgccgggagactatcttgtgattgaagggcatatcgctccgccttcatattgctccttgaaactgggaatgtctcttttccgcaatgcgcatcattatttctcaatggtcagcaagagcgtcgaggcttatggagagttggccgcggaattggatgatggtgagttcttgactgacacggagttgttcacacaggttgtcaaattgttgaaggccgattatggagccgtaaaggtgaaagatctgagtcccgcgcagaaacaagacttggcaaggaaacttcgttatgattaccattcgtccaacggccagataaggcgtactcttaatatgactcagtatgaggttgactctctgtttccgttaactgccggtggctcgtaa

SEQ ID NO: 702 - DNA, 354 bp, Alistipes sp.
atgtggagactgctgacactgtccgtcgcccagagccttctgctttccggaggccaggtccttctcaagttcgcccttgagaaaatgggaagtttcgagtggacgtgggcgtttttcggccgcctgctcgtgaactggtggtttctgggatgcggcctctgctacgccggcggcacggtcctgtggatgtacatcctcaagaggtttccgttcagtatggcctacccgatgatcagcctgagctatgtgttcggaatgctcgcggcgatattcatattccacgagaatattcccgcaacgaggtggatcggagtttttttgatcatcagcggctgcgtgttcatagctaagtga

SEQ ID NO: 703 - DNA, 744 bp, Alistipes sp.
gtgaaaaagatagcgttgatactttccgtctttctttccgcgcttaaccttatggccgcggagagggatagtctgtccgtctctgaaaaacgtggcccggacaggttgttcatgcctaagggagacttttccgctggtgtacagttcttctatgcggacttgtccagcactgacagtgaatatcttatgctgcttcagcatttggatgccaacggcactatgatgacgttgtcgcctttcctcgactacacttataaggacaataggtcagtcggggtgagggcgaaatattcatctgcgaaaggaggtgtctccaacgctgatctctcgatgctcagcgatgatctggcggtctctttgaatgacatacaggcggattctcgtacggtccaggccgaggtctttcatagagcctacgcctctttggacaagcgtggcaggataggagtgttcaccgatgtgtctctgggatattcctacacccgcacctcattctcctacaacgaggagagcctcgacagttacgccgcggcgaacagggtaaagatcgctgtccatccgggtctgatgatcttcgtgaccaacagcataagcacgcacgtggcgatcggcatcggcggagctacctacaaccacatcgactactacaagaacggagagattgtgggcacgagggatttctccaaggttcgtttcatgcttgacgtgcttgatatttctttcggactaagtttccatatttag

SEQ ID NO: 704 - DNA, 888 bp, Alistipes sp.
atgttaaagacaaatctgaagcttgtgtctgtcgcctttcttgccgtactgtctttccagtcgtgcaagtcggagtacgaggctcttctgaatggaagtgatgtggatgcgaaatatgccgccgcgttcggttatttcaatcatgggaagtacagcaaggccgcgcaactgtttgagtctctcgcggtcctgaccagcggaactgatcgtgacgacactgtccagtactattggggactgagcaattaccgcttcaaggactattacacggctgagaccaatttcacgaagttcataacgaatttcccacgcagcccgttcgccgaggaggcgtctttcctcaggatagactgtctttaccgttccacactccgttatgagttggatcaggttcctacctacaacgcgatcaatgtcatcagtcagtatatggtcgagaatcctggaaactcccacgccgcgatctgcaacaggatgctcaaggagttgaatgaccggttggacaagaaggcttacgaaaatgccagactctactacaggatggaggactacaaggccgccagagtcgctttcaggaatgtccttaaggatgacgcggagaatatctaccgtgaggacattctctattacatcgccaagtcttcctacaaatatgcttccctgagtgtcgagaacaagcagaaggaacgatatctgacttttgtggatgattattacaacttcatcggcgagttgccggactctccgtaccgtaaggaactggacgcgctctatcgccgttcgcagaaggctcttggacgttacacaggagctgacgaggatcttggaactaaggaaaaggactttgagagggacagaaaaaaattattgaaacaatccgctcaatag

SEQ ID NO: 705 - DNA, 879 bp, Alistipes sp.
atggcgtcaggtgaaaacagattgatacgtcgcaggctcgccggagcctggctgtccacggtgatcagcatcagtcttgtgctgctgcttgtcggcgtggcgggacttctggtggccaacgccagaagtgtctccgattatttcaaggagaacatgcaggtttccgtgctgatgaagcaggaggtcggcgatgatgaggcgatggaatatgtctccgatctggacgccaagcctttcatcaagagcaccacgttcgtgtcgcgggagcaaggggccaaagagatgacggatcttcttggcgaggatttcctcaatgtcttcgaggcggctccgattcctgtctcagtggatgtgaccctgaaggcggattacgtgtcgtcggacagtctggaggtcgtgaagaatgagatcatgaaatctcctttggtcgatgaggtggtctatcagcagtctcttgtggacaagctgaacaccaatctgcggaagatctccatggtgcttggtgttttcatcgtcctgcttctcttcatttccttcgtgctgatcaacaacactgtgagactgaatgtgttctctcgcaggttcacgatccacacgatgagacttgtcggcgccacgaagtctttcatccgcgccccgttcctggtccaggcggtgttccaggggcttttctcggctcttctggccaccttgatgcttgtcgggattctcttttttgtcagaagcgagttcgctcagcttttcgaggtgttcaggctggacatgcttctgattgtgatcggagtcgagattcttgccggcgtgctgatctgcgttgtcagcacggcgttggtcgtaggccgtcttgtctcgctctccaaagatgaactttattgctaa

SEQ ID NO: 706 - DNA, 603 bp, Alistipes sp.
atggcaagatatattggtccaagcactaagatcgcccgtaagttcggcgagcctatattcggaagcgataaggatttcgagaagagaaactatcctccgggacagcatggtctggcggcgaagcgcaagaagcagcgtgagtatggaatccagctcaaggaaaagcagaaggtaagatacatgtacggccttctcgagcgtcagttccacaacacctacctcaaggcttcaaagatggccggtctgagaggtgagaacctcctcctcctccttgagtcaagacttgacaatgttgtttacagaatgggcatcgctcctacaagagccgccgcgagacagcttgtcagccacgctcacatcacccttaacggtgaggtctgcaacatcccgtccgttcaggtgaagcctggcgatgtcgttgcggtgagagagcgctcaaagagccttgaggtcattcagaaaagtgttgcctcagcggcgaaatattcatggatcgagtttgaccctaaggcgctttcaggcaagttcctgaatctccctgcaagggcggacatccctgaaaacatcaacgaacagctcatcgtcgatctgtactctaagtaa

SEQ ID NO: 707 - DNA, 549 bp, Alistipes sp.
atgacaaagaatctcatcataccagccctgatgggcatggccgctcttgtctcttcttgcggcaagagcgaggtcgagaacgcctatacccagcaggacaagaacatcgaatctctggtcaaatcccttgctccggaagaatccgaggcgacggtcgattatcttgacggcgtcgtaagggtcaccgtgaagcacggagaaggggccgcgcttgagagcggcggaaccgtgtccttctactatgcgggacactgcatcaacagttccagcctcagttccgggaatatgttcgtgaccaacagcaaagaattcgccgaatcctacaactggacggtgaccgactccaccatctttcaggtcagcacggtcgatctcgcgaaggacaaccttgtcaaaggcctgaaaaaaggcatcgtaggggtcaaggccggagatgaatgttacatcatgttcaacggaaagtacggattcgggaagcacacgaacggaaccgtgccaggaaattcggctttggcctatcatttgtggataagcagcgtctcgaattaa

SEQ ID NO: 708 - DNA, 786 bp, Alistipes sp.
atggaaaagatcaacgtttcaggcaataggttcagtactgacataacgatcccgtgctacgatacggacgcatcgttccgcctgaagccggccgcgtttatggatcacgcccaggaaatggcgtatctggcggcccaggcgcttcatttcggctatgacgaccttcagaggcatcacacggcctgggttctgtcacggatgcggatggattttctgaaccctccgaaatggacggacgagacgaccctctacacttggcacaagggacaggacggcctgttcttcctgcgtgacttcgagctccgaaggaagggcgacacggacttcgccgacaaatcaaaggcgcaggtgctttgcacctcttcgtggatagtgatgaatgtcgagacccggcggctggtgcgcagcgatgaggttctgaatatggtcccggcgaccacccagtgccctgacaatgcgatccagatcccttgcggcaaggtcgtgatgcctaagaatatccccgcggaggaagtcggctgccacaaggcggcatattcagacatcgatgtgctggggcacaccaacaatgcccgctacgtggtctgggctatggactgcattgactatgaggaggtcgccggcaaccctatcaggagcataagcatcaacttcatcaaggagacgaagcctggggaggttgtcaggatattcagaagtgttgaggatattgacggacaaaagaaatatttcatagaaggtaaaattgaagacaaaccgtgcttttgcgcgcggatagatttttaa

SEQ ID NO: 709 - DNA, 597 bp, Alistipes sp.
atgagcaacagagtattgatcttctccgccccgtcggggtccggcaaaagcacgatagtcaaccatattcttggaatatacaaggatcagatggagttctcgatctccgccacctcaagggctccgcgcggcgccgagcgggacggcaaggaatatcacttcgtcaccccggagaagttccgcgagctgattgccaaggactctttcgttgaatatgaggaagtttacgaggatcatttctacgggactctcaagtctgaggtcgaaagaatatgggcggccggccacgtcatcatattcgatgtcgatgtgaagggaggagtcaatctcaagaaatatttcggagacaaggctctgtccatattcgttcaggctccgtccgtggaggctctaagggaaaggctcgtcaaaagaggaaccgactccccggaggccatcgaggagcgtgtcgccaaggcggccgaggagatgacctacgctccgaaattcgactatgtgcttgtcaacgatgacctaaagaccgcgttcgccgaggtggaaaaggtcgtcgaggactttcttgacgatggaaagctgaactactcaacattcatctaa

SEQ ID NO: 710 - DNA, 1341 bp, Alistipes sp.
atggcgaacaaactttgggacaaaggattcaaggaggacgagaggatcgacgcgttcacggtgggaaatgaccgtgagctggatcacgagctcgccccttacgacataatgggcactatggcccacatcacgatgctggagagcgtcgggcttctctccaaagaggatctcgacaagcttctgccggtgcttaaggaactatattcatccgcctgcaagggagagctttacgtggaggaggatgtggaggacatccattcgcagatcgagcttatgctcacgcgcagacttggggatgtcggaaagaaagtccacacgggacgttcccgcaacgaccaggtgctggtggacttgaaactctacgccagagcggagattgagaataccgtgcataaggtcgagtcgcttttcaatacacttcaggaggccagcgagaggtacaaggatgtgctgattccaggctatacccaccttcaggtggcgatgccgtcctcgttcgggctttggttcggggcctacgccgagagcctttgcgatgacctcagcataatgaaggccgcctgggatgtggtgaacctcaatccgttgggatccgcagccggctacggctcgtcagcgccgctgaacaggactctgacgacggtgctgcttggtttcgaggacttggactacaattcagtatatgcgcagatgacccggggaaagatggagcgggctgtcgcgttcgcatattcctcagtcgctgagaccgtcgggaggctcgcgatggacggatgcctgttttcaagccagaacttcgggttcatccatctgccagacgcactgaccacaggttccagcatcatgccgcacaagaagaatccggatgtgttcgagctggtgagggcacactgcaacaagctccagggcgtgccgaacaccatccggctcatcatcggcaacctgccgagcggctatttccgggatatgcagatcctaaaggaagtcttcttccctatattcaaagaaatgaacgactgcctcgacattgttgaatatgcagtccgcgggatggaggttgtcaccgatgtgatggacgatcctaagtacaggctggcgttcagcgtggaggaggtcaatcacctggtggagaacggggtgccgttcagggatgcctaccgtcaggtcgcggattcaatcagacaagggacttttgaatatcacggagaactccaccacacccatgaaggttccataggcaacctctgcaacgaccgcatcgccgccaagatgtcccgcatcatctccgggttcggcttcggggaagttcacgcggcggtcacgaagctgactgaaggataa

SEQ ID NO: 711 - DNA, 1074 bp, Alistipes sp.
atgaaatgcaatataatatttgtaattttgcagacagcaatgaaagacatcacagttttagacagactgacgggtggttcatcccgcgtcaccatcgtcgtccacacccatccggacggggatgcggtcggaagcggaaccgccatgttgggttatctgacagacataaagcgcaagaacgccgcgctgatcgtaccggacagcgtcccggactccatctccttcatcacgaaaggattcgagcccggaagtgtcatcgtgttcgaggatgagaggctgaaagcggaggaatggatcaattcctgtgacctgatcatctgtctggactgcaattcattctccaggacagcggacatggagactctcctgaggaaatccacggcccgtaaggttctgatcgaccatcatctgaaccctgagacagcatcctttgacctgacgttctcaaaggaagggatatcctcggccagcgagcttctgttctggatcctgatggagacgccggagatcgaaggagacgcgtctcgtctgccggcaagatgcgccgcctccctgcttaccggaatgacgactgacacgaacaacttctcgaactctgtctttccaagcacgttcgagatggcctcaagactgatcgaagccggagtggaccgtgacgccatactcgtcagcctgtacaacaactacagggagaaccgcctgaggctcatggggttccttatgagcgaaaagctcacgatcaccccgcgcggcgtcgctttcatcatcctggacaaggagacccaggacaggtttgacttcaaaagaggcgaaagcgaaggcttcgtgaacatgccgttgtctgtggcggaggtgcgcatgagcatattcctgacccaggaggacgacatattcaaagtgtccatccgctcaaagaagggagtctcggcgaatgactgcgccgcaagatacttcaacggcggcggacatgagcaggcggccggaggaaagctcaccgccgggaaagacctggcctccctcaaggacgccgaggcatacatcttgaaagtaacgaatgagttttttggaatatga

SEQ ID NO: 712 - DNA, 945 bp, Alistipes sp.
atgaatatgaaaggatatattcttttggcgtcattgctgcttcctgcggcgctgatggcgcagccggcgacctccggacagtacacttacaccggagcgcccgttaaccttaccgagcacacgttcaagtgcgaccatctgctcaagcttcagggcaccgacaaggaggcttaccaggggatggacatctggggagactacatcttcagctgccagaactccggttggctgaccgtctataagattgacggagagaagatcaccagagagtgcaagccgttcaagcttgccagctacgacaaggtgaaccatgccaatgtcgccactttcggccgcacgttctatgacaaggatgaccgtttcccgcttctgtacgtcagccagtgcaacaggaatccgatcaacggacgcaaggacgtgctttacgtcgagcgtgtagccaatgatctcaagtcatccgaactggtccagacgatctacttcaaggacaccgaccatctttttggctacgcccttcagtgggtcatcgatccggacaacaattacctttacggttacggcaacacagttgacaacaccaacgccctgaaccgtcaccgcatcgtgaagttccgcatcccgaaactgaacgagtccacggacggcctcgtgaccctgacaaaggatgatttgttggagaattatctgatcgaggacacctaccagactcatttcaatccgatcggccagggcctcttcatcaagaacggccagcttttcatgcctaccggtttcggcaaggagaagcagccttcgatcctctacgtctggaatctgaacacccgcaccatgcagaatgtcatcgatttgacgaaagccaccttcggtgagctcgaggactgcgcctactacaagggcgacctctacatccaggcccagggcgatctgttcaggctcactttctga

SEQ ID NO: 713 - DNA, 588 bp, Alistipes sp.
ttgtctgaagcctttttcggtatccagggagggaggattaaacaaaaagatatggacatattcgagaaatacgagagtgacctggtcgataggcttgtggaactgagtacggccagaggactgctggacggaatgcttctgagcactcctgacatcacggccagatgggaaccgatagccttggaatattccggtgacgctgtcagggagttcaacggttatcccgaggtggtgctggcctggaccgcctacatcggaatggccgtcgcctgctggtgggacaaggattggatccggtacaaagaccaaggatattcatcactggtcggctccagaggattcgatgacctggatgagcacgtgaccagggatattcttaaacatcctttgaattcgaaggaagccgccgggatagcgaagaacctcgcctttttggccggggaggcatattcatttatgatgaggcagggagtcgagccgcagagcgttgaggcgttcaatgtcttccgacacacgctttccgctatgtaccgtgtcggcgcggcactggaactcaaggccttgcgttacaagatggagaagatttag

SEQ ID NO: 714 - DNA, 471 bp, Alistipes sp.
atgaaatattttatcagagctgtcaaatactttttctacttcaccatcctgtttgtggtcataatggcggcgctcgtgttcatcggagtcgtcaaggctgatgtcagcctaatgttccgcgatggctataagtcgctgtggcagatagccttgctattcgctttcgtttcagccttctacccaagattcggtttcatcaaaagatcagtcatattaaaaggtgaatattccgacctccgtggcgggattattgaatatatggagatgcgcggctaccgcctcgaaagcgaggatggcgagaatatgacattccgcctccgctccaagttcagcgccctcttcaagatgttcgaggatcggatcacaatgacccgcgagcttggcggcttcgaggtggaaggcctgaccaaagaagtggtgcggattgtcggcggactggagtacaaattccgggtgctggacgaggagtaa

SEQ ID NO: 715 - DNA, 531 bp, Alistipes sp.
ttaaaaggatctccatcttcaaggatggagatcaaggagaatcaaagaaaaagtaaacaattaatattcaggaatatgataacaaacatcgcattggtggctcatgactcaaggaagcaggaacttttggattgggtacgttacaacgctggttccctcaaacattgccatctgttctgcaccggcacgaccggccgtcttgtttccgaggcgctgacagagaaacttggacctgaggctccgtctgtcgtgtgcatgctcagcgggccgctcggcggtgatttcgagatcggtggcatgatagccgagggaaagatcgacatgttggtattcttctgtgacaacctcatcatgcaggggcatcagaacgatgtgatgggcctgacccgtctcgcgtccttgtacaacatcccgttcgcaaccaaccgcagcaccgctgacttcatcatctcctcccctctctacaccagcgagcactacaagcgcataattccaaactgcatcgactcttacaaaaaccgcaagttataa

SEQ ID NO: 716 - DNA, 801 bp, Alistipes sp.
atgaatatgaaaaagatcgttaaagttgcggcggtgggtgcattggttgcgctggccgcttcgtgcgctccgcagaagatcgcggtgacggcgcacagaggattttggaactgcgaggaggccgggtacgccgagaactccatcaaatcgcttgaactggcgcagcagaacgggttgtggggcagcgagttcgatgttcacatcacttccgacctcgttatgctcgtgcatcacgatccggacatcgacgggatgcgcatctggaatcacgactacgctgatttcaaggactgccgcctgaagaacggcgagaagatcccgactctggacgagtatctggcacagggagagaagagcaagaagaccgtgctggtgttcgagctcaagaagcagattgacaaggctcacgaggactatatggtcgaccagagcgtcaaggctctcaaggagcacggtttgtacaaccctaagcgtgtgattttcatctcattcagtctgaatatgtgcgagaggctcgccgccctctgccctggattcacggttcagtacctggacaaggacaagagccctgaggaactcgccaagctcggaatcaacggtgttgactaccagtacaaggtcttcggaaagaacccgacatggttcaagcaggcccgcgacaacaagatgagcatcaactgctggaccgtcaacaaggagaaggacatccaggatatgatcgatctcggtgtcgattgcatcacgaccaacgagccgctcctcgtccgcgagaagctcggcaagagggaaaaggtgaagtaa

SEQ ID NO: 717 - DNA, 366 bp, Alistipes sp.
atgatacagcaggaaacacgtttacaggttgccgacaacagcggtgcaaaggaggtcctctgcatccgtgtgcttggcggtacgcatcatagatatgcgacagtgggcgaccagatcgtagtcgcgatcaagagcgctcttcctggcggcgacgctaagaagggttcggtctccaaggctgtcgttgtccgtacaaagaaagaaatccgcagaccggacggatcatacatccgtttcgatgacaacgcgtgcgttcttctgaacaacgcgggcgagcttcgcggaacacgtatcttcggccctgtggccagagagctgcgtgagaactatatgaagattgtttcactggctccggaggtcctttaa

SEQ ID NO: 718 - DNA, 858 bp, Alistipes sp.
atgtctgatgaactgaatatactgctgacaaacgacgatggttatcaggctggtggcatacattcgctggctgacatgatgcgtcaatttggcagaatcacggcagtcgcgccgaaattccaccagtccgggatgtcaatggcggtctcgatgggtggcagggcgatcgcctacaaggaactcccgacggaggatggagtgcgttggtcctacctcgatgccactccggcaagttgcgtgaagtatggcctggacgagatcttctggcctcagaagccggatgtcgtggtctgcggaatcaaccacggctccaacgctgccaccgcggcgaactattccggaaccctcggcgcggcggaggaggccgccctgaacggaatattaggcatcggagtctcgctcgacactatgagcctggacgcggacttctccgttgtcaatgaatatttccccggcatattcagaaaactttgggcgtgtcataacccgaagtcaggaatatattataatgtcaattttccgaatattccggcatcggctgtcaaaggcatccgtgtgggacatcaggggctggggcattgggagaaggagttcaagccttgggacgctgagcttttcgccaaaagaggagtccgtccggaggatctggggcacacgtcattcccgaaggccgaggagggggagaccctttacatgatggtcggggaatttaaggacgattcgccggtggatgacattctggccgatcatcacatcctcgccgacgggtacatctccattgtcgcccacaacatcaacagttcggaccacgaggagatcgccaggttgaacggacttgggttcaatgaagatttttaa

SEQ ID NO: 719 - DNA, 450 bp, Alistipes sp.
atggaaagaaacaacaaggctccgacaatcgaatacttccgtgaactacttagaaaaaacggactgaaagtgacaccacagagaatcgccgtacatgaggcgatgcttaggcttggacacgcctgcgctgacatggtcacggcggaaatccttgcggcgaaaaagacgaaggtcactgtcgcctccgtctataacatcctgacccagctttctcttttgggaatataccaccacaggatgagcgagaacaacaagatgtatttcgacgtcaacactttcaagcattttcatctttatgacacgatgaaccacactttctcagatgtgattgacgacgagctctatcagcagatcgagggcaagcttctcgaacgccgcttcaaaggctacaagattgacggaatcgacgtgcagattctggcgcacccttccgtgaaagggaagaaataa

SEQ ID NO: 720 - DNA, 855 bp, Alistipes sp.
atggaaaatattgataacgagacagtaaaatttgactgtaaccgtggctgcacaatctcccaggatcaggagaccggggaatatgactgcaattaccgtcagggttgctgtaaactcaaggattacgactggcttcacggcatccggcaggagcagtacaaagatcttttcgaggtgcgcttcaagaacaccagaaaggggatttacgtcaacgcttccggacaggggatcaaggccggggatctggtcatagtcgaggccatgaatggtcatgaccttggaatcgtcactttggaaggcccgattgtgggacgtcagatgaagtgtaagggtgttgatcctgagacaacacagttgaaaaagatctaccgcaaggccaagcctttcgacatcgccaaatggcaggaagccatagcccgtgagcaggacaccatgattcaggcgcgcaggatcgccgccgagcttggtctggacatgaagatcggagacgtggagtttcagggtgacggcacaaaggccattttctattacatcgccgacgggcgtgtggatttccgccaactgatcaaggtctatgcggaggaattccgcatcaggatcgagatgaagcagatcggggcacgtcaggaggccggtctgatcggtggcctcggagtatgcggacgggaattgtgctgcgccaatttcattacgaatttccagtcgatctccacttcggcggcccgtacgcaggacctgtccctgaatccgcagaagctggctggtcagtgcggcaaactgaaatgctgcctgaattatgaggtcgccaactatctggacgcccagtcccatattcctaaggttacggaaccgctt

SEQ ID NO: 721 - DNA, 660 bp, Alistipes sp.
atgtcaaaatacagaaagcttgagaccttgacggcgatgaaagagacgggaatagtcccggtcttcttcaacaataatgtggaaatcgcccaaaacgttgtcaaggcctgctatgaaggcggcatcagggcctttgagttcacaaaccgcggagacttcgcgatcgaggttttcaaggagttgtccaagttcgttttggccgagtgccccgggcttatcctcggtgcgggaaccattctggacactccaacggcagctctatacattcagatgggcgcgaacttcatcgtgtcaccgtctctgaacccggaggtcgccagactgtgcaacagacacgggattccttacacccctggatgcggaagcgtcaccgagatctgcaacgcgcaggaactcggctgtgacctcgtgaaggtcttccctgccggaagcgtaggcggaccgaagttcgtaaaggacgttctcgcacctctgccttggtctatgatcatggccacaggaagtgtggagccgaccgaggagaatctctcggcctgggccaaatccggagtcacctgcgtcgggatgggctctaaactgttcccgaaagagatgatcgcggccggagaatggtcaaaaatcaccgatttgtgcagatcagcgctgaaatttttcaaataa

SEQ ID NO: 722 - DNA, 909 bp, Alistipes sp.
ttggccttgctttcctttgtcctaaccatattcctttttcaaaataaggctgcaaagatagcatttttcttttttgtatatgttcctaaccgtcactccgcttcctggaatattcatagatggttttcttttgctatttttgcagggaaaatgagacaattcgtgatcaggccgctgaacgcggcgggacatattacggctcagccgatgcataggatggtcagggaagactggtcgtttatctatcttatttccggagaggtgcttgcggatgtcgatggccatccctatctgttgcgggggcaggattgcgccttgatcccgccgcagtcggcatattccgtgaaatatttcaaggattccatcgggtatatgggagcgttctcttccgggctgctgcgtaattccggacatagggtgctgagactcagggcgccgagtgtgatgactgttccgatggaggacaaggttttcttcgatgagcttctgatcagaatgacccggttctcggaagattttcctacgattcaaggattgctggaagtcttgcttggagagtttgacaacgtcattcctcagaacaacggaaccgcgtcagccagactttgctccgcatatcttggccgggtctttgacacttcacgtccgttcggcggagtgtccggctatgcggaggaactgggcgtgactcctaaccatctgaaccgtgtcgtcaagtccgagacagggcgcagtgcgggagagtggatagagaacgcgcgtcttgctttggccagaacccttctccatgatcatggcatcccgatctcagaagtatcctacaggcttggcttcgaggatccagcctacttttcgcgcttcttcagaaaactggtcggaatgtcaccgactgatttcagaggcatgtaa

SEQ ID NO: 723 - DNA, 627 bp, Alistipes sp.
atgttagtgataggaatagccggaggctccggttcaggaaaaaccacggtggtcaacgcgataaccgagaagttgaaggaaagagtggttgtgatccctcaggactcctactacaaggactccagccaccttccgatggaggtcaggcagcagatcaactttgaccatccggacgcgatcgacttcaagctcctctgcgatcaactcaaggatctcaagaacgggaaggccatcgaacagccggtatattcctacatcacttgctcaagatcaaagacggagacagtcacggtcgagcctgcggaggttatcatcatcgaggggattcttgtgttcacctgtaaggaattacgggaccagatggacatcaagatattcgttgacgccgatgacgacgacagattgatgagagtcatggcaagggatattctcgaaaggggaaagacggtggagaccgtgatcgagaggtacaccaagaccgtcaagccgatgtatctccagttcatcgagccgagcaagcgctatgctgacatcatcatcccgcagggaggacataacaaagtcgccatagacatcatctccgcgacgatcgagaaatcactgagagaacaggaggaggcgaaataa

SEQ ID NO: 724 - DNA, 1224 bp, Alistipes sp.
atgaagaatttcagtacaaagaaaaggttgctggcgtcagtcgcgccggcccttgcggtgttcgccgccttgttttcatccgcttgcgaccgggtggaacaagcggaactgtctcccgccgatccgatctccatggtggatccggctactgatctgtcggccgaaagcgtcgcaagaatgctctccgggttgcctctcacgttgacccaggtccgtgaagtcttcgatggtgtggtctcctcgtcttccaatggctatgatgaggaatatcctttcgcgaatctgcttgcgtctccgggttccggagtcgggcacgaactgcttcagacaagatccgtgactgaatatccagaacctttgcgtgatcttttgtccgccgcggacatcgctcagaccagggcgggttctttcttggacgctctttccgcatccgggttgcagatctattggccatattcagaggactgggacgggaaggcaatgcctgtcatcactttcaatccggaggagtcttccggcgatgcttatctcaggcggcaggatgactctaatgtaggtttccttagggagcaactcccgaacggggcttggatcgtaaaggaagtcactgtggatgaggaatatgcccgcaatcatcctgtatgggtcataaacaggaatgaggatgccgcatatcttactcctcagatgctggacgcgctttatccggagaggacagtggcaatggcagtctccacaaggtcttacgaagattgccggacattggtcctcaaagaattcaaggctcatcgaaactatgattcatggttggcaggtggctcggagttcttcgttaagtgcggctctttgaatgggttcacggccaagactgaggaggagttgaagctttacagcccgtccgtcaccgacatgatgatcaacgtgaaacgcaagaatgtgggcaaaacgttgagattcaacaccgtgcttgtgtcggaatggacatcgcagcttgaggagtgcgtgttcctgatgatcgaggatgatggcggcaagcagacttcatggaaggccagcggcttggtgaagatcaaatccaagtcttatggattcgaggtcgaacttcctttccgtcgtaatgatgacctcgtctggcgcggaaaactctccaacaactatttcgagaagtacaacggtaagccaaaccgcttcggtgacgtcagcatcaccttcagcttcctgtaa

SEQ ID NO: 725 - DNA, 714 bp, Alistipes sp.
gtgtggcgacgcacggttttggactttcaggagaaacgcaagaagttttggattatgatcattcaggctaagggtatagaaaaatctttcgggaatcttagggttcttaaaggagtcgattttcaggttgataaatcagaagtcgtgtcgattatgggcgcgtcaggcgcgggaaagtccacattgcttcagattttgggcacattgtccacacctgactccggctctctggagattgacgggactgacgtgctgcatctgagcggcaaggacctttcggctttccggaaccgccgcatcgggttcgttttccagttccatcaccttttgcctgagttcaacgccctggagaacgtgatgatcccggccttcatcgccggacgttcggacaaggatgccaaggccgccgccaccgcactcctgaaggatatggggcttggagagaggatggagcacaagccgtccgagctttccggaggcgagcagcagagggtcgccatagccagagcccttgtgaatgagccggcgatcctgttcgccgatgagccatccggcaatctggactcgaagaccaaggccgagatccaccagctgttcttcgatctgaggcagcgctacggccagacgattgtcattgtgacacacgatcctgacctcgcgcggatgtgtgacaggtccctgtttatgcgtgacgggcagttcgttgaggaatag

SEQ ID NO: 726 - DNA, 1128 bp, Unknown
  Description of Unknown: Clostridiales sequence
atgatagggcggcaagtaaggcggtatctagcaggcgccatcgccatcctgtccctatgggccgctctgcccgccctagcagatcaacagccggtatccagcgcagcgggggccatcttaatggaagccaccacagggaaggtactgtatgcgaaaaacgcccatcagcagttgcccatggctagcaccacaaagattatgacggcattgctggccattgagcatggggatttagacgagatggtcaccaccgatgccagcgcctatggggttgagggttccagcatgtatttgcagctggaggagacggtgagcctgcgggatctactctatgggctcatgttggcttccggaaacgatgctgccgtggccattgcggtgcatatcggccatggcgtggcgcagtttgccaacatgatgaaccagcgagctaaggccctgggcgcgtttaacaccaattttgtcacccccaacggtttaccggacccagaccattatacgacggcctacgatctagcttgcatcgcggcggcggccatgcaaaatcccacctttcgggagatcgtatccacccaatattatcgaaccagcacgggggctgtgcccaggacatttaaaaacaagaacaagatcctatggaattacgaggggggaaacgggatcaaaactggctataccaaggctgccggccggtgcctggtgtttgcggcggaacgggacgggatgcagctggtgggggtgttgctcaattgcagcgatatgttcgaggaagcggaaatgctgttggattacggcatggagcattatgaaatgacgccgttggtaagaggcgggcaagccattgccaacgtatatgtggcggatgggatgaaaaaccggttggcactttgcccgggggaagatataatggtacctgtggaaaaggatgggagcagcttatataagacccgggtgctgctaccagatgggctaacggctcccataaccgcagggcagacttgcggggaggtggaggtcctggaagaagacgggaccctgcgggccaaatttgacctgctcgccatggaggacgtggaccaggccacagtaggcttctatataaagaagctattccgcaacatgacatag

SEQ ID NO: 727 - DNA, 1338 bp, Unknown
  Description of Unknown: Clostridiales sequence
atgttaaaggtaaccaagtttggtggtagctccctggcagatgcccgtcagttccaaaaggtgaaggatatcgtacaggcggacggcagaagggtcgtggtagtggtctccgcccccggcaagcggttcccggaggataacaagatcacggacctattgtatctgtgccatgcccacttgaaatatggggtctcctatgacggcatcttttccatgatcgaggaccggttcctggagatccaaaatgaattggggctggatgtggatctaaaaggggaatttgccaagatccgggccaatatgcataaaaacatgtccatcgactatctggtctcccggggggaatacctgacgggaaagctgatggccgcctatttgggctatgattttgtggacgccacagaatgggtagcctttggctacgacggcaagctggatatggagaagagccaggccaatctggcggccatgtttggggaaaagtctaaggtggtgttgcctggcttctatggggcgctgccggacggtaaggtgcgggtcatgagccgggggggaagcgacatcaccggcgccctggccgctgctgccattgacgcaggcgtttatgaaaactggacagatgtttccggcatcctgatggcagatccccggatcgtagacaatccacggccgattgcccatattacgtacagcgaattgcgggaattatcctatatgggagccaacgtgctccatgaggagaccattttcccagtgcgtatcaaggacattcccatcaacatccgcaataccaacgatccccaagcccccggcaccctgatccaggagagcttttccaaggagacccgggaggaacgcaaacggttcattacgggaatatccggccgcaaggatttttctatcctcaccctgcgcaagggccatttggccgcggataccggcaccattcgtggggtattggctatttttgaaaaatacaacgtgcccatcgaacatttccccagcggcattgatagcttttccctggtggtctctacggaaaagattaaatcttgtatttatgatataataggggagatcaaggacctgttccaaccggattccatcaccgtaacggacaacatcgccctgatcgccacggtgggccggaaaatggcctttatccccggcgtcagcggcaaggtgttcggtaccctaggggccaacgatatcaacatccgcatgattgcccagggccccgatgagatcaacatcatcgtaggggtggaaaaccaggactttgaaaagactattcgcgttttgtacgatagctttattgtaggagggaaagaggaatga

SEQ ID NO: 728 - DNA, 2031 bp, Unknown
  Description of Unknown: Clostridiales sequence
ttgaaaaaaaatctttccaccccgctgatctacctggtgctgctggtggtcatcatcgcgctggtgtccggctttgacccccgggggaattcggcggaagaggtgagctataacgactttatccagctggtgcgggaggaaaaggtggcctatgtggacatcacggacctgcagctggttggtttatacgtcgatagcgaattgtcccaggaaactttcccggccaagtatgatttctatacctacatcccctccctggaagcttaccgggaggatatgaccatcctcaccgaggagctcaagggcatcccccgggatcaggtgaccaacgcggacttccccgtggaatccatggccaaccccacccccaagccctccatctgggaagggttgcttccctatgtgctcatgatcggcgcgctggcggtgctgtattatttcatgttccgctcccagggcggcggcaacagcgtgatgaacttcggcaagagccgggcccgcacccagatggaccctggcaaaaaggtcacctttgccgacgtggccggcgcagatgaggaaaaggaagaactgcgggaagtggtggagtttatgcgctcccccaaacgcttcacggaaatgggcgcccgtatccccaagggcgtgctgctggtgggcccgccaggcaccggtaagaccttgctggccaaggcggtggccggggaagccggcgcacccttcttctccatttcgggttccgactttgtggagatgttcgtgggcgtgggcgccagccgggtgcgggatctgttcagcaccgccaagaaatgcgcacctgccgtggtattcatcgatgagatcgacgcggtgggccgccagcggggcgccggcctgggcggcggccacgatgagcgggaacagaccttgaaccagctcctggtggaaatggacggctttgccatcaacgagggcatcatcgtattggccgccaccaaccggccggatatcctggaccccgccctgttgcggcccggccggttcgaccggcagatcaccgtaaactatcccgacgtaaagggccgggaggagatcctcaaggtccacgccaagggcaagcccctggcggaggacgtgtccctggcggtgctggccaagcggaccagcggctttaccggggcggatctggaaaacgtattgaacgaggcggccatcctggcggcccgctataagaaaaagaagatcaccatgctggagctggaggaggccatcacccggacggtggtgggcccggaaaagaagagccgggtggtcacggacgaggataaaaaggtcaccgcttaccatgaggcgggccatgccatcgtggcgctgaaaatgccccattgcgacccggtacacgaggtttccatcatcccccggggcgctgcggccggctataccatgaccatgccggatacggacgacaaccatgtctcccggggcaagatcctggatgagatctgcatgtgcatgggcggccgggtggccgaaagcatcgccttggacgacgtatgtaccggcgccatcggcgacctgaagcgggccagcgagctggcccggcgcatggtgatcgagttcggcatgagcgacgccattggcccggtgttcctgggcggggacacggaggtgttcatcgccaaggattggggccatcagcggaactattccgaggaagtagccgccaaggtggacgcggaaatgcgccgcatcctggaggaacaattcgaccgggccaaggctgtgctggaagaaaatcgggaggccatggatcgggtggtgaaggccctgctggagtacgagcgcatcgatggggatcagttcatcaagatcttcaatggggaatccatcgagatccgcagctacaaggaccgcaaggcggacctggaaaagccggatgaagaggtcctggcccaggagcaggctcaagccgctgcccaggagccacaagtcccccccacggctccggaacagcctgcgcaaccggaacagcccgaacagccggacgagaaataa

SEQ ID NO: 729 - DNA, 1920 bp, Unknown
  Description of Unknown: Clostridiales sequence
atgcaaaagatccaggtattaagccaacagatcgccaaccagatcgctgccggcgaggtggtggaacggccagcttccattgtgaaggagctggtggaaaacgccatcgacgcaggcgctaccaccatcacggtggagatccaagagggcgggatatcctatttgcgggtaacggacaatggcgccggtatcgaagccgaccaggtgcccgtggcctttttacgccatgccaccagcaagatcgccagcgcggcggatctggaccagatccagactttgggattccggggggaagccttggcgtccattgcagcggtatctaaggtatctttgaccacccgtacccagcaggcggaatccggcaccaacatcgtgatccatgggggcgaggtgcgctcctgccaaccggccgcctgcgccgggggcaccagcattgaggtagaggacgtattttataacgtgcccgcccgcaggaagtttttgaaaagccagcgggcggaagccgctgccattggggatctattgtcccgcatcatcctggccaagccccatatttcctttcgcttcctaaacagcggcaagcaggtctaccaaagcgccggggacggccagctaaaacatgccatacactgcgtatacggcagcgaggtgctggccaaccttcggcctgtcagctaccgctacggccaactggaggtttccggctttgtaggcaccgagcagctagcccggcccaaccgcttgcaccaatccctgtttgtgaacggccggtatattcgttcccagcggatctcttttgcggtgcagcgggcctttgagacccggctcatgagcggaaagttccccttctatgtgctggatctcagcatcccctgggaagccgtggatgtgaacgtgcatccccaaaagatggaagtccgttttaaggacgaagagcaggtattccgggctgtgaccgttgccacccgcatggccctgggggataccgttgcccccttggttcgggaaacggacgtagcccccttccgcaaaatggtcagccatttccccgaagaaaacaaggagaagccaacccccggctctgccttttccaccatgtccaccgcagagctgaaggaattgcaggaaaagctgggaacagctcgtaccacctcccaattcgatgggttattaggggaaccgggggtgtcccaagaatggcgacgggaggctttgcccatactttcgccaaagggatatgccaacgaaccagcgtcccaatccccggtgacgcctgcgccccagcaggaggtccttccgccagaaccggcagagccgcctgtccaggaagctatggactttggcattgcgccctatcgggtggtggggcaattattcgaatgctactgggcggtacagcagggggatcgggtattcttcatcgatcagcacgcagcccatgagcgtaggctgtatgaatccctcatggccggccaactggccggcgcgtcccagatgctgttgctgcccatccaggtcaaacttcagccgggccccttcgccctgctgctggataacctagctgcctttgaggagctgggattccagctccaggagtttggcgcccttaccgtgcggatcttggcagtcccttcctttatgggagaaggggcggatgctggagacttccttcgggaggcgttggcgtatctggaacgccaaggcagcgtgcgggcgacggatcttaagcgaggcgcccttatccagatggcctgcaaacatgccgtcaaggcgggggataggctggcgccggatgagatcgaggcgttgttggcccaatatgcggcccaaggggttcccatgacttgcccccatggcaggccggtgatggtccagatgacccggttggaatttgaaaagctctttaagcgggtattataa

SEQ ID NO: 730 - DNA, 975 bp, Unknown
  Description of Unknown: Clostridiales sequence
atgcaagaaaccttatctatgacctccagctgggataaaacctttcccaaaagcgaaacggtggcccacgaaaagatcacctttcacaaccgttatggcattgcgctggcagccgacctatatcgtcccaaaggggcggacggaacactgcccgccatcgccataagcggcccctttggggctgtgaaggaacaggcttccggcctatatgcccaagaattggcacagcgaggctttctgaccattgcctttgatccctcctataccggcgagagcggcggctacccccgttatgtggcctccccagatatcaataccgaggacttttgcgccgcggtggactgcctttgcgtgcgaccggacgttgacccggagggaatcgggatcttgggcgttggcggctggggcggcatggccctgaacgccgccgccgtggacactcgcatcaaagccaccgtggcctccaccatgtacgacatgacccgggtcaacgccaaaggttattttgacagcgaggacagcccacaggcccgctatgaaaagcgcaaggccatgtgtgaccagcggaccatcgactatcgaaacggcagctatgccttggcgggcggcgtgccggactccctcccccaggacgcccctgccttcctgaaggattattatgcctattataaaacgccccgcgggtatcatccccgctccctgaattccaatgggggctggaacatcacctccgccctgtctttcctcaatatgcccatcctccaatacagcagcgagatccgttccgccgttctgatggtgcatggagaaaaggcccattcctgttactttagtaaggatgcctttgctaagctgaccggagataacaaggaactgctgctgatccccggggctagccataccgatctgtacgatcgaagagacatgatcccctttgaccggatcgcaactttcttcttacaatatctgcaataa

SEQ ID NO: 731 - DNA, 1302 bp, Unknown
  Description of Unknown: Clostridiales sequence
atgaaggtaggcatggtttccctaggatgctccaaaaaccgggtggacagcgaatatattctggcagccttgaccaatcaaggctttaccatcaccgccgacccaaaggaagcggaggtgattttggtaaacacctgcggctttatcgatcccgccaaggaggaatccatcaacaccatcctggagatggccgcctataaggagaccggccgctgcaagttgctggtgggaacgggctgcttgacccagcggtatgaaaaggagctgcgggaggagctgcccgagctggatctgctttggggggtcaaggacccccaggggctggcgcggaaggtggcggaaatggccggcctaccccagccgcaaccccctggctgctgtccccgcattttgaccaccccgcggtattctgcctacctgcgcattgcagacggatgtgacaatcgttgcgcctattgcgccatccccttgatccgcggcccgcgcaagagcgtgcccatggaggatgtgctggcggaagccaggcgcttggcggagggcggcgtggtggagcttacggtgatcgctcaggatacctccgcttatggcagcgacctttacggcaagcccatgctgcgggagctgctattggagctgtgcaaggttcccggccttcattggatccgggtgctgtatacttatcccaatacggtggacaccgacctgatcgacgccatggtacgggagccaaagctggtaccctatctggatatgcccatccagcatattgcgccggatattcttcggcgcatgaaccgccatggtactgcggcgcatatccgggagatggcggcttacgcacgaaacgctagcccggatttcatcttgcggaccacggtgatcacaggcttcccaggggaaacggaggaggaattcgaccaattggccgaatttttgcaagccaatccctttgaccgtcttggcgcctttgcctattcgcaagaggaaaatacccctgctgcgcagatgccggatcaaattccagatgcggttaaagcagaacggctagatcggatcatgactgcccagcaagcaatatccttggtgtgtaatcaaattcgtgtcggtcgaacgtacgaagttttggtagataaggtgcagggggatatttgcctaggccgttcctatggagaagcccccgaggtggatggttgcatccgcttctattaccaggggccggcccccaaacccggcacgtttgtgcaagtccgtatcaaccaggccggaccctatgacctatggggcgagatggtgcttcaataa

SEQ ID NO: 732 - DNA, 1434 bp, Unknown
  Description of Unknown: Clostridiales sequence
atgggaaactgttccaaacggctggtaaaatattcacaatcctttacgcggaaaaacctatgcaaccatatttttataaagtttgaaaggcaggtgttggctttgccaaaatattccatccggggtggcgtacatccactggaaaactgccatgggggcaagacgcgcactagcagcgtagccattcggccccatgcgcccagtgtggtggagctgtccatgtcgttgtttttgggcaggcccagcacgcccctggtcaaggtgggcgattatgtgaagttgggccagaagatcggtgaatccggcggctttgtgagcctgccggtccacgccagcgtatccggggaagtgatcagcgtaaagccccagatgatgctcatggaccggccggaaatgaccgtgaccatccgcaacgacatgcaggacgaatggatcgaccttacgcccctgggtcaggatgtggacagcgtggagccgtcggccattatcccggccatccaggaagcgggcatttgcggcctgggcggcgcggcgttccccacccatgtgaagctgaccatccctgaggggaagcggtgtgaagccatcatcgtcaacggggcggaatgcgagacccatgtgacggcagaccatcggctcatgctggaaaatgcccaggatatcgtggatgggctgcggctggccatgcgggccgtaggggtggaaaccggcatcatcgccatcgaggacaacaaaaaggacgccatcgccaccatgaaacaggcggtggcgggcatagccggcctgtcggtggtatccctgcaggccaaatacccccaaggcagtgaaaaacagctgatctatgccaccaccgggcgggaagtgccttccaaaggcctgcccatcgacgtgggggttgtggtgctcaacgcagggacggcggcagccattgcagacgcggtgttgcggggcaagccgctcattcagcgggtcaccacggtgaccggctgcgtcaaggagccggccaacctgttggcccggatcgggaccccggtttccgaactggtggaggcctgtgggggctatacccaggagccctaccgggtggtgatggggggctgtatgaccggcctatgtacgcccaacgacgccgtacccactggcaaacgcaccaattgcgtgatcgccctgacggaaaaggaggccaaaacccaagcggagggcccttgcatccggtgcggcaggtgcatcgaggcatgtcccatggggttgcagccctataagatgcgccagctctgcgacaaaggggacctgaaagcagcggaagcggccaatgtgatggaatgtgtggtatgcggttgctgcacctatatctgcccggcgcagcggcagctcacatccatattcaaaaacaccaaggacgccatcgcgcgggaagcaaggagggcaaaataa

SEQ ID NO: 733 - DNA, 1116 bp, Unknown
  Description of Unknown: Clostridiales sequence
atgaaagaaaagctgaaaaaaacctatgaagccgtgggcttgccccgcttgctcatcatctgcttcttcctggcgctgctgctctcctcgggctccctggagctatccatccccagcctgttgggggatacggtgcgccggtgggtcatgtacggcatattggtgctggccatggtgccggcggtgcaatgcggcatcggcctgaatttcggcgtgagcctgggcatcgtgggcggcctgttgggcgccaccatcgccattgagctggaatttgccaacccctggatcagtctggcggtggccatggtggtgggtacggccatcgccaccgtgttcggcatgggctacggcctgctgctgaaccgggtcaaaggctcggaaatgacggtatccacctatgtgggcttttccaccatcgcctttatgaacatcgtttggctgtccctgccctataaaaacggcgaaatgatctggcccctgggcggcgccggcctgcggaataccatcaacctgaattccagcttcggcgaggtgctcagcaatacgcccctttccatcaacatcagccaacagggcgtcacctttggggaaaaagcggcggagctgaatgcggctgccgttgggttctatatccccacagccgccctgctgctcttctttgcggtttgcttcttgatgtggctgttcatgcgcagcaaggtgggcctggccatgagcgcagcgggcgccaatcccaagtttgcccaggccaccggcatcaatgtgaacaacatgcgcatcctgggcaccaccatttccaccgccctgggcggcgcaggcattgtgctgtacgcccaaagctacggcttcttgcagctgtataacgcacccttgatgatgagcttccactgcgtggcggccatcctcatcggcggcgcatccatcgcccgggcccgtatctcccacgtcctgttgggtacgttcctgttccaggggctgctggcggtggcgctgccggtggtgaacaaggtcctgccggagggcaacctttcggatatcatccggatcatcatctcctacggcatcatcctttacgccctgtccaaaaccaagcaaggagggaaaggcgatgcgtga

SEQ ID NO: 734 - DNA, 1254 bp, Unknown
  Description of Unknown: Clostridiales sequence
atgagcgggaaaggcacgattaagctcctgggcattcttgcgggcgcatccatgttgacgggatgcgctgcagctgcaacaacggccaatgtgacccaggaggaagaagtttcttctgcgattgcatcggtccatggggagagtattcccttggcaaaggcggctgtagacgatgccgtcacggtggaacccacccagtcgccggacgcccatgtggtagagatcactttgccgccggctacgccggcctatatggtggtgacatcgccgcaggcctccagccagacgcaaccagcggcgaccccggaagccagcccggcagcaacccccaacccgactccaaccgctacaccggaagcgacccccagctatacggtggaagagctggaggaatatgtggacggttatgtgctggcggccacagttaatctgcgagccggcccggggaccgggtacgatgtgctgggggaatatgaacgctacgataccctgttggtgaccggcacctgcgaggaatggtatcgggtaaagctggacggcctgcggggctatatgctcaaggagtttgtagccatgggggatgtgccagaacctacgccggcttatgcggtggaggagttggacgaatatgtagacggctatgtgaacgccaagaccatcaatctgcgggcaggccctgggactggctatgatgtgctaggggaatacgagcgctacgacaccttgctggtgacgggcaaatgtgaggaatggtaccgggtaaagctggatggcctgcggggctatatgctcaaagagtatgtgaccatcggccaggtgaaggaagcggagcccaccccggcgcctacgcccacaccggagcaatccatcccagtggtagaggaaacgcctacgactaccccctccacgagcatttctcaggcggacgagctgtatctggctgcccaggtggtgcaaaaagaaggggatatggaaagctatgtggctgttgccaacgtaatttataaccgggtccatagcagcagcttccccaacaccatcgaggaggtcctgtaccagaaaaaccagttttccaccagtaacctgaaggcgccttccaccgcggctttggcggcggtccagcagatcttcatcgacggcaacctgatcctgccagcggaggtaatgtatttccaagcggcaagccggggtacggaccgcagcggatatacctattatggcacctacggtggaaacgtatttttctaccgctag

SEQ ID NO: 735 - DNA, 1152 bp, Unknown
  Description of Unknown: Clostridiales sequence
atgatttactttgataatggcagcacatccttccccaaagcgccaggggtgggcgcagccatggcggcgctgctggagaacgcgggctttaacatcaaccggggcggctatgaaggcgcctatgcagtggcggatatggtattggatacccgggagatgctatgcaagctctttgattggcaggaccccaaagacgtgtgctttaccggcaacgtgacccagtcgctgaacctgatcctcaaggggttcttaaagccgggggatcatgtggtggtcagctccatggaacacaatgcagtcatgcggcccctgaaccagctggcggcccagggggtcgcctttgacgcggcccaggccgatccggacggtaccctgcctatagcgcgggtagaggcgctgcttcggcccgatacccgcctggtggtcatgacccatgcctccaacatctgcggcaccatcctgcccatccaggcggtgggcgccttatgcaaggaaaagggcatcccctttgtggtggacgctgcccagaccgcaggcatcctacccctttccatgaaagacctccacgccgccgccatcgctttcaccgggcacaagggcctgctgggccctcagggcatcggcggtatggtgatccgggaggattttgcccagcagatcgaacccctgcttagcggcggtaccggcagcgtttccgatacggaattcatgccccatttcttgcctgaccggtttgagagcggcaccatgaacctgccggggatcgccgggctgaacgcagccctggcttacatccaggaaaccgggctggacaagatctaccagaccgaaatggccctttgcgcacgcttcctggcgggggcccgcactctgaaaaacgtacgcattgcaggcatagacggcctagaaggccgcgtggccaccgtttccctggacttcacccaggctggcttggacaacgccatggtttccttccaactggatagcgaatacgggatcatgacccggtgcgggatgcattgcgccccccgggcccacaagaccttgggtaccttcccccagggtacggtgcgctttgcctttgggcatcggaatactccccaggaggtggatacctgtctggaggccttggaaaccattctggcaggctag

SEQ ID NO: 736 - DNA, 1290 bp, Unknown
  Description of Unknown: Clostridiales sequence
ttggctaaagaacgccggcttcggatcaataagctggggacgcagctcaccatcagcgccttgctatgcatggtcgtcgccctttgcgttttctatctgatgcagagcgcagctagctttgctttgaccaattgggtatcggattcggacttttaccaggccatgagccgccggtttgccaatcgtgtccagcagtatgtcacggaaaaccacatttccctttccaacctggatgccctggacaatatgcagggggatattttgatctccgtataccaggacgatgtgttgctttacgattccctaggcgcggacgcaatggtagatcccttgccaagcgcagtatatcccctttccttagaggacggggaagcctgggtgtacatttgggactatgggttttatacggtctatttccgggtgtttgatatgatcagcgccctgtttgcctttttctcctttgtgatcctgttcgtctttctgatccacaagaagctgaactatatcctgcggctggaaaacgagctggccatcctagagggcgggaacctgcaataccccatcaccatccagggcaacgatgagcttacctgcctggcccaaggcatcgacgatatgcgccgttccttcatcgagcgccagcagggggaggcggaggccatccgggccaatcatgccctgatcaccgccatgtcccatgacctgcgtacccccctcacctccctgaccggctatattgagctgctgcaaaaccagcaatatgccacggaagagcagcggcaatatttcatccaggccagccgggacaaggtattccgcatcaaggaaatgaccgacgccctatttgaatacgctttgtgttccggcgatgtcgcccccgcccaattggaggccatggacgcgtatgagttgctcagccagtttgtggaggaatacggctttgaactggaaggcgcaggctttcagctggagcgcgccatcccgccctttcaggcccaggtgctggcagaccccagccgcttatcccgggtgttcgacaacctgacctccaatttgaaaaaatatgcggaccccgcctatcccatccaggtcagcctgtccgtacagcgggatcaggtggaaatggtcgtggccaatcaaacccggcattatgccgccgtggaaagcacccgcatcggcttgaaaacctgtcaatccatcctgcaacagcacggcggcgggttccaaaccagcatggatgggagccggttccaagcccgccttgttcttcccctgctccaaggggattga

SEQ ID NO: 737 - DNA, 1329 bp, Unknown
  Description of Unknown: Clostridiales sequence
atggaaaagttctttaaactcaaagaacacaacaccactgtccggacagaagtgatcgcgggcctgactaccttcttcgctatggcctacatcatcttcgtgaaccctgacctcctctcccaaaccggcatggaccagacctctgttatgatggccacctgcctttccgctgccgtgggcacgctgttgaccgccctgatggcaaacgtcccctttgcgcaggcccctggcatgggcttgaacgccttctttacctttagcgtatgcttcggcatgggctatacctggcaaaacgccttggccatcgtgctgatctccggcgccctgttcttcttggtggcggtttctcccctgcggagcaagatcatcgatgccatccccgcccccatcaagcatgccatcagcgccggtatcggcctgtttatcgcattcatcggccttctgaatgcgggcatcgtggtgtgcacctcttccaatgtgacggaccttgcccccatggctggcaacaacgccgccgtcgtggccctgatcggccttttgattaccgccgtgctcatggcctataaggtcaagggcgccatctttataggcatcatcgccaccaccatcgtgggcatcccctttggcgtaactaccttcccggaaagcatcgtgttccatggcttcggcgccctggcccccacctttggcgccgtgttcaccgatggcttcaacggcttgatgcagtttggccttttgcccctgctcactgccatcatcaccttcgccatctgcgactgcttcgatacggtgggtaccctcatcggtaccgccagcaatgcaggcatgctggataaggatggcaagctgcccaagggcgacaaggccctgatcgccgacgccatcgccaccatggcgggcaccgtgctgggcacctctacggtcaccacctttgtggaaagctccaccggcatcagcgagggcggccgcaccggcctgacctctgtggtggtagccatcctgtttgccctggcagccttcttcttcgcccccatcgccctgatcatccccagcgcggccacggcccccgccttgttgatcgtcggcgtgctgatgctcaagggcgccgcggagatcgattggagcgatatcgaggtggccattcccgccttcctcaccatcgccatcatgcccttcgcgtattccatctccgatggtatcgcctttggcttcatcttctattccctgatcaagctgatccggggcaagggcaaggaagtgccggtgttcatgtacatcatctccgtactgttcatcgtcatgtatgtgctctccgccctgcctgcataa

SEQ ID NO: 738 - DNA, 1176 bp, Unknown
  Description of Unknown: Clostridiales sequence
atgtatgagctttgtacggatatcggctatgtgacccttaccaaaacaggggaacagctttgcggcgaccatgtggagctggtccagcaggcggatggctccgtggtgctggtgctggcggatggtctgggcagcggcgtaaaggccaatatcctttccaccctcaccggcaagatcatctccaccatgatcgccaacggccttaccctggaggattgcgtcagcaccatcgccgccacgctgccggtatgcgcggagcgcaaggtggcttattccaccttcaccatcctgcggattgtggattgcgcggaagcggagctgatccaatacgataacccccacaccatcctgctgcggcggggcaaacatgtggattacccggagatctgcgaaaacatcgatggaaaaaacatctacaagtcccgtatgcgcctttgggaaggggacgtgctggtggctatgagcgacggggccctgaacgccagccagggcaataccctgaacatgggttgggatcgggcggccatcatcgacttcctggaaaccatgtacaacgatagctttaccgccaaaacctgggcggccatgttggtggaggagtgcgaacgcctttacgggggccagcccggggacgatacctccgcctgcgtcatccgcctgcggcggcggcaggtggtaaacctgctcttcggcccccccgaaaaacgggaggataccaacaaaatgctttccctcttcttcgccaaggagggcaagcggatcgtctgcggcggcaccaccagcgagctggcggccgcctacctaggcaagcccctggatacctccatgcccctgtacctggaccccaagatcccccccacctccaagctccagggggtagacctggtgaccgaaggggtcatcaccatggcaaaggtgctggaatatgccgaggactatgtgaaggaaaaccgcctttatatggactggagctgcaaaaaagacggcgcttcccagatcgcccggatgctctttgaggacgccacggacgtgaatttctatgtgggccgggccgtcaacgaggcccatcaaaaggaaggcctccccatcaccttcaacgtgaagatgcagatcgccgaacgcctctccaaactcctggaggagatgggaaaacgagttcaggtgagctatttttaa

SEQ ID NO: 739 - DNA, 1671 bp, Unknown
  Description of Unknown: Clostridiales sequence
atggaaaccaatgaactcctgatccaaatcgccttttgggcatatgtgctgctggacggggtggcagttaccctggcagccattcccttccttcatatgttgcagctggaaagctaccagggtcccatgtatcttaagtgggtgcgtaagcacctgggccaatggtccggcccctttttggccggtgtggcgggcttccttttgcgcatagccggccaatttttcccgggcggctttgggaccctgctatggcggggcggggacgtgatctttaccggcatgatgctagcctttgggatcatggccctaaaaaatcaaaaaaaggccaaaaaacccctgcgctataccgctagggtcaagcggctattggttcccgtattcctgctcgccctggtggggccggcggcgcggctgctgttgcaggcgtcctatgtgcggctcctttttaatggcatacagccttggggcggctggtgggactatggcttctggccggagcttgtgcggtttttgcccgggctgctgctgccccttgtggtatgcctggcccatgtgctcacctggccggtggaaaagctggtccagggctggtatatgggggacgccaggaaacgcctgcttgccaatccggcgctaatccgcatcggcatcaccggcagctttggaaagacctctaccaagtacgctttgggcaccatcctgggggaaaaatataagaccctctatactcctggcagcttcaacacccccatgggagtgacccgaaccatacgagaaaaactcacgccggaacaccaagtgtttatcggggagatgggggctcgttataagggggatgtggcccagctgtgccgtctggtcagaccgcagtacggcatccttaccgccattggcaagcaacatttggaaaccttcggctccctggaaaacgtaatgcgcgccaaaggggaactgttggccggggtcggcagccagggctgcgtctttctcaacggggacgatcccctgtgtcgccagctttatgagaacagcccattacaggaaaaatacctttttggcacccagggagaaggcttgtatatgcgggcggaggatatcaccgtaggcccggagggcagccggttcaccttggtttgccaggatgggacccggatcccctgcgtcacccggctcctgggccggcacaacatcctgaacgtggcgggagccgccgccctagcctataagctgggcttaagcgaagcacagatcgccgccggcatcggcaagctggagccggtggagcatcgcttgcagctcttgcccggccccattaccgtgatagacgatgcctttaacgccaacccggtgggctccagcgaagcgctggaggtactgaagtccttcccaggccgacggatcatcattacccccggtatggtggaactgggggaggagcaggcggccttgaaccaggcctttggcttgcacatggcgtcttgcgtggacgtggctatcctggtgggacccaacgccccggccatcaaggcggggctcctggaaggcggcttcccagaggaccggctggtggaggtggaatccctggcccaggccacggaaaagctgccgctgtatcaacagccagggtgtacggtactgtttgaaaacgacttaacggataattataattga

SEQ ID NO: 740 - DNA, 1158 bp, Unknown
  Description of Unknown: Clostridiales sequence
atgcgaagaaacaaaaaagggcttgcgttgctccttgccctgctgttgccgctggcgatgctgttatccggctgcgcccaaagcgccgggccggcggcttccgccgaggccgtccccacccaggaagcggctggggcggaaacggcccaagatgcggttgctccgccggaggaggccgcgccccaggaacgggagatcaccgacatggccggtcgtaccatgacggtgccgctggagatcgaatccgtattttccacaggccccgcggcggcaatttatctgtacaccctggttccggataagctattggggtggaattatgcgctcaatgacattgaaaagagcatcatcctggagcaataccatgacctgcccaacttcggccagggggacgccgtcaactatgaggcggtgatcgccgccggccccaccatcgccctgaacgtaaccagcatcaatgacggaagtatcgatgcatccgacgccctggcagagcagctgggggtaccggtggtgatggtgagctccgacctattggatgcgccggcagtctaccggtttatggggaagctcttcggtgtggaagagcaagcggaggctctggccgcctacgcggaggagaccttcaacgccatttccagcctggatattccccatgaagaaaaggtgcgcatttactacggcaacggtgaagattccctagaaaccgcccccgccggttcttcccatggccagctcatcgacctggtaaacgccgtcaatgtggcggatctggagctgggggacggttcccgggtgcagatctcagcggagcagctgctggcttgggacccggatgtgatcatcgtcaacggagaacctaaggcggatatgaccggcagcgccgcggcggaggccattctggctgatcccctattcgccaccctaaaagccgtacaaaacggggcggtctacggtacccccaatgcgcctttcagctgggtggaccggcctccgggacccaaccgcatcgtcggtatgcgttggctatccggcctgatctatccggaatacctggactatgacgtggatgaagcggtgcgggaattcttccagctcttctatcacgtggagcttacggacgaacaactcacacagctttacaacggcaccctttaa

SEQ ID NO: 741 - DNA, 3288 bp, Unknown
  Description of Unknown: Clostridiales sequence
ttgccggtctccgggcaggccacggagcaggccctggtgatcaacgaggtggtctcttcaaattccacctccctctcccacccggaattgggttccccggactggatcgagctatataacggcaccaacgccaccattgacctgtccggcttcggcctgagtgacaatgtaaaagagccccataaatggaccttcccagaagggaccaccatcccggcgggaggatatttgctaatatatgcgtgcagctataccggcgaagacgatagccttttatgcaccgatttcggcctatctaaaaacggcgaatcccttcttttgaccgacgcctattacgccattttgcagcaggtggatctgcctgccctgctgccggatgtttcctatgcccgggacgcttccggccaatatggttattgctccgacccaacccccggcaaggaaaacggggaagtggtcttttcctccgccggggacgccatcactgccggcacctccgacgccctgaccattaccgaatgcatgcccaaggccggggcttgcctggccccggacggaaaagcctatccctgggcggagctatataacagcggcagcgagcccctactgctttccgactactatctttccgataacatccatgagcccctcaagtggcggctgcccggcgccaccttggaagccggcgcctataccaccatatggttctccggggacgagggcaaggacggcatccacgcagggttccgcctgggctcttccgacgacaccctggtgctcagcgacagcacgggaacccagatctccatcctcacctggcccatggaccagatcccggagggggtatgcgtcctgcccggcggccaatataccgcccaggccacccccggccagcccaacagccagaccgggatattctcttccctggagtttgctcccatggaggcggacgcgccggtgcgcattcacgagatcctgctgcataaccaatacagccttcgggatgaaactggcgaacggaccccttgggtagagctctataacagcagcagccaagccgtatcccttggaggctgctatttgagcgacgacccggaaaatcccttcaaatgggccttcccagaggattccagcatacagcccggccaatacctggttattttcctctccggcaaagatgccgccggggatgccctgcataccagcttccgcctctcggactccgacgaagccctggtctttacccaaaccagtaccatgagccaggatcaatgggcgttgcctacccaattgggggataacgtatccatgggccttgcggcggacgggtccatcgcctactttaccacccccacccctggggcggccaataccacccatagctttaccgagcccctaaacgggggctatacggatatggagggggtctatatcagcgaggtctccgcggtgagcgccgcgaaaagcggcaaggcggactggatcgagctgcataacgcctccgacagtaaggtggatctggcaggctggcacctgagcgacgacccagacgacctgcaaaaatgcaccttggaaagcatgaccctggacgccggcggttacggcgtcgtcaccgcctcttccagcaccgcaaagggcgcgacagcgccctttggcatatcccccaccggagagaccctgttcctttccgacgcccaaggcaatatccgggatgtgttccaaaccggcgccctccggcttggcgtcaccgccggccgttccgccggcagcgccagccgggtctattataccgaggccacccggggggaagccaacggcgcgcaaagctataccggctttttgcccaccccggtgttctcgaaaatggggctctatcacgaccagcccttctccctgaccatcacctgtgacgccccggacgccaccatccactataccctggacggcagcgagcccacggaggcttcccccgtctataccggccccctcaccattcaggagaacaccccggtccgggccaaggcctttggcgggggcctcctatccagcgacgtggccaccgccacctaccttttcgagaccccccacaccctgccggtggtctgcctaagcgcccaatccgacgactgggacgccatgtattccgtgacggagcgcaagcttcgggtggaaaagcccgggcatttcgcctactatgaaaccgacggcgccttgggcaccgcctttggctgcggccttagggccagcggctcctctaccctcctggccaggcaaaaatccgtcgccgtattcctccggggagcctacggacaaagcgaaacgaattatcccttttttaccgacagcgacgtgaccgtgttttcctccctggtgctgcgcaattccggccaggaccgggataaggcccggctgcgggacagcttcttctccaaggcggtcaagggcctgaacatggaatacgctgaaacccggctggtgatcgtatacgtaaacggccaatactggggcatctacgacctgaacgaaaaccagaacgaggattatatggccgcccactatggggtggacccggacgctgtggacatcatccgccggaacatcgaagccctggccggccgcaacagcgaaaataagcgggttcgggcatgggccttggccacggatacctccgatccggacaaatacgccgaatacatccaatgggtggacccggattactttatcgattatctcatcgcccaaacctattttgccaacggggacatgttcaaccaaaaatactggcgcagccaggattataccgtgcgctggcggccggtctattacgacctggatctggccctatccagctccagccccacccgcaacatcctgcccaactacttcaacgccgagggcattccctcccaggacggctcccttaccaatatggacctatatgtgggcctgcggaaaaacccggactggtgcctggcctttggggaacggtatgtctatgtggtctacaattatttcgatcccgaccgcctgaccgccatcctggacgatatggtgaaccagctccggccggaaatggcccgccacatccagcgctggggcgcccccagctccatggacaaatgggaaacggaagtggctgagctgcgggaatgcttgcaggcccgtcaatcctatgccctgaaatatctccagcgggaatttgattttacggatgcgcagatggcccaatgggagcaggctgccaaggccgctgcttccacggctgtttctcctacgcctgcgccctga

SEQ ID NO: 742 - DNA, 471 bp, Unknown
  Description of Unknown: Clostridiales sequence
atggctgtcctgacacatgttattccttgccagtcatacatttttggggtaaaatacaaacgtaataatatgctttatgataggcgattactttttaaaggaggtttgcatatggcaggcacgatcattaccgagcttggacgtatcaccatagacgaggatattctggcgaatatcgccggttatgccgcaacggaaaactacggcgttgtgggcatgaagccccggacggctaccgatacgtttttgcagcttgtaggcaacgataccaaccgcaaacgaggcgttaaaatcaccttcctgggagacggtagcgaggcggatgtagatctgtttgtcaccatggtctatggcgtttccttacaggtggtggcaaaaaataccatcggcaatgtacgctatcgggtagaggaaatgaccggcattaaggtcaacagcgtgaacatccacgtagaaaacatcaccgcttga

SEQ ID NO: 743 - DNA, 1065 bp, Unknown
  Description of Unknown: Clostridiales sequence
atggatgaacccctggcgcttatgtccatggaccttgcagacctgcaggcgctgatggaaggctggcgggagccggcattccgggcaaagcaggtctatgggtggcttgcccggggcgcaaggccggaggagatgaccaacctgtccaaaaccctccggcagcgccttggagaattgccctatggaggcgctgccatctatgataaacgggtatcccaacgggacggcaccataaaatatttgtttgccctggaggatggcaacctggtggaaggggtgctgatgcgctaccactatggtaacaccctatgcatctccacccaggtgggatgccggatgggctgcgcattttgcgcctccaccctggagggttgcgtacgggatctacatcctggggaaatgctttcctttattgcctgcgcagaacgggacgaaccggcgcaaaaccggagccgcaccgtcaccaatattgtgttgatgggcagcggcgaacctctggataattatgacaacgtggtaaaattcctccatatggtgacggatccggcgggtatgggcatcagcccccgaaacatatccttatccacttgcggcctggtgcctaagatatggacctttatggaggacgcgccccatgtaaccctgtcgatttccctgcatggggtggacgatgaaagccgtagccggatcatgccggtaaaccgccggtacggcttatcccagttgatccccgcagccaaagggtatgcggataaaaccggacggcgcgtggtatttgaatacgccctgatcgcagggcagaacgcctccaaagaagatgcggctaagctggccgcacttttgcggggcgtaaactgtcatgtaaacttgatcccgcttaatccagtaaaggaacgggggctagccggtattagccgggaaaaagcccatcagtttgctggttggctgacggaaagggggatctctgctaccgtgcgcagggagatgggaacggatatcgagggcgcatgcggacagctgcgccgccgggtactggcagaagggaaaggaggaagcctgcagtga

SEQ ID NO: 744 - DNA, 1749 bp, Unknown
  Description of Unknown: Clostridiales sequence
atgggaaggtttccggatgcttggttgcaggagctgttgtcaaaaagcgacctggcggccatcgcttccgaatatacggtcctcaagccaaagggaaggcggctttggggctgctgtcccttccatagcgaaaagaccccttccttttccgtgaccccggatacccagctgtattattgctttggctgccacgcagggggcggggtgatccagttcgttatgcaggcggagcggctcacctataccgaggctgtaaaaagcctggcccagcgggcgggtatggagctgcccgaagaggtgaacgatgaaaacctccaacgggagcgcgcccagaaggagcgactttacggcgcctgccgggaagccgcccggtattatgtgcgcaacctcctgggggagcagggggaagccgcccggcaatatttgatccgccggggaataaaggccagcgccgtcaaggcctttggtctgggctatgctttgcccggctgggagaacctcgcccaatacatggagcaaaagggcgtatcccctgagaccctggtggaggccggcctggccatacggggcaagcagggacggatctacgacgcttaccgggaccggatcatctttcccatcatctcggccaacggccgggtgttggggttcggggccaggaccatgggagacgatacgccaaaatacctcaataccggcgatacccccatcttcaataaacggtataacctttatggcctgaacctgcaacggggcaaacgcccgggggacctcatcatggtggaagggtatatggatgtggtgcgcctgtatgaagggggggtcaccaatgcggtggctagcctgggcaccgcccttaccgtccagcaggccaggctcctgaagcggtatgttccccgggtgtatatctgttacgatggggatgcggcaggccagaacgccacccttcggggtatggatatcctggcgggagagggcctggaggtgcgggtaatggccatccccggcggccaggacccggacgaatatgtgggggcccacgggggggaaggtttcctttccctgaaggaccaggccaagaacctacaggaatacaagctggacgccctttggcggggcgtagattcccaggacgccaacagccgggaggaatatgcgaaaaaggcctgtagctttttaaataccctacagccggtggagcgggaccggtatatccccattgtggcccggcgcacaggctatagcttggacgctgtccgggcccaatgccagatcggccagggacccgtccagaataaccctggaaaataccggcatactaagcaaaatcaggggcccaagccgcagcctgccaccgccgggctggagactaccctgctggcctgcatgctcaagagccaggacgccctgttggcggccttgagccggatgcaggcgttggagatccgcttcccaacggcggcccttaaccaactggcggaacggctgctggcggaaaaccccgatcccgccctgttgatgggagagcttaccggggagacggcggccctgatgagccaggccatggagcggttggagggcttggtggagccggaagccacggcattggattgcgtgaacacattggcccgtatggccatacgggctcgcatggaagaactgagcgcagcctatacggatagcccggaaacagcccaggagctatccgcgctgcaaaagaaattgacggaattaggccccatggcctga

SEQ ID NO: 745 - DNA, 2073 bp, Unknown
  Description of Unknown: Clostridiales sequence
atgaagaactataccgcagcaaacatccgcaatatcggcattttcggccacggcggcgaagggaaaaccacccttaccgaggcaatgctttttaatgccggtctgatcgagcgtatcggtaaggtggaaaacggcaataccaccaccgactacgatcccgaagaggtcaagcgcaccatttccatcaacgccgcgctggcgcccttcgagtggaaggatgtcaaggtcaacatcattgacgcccctggctttttcgatttttatggcgaagtgaccgctgccatggcgttggcggacgcggccctgatcgtggtaggcgctgtttccggcccagtggtaggaacggaaaaggccatggccatgtgcaaaaagtctggcaaagcccgcatgatggtcatcaaccagatggaccgggaaaatgccaacttcgacaaggtgatgggcgaaataaacgaaaagtttggccccagcgtcgtgcccattcagctgcccattatggaaaagggcgcctttgtggggtatgtggatatcgtccatatgaccgctcgccgctttgatggcaagggcgagaaggaaatgcctatccccgatggccttgccgatcgggcccaagagctgtacgagcagctgaccgaagccgctgcggaaagcgatgaagccctcatggagaagttctttgaagagggcgagctctcccgggacgagatcctccagggcctaagccagggcgtgttggacggcgtcgttaccccggtgtgctgctgcgcggccgcccccaacattggcgtgaccacccttatggataacctgatccactatatgcccgccgccaaccaggtggctgctcctgcggctgtcaatcccaaaaacggcgaagccgtgcaggtgggccaggatggtaagtttgcgggccaggtcatcaagacggtgatcgaccagtttggtaaatattccatcattaaggtctatcgcggcacgctcagcgtggatacgcccctgtataacaccaatcaggaaaagaacgagaagggcactgcccctggcctcatgcggggcaagaaggttacgcccatggataagttgatcgctggggatatcggcgcgctgtccaagctccagtataccgccacgggagataccctgtgcgatccttcggacccggtacagtttgcagccatcgagttccccaagccctgcattagcctggcggtttccgcgaagaagcagggtgaggaggacaaggtctttgccggacttaacaaactcctggaagaagaccccaccatggccatcgaaaagaacgtggagactggcgatgtgctgatctgcggcctgggcgaagtgcatctggatgtgctttgctccaagctgaagaataagaccggcgtggaagcccagatctccgatcctcggattccataccgtgagaccattcgcggcaccgcggaagccgaaggtaagcataagaagcaaaccggcggcagcggccagttcggcgtggtcaatatgcgctttgagcccctgaccaacggcgaagatttcgagttcgtcaatgccattgtgggcggcgtggtgcccaaggaatacatccccgccgtggaaaagggtacccgggaagccatgaagaagggcgtattggccggctatcccatgatcggcgtcaaggccaccctgttcttcggcaagtaccatcccgtggactccaaggaagtggcctttaagagcgcggcccgtctggcctataaggaagcctgcgccaaggcccagcctgccttgatcgagcccatctatcagtacaacatcaccgtgcccaacgagtataccggcgccatcatgggcgatctgtccagccgccggggtcgggtgttgggtatgaacccctgcgaggacggtaccgaggtagtggcggaagcgcccctgtccgaaatgtttaagtatgccacggatctgcgctccatgacccaggcgcggggttactttaccagccaatttgtccgctatgaggacgtccccgccatggaggccaagaagatcatcgagaatgcccagaaggacgaggacgaggacgaataa

SEQ ID NO: 746 - DNA, 2406 bp, Unknown
  Description of Unknown: Clostridiales sequence
atgcaggcagtcatcatggccggcggacatggcaagcggctgcgccccttgacctgcaccatgcccaaaccaatggtgccacttttaaacaagccggtgatcgattattgcgtggagctgcttacagcccatgggatcacggacattgcagccaccctacattacttgccggatatgatccgagagcatttgggggatgggcgggcatttggggcggagattcgttatagcgtagaagacaagcccttgggtaccgccggcagcgtggcggcggtggcccggcctggaaagcctgtgctggtaatgagcggcgatgccataacggatgtagacctgggcgcgctgatccgggcccacgcggacagcggcgcggcggccaccattgtgctcaaacgggtgcaggtccctacggaatacggcgtggctttgatggatgaaactggccgcataagccgctttttagagaagccccagctttcccaggtgtttagcgacctggccaatacggggatctatttgctctccccggaagcggtggaaatgatccccaaggatcaagcctacgatttcagcatggatctttttcccaagatgctggcggcaaacatgcccatcatgggtcatgtcacagaaagctattggtgtgatattggggaccttagggcctatgtacaagcccagcgggatatgctggcagggaagtgcgcctttgagaccttggcggtggagcgggatggcatttttatggagcatgacgccaaggtatccccggaggcggcgctggttgccccctgctacattggccgggatgcggaggtggcaggaggcgccctgctggcggacggtacggtgctgtgcagcggcgttcggatcggggcgggcagcagcatcaagcggagcattttgctgcaaggcgcccgggtacgggagcatggggagatccggggtgcggtcatcgcggaaggcgcccaggtggacgaccatgcccgtatctttgccggtaccgccctgggggctggaagccatgtgggaaaaggggcttctataaccgccggggcttgcctgtggcccaacaaacaggtggaggatggggcgacctgccaggaggatgtgatctgggatgggggcctgcacaagaacaacctggatacggtggtaaaaggctatacggatggggaccttgggccggagcgagctgcacggattggggcggcctatgtaaaaagtcagaaaggcgctcaaaaggaattggccattgccacagatgggagccagcaggcggttatgctcaagcacggggccatggcggggatggtgtcccagggcggggacgtatatgatctgggccattgcagctattccgcctttacccatgggattcgcagctacggcctacagggcggcatctatgtacagcgagatggcacagggccccatggagcggaattggctctatgcgatgggcagggctgccggttgacgggcgggagcttccgttccttccggcaggagttgctcagcgggccacatccgcctttgacggcccagcggctgggcatcatccagcagctggggggcgcggccaaaggctatgaagccaggctgggggatatcttggagccgggggtccaggccggtgggtataagatcatcctcagcggggatggggacctgtatgataccgcggcccgggtgcttttaccggctggatatagcgtgctattcatggcggaacgccaggcgagccgcttgcatggcagcatgatccaacagggggcagagttagggttcttcgtggacgaaacaggggagatgacctgtatctttcgggatcaataccttggcgaaagccagcggatcgttttactgatccaatgcgctctggcggaagggcggcttcggggccatacagggctgccggttgggatcagcgaaacctatgcggaatatttggagggcttgggatgcaaagtacatcgatgcccagaggaccgggaaaaatggaagaaacaggcattgacccacggctgttatcttccagagctatttgaaacggaggcagcggtggtgcggttaagccaaatgggacggcagggacggcttgccggctacgtggagcagttgcccaagacctatgaagcggagggcagcgtgggctgctcctggaaggagatggggcgggtaatgcgaagcttggtggagaccgagcgcagcgaccgggtggagctgatggacggggtgaaggtgcgcagcgacaaaggctgggtgttgatccggccgaacggggatctgacagcctaccgggtggtggctgggagcttcaatggggaatatgcgcaggagctgacagacctgtatttggataaggtccggcagattgcccaagacaaaggggaagaatcgtga

SEQ ID NO: 747 - DNA, 897 bp, Unknown
  Description of Unknown: Clostridiales sequence
atgtttaccgcaaaagacgtaatggccctgcgcgagatgagcggcgccggcatgatggattgtaaaaaggccctggtagagtgcgacggcgacatggataaggccatggactatctgcgggagaagagcctggcggcttccgccaagaaggcgtcccgcattgcggccgagggcgtggtatccagctacgtgagcccggatagcaagaccggcgtcatcgcagaagtgaattgtgagaccgacttcgtggccaagaccgacgacttcaaggccctggtggatacggtagccaaactggtggcggagcaagatccccaggatgtggacgcccttatggcgttggataccggcgacggcaccgtggcggagatgatcacccgggccgtggccaagatcggcgaaaagatcaccatccggcggtttgcccgcagccatgtggaaggcggcatggtggattgctatgtgcacctggggggtaagatcggggtgctggtggagatcgcctgcgaggacgtggccgctgccaagcccgtggcccatgacatcgccatgcacattgccgctgccaagcccacctgcctgtccaaggcggacgtgaaccaggatgacgtggagcacgagcgcaagatcctgcgggagcaggccatgaacgagcccaagcccaagcccgccaacatcatcgagaagatggtggaaggccggatcgaaaagtactacaaggaagtctgcctgctggagcagccctttgtcaaggagcctgacatcagcgtgggcaagctggtagagcgcaccggcggcatccaggtgctgggcttctatcgcttcgagatgggggaaggcctccagaagcgggaagataatttcgctgaagaagtgatgggccagatgaagaaataa

SEQ ID NO: 748 - DNA, 2181 bp, Unknown
  Description of Unknown: Clostridiales sequence
ttgggaaatgcaggggtatccggcaaaaaaagattagcgatcaccctggttggggtggcggtgatttttttcctgctcatcctgcgcttggcctggtttatgttgatccggggctctgagcttagggagctggcctccaaccagcagacccaggatacctccctcaccgcttcccggggcgccatcagcgacgcctccggggtggtgctggcccaaagcggtaccgcgtataaggttttgctgaatccatacctgatgagccaggaggaatacgcggacgaccggcagcggatcgccctggagctgtccgagatcctggaaatggattatgattatgtgttacagcaggtcatgaagaccaatagtgctggtgaatactatagagaggtcatcctgaagcggcaagtggaacgggatgtgatcgacgagatcaatggccgccaactgggagccggggtctacacggccatcgactccaaacgctattatcccaacggcagcctgttctcccagctgctggggttcaccaccatcgacggggtggggcaaagcggcctggagcagaagctggataaatacctggcgggcgaggatggccgcatgatcacggaaaccgaccgggcgggccaggccctggcctatggggcccaggagatcatccagcccatcaacggctacgacgtggtgctcaccacggacagcgccatccagtccttcctggaaaaggccctcaaggaggccctggaggtaaaccaggcggaaaccgcccaggggatcatcatgaaatgcaaaaccggcgagatcgtggccatctccacccagccggactatgatcccaacgatcccccccgggacgatatgtccctactcaattccttgagccgcaaccgggtggtggcggatagctacgaacccggctctacctttaagatcatcaccctggcggccgccctggacagcggcacggtgaatgaatccacctcctaccattgcgatggctcgtacgtggtaaacgaggagcggatcaaatgctggaaggacggaggccatggcagcgagaccctgatcgaggcggtgcagaattcctgcaatccggccttcatgcagatggccttggccatgggggtggagaccttttacgattacatctacggcttcgggtttgggagcaccacgggcagcggcatctccggggagagcggcggcatcgtgacccaccagaagtatattaacgacaataccctggcccgcatcggctttggccaaagcatcgccgtgacccccatccagttggccactgccgtatgcgcggcggtgaacgggggagagctgatgcagccctatgtggtggaccgcattgtcagcgaaagcggcgaggtgatcctgcaaaaccagcccaccacggtgcgacgggtgatctcggaagagaccagcgccaaggtccgcaccattttggagagcgtggtcaccgagggcagcgggaaaaacggcgccatacccggttaccgggtggggggcaagaccggcaccgcccagaaatacgaggacggcaagatcgccgaaggcaagctgatcgcctccttcatcggcttcgcgccggcggacgacccggaatacctgtgtttgatcctggtggatgagcccaaggtgggcaccattttcggcagcacggtggcggcgccctttgtcaagcaagtgctggaagaaaccctgcgccacgcgggcttcttgcccaccgagcaggcggagaccgtgagcgtgcccgacctgacgggcatgaccatccaggatgcgaaggcggccttggaggccaacggcttggaagccgtataccaggacgatgaggcggatacggtgaccgcccaggtggcggcgcccaatgagatcgtacaaaaaggcagcgaagtgctgctatataccgccaacaccggcgagatcatcaccgaggcggagatagagcaagtgaccgtgcccaatgttttaggccgcacccggctgggggtgaaggatatgctggacgaggcggggctggagatccgcatcgacccgccggatcaaacgggcatcgccttccggcaggtgccggaggcgggcaccaaggtagaagctggcacagaggtgctggtggagtttgaaaacgccgccaccgccaccttgcccggcgacgaggaagaggactag

SEQ ID NO: 749 - DNA, 1233 bp, Unknown
  Description of Unknown: Clostridiales sequence
atgaagcggatcgcggtgatcggcggcggcccggcgggtatgttggccgcagcggaagccgccggcaaaggaaaccaggtcatcctgtttgagcaaaacgagaaaacgggcaagaagctctacattaccggcaagggccgttgcaatctgaccaacgcctgcccggtggaggagatgttcgagcatattccccgcaaccccaaattcctgtacagcgccttgtatggctttaccaaccgggatatcatggcgctggtggagtctatgggaattaagctaaaggtggaacggggccagcgggtgtttcccgtatcggaccatgccagcgacgtacttaaggccctgaacgcctatatgcagggtaaaggggtggaggtgcggctgcatagccgggtggagtccttgaaaaaggtccaggctggatttatcgtaacggtaaatgggcaggacttgccttttgaaacggtgatcctgtgtaccggtgggaaaagttatccaaccaccggttcagatggttccgggtatgcattggcccaaagcctaggacataccctgatcccttgcaagccttccctggtgccgctggagacccaagaggattggccgaaaacggctatgggcctttccctgcggaatgttcggctccaagtgaaacaaaggggaaagacggtgttttctgaactaggggagatgatgtttacccactttggggtatcggggcctttggtgctatccgccagcagccgcatcgcagacgctccccaaggctgcctgctttccatcgatctgaagcctgggctggacccggaggccttggaccggcgggtgcagcgggattttgaaaagaataaccggcggcaattctccaatggattgggagaactcttgccggccaagctcataccggtgctggtggagctttccgggataccgggggatttgaacatcagcagcgttacccgcgtccagcggcagcaattttgccacctggtaaaaaatctgccattgaccgtaaaggggccgcgggatatccaggaagcggtgatcacccggggcgggatcccagtgaaggaggtggacccttccaccatggaatccaagctggtaaagggcttatattttgccggggagatgttagatgtggatgcctatacgggcggattcaatttacagatcgcctattccacaggcgtgttggctgggcgcagcgccggagcgggcgaaaggggataa

SEQ ID NO: 750 - DNA, 2361 bp, Unknown
  Description of Unknown: Clostridiales sequence
atggtgctggctgtcctgggatttgtgctgtttatggcggcgcagctctgggatctggacgcatggcaggattttgacccagccaacattttaggcgcccagcaatccctcatcctttacgatggggaaaacggcgagatcctccggcttcacgacaaggaggaccgggtatccatccccctgtccgatgtgccggatttggtgcaaaaggcctttatttccgccgaggacgcccgcttttatgagcatccgggcgtggatgtgatccgtatcgtgggggctgcttgggcagatattaaagcgggaggctatgtccagggggcttccaccatcagccagcagctgatcaagctgagccacttgaccgctgacaaaaccatctcccgcaagctggaggaggctgtgttggcctgccagatggagacccgctactccaaggacgagatcctggagatgtatctaaactacgtttactttggcggcggctactacggtattgaggcggcggccctgggctattttggcgtccacgccaaggatctgtccgtggcccagggagccatgctggcgggcatcttaaaatccccctccaactacgcgccccatctggattttgaggcatccctggcccgccgggatacggtattgagcttgatggcggaatatgggtacctggatgaccaagggttggctgacgccaaaggggaaaccatggtcatccttcatgatggcaccgcctccgaggagggccggaattattatgtggacgcagccctgcaggacgccatggagatcttgcagatcgatagcgaaaccctattgagcggcggctatcggatctatacggccatggacagcgccatccaaaaccagtgcgaggccattttccagcaggacgacctattccccggggacgcccagggggccattgtggtacaggaagcaggaaccggcctgattcgtgccatggtaggcggccggggggcatacgataccgccatggcctttaatcgggcgacggatatccgcaggcagcctggttcggtgatcaagccggtgatcgcctatgccccggccctagagggctatggttacaccgccgccaccatgctgttggatgaacccaccacctttgcggaatacagcccccgcaacttcggcaacaaatattacggctgggtcaccctgcgggaagcggtgactcgatccttaaacgtacccgctgtaaaggtgctctccgatatcggggtatccgcgggaaaggcctttgcccaaagctgcggcattccctttgacccccaggataccagcctgaccttggccctgggcggctttacctatggggtatcccctctacagatcgccggggcctatgcggcgtttgcttcccaagggatctataatacccccacctgcatccaacggatcacggacagcactggaaaggagctttatgtctatgaaccggagaaccggcgggtcatgtcggagcaaaacgcctatatcctcaccagtatgttgcaaagcgccatccaggaagggaccggacaccggctcaaggatctggatatccccttagccggtaagaccggcaccgtgggagaaggggaaggcaatcgggacgcctggatggcctgttatagcgccgactatgcggcggcggtttggatcggctacgataccagccaggatggcgctttgccccaggacgccaccggtgggaaatatcccgccttgatcctggagcagctgttccaaggcctttaccaagaccgcgcgccaaaagaattttccatgccctctggcgtcaatgcctataagctggataaacgcaccttggaaatgttccatgagccggtgctggccacagccttgacccccagctccgccatccaaaccgaggtgtttgtggaggggacgcagcccacagcccaaagcagctattgggtggtgccctcgccgcccggtgaattccgagtatatttgggtggggacggaaaaccgcaaatcgcctttaccggccgggaaagctttgcccaatatcagctataccggcaaaaggggaccgaaagcccccagctgatcaaaacctgggacggcaagggcgccgtcacctatggggatgattccgcgctgcccggctgcacatatacctattatatattgcctgtgcatcaggaaatgaacgtgggcggagagcaggtaaaaggacccgccaccaaaaaagtaacggtcaccaccccggaagcggtgatcgatgtggagatccctggacccaccccgcaaggtgaagttaccccttcgccggcagcttcccccagcctgctggaggaattgtctgctgcttttgccggtaggtga

SEQ ID NO: 751 - DNA, 2244 bp, Unknown
  Description of Unknown: Firmicutes sequence
atgagtaaaatattcaaaaacatggcgccgtattggaagactgtctttgtgattctggcgctgcttttgattcaggccatgtgcgatctggcactgccgtcctatacgtcggacatcatcgatgtcggcattcaaaaaagcggtgtggagcatgtcgtgccgcaggctgtgacagcagaggaattcgagaccgcacagctgacgatgacggaggatgagggccgcctttggcggaatctctacgaaaaggaaggcgaggtttacaagctgacggagagcgcgcaaaaacgctgggatgaaatggatgaaaaactggtgctgccgctgattctaaactatcagatgagcgccatggaggagtccgcgtttaagtcctacgcagcggtacagagcggtatggacaaggcaaagattgacgcgatgagcgtggaagagctcggcaggatgctgggcgtttccctgacaccgttcgaacagcaaaaagaggatgaggacggcaatccctacaccgcggtctgcgtggatgtccgtccggtattcacggcaatgcgcgatgcaggcaggatgcaggaggacgcaattctttcgatgcggcaaaacctgcaaaagaccatcgacacgatgggaagctccatggtcagatccatgggcgtcgcctacgcagttgcctgcgatcaggcagccgggctggatgtcaatgcgatacagacctcttacctgtggagagccggtctgaagatgctcggtatggcattgatcatgggaatcgcgactgttttggtcagcttctttgcttctcgcgtcggcgcgggcatcggcaaaaaccttcgagacggcgtcttcaagcgggtcgttggattttccaacgcggagatggacaaattctctactgcctcgctgatcaccagaagcaccaacgatattcagcagattcagatggtatcggctatgctgctgcggatggtcgcgtacgcgccgatcatgggcatcggcggtgtcatcaaagcgatgcagaccggagcagggatgggctggatcatcgcgctggcgctgctcgtcattctaggctatgtcatggtgctgatgtcagcgtccatgccgaagtttaaactcatgcaaaaactcgttgacagactgaatctggtttcccgggaaatccttaccggactttcggtcatccgcgcgttcaagcgtgaggacaaagaagaagaacgtttcgatgaggcaaatcgcgcgctgaccaggaccatgctctttaccaatcgcgtgatgaccttcatgatgcccggcatgatgctgattatgaacgtgctgaccgttgcgattgtctggttcggagcgcatcagattgacgcggggaacatgcaggtcggcgcgatgactgcttttatcacctacgcgatgatgatcgtcatgtctttcctgatgctgaccatgatgtccatcatgctgccgagagcggcagtcgcggcagaacgtatcgatgaagttctgcagacagaatcttctatcaaagatccgcaaacgccggagcaccttacaacctgtgagggcgtgctgcgtttccatcacgtttgcttccgctatccgaacgcggaggaggatgtgctgcacgatattgattttaccgcgacgccggggactaccacagcgattatcggcagtaccggatgcggtaaatccacactggtcaatctgatcccgcgtctgtatgatgtgacggcgggcagtgttgaaattgacggcaaagatattcgcaagctgtcgatggaagaactgcgcgggaagatcggtttcgtgccgcaaaagggcgtgttgttttcgggaaccattgcctcaaatctccgttttggcaacgacaacgcgactggtgaagaaatccgccgtgcggctaagatcgcacaggcagaggattttatcgaagaaaaagaagaaaaatacgacagtccaatcgcgcagggcggcagcaatgtttcaggtggtcagaagcagcgtctggcaattgccagagcgatcgccaagaatccgaagatttttatctttgacgacagtttttcagccctggatatgaaaaccgacgcggcgctgcgcaaggcactcgccgaaaacgtcaaggacagtacggtcatcattgtggcacagcggatcagcacgatcctgcacgcagagcagattttggtgctggatgaaggccgcatcgtcggcagaggtacacatgaggagcttttgacaaactgcgaggtc

SEQ ID NO: 752 - DNA, 1260 bp, Unknown
  Description of Unknown: Firmicutes sequence
atgaacaaaaacagcatggcatacaaatatcttatgatcctcattgcaacctgcacgacggtcgtttattttatcccttatgcatgcaatgatttctacaaccattttatcgacacctatcatattacatacggccaggccggagatcttcttacgttctttggcatcaccgctgtcatcggctattttatcggcggttgggttgccgataaatttaatcccaaaatgctggtggtgtggtcggcgattttaaccggtcttgccggaactgtggtggcgttctctacctcctttacgattcttaaaatcatgtactttctctttggcatcaccagtacttgcatgcactggagcgcctttttgaaggtaatcaaaaatattggagaagatgacgaacaaggtaaactttttggattttataatttttcctacggtctgttcggcatcgcttgtacctacctgattctcggtatgatggaaaccgcattggcaaaatatgaattccgcggcggtatgatgatttactgcgtcatctccgttgtctttggtattctaacatggatctttgttccatatgatgaagaaaaggcaaaagccagagaaggggctgatgataaaattgacttgaagctcatcggcaaggttctcaaaatgccgatcacctggtacttaggtctctttacgctcggttacttccttgttcgttctactgtgccttacctgaatccatatatgaccgatgcctttggggtatccattggcatcgctgcacttgtcactaacacactgcgcagcggcatgaacctcatcgccggaccagtcggaggtttctttatcgaccgcctcaaaagttctacaaaggttgtcatggtcggaggcattggaaccctgctatttactatcgtgctgatgttggtgccgcaacagcataacatgattattctgctgattaccgtctgcattatcctgctgctgttttcttatgttaactcaactgcgctttacacaccggtcactgaagcgagggttccgttcaaatatgtcggaactgttttgggcgtcgcatctgcaattggttattcctcggatatttggctgtataacctctgtgggacgtggttggacaacaatggcaacgcaggctattcctatatttggcttctgcaggctttcggcgcaattatgatgatcgtcatgggtctgctcctcgcagccacttacaagaaagtacgtaaaaatggaaatcaaactgaatcgtaa

SEQ ID NO: 753 - DNA, 1851 bp, Unknown
  Description of Unknown: Firmicutes sequence
atgaaccgattgtatattaaatcgcgggacactgctcaaaaaacagtagaaggtctttataaggatctggaaagaagaatcatcgccagcccgccgggacaatgcccggtcgatttggcgtcagccttcttaaaactatgtcattcacagagctgcggcaagtgcacgccatgtcgcgtcggtctgggacagctccagatgatgattgatgacattttggaaatgaatacggaaccggggatggaaacgctggagctactggaaagaaccgcagaagccatcagcgtctccgcggactgcgcgattggctttgaagctgccaatatggtactcagaggcttgaagggataccgggacgactttgaatctcatatcaaatatcatgcctgcgcggacaatatcaagaagcaggtacagccggtaccttgtgtggcgatgtgtccggccggcgtggatgttccgggttacatttcgttgctcaagcatgaacggtacgcggacgctgtcagactgatccgtaaggataatccgttcccgacggtctgcgcgctgatctgtgagcatccatgcgagcagcgctgcagaagaattctggtagacgcgccgatcaacatcagaggtctcaaacgtttcgcggtggataactgtggagatgttccggtaccgcaaaagatggacgataccggcaagaagattgcggtgatcggcggagggccttccggattgtcggcggcctacttcctgtctatcatgggacatcaggttacggtatttgaaaaacgcgcgcagcttggcggcatgctgcgttacggtattccaaattacagattaccgcgagaaagactgcaatgggacatcgacgcgattctttcgaccggtgtggaagcgaaatgcaactttgacatttcttcaccggagggcatggcagagattcgcaatcattttgacgcgacctatatttcgatcggctctcataacgcgaaaccgatcggtattccgggcgaatacgccaaaggggtcattccggctgtcgaaatgctgcgcgggatcggtgatgacgcgatgccggatttcaacggcaaggttgtcgtggtcatcggcggcggcaacgtcgcgatggacgtagccagaactgcaaagcgtcttggcgcgaccgaggtcagcatcgtttacagaagaagaaaggatgacatgaccgcactgccggatgagataggcggcgcgattgccgaaggctgtacgcttgtgcagctcaaagcgccatccaggatcgcgacgaataaacgcggagaggtgcaggcactttgggtgaaaccgcagatcgcggggcaggctgacaagagcggcagaccgcgtccggtggattcttccgaaccggaggaaaagatcccttgtgatattatcatttccgccatcggacaggctactgatattcgcttctttgaagagttcgggattccggtattccgcggcaatattcaggcaaagaagaacagtgtagtggacaatgtactcggcacttatgcgggcggggactgcgtcaccggcccgtctacggtcatcaacgcggttgctgcaggcaaggttgctgctgccaatattgacgcctatttagggtttaaccatgagattaccgtcgatgtagatatcccgacgccgattccaaatgatcacttgccttgcggcagagtggaattgaaggaacgtttcgcgaagcagagaggaaatgacttcgatgaagtggagcagggcatgagtctggaggaagccatgcaggaagcttccagatgtctgcgctgtgattatcatggcttcggctcattcagaggagggagggataccaaatggtaa

SEQ ID NO: 754 - DNA, 1977 bp, Unknown
  Description of Unknown: Firmicutes sequence
atgagtacagaagaagtaagaaccgcgcagaatccggaggctgcggaagtagatacagaggaattttcggcagagcaattgagcgaacagagaaagattcgccgcgaaaaattaagaacgctgcaggaagcggacagaaacccatatctggaggaaaactggaacgtgaccgcgcatagcaaggatattaaggataatttcgaagcgatggaggatcaggaggtttcctgcgcgggcaggatcatggccttccgccagatgggcaaagcttcttttatcgatctgcaggataagcagggcaggatccagtgtttcgtttccagagacgcgatcggcgcggacgaatacaagttctttaagacctacgacatcggcgatattgtcggcgtggagggtacagtattcaagaccaagaccggggaggtttccatcaaggcaagccgtctggttctgctttccaagtctttgcaggtactgccaaacaagtggcaggggctgaaggatcaggatatccgatatcgtcagagatatgtggatttgatcatgaatccggaagtacaggaaatgttctacaagagagccagaatcatcaaggagattaagagagttctggaagaagattacggctatctggaagtggataccccaatcctgacgaccatcgccggcggcgcgaacgcgagaccgttcaatacgcaccacaatacgctggatctggatatgaagctgcgtatttccaacgagctgttcttaaagagactgatcgtcggcggcctcgacagagtatatgaaatgggcaagatgttccgtaacgagggcatggacagaaatcacaatccggaattcacatccatggaatgctacgcggcgtatggcgatatggagctggtgattgaggtaaccgaacagattgtctacaaggcagcgatggctgtgaacggaacgccgattctcaagtatcagggcaaggaattcgatgtaacaccgccttggaagagaatcgacatgacagacttcgtttgtgaagtcaccggaattgatttccatcatatcgaggatgatgaaactgcgagagcggaagcgatcaagtacggcatggatgagggagaagtgcagcactggacacgcggtaagattatcgcggaaatgttcgaggaatactgcgaagatcttccgggtgtgctggacggaccggcgccggtatttgtcaccggacatccggtggagatctcaccgctggcaaagagaagcaagacagatccgagaatcacgcgtcgtttcgaaggctatatcaacggctgggaaatctgcaacggcttttccgagctgaacgacccgattgaccagtataaccgtttcgcggagcagcaggcacagcttgacgcggggctggatgaagaagcgcacccgatggatatggacttcgtcaatgcgctggaggttggtctgcctccgacaggcggactgggcatcggcatcgacagagtcatcatgctgatcaccgacgcgccgagcattcgcgatattatcctcttcccgaccatgaagccggtcggcgctgacaagaaggcagacgtatcgccaaagaaggttagagttcttgatgaaacaaagatcgaggtagagcctttattcgaagaatatgtagactttgattctttcgcagcctgtgatttcagagcagtgaaaatcaaagcatgcacagaggttccaaagagtaagaagcttctgaagtttgtccttaacgatggaagcggcacagacaggatcattctttcgggtattcacggatattatgaaccggaagaactggtcggcaagactgcggttgccatcacaaaccttccgcctagaaagatgatgggcgaagaaagcaacggtatgcttttgtcctgcatcaacaagtatgatggcgaagaaatgttgaatttcatcatgctggatgaccagattccggcaggcgcgaaggtgtattaa

SEQ ID NO: 755 - DNA, 1359 bp, Unknown
  Description of Unknown: Firmicutes sequence
atgtatatgttggccggtacatatttgctgttgtttttgacgacggtcgcggggatcagtccggcagtcgcgggcgcgatctgcgcggccggttccgtttgggaggcactctgcgctccggtggtgggctttgaatccgaccatgcggtgacacgcttcggcagacgcaaaccttttttgctcggggcggcttttccggcagcaatcattactacgctcttgtttacggcaatccaggcatcgccgggcgtgaaggttgtgtattatttggtgatggtgctgctgtactggacctgcttctcgtctttttttgtgccatacatggcatggggttccgatttaaccgatgactacaacgagagaacggtgctgcgctcattttcctatatctttaaccaggtcggcatgtgcatcggcatggtactgccatcgatcctcgttgactattgcgtcagcagaggcaggtcactctcgttttcgtggacgcttgtcggtctgatggtcggcgtgtgcggcgcggccgctttgttgatctgcgcctggtcgattaagaatgatgacaagaaggattttgtcaaaccgcgcaaacagcgcgagaacattctgcatgcctatgcagcgatgtttcgggagtattggcagctgattcaaatgaagcctgtgcagattatcatcggtgccagccttgcctatctgatcgcgaacatcacattttcttcagaccgcgtgttctttatgaccttccacatgggcatggacgagaaagcaatctccgcggtgctgatgctgatcacgctggccggcgtggcgacggttccgttcatcgccaaactgggcgcgcgcttcgataaaaaggatctgttcaaaacagttatggcggtctgcggaattctgatgatcgcgaccaaattcatcggcgtggattcctatccgatgctgatttttgtatgtctgctgtacgccgcggccaacgcagcctactggcagctgatgccttcgatgatctacgatgtgtgtgaggtggaggagctgctctccggtgtgaaacattccggcgcggtcatttctctgcaggctttgtccgaatcactttcgattgccgtcggtctgcaaatgctgggtctggtgctggagttagcaggttttgatagcgagcttgcggtgcagacgccgcttgcgctggaatgggtcgaaaatgcttttgtcgtgattccgggcgctgcgatggtcgtcgtggcgcttgtcatccgcaagtcgaatttgaccaaggaggtctttgatcgtgtcaaagaggcgcttgcgaaacggcatgcgggcgaagaagtggatattacagagtttgaagagattttcgaataa

SEQ ID NO: 756 - DNA, 1578 bp, Unknown
  Description of Unknown: Firmicutes sequence
atgaaggtaagcgttaaggattgtctacagctggaagctttccgcaagtgcattgtcgttgcaggagaaaagcacatggatcgccgggtaaaagcggtttcggtcatggacgcggcaacggcggaggaagcggtcaagtgcagcggcagcagcggcaatatggtgttgacttcgttcgcgggcatgaaacatgacgtgaaacagcagcaggaaacaattcgcgaactggcaaaggcaggtgtcgccgcgctggtggtttttcgcagggagcagaccacgcagcctgttgacaaggcagtgacgcgcgcagctgatgaggccggtctgccgttgatcatcatggtcgatggagaaaacatggactattcgcagatcatcgcggaggtcatggaacacgtgctttatggcaataattttaagaacagcctgatcaacaacacgatttttcatctgttgaattttgaaaagcacgcgaatttccagcaggcgctgcgtgaggcggcgatcaacaacgactttcaggtagtgcttttgagcgaggacttcaacccgatcttcgcgatcgaaacgcggcatcagaccacaattaacgaggcgatccgccgcgggaaggaagcggcgctgaacctcagcaacatctacagtctgatcgagatcgacggggtgctgacctactggggtctggtacacatcaataacgaaaaatactatctgttcattgtcgataacgacgacaattattcgtccggcgaaatgaccaagctggccgagatcatcgagctggcgatgggcatgtggaagtacacgccggagcgtgacgcgaaggcagagcttgtcaaggcgctgatgcgcggcaacaagagtctggcgtattcgatccgcgaggaagcaggcgtgaaattaaccgacattctttcggtcttttatgccaaaggtattgaggataaccatgcggaggaagtgattcatcggtttgtcagcgagggccttttggacatcatcaagatcagcgaggaaaacgaaagctacgcgctgctgctcaagggggcgaagctggctgatcaggaggaaaacgaggaaaaggctgtttgcctgagattcttcgacgcgctcaaggaaaacaagacggtccgcattttccatgtgaccggcatcgacggcatcgagggcgcaggagacggattccgtctgatcggcgaaacctgggcgtttgtaggaagcattttcccgtacaagcgggtgttcaccaaatatgaactgacactggtcagcaactgcatcaatattcaagtgcagggcggctatctgaaaaagaactatatggatcttttggagccgtttcgcaaggagggggacaacaagtccaggcagcttttggaaaccctggaaaccttcgtgttggacgcgggcatgaacagcggcaagacctctgagtttatgggcatccacacaaacacagtgcagtatcgcctgaagaagattaatgaaatcctcggcgcggagattaccggaaaccgcgtgattccgggattgacaatcgcgctcgcgctgcggagaatggaagcggcgtcgaaatag

SEQ ID NO: 757 - DNA, 2640 bp, Unknown
  Description of Unknown: Firmicutes sequence
atggaaagactaggattaaacgaaatcagaaggcgatttttggacttctatgcttcaaaagaccattatgtcggtaaatcagccagtttgattccgcgaaacgacaaatccatactcatcattaactccggcatggcgccgctcaaagcctattttgccggaacggaaacaccgccaaagaagcggatgtgtacctgtcaaaaatgcattcgtaccggcgatatcgataatgtcggccatacggcgcgtcatggtacattctttgaaatgcttggaaatttcagctttggtgactacttcaaaaaagaatctctgagctggggcgtggaatttttgacgcagcatttgggttttccactggaaaagctgtgggcaaccgtttatttggatgatgaggaagccatcaacatctggaaatcactcggcatgaatccggaccatatcgtgcggcttggtaaagaggataacttttgggaaatcggactcggcccatgcggaccggactcggagatattttacgaccgaggggaagaattcggctgcggtaaaccggactgcaagccgggctgcgactgcgaccgtttcttggaaatctggaatcatgtgttcacgcagtttagcaaggaagaggatggatcttattccaatttagcgcatccgaacatcgataccggcatgggacttgagagaatggcctgcgtaatgcaggggacagattccatcttcgatgtcgataccatcaaatatattctcgacggtgttgtagaaaaatccggcgtaatctaccatgacggagcggaaccaacagatgtttccatccgcattattactgaccacctcagagccatgacttttatgatcgcggatggcatcatgccttccaacgagggcagaggttatgtgctgcggagacttcttagaagggcggcgcgccatggcaggattctcggcatagagggaagcttcctggtcgccttatcaaatcgtgtcattgaggtttcgggagaagcctatccggaactacttgaaaagaaagagtacatccaaaagattattcaggtagaggaagataattttgcggccaccattgataaaggtgaggaaatcatcgcgggatatatcgatgacttaaaacaaacaggaaaaaccgtcttggacggagccagcgttttcaagctttatgatactttcggcttcccgttggagctgactgaggaaatcttagcggaaaacggctttaccgcagacaaagaaggcttccaaacgcacatgcaggcgcagaaggagctagcgcgtaagaacagaaaatccaatgaggatgagggctgggacaaaaatgaacttgacctcgatattccaaagactgtttttacaggatacgacacgctcctggataccggcaagatcttagcgattcttgcggatggaaagctgactgattctgtcagtgagggacaaaaagcggtagtccttgtagatcaaacaccgttctacgcggaaggcggcggacaagtttgcgataaaggttttatgtcaaccgttacagaggctgacgatgaaaaaatctttgacgcggaagttataaaagttgaaaagaaagatggaatcttttatcatacggtcatggttttagctaattctattcatgtcggcgatgaggtcttgcttacggtagatcctgaaaagagaaatgcggcggccagaaaccataccgcgacccatctgttacagaaggcacttaaggaagtgctcggcaatcacgtggagcaggcaggctctatggtcaacgaatcgatgcttcgttttgacttttcccacttcgaagcggtgacaagtgaacaactcgcgaaggtcgaagctatcgtcaacgaaatgatcgacaatttcctgccagtaactaccgccgaaatgagtttggaagaagcgcagaaaaccggcgcgatggctttattcggcgaaaaatatggttcgaccgtcagagtggtcaatgccggagattggtctatcgagctttgcggcggtacgcatgtaaagaataccggagagatcggcgcgtttaagattatctctgagggcggtgttgcttccggtgtcagaagaattgaggccgtaaccggtgccggcgttcttcaggccgcgaaacaggcagagaatatcctcggacaggtttgtgaggcgttgaaatgcaataaaactgtcttagcggataaagcgaagtctatggcagaggaactcaaagcgcttaaaaaagagttggaagaaatgaaaaaggccgcaatgggcggcgaagctgacgcgatggtcgcaggcgctaaacaaatcaatggtgtcaagcttatctgtaaggaattcgctgattaccagatcgcggatctcagaaacctttctgatgatatcaaggcggcaaacaagggcattgtgatggtattcgcgaccgttaacggaccgaaggttaccttcctggtatctgtcacggatgatttactggacaaaggttatcacgccggtaatatgattaaacagatcgcggcagcctgcggcggcggaggcggcggtaaagcggacatggcgcaggccggagcaaaagatccgtcgaaaattaaagacgcatttgcgcttgcggaatctctgataaaatga

SEQ ID NO: 758 - DNA, 2004 bp, Unknown
  Description of Unknown: Firmicutes sequence
atgaaaaagattacccctgacttctttaaggaatacgttaatacaacagatatgcagtataacggcaacgacctgttttcgtttgttcgctatgacactgtttttgaagaggacaaatatgtttccaatctatggctttttgacatgaacaccaacactgtcaaagaacagctgactttcgacgattctgtcggcatgcaccagtggctcgatgaagaaaacattatcatcgcaacagctagaaccgaagcagaaaaagccgcacaggaaaaaggaatccctttagtaattttttataagtttaatattctgagcaaggaatataccaagctgtttgaagtatacaagaatgtctacaaatttgaacgtatcgatgatgatcgctatcttctgctggccagcgaaaataaaatgcgtgatcgttacctggaagccgccggcggcgactgggatgagtatatcaagattcaagaaaaggaaagcaaatactttatcgccgatgaagttccgttttggacgaatgacggaggatactgtaatcaggagcgtggccgagtctatctttacgacagcggcgagttgaagcaacttacacaggatgatatcagcgtttatgatatcaaatcctacaaaaatctgtacggcctcttttacggcgtagaatccggcggcatgcagcgaactgagggcaaagtctataaaatcaactacaaaaacatggagattacaccgattgatgactcaaaccattacatctacaccaagattcaaccgattgatgaaacgcatattttgcttggtcgcaatgaccgaagttttcatggggaatatcaaaatgaatacattgacattttagatatgaataccggcgagtttacacgaaacaacaaaactacagatatccactactacgataatgtgctgaccgacattacctatctcagtggctggttaaacaagatcttgacaacgccaaacggtatcatctatatcagtacgcgcggcggcagttccaaactctacttcagtccattcggcgatgacagtatgcaagaactgacacatccagatggcaaaattctggactacttcctctgtggcgacaaaatttacatgtctgcgatacgtggtctctctggaggcgaattctatattcttgaccttgtcaccggtaaagaaacgcaggttagcaactataacgaccatttagagaatgaatacaactatccgcaaatggaaatctgtaatttcacaaattccgacggtctggaaattgagggttggctgatgaaaccagtcgatttcgctccagataaaaaatatccggcgatcctcttcatccatggtggtccaggctctgcttatggcccggtagcaactcacgaaatgtttgcgatgtgcgcggaaggctatggtgttttttactgtaacccaagaggttctgaaggaaagggcggtgctttcgctgatattcgcacgaaatggggtactgttgattatcgggatcttatggaatttaccgatacagttctcgcgcgtaatccttggattgacgtaagccgggtcggcatcaccggtggttcttacggcggcatcatcatcaactggattatcggccatacgaaccgttataaagcagccatttctgaccgctgtgtttctaacctgattagtgactatggcatgtcagatatcggtttcccatgcaataaagatacctatggaacaaccccttgggaaaatcttgaatatctttgggatcaatccggactgaaatacgctccgaatatcaagacaccggttctctttatccatggcgtggatgactaccgctgcacttatgaccatgctcttcagctgcacagcgcgattacctacttcggcggcatatctagagttttcgcggtcaaaggcgaaacacatgaactttgccgcagcggaagtcccaaaaaccgggaacgcagaattctcgaaatgcttcattggttcgaaaaatatctgtaa

SEQ ID NO: 759 - DNA, 1467 bp, Unknown
  Description of Unknown: Firmicutes sequence
ttgaatacgaaaattaaattcgaccgtcacagcatcaaattccgcctgtggatgtatttcatcggcatcggcgtcggaattctgctgctcgtttggtttctgcagattttttttctgaacaactattacgagcacatgaagactacagaggtcaatcgtgttgcctcctccatctatcacgcctacgcgcgcggtgacgcgggattgacggaggccattcaggatctttccatcagcaacgacttctacgtgatgatggaatccggcggcaaggttctgctgttcatgccggaggcagagagtctggttccggtctatcagtacaaggatcaaatcccgaagctgcgcggcatgctgcaggaggcgcccgccaaaaccacagcggtttccttcaagatcaataccggtttggaaaagtacaacacccttgcttacgcgacctatttgagccggacaaagaatcaggaggttttcctctacatcttctccccgctgtatcctgtcacttccaccgttgaaattttgaaggaccagttgttttatgtgaccatcatcaccctctgtgtcaccttcctgctcgcggtttactttgccgaccgcatttcgaagccgctcaagggtatcacgcaaaccgccagaaagatgggaaaaggcaactacaatgtcaggtttgaggcgaactcctattccgagattaacaatctcgctaagacactgaacgtcactgcttatgaactggggcaggcggacaaccgtcaaaaggatctggtcgccaacgtttcccacgatctcaaaacaccgctgacgatgattcgctcctatgcggaaatgattcgcgatctatccggcgacaatccgcaaaaacgcaatgcgcatctggctgtcatcatcgacgagtctgaccgtatgagccggctggtcagcgatatggcgacaattaccgccatgcagaccaaaaagatgaagctgcacaagacgccgacagacttatcctcgaccgccgcttctattctggcttcttacgaaattctgcaggagcgcgaaggctatgattttatcttcaacgcgccaaaggaggctttcgtctacgcggatgaggataaaatcaaacaggtcattgcgaatctcaccggcaacgcggtcaaatactgcggggaagacaaggtgatcctcgtgacgatccgcaagatcggcaaggtctttcgtctggaggtttccgaccatggtcccggcatcaagccggaggaactgccgcatgtttgggatcgctactacaaaacgagcacgaactatgtccgggaaacgaccggcaccggtctcggcctctccattgtcaaggagatcctcaccctgcacggcgccaattacggtgtcgaaagcaaggtcggcaagggcagtaccttctggtttgagctggacgttctgcgcaaggagcgcgaaaaaacaccgaaggagaaaaaatcctga

SEQ ID NO: 760 - DNA, 1191 bp, Unknown
  Description of Unknown: Firmicutes sequence
atggaactatcaaaaaagattcaagcaatggaactctctccgatcagaaagttcgttccttacgctgatgcggccagagcggcaggcaaaaaagtttacggactgaacatcggtcagccggacatcaagacaccgcgtgcgttctttgacgcagtcaagaacttcgaccaggatgtattggcctatgctaattcccaaggcattccggaattattggaagctctagtcggttactacaagagactgggtcttgattttgaaaagaaggatctgctggttaccaccggaggttctgaagcgatttccatgctgatgaccgcgctgctggacgatgacgatgaagtcatcatggcagaaccgttctataccaactacaagactttcatcgcggctgcgggcggcaaactggttggaatcccgacgactgcggaggaaggctaccagtacgcggtaaaagaaaagatcgaagctgtgattacgccgaaaaccaaagccatctgcattatcaacccgggcaatccgaccggcaaggtgttgacacacgacgaaatgaagctgatcgtcgataacgcgatcgcgcacgatctgttcatcattgcggatgaggtttacagagaattcgtttatgacggcaagcgcatggataccttcggttccttcccggaagccgcacagcatgtcatcatcgtggactccatctccaagagattctccgcgtgcggcgcgagaatgggttccatcgcctccaagaacgaagcgctgatgggaaatctgatgaagatctgtcaggccagactgtgctgtgcaacgctggatcagatcggcgcggcggcgctttacaacatggatccttcctatttcaacgatatcaaggcggaatatgagcacagaagaaatgttgccgttgaagcgctgaacgaaatcgaaggcatccagtacggtgttccggaaggcgcgttctatatcacctgcaaacttccggtagacgatgccgaaaaattcctgatgttcctgctgacagagttcgatgtcaacggcgaaacctgtatgttcgcgccggcaggcggattcttcaccaatccggaagcgggcaaatctgacatgagaatcgcttacgttttgaaggcagaggacatgaaggccggcatcaacatcatcaaagaaggtatcaaggcgtacaacgcgagatag

SEQ ID NO: 761 - DNA, 2325 bp, Unknown
  Description of Unknown: Firmicutes sequence
atggcagaaagaatggtcatgccctgcgtgccgctgcgtggattgtcggtgtttccgcacacgatcctgcattttgacattggcagggaaaaatccgtcaaagcactggaagccgctatgacggcagataaacagttatttctgacttctcaaaaggatgaaaacatcttgattccgacgccggaggattattacgaggtcggaacggttgtaaagatcaagcaaatgctcaaaatccaaggtgacgcagtgcgggtgctggtagaaggccagtatcgcgcggtgatgagcggcgtcgcgacggaggagccatatatcatggcagagcttacggaggcggaaattacgccggcagatccgcaggaggtagaagtgcaggcgatgatgcgctctgtactctatgccttcgatgaatacatggaattgaacccggcaatcaaggatgaggtttatgagctgatcagctcgatcgaggagccggatatcttcgcggatacggtggcgatgcagctggacgttaaggttgctgccaagcaggaggtgctggaggccttcgacgtgaaacagcgtttgcaaatcgtcaaccgccagattttggaggaaaatcagattcttgccatggagcgcgacatcagtgagcgtgtgcaggaagcggtgaaacagaatcagaaagaatatatcctgcgcgagcagatgaaggtgattcaggacgaactcggctacggagaagaagccgcaagcgaggcggagcgctggagtgagcagcttcaaaagctgaagctcgatccgaagattgaggaaaaggtaaaacgtgaaatcgctaaatttaccaaaatgccgccgagctccgcagacggcagcgtcatccgcaattacgtggagacaattttggaattgccttggcacaaatcctccaagaccaatgctgacctcaaaaaggcggaacgcattctcaacgaggatcactatggacttgaaaaggtcaaggagcgtattctcgaatatctggccgttgtgcacctcaataaggcgatcaaaggtccgattatttgtctggtaggacctccgggtgtcggcaagacctcgatcgcgaaatccatcgctcgcgcgacgggcagagagtttgtccgcatgtcgctgggcggcgtgcgcgatgaagcagagatccgcggacacagaagaacctacattggcgcgattccgggacgaatcattacctctatcaaagacgcgggcaaggataatccggtcttcctgttcgacgaagtcgataagatcggcgcggactttaaaggggatccggcttcggcactgctggaggtgctggacccggagcagaacaaggaattcaccgatcatttcctcgacattccgtttgacttatccaaggtcatgttcattacgacggcgaactccaccgaaacgattccgcgtccgcttttggacagaatggaagtcatttcggtaccgggctacaccgaggaagaaaaagtaaaaatcgcgcagcagtacttaatcccgaagcagattcgggcacatggcttgaagccgaagaattttttgatcagtgagaaggctatccgcgatctgatcaattattataccagagaatccggcgtgcgtaatttagagcgcgagatcggaagtctctgccgtaaggtcgcgcgtaagattgtttctaaaaaagggaacgcttttcgcattacgccggcgagtctggaaagctatctgggcaaaaaaagatatcattacgatgtcgtagaaggcgagagtgaggtcggggtaacgaccggcatggcatggacacaggtcggcggcgatacattgttcattgaaacagcagtcgtgccgggaaccggcaagattcagctgaccggacagcttggtgacgtgatgcaggaatctgcgaaggcggccatcacttatattcgttccattgcgggcgagtacggaatcgatgaagaattctataagaagaacgatctgcacgttcatgtgccggaaggcgcggtgccaaaggacggcccatccgcgggcgtaacgatgttcacctcggtgatgtccgcgctgacaggcaatccaatccgtaaggacgtggcgatgaccggagaaatcacgctgcgcggtaaggtgcttccggtcggcggcatcaaagaaaaggtactggcggcacaccgcgcgggcattcgcacgattcttttgccgcgtgaaaacgaagcggatatcgaagagattccgcaaagcgtgcgcaagcagctcactttccacctgctcgataaagccaaggaggctttggaatatgcgatggtaaaagattcagagtga

SEQ ID NO: 762 - DNA, 1107 bp, Unknown
  Description of Unknown: Firmicutes sequence
atgtatataaaaagcatagaactgaaggattttcgtaattacgaaaatctttctttaaactttgatccgcgcgttaatttaattttgggaaaaaacgcgcagggaaagacgaatcttcttgaggctgtttatctgacttctatcggcaaatcctttcgtaccaatcgattgagcgagctgattcgcttcggacaggattacggtaaggtgtttgtggaaacctgccgagaggacgaggaaggttcggtggagcttatcctcagcaaggattccaaaaaatcagcgaaaatagacggtgtgaagataaaaaaagcctcagagcttttggaacacgtttatctggttatattttcaccggaggatttaaaaatcgtcaaggaagagccggaaaaacgaagaaaattcatcgatagagagctttgtcaaatcaagcctctgtattacgataatctcacacgctatcaccgtatcctcatgcagcgtaacgcttatttgaaggaaacacaggtagaaccggcggtgctggatatctgggatcgccagcttgccgcgtgcggcagccgcatgatgctgcaaagagaaagttttatcaaaaaaatcaatcagatcagcagcggaattcatcgggatatcacgaaccaaaaggaagcgcttaaggtgtgctacgcgccgaacgtcaagctttgcgaaaccgagaaggagcaggaggagtttttatatcagtctttccaaaaatcgctggagcaggatctcagacagcgcgcgacaaccaaaggtccgcataaagatgatttagaattttttatcaatgatattaatgtcagaagcttcggttcacaggggcagcagaggacaacggcgctttcgctgaagctcgcggagatccatattatcaaggaggaaacgggcgaggatccgattttgcttctcgatgatgtgatgagtgaactggattttgaaaggcaggaatttttggttaagaccttatccgatgtgcagctttttatcacgactaccgagataccggatattttatttcaaaaatttcctcactatcgcgtttatcaggttgaaagcggcaaaatcagcgccagccccaagcggtaa

SEQ ID NO: 763 - DNA, 1227 bp, Unknown
  Description of Unknown: Firmicutes sequence
gtgcgacatgcggaggcgcatggcaaaacaagaagaacagagataaaagagagggacaagaagatgaacattgcagaagcagcgcgaaaatacgctgattatacgattgaaatgagaagatatttccacaagtatccggagctgagtttgcaggaggagaataccgcgaagaagatccgcgaagaactgaccaaaatgggcattccatttgtcacgatggcgaactacggcaccgttgccaccatcggcggtaaaaagccgggcaaatgcgtgctgcttcgcgcggatatggacgcgttggcggtacaggaggaaaacgattttgactacgcctccacaaagccgggcgtcatgcacgcctgcggacacgacagccacagcgcgatgctgctcggctgcgcgaagattctcaaggatatggaggatgaaatcaacggaacggttcgtctgtgtttccagctttccgaggaaaacggacaaggcgcgaaactgatgatcaaggaaggactgctggacggtgtcgatgcctgctttgcggcccatgtatgggcgaacgtggacagcggctatgttgccgtcgcgccgggacctgtgatggcaggcgccagcctgtttgaaatcgaaatcaagggaaaaggcagccatggttccgcgccgcatcagggcatcgatgccctgacgaccggctgtgcggtggtcgaagaactgcaaaaaattattagccgcgagattgacccgcaggacgcggcggtgatctccgtcggctctttccaaagcggtacgggttggaacattatcgcggattccgccaaactggtcggcacgacacgctgcttctccagagaagtcaacgctatgctgccggaggcgatggagcgcgtcgtcaaaaatgtttgtgaggcgcaccgctgtgaagggaaactgatctataccccgatcgtagatccgaccatcaatgacgaaaagatggcgaagatcgcgcagggctctgtcgcgaagatctttggcgagaacaggatccaatacatgaagccgacgaccggaggcgaggatttttcggaaatgatgcgtgaaattccgggcgcgatttgcatgataggcgtgcgcaatccggagattgacggcgtttacgcgaaccatcacggcaagttcaaggtagacgaggagcagatggtcaagggcgcgggactgtacgcgcaaatggcggtagattatctgaatcagtaa

SEQ ID NO: 764 - DNA, 1809 bp, Unknown
  Description of Unknown: Firmicutes sequence
gcggtcagcggcaccatgctggcctcgacaacgcaaggacgctatgtggtggaagcgatgaatctggccggctacggcatcgcagtgccaggcgtgcatgaatttgattacggagtttccggattggtgggcacgctgtcaaagggagcgaagcatcaatatatcagctgcaattttacgatgacggcaaacggacagacggtgttcaaaccgtatgtcatcaaaacatacggcagcgcgaaggtggcctatatcggcatcagcgatccgcagacgattagtaaatccggcgcgtcgtttaagaacagcgacggcagtgccgcctactccttcgcggatggttccggcggcaagaagctctacgaagctgtgcagaatgccatcgacgaagccaaggcagccggcgcggactatatcgttgcgatcggtcatctgagtacgacaggagacgcggcttacacgccaaagagcgtcatcgaaaacacaacggggattcaggcgtttatcgacggcaatacgcatacagccattgtcggtgaaaaggtcaagggcgcggatggcgctgaggcgctgctgacttgcgcgggcgcaggtctgaataacatcggcgttttgaccattacggcaggaaagagtatttcctcccaattggtaaacagctatcgcttgcgcgacattaagaccaaggacggaattgacgcgctgaccaaaaagtacaaacaaaatctacaggaaagcttcgcgacgaccagcagcaggctggaggcagctaacagcagcggcgtcagaattgtcgagggagccgaaacaaatctcggagatctctgcgcggacgcgtaccgtgtggtaaccggagcggatattgcttttgtcgaggcgagagagatcaagagcaatattgaactgggctcaatcagctatgatgatattatgaacgcgctgccgggcggacgctcgatcagcgtgatcagcgtcagcggctatgatatccttgacgcgctggaaatgtccgcgcgggtttatcctgccaagaacagcggttttttgcaggtctccggcattacctttgacattcaggaaaccgtcattccgtctgtaacgctggatggagacggcaattttacaggggttacggacgactatcgcgtcaccaacgtaatgatcaacggtaaggagttggatgtgatggcgaattacacagtcgccggtaccaacgcgctgctgaacggggagactggttatacaatgctccaaaacggtccgctcaaaaaagccaacatcacgaccgataatcaagccctgatcacctatatcgccgcttcactcaaaaacagcatcggcggcgcgtacagcaaatcgcagggccggatcgattcgatcaagctggcgagacaaagcgagattaacgccgaaatcgaaaagaagattgaagaaaagttgaaagactatgccgtggaggtaaaagcgctgcgagaacagctggcgatacagcaggacatcatcgcgatgaaatcgctttctctcaaagtgacggcaaaattcagcaagagcggcagcaaacgcactgtaaaggtcacttggacaccatcctcaaagatcagcggcgtcaaataccagctttacaaatccgcgaagaagtctgcaggcttcaaaaagctcacgacgacttccaaaacaaccattcgaaacacaagcggcctgcgcaagggaaaaacctattattacaaagtccgcgcgtacaagtacctcaagggaaagtactattacagcggttggtccaatgtacgcagctgtaagatcagcaaatag

SEQ ID NO: 765 - DNA, 1677 bp, Unknown
  Description of Unknown: Firmicutes sequence
atggaattcaagagcgacattcagattgcgcaagagtcagttatgacaaacatcagtgagcttgcggcacaggtagggatcgatgaacagtatctggaactgtacggcaagtacaaagcaaaaattgattacagattattgaaggacaaggcagatacgccggacggcaaactcgtgttggtgaccgcgatttcaccgacgccggcaggagagggcaagaccacgacaaccgtcggtcttgcggatgccctgcacaaaatgggcaaaaatgtattcgctgctttgagagagccatccttagggccggtattcggcatcaagggcggcgcggcaggaggcggctacgcgcaggtagttccgatggaggacatcaatctgcacttcaccggcgacatgcacgcgatcggcattgccaataatctgattgcggcctgtctggacaatcatattcagcagggcaaccgtctcggcatcgatgtcaaaaagattacatggaagcgtgtcgtagacatgaatgacagacagctgcgggagatcgtggacggcctcggcggccgcatgcagggcgtgccgcgtgaggacggttttgaaattacagttgccagtgaaatcatggcaattctttgtctttctaaagatattttggatttgaaggataaagtggcatccatcatcgtcggctatacttatgacgatcagccggtaacggtagctgatttgaagattcaaggcgcggtcgcggcggtgctgaaggacgcgctcaagccaaatctggcgcagactctggagcatacgccggcgttcatccacggcggaccttttgcgaatatcgcccatggctgcaattccatcatggcgactagaatggcacttaagctggccgatatcgtggtcacagaagcaggcttcgcggcggatcttggcgctgaaaaattcgttgatatcaaatgccgtaaggcaggactgcatccttccgcagcagttgtggtcgcgaccgtcagagccttaaaatatcatggcggcgttgccaaggaaaatctaaaccacgaaaatctggaagcgctgagcaagggtctgccaaatcttttgcagcatgtcgaaaacgtcacgcgcaattttggtcttccatgtgttgtcgcgattaaccgcttcccaacagataccgaggcagaacttgcgctggtcagagaaaagtgcagggagcttggggtaaacgtcgcactttctgaggtctggagcaaaggcggtgcaggcggtattgagctcgcggaagaagttctgcgtcttgtagagggagaaaacaactttcacttcgtctatgaggacgatctgccgctcaaggaaaaaatcgaagctgtcgcggccaaaatttaccgcgcggatggcgtaagctttaccgcagccgcaaaaaaacaacttgataccattgagaaacttggcttcggcaagcttccggtctgtatggccaaaacgcagtacagcttctcggatgatccgactcttttaggagcgccgcgtggcttccaaattacgatcaaggacgttaaggtgtgctccggcgcaggctttgttgtcgccaaaaccggcgatatcatgacgatgccgggcctgccgaaggtgccggcagccgaaaagatcgatgtcgatgaaaacggcgtcatcacagggcttttctaa

SEQ ID NO: 766 - DNA, 1443 bp, Unknown
  Description of Unknown: Firmicutes sequence
atgacctacgaaaaggaaattccggagtacgcgatggtgccggcaaaggaaatggaggagcgcgtcatcacgcccgtcggcaaagaggccgtctataccgaggtacagctcaccaacatcagccaaaagcccaaaacgatgattaccatagaagaggacatcctggtgccggataccaagccggatctcgcgagaattttgttgattgacggaacgccgcgcccgtcgaaccgccgtctcgggcccgtagagaagggagaggattccctgagtctctccggtgaaatcgaactgcagacgctctatcttcctgaaaaacaggagggtgcggaaaccgtgatttcggtgcagacgcgagtgccgtttcaggaacagtgccatatcgcgctgacgccggaatccacgctgcaactggagattcatgtcgaaaaaatcgagtacatggtcattaacgagagaaaatatcgcgtcaagatttttttggcactctgcatccgcgagtatgtcgaccgcaatccggcgctttttgaaagcatcaacggagaagagattcagacgcggcgggaaaaaatcgaaatgaccaacgtcgcgcagagaagaagtgataccctgcatatctgtgaagatctggatatcaagacagaatacccgccggaagcggtcctctgtcagagcatcgcggtggtagagaattataaacaggtgacagaagaaaaggtggtaatcagcggctttgtctgtgtcaatcttttgtatcgctgcagagaagatggcgaatattgcgaggatctgcatcaggcgcgcgaaaaggtggaattcacgcagttcattccgctgcatggcggcggggtcgcgggcgcgggcagtcagattgtcttcgatggcagtgaccttagggttaagccggcgcgcggagaagatggggaagaaattctgcgcctggaaggagatcttctgaccgaagtcgaaatctaccgcaatacggaacgggctgtcgtcgtggacgcttatcacagacaaaaagattttttgtgtgattatcaggaggaaccctgctgcacactgatcggaacgacgatgggagaggcttccttacgggagattttttcaccggagctgccggagagcgagctcgcgcgggttctgtacacagagggaagggttttggatggacacagccgctgcgagcagggcaagattgttacggagggaaagctgtctgtcagacttctctgtctgtgcggtggaaacccggaaacagcaggacagctgttcagcgtaacggaggaactgccgtttcgcgtggtaacgagtctgccgcagctagaaggcagcgagagcattcgcgagcagatctttatcaaggagctttgggcagaaaagatcaatgggaagcagctcgaatgcagcgcgaacgtactggttatgacggaggtgacgcgg

SEQ ID NO: 767 - DNA, 1383 bp, Unknown
  Description of Unknown: Firmicutes sequence
attgagctgattgacgagggcgtatacattgtcgatcaggacggtgtcggcaaattctacaacaaagcgatggcatcgatggaaaaagtcaatattgaggacgtactgggaaagaagttccacgaagcttttcctgattttagtctgagcgagagcacgatgttcgaagcactcaaaaaaaacaatccgactcttcgcaagcagcagacctacaaaaatctctacggcaaggagattacaacgatcaacagcacgattcccatcattgcggatggcaaaacggttgccgcggtggaagttgccaaggatatcaccaatattcggaagatgtcggataccttgttggagttgacggagggcaagcgcgaaccgcgcgccgaagaggatgaagcgcagcctgtcggcatcaaacgctatacctttgacgacatttacggtgaaaatcaggtctttcggcaggtcattacccgagcgaagaaggccgcgctgaacgatgcttcggtctttatctacggcgaaaccggaaccggtaaggaattgctggcacagagcattcaccatgcgggcaagcgtaaggacagaccttttttggcgcagaactgcgcggcgattccggaaacactgctggaaggcattctgttcggcacgacgaagggggccttcaccggcgcggtcgatcgcgcggggctctttgagcaggcaagtgggggaactctgctactggacgagatcagcgcgatgccgtatgacctgcaaagcaagctgctgcgtgtcttacaggaaaactatattcgccgcgttggcggcacgaaggatatcccggtgcgggcgcgcatcatcgcgacggttaacgaaccgccggaggaattgatggcgcaagggaagctgcgaaaggacctttattatcgtttgaatgtcgtgaacctctggattccggccctgcgtgagcggccggacgatattcctgtgcttgcggaagcttttctccataagcacaacaagcgattcggcaagcagctctgggctatctcggaggaagcaattgtaaaattaaagcagtatgattacccgggcaatgcgcgagaactggaaaatctgattgagcaggcagtatccatggccgacaaggaacatgttttgagcgataagatgttggcaatgccgagtttcgggcggcgcgcgcatctggcggagcagcttcctgagcgcagctatgacgcggaatgttctctgccggactatctcgcagaggtggaaatacggattatccgcgaagccatcatcaacgcggagggaaacatctcaaaggcggcggagactttgcagatcaagcggcaaactctgcagcataaattaaaaaaatatcacatcagcgtgctttga

SEQ ID NO: 768 - DNA, 1347 bp, Unknown
  Description of Unknown: Firmicutes sequence
atgaagatcttgaatccgaaagacaaaaatgattcgtatcagaaccgggaggatatattttttatgaaagcaacatttatttcaagagaaaacaacaatgtaaaattcacgatggaatttacggcggaggagtttgaaaacgcgcagatcaaggcttatcaggcgtccaaggaccagttccagatcgacggtttccgcaagggcaaagcaccgagaagcatcatcgaaaagcattacggtgaaggcattttctttgaagaagcgattgatgagctgttcagagaaaactacggcgaagcgttaaaggaattagaccttgaggtcatcgacgcgccggccgcggaattcagcaagatcgcgaagggggaaggcttcaccatcaccattacagttccttgcttcccaatcgtagaagtgaaagactacaagggcgtggaaatcgaaaaggttacgcaggaagtcaaggacgaggatatcgacaatgaaatcaaagcgttgcaaaagagaaacgcgcgctctgtcctggtggaaagacccgcgaaggaaggagacacagtacttttggactactccggctttgtaggtgaggagcagttcgagggcggcaccgcggaaagacagaagctgacgctcggctccggcatgttcattccgggctttgaagaacagctgatcggtgtgacaccgggcgaaaagaaagatgttgtcgttacattcccggaagagtaccacgcagaggatcttgcgggcaaggaagcggttttccactgcttagtacatgaaatcagcgaagaacagctgccggagctggacgacgaattcgccaaggacgtcagtgaatatgatacactggaagaattaaaaaaggcaaccaaggaaagactggaagtatacgcgaaatcgtccgctgaaaatcagatgaaggacgcggcgattttaaaggtcgtagaagcgaatgatgtggaagttccgaagtctatggttgaggatgaaatcgaccgcatggcgaacgaactcgaccagcagctcagatatcagggcatgggactgaatcagtatctggaatttgttggaaagaatatcgcggaattcagagaggaactcagaccggaagccgaaaaatccgtcaagacgcgcatcgtgctgatgggtgtcgctgctgcggaagctctgcaggttaccgatgaggaaagagaagaagaactcaaggcgatggcagcgcagtatcaaatggaagtcgaaaagatcaagagcctgatcggcgaagaaaaccttggtttcctgacgaaggatctgcaggttaagaaagcaatcgacttcatctatgacaacgcgaagatcaaataa

SEQ ID NO: 769 - DNA, 1824 bp, Unknown
  Description of Unknown: Firmicutes sequence
atgcagaaaggaatttgcgatatggatattttctcggtgattaccctgctcggcggactggcgatgttcttatacggcatggaggtcatgggagacggactcaaaaatgcttctggctccgcgctcaagcaggtactcggcaaggcgacccaaaatctgatattgggtgtcattacaggtatgctggttacagcggtcattcaaagctcgaccgcgaccattgtattgacggtcggcttgatcagtgctaatattttagatttaaagcaagcggtcagtatcgtgatgggcgcgaacatcggcactacggtaacggcacagattattcgtttgatggatattgaatccggcggcagtctacttatggatttttttaaaccttccacgctggcgcctttggcgctgattgtcggtgttgtgctgattatgttcgtaaagggcaataagagcatggcgaccggcgaaatttttgcaggcttcggcatcctgttcagcggtcttttgaacatgacagcagctgttacgccgctttcggaatcacaggcttttttggacctgatgcagcgtttcagcaattatccgctcattgcgatcctgctcggacttgtgatgaccgtcatcgtacagagttcttcggccatggtcggtatgattcaggcgctttcggtaacgggcgcgatgactttcaatctggtgtatccgttgatcatgggtatcaacctcggcacctgcgtgaccaccgcgctggtttgttccattggttcttccaaggacgccaagcgtgtcggaatcgtgcatatcgcgtttaacgtgatcggtaccattctgtttatgatcgtcatgaccatcataaaatctatgggcggatttccgaatctgtgggaaagcgtggcaaacagcggcagcatcgcgaacttccagaccttattcaatctggtgacggcgattgcgttgattccgttcgcgggatttttggtcaagctgtccattgtgatcgttaaaccggatgctcgtgacgcggaggataaggcaaacctgatggtaccggatgtcaaactctttgaggttccggcgatggcgctcagcgaatgtaatcacgcgatcgcgcgcatgggtgaggtggctttgaagaatatcagacgcagctatcagctgctgcaaaactacgatgtcaagcgcgtcgatgtcatcaacgaaaacgaggatcagttagaccagttcaccgacgcgatggacggctatttggtgaatctttcaaaatatgttgaaaccgataacgacaaccagagcatcaatatcttaatgcaggcaaatacgaactttgaacggatcggtgaccatgcggtcaatatcatggaagcggcacaatctgtcgctgtggataagattcaactttctccggacgccaaagccgaaatggatatcatcaaagaggctgtcatgaacatcacgaagatgaccgtagaggcttttgacagctaccattataacctcgcaaaaaagatcgagccgctggaggaagtgatcgacgatatggtggtatcggcgaagaatcatcatgtggagcgtctcaaactcggacagtgcaatatggagagcggcatgatcttcgtggatcttctgacaaatctggagcgtatcgcggaccaatgttccaatatcgcgctgctgattttgagtcaaagagataagtccattctcggcaatcatcataactacctcaatgaactgcacaagggcggtgatgtgacctacgacaaggagctggaatggcaaaaagaacagtatcttgaaaaattccgccgaatcggacaaaaagcgtag

SEQ ID NO: 770 - DNA, 918 bp, Unknown
  Description of Unknown: Firmicutes sequence
atgtataaggttagattacagtccttcgagggcccctttgatctcctggtctacctgattgaaaccgccgaaatgagcatttatgatatcaagatcagtcagattaccaatcaatatctggaatatatgcaagccatgaaagaacgcgatgtttttgtctcgacggaatttatggtgctggcggcctctttaattgagattaaatcgaagatgattttgcctcgggtatcgcaggaggacggcgctttgctggaagaagatccgcggacggagctggtagagcgtctgctcgaatacaaacgcttcaagcaggcggcgcggttgtttgaggaacgcgaggaaagcggtacgcgtatttttgagaagccgcaagaggatatttcaatctatctgcaaaatccggatgaatatctcagtcttgacatcaagcagttcgcggctgcgttccgtctttttatcgagaaaaaacacaaggtcgagtctgtcaaaaagcattacgagcgtgtcgaacgcgagcgtgcctccatggaaaagcgcatgagcctgatcctcaaggcagtgcgccgcaagatcggtcaagtattcagcttcaaagagctgattcagaatacaaaggatcgctatgacatcgtcgtgaccttcctttctcttttggaaatggcgaaggaacgcgtgatccgcgtcgatcagcaggtaaattacggtgatattacggtgtccgcgggcgagcgggtccatgaagatacagtattggaaagctatgatgccgcggaatcgggaaggtatgacgaggaacccgcgtcgccgctcggggaagccgcggcagatgtaacaagaagcgcggcagccgcgccgcgaaccggcagacagtgggaagcgggaacgaaaggagaggcggaaaacggcaatgacaagtaa

SEQ ID NO: 771 - DNA, 1512 bp, Unknown
  Description of Unknown: Firmicutes sequence
atgagagaaataggttttgacgcggacaagtatatcgaagaacagtccaaatatattttggaaagaatcaaggcgggcaatgggaagcggctgtatttagagtttggcggcaagctggtgcatgacaagcacgcgatgcgcgtactgcccggttttgacgaaaacgcgaaggtcaaactgctgcagcgcatgaaggatcaggcggagatcatcatctgcgtttattccggcgatatcatcaacagcaagacccgtcaggatttcggtatcacctacgacttggaggtcttgcgtctgatcgatatttttcgcaagcatgatttgaagatcaacagcgtcgttgtaaccagatacgaggacgctccggcagtcaatcgctttattaataaactggagcgcagagacatcaaaacctacaaacactacttcacgaagggctatccgacggatgtcgaaaccatcgtcagcgaagaaggctacggggccaatccttatatcgaggtaacgaagccgttgattgttgtaaccggaccgggaggcggcagcggcaagctggcgaccagcctttcgcagctctatcacgaatataagcgcggaaccaaggccagatacgcgaagttcgagaccttcccgatttggaatcttccgctcaaacatccggtcaatatcgcctacgaggccgcaaccgcggatctgcgcgatgtcaatatgattgactccttccatttggaggcttacggagagatggcagtcaactataaccgcgatttggaggtttttccggtggtgaaacgaatcattgaaaagatcaccggagagtcggaatatcaatctccgacggacatgggcgtcaatcgggccggcttttgcattaccaatgacgagattgttcgcgaggcagccagacaggagatcatccgccgctttatgatcgcgaaatgcgactataagaagggtaagatttccgaggcggtgctggaacgttccgagctcctgatgaaggaggtcggcgccggagaggaggaccgtaaggttgtgattccggcgcgcgaatatgcggaatataagcgcaattgcgataaaaaatatgtcaatgtcgtcgtaatggctatcgagatgccggacggcagcatcgtaaccggacgcagcagccgccgcatggtcgccgcgggcgcggcggtgctgaacgcgattaaaaagctcgccggaattccggacgatctgtacatgatcgcgccgaacgtattcagcagtattcagagcatcaagggcgatattctgcattatgaccggacaagtctcaatctggaagaaattctgacagcgctgaccatatctgcggagaacaattcctgcgcggcgaaggcgattaaaatgctcgaaaagctcaacggctgcaaggcgcattgtacggcgattctcagcgaacgggatgaacaggtactcaggagcatgggcattgacgtgacctgtgatccggaatatctgactacaaacttatacttatcgtaa

SEQ ID NO: 772 - DNA, 1869 bp, Unknown
  Description of Unknown: Firmicutes sequence
gcgatgatgccggcgatggcattcgcggacacgacagccccagcgccggaaacggcgccgacagctccggccaaatcgaatgacattgtcattctcggcaccagtgatgtacactgcggtatcgatcagaacatcggttacgcgggtcttgcggcttacaaaaaggccatggcagaaaagtacaactatgtggcgcttgtcgacgcgggtgacgcgatccagggtgataccatcggtacgttgtccaaaggggaataccttgtggacatcatgaacgaggtcggctacgatgttgtcgttccgggcaaccacgaattcgactacggtatggatcagttcctcaatgtcatcgtgccgaagatgaaagcgacctatgtttccgcgaacttcgtcaagaatggcaaaccggtctttgatacctacaagatgatgacctacggcgacaagaaggtcgcgtttgtcggcatctgcacgccggaaaccctggtgaagtccacaccaacctatttccaggacaaaaacggcaactacatctacgacttctgtaacgatacaaccggagaaaaactgtataaggcagtacaggacgcagtagacgccgcgaagaaagcgggcgcgaactatgttgtggcagtggcgcatctcggtgatgacagcgcgagcgcgccttggacttcgatggacgtgcttgcgaagacaagcggcattgacgtgcttttggacggccacgcgcacagcacagttgttaagagcgtcaagaacaaggacggcaagagcatccaaatggtcgcgaccggaacgaagctcgaaaatatcggtaagatcgtaatcgccgagaacggcgcgatcacagcggaatatataaacggagacgtggcaaaggataaagacgcaggcgtcacgaagtttatcgaaggcatcaaggcgaaatacgcggaacttgaaaagaaggttgttgcgaaaacggcggttgatctcgcgattgcggacaaggacggaaatcgtctggtcagaagtgaggaaaccaacctcggtgacctttgcgcggacgcgtaccggaatgtactcggcgcggatatcgcgtttgtaaacggcggcggtattcgtgtggcaattccgaagggcaatatcacctacggacaggtcatcgcggtacatccgttcggcaacatggcgtgtgtagtagaagcgaccggacagcagatcctcgacgcgttggaattcggcgccagaaacgtgggtaagggtgaaaacggcggattcctgcaggtttccggcctgacctataccatcaattctctgatcgaaccatctattcagaccaatgaagcgggagaattcgtcaaagtaaccggcgactacagagtcagagacgtcaaggttggcggcgtggatctggacttgaataagacttatacgcttgcttcccataactatatgctcaagagcggcggagacggtttcgtaatgttcaagggcaacaagctgctgcaggacgaggtcatgattgacaatcaggttctcatcaactatatccaaaagaacctcaacggtgtcgttgacgatcagtacgcggcgccgcagggcagaatcaaaatcttatccacagagctttttgcgcaggtcagtgaaaaactgcaggtcgcggaatacgagtgcaagttaaccgcgaaggcgcagaaaaaggctgtgaagctgacttggaatgcctgtgccgcggacagtgtaaaatatcaggtttacaaatccacgaaatcgacgaagggctttaagagagccattacgacaagcaaaaaaacttacacggcaaagaagctcacaaaaggtaagacctattacttcaaggtcagagcgatcaagacaatcggc

SEQ ID NO: 773 - DNA, 1239 bp, Unknown
  Description of Unknown: Firmicutes sequence
aaaagaaaaaaagggcttgaaaatcaattaaaacaagagtataattctgtatttgtgatgcaaggaaaaaggaggttcatggaattggaaaactatatttttttagtgagtatcgtgattattttgctgacgactaaaattttgggggatgtcacgaataaagtaaatatgacgcaggttgtgggcacgctgcttgcgggcgttctgatcggcccttcttgttttaactgggtaaacgaaacagatttcgtaaataaaacagccgaaatcggcgtcatctttttgatgttcatggcagggctggataccgatgtaaagcagctcaaaaagaacagtgtcgcctgtgtggtcatcgcgtctcttggtgtgctgctgccgctgatcggcggaaccctggcttattactgttactttgagcagggcgctacggactatgaggaaatattaaaagctgtatttatcggtgttgtgctgaccgcgacatcggtcagcatcaccgtagaagcgctgcgggaaatggggaagctggatggcaagggcggcagtgcgattctcggcgcggcagtcattgacgatatcatgggcattgtcgttttgactatcgtcatcagcttgaaggacgaaagcgtatctttggtgggcgtgcttcttaagattctcgcctacgcggcgctcatggcgctgcttggatatctttgccagcgttggcagacgcggattgaccacaacctcggccgtcgccgcattacgacctatgtggtcgcagcctgctttatcatcgcttatatttcggaaacatattttggtgtggcggatatcacaggcgcttatctcctgggcttgttcctctctcggcacgaaatcaagagtgaaatcgcaagaaagctgtcggtgccttcctatctgttcttttcgccgatcttctttgccagcgtcggcctgaaggtcgaactgagcggaattacaggaagcctgattgtattttcgctgattttgctgggcgtcgcgattttgaccaagatcattggctgcggtctcggcgcgaagctttgccgtttcaccggtaaggaagcgatgcaggtaggaatcggtatgatatccaggggcgaagtcgcgctgattgtagcgcagaagggctacgcgatcggcttgatcgacgcggccatgttcccgccgattgtcatcgtcgttatcgcgacaacgatttttaccccgattgctttgaaaaaagtaatgtag

SEQ ID NO: 774 - DNA, 1479 bp, Unknown
  Description of Unknown: Firmicutes sequence
atgatcaatcggacaatatatgaagaaatcggaaaacgcgcgggcggcgacatttatatcggcgtggttggcccggtcagaaccggcaaatctacctttatcaagcgcttcatggatgtgatggtgttcccgcatatgataaacagctatgaaaaaaccagagtcatggatgaattgccgcagagcggcgaaggcagaaccatcacgacaacagagccaaagtttattccgccggaggcagcaacagtatccgcgggaaacggcgtgcagatgaaggtgcgtttggtagactgcgtcggatatttggtacctggcgttttgggcgacaaagaagaaggcgcggaacgcatggtttcaaccccttggtccgcggagcagatgagtttcagtcaggccgcggagcttggtacggaaaaagtgattcgcgagcattcggtggtcggcatcgtcgttacgacagacggcagcttcggggagctgccgcgcgaaaactttacagaagcggaggaaagaacgatcgcgcagctcaagagcctgcaaaaaccgtttgtagtactgcttaacaccgtaaatccgcaaagtcaaaaaagcagagaacttgccgctgcgctggaggaaaaatacgaggttccggtactttcgcaaaattgtcagcgtatgcaggcagaggattttgacttagtctttcacagactgctcctgcagttccctgcctgtgaaatcgcgattacgctgcccggttatttagacgcgcttcccaagacccattggataaaagaaaccatgatcgcgcagatacgggattggacgcgagcctttgaaacgatggggcaggcgctggatacctgtccgatgatcgtagacggaacggttatgaaggaggtccgcatcgcgcgtacagatccagcgaacggattgatcgtgctgcagccgcagctcgcgccggacctttattataaggtgattgaggagctgctggacgcgaaggtggaaaatgacagccagctgttttgcatgctgcgcgcgtacgcggaagcgaaaaaagcctatgacgggctaaaaagcgcattaacagaggctgagaaagaaaactacggaattgtcgcgccgaagctttttgagatgacgctcgaaaaaccggaggtcttcaagcagggcagtaagtatggcgtgcgtatgaaggcaactgcgccctgcatgcatattatcaagaccaatatcaccactgaggtgtctccggtcgtaggtacggagagtcaatctgtggagctggcgcggaatttatccgaacaatttgataaaggggaggacaccatttgggaaacgaatctctttggaaaaacgctgaaggaaatggtaaccgagcagatggaaagcaaggtcagcaatgtgccggagcatctgcgcggcaaggtacagcgttccctgcaaaaaatcagcgatgagggaaaggactactttatctgcattattttatag

SEQ ID NO: 775 - DNA, 1536 bp, Unknown
  Description of Unknown: Firmicutes sequence
atgaaaaaaatgatatacgctacaatttataccatggatcgggatcaccccaccgcggaagcgatgggaattgaagaggatcacatcttctttacgggcacgagagaggaagcacgcgccatcgaggttgacgaaagccttgcctatccggatcaagtcattctcccgggatttatcgacacccacgtccatgttattccgtccggactgtttatgacaggtgcggatctttcgcaggcggaggacttggcggaggtcctcgaattcttgcgggctaaggcggccgagacaccggagggcaaatgggtgatcggcgcgttctttcaggataagcacatcaaggaaaaacgctttcccaatcgatatgagctcgacagcgtttccacaaagcatccgatttttatctgccacaatgacctgcatccattttccttcaactccgaggcactcgcgctgctgggcttcgaccccgcgctggacggcgtctgcactgatgaaaacggtgaattgacaggctgtatcgttgatccggcctgtgttgattctctggagcgaatctatgcctttttttcggatgaggatctgctcaagggctgcgaggcagtggatcagatggcggcagcgagcggtgtgaccaccattttcggcaaggattcgattcgtgtcctgaagctgcgcgaacaaaacaaggaacggttccgcgcggaattcaaaccgatgtggatgacctacaataccaaagactgggaaggcttgcgcgagattctggaagatgaagcgctgcgcgaaaaaacctgtatctgtacgttcgcggatggcgcattcgacggatggtcggcatcggtcatcgaaccttatgaaggcagaccgacggagtttggcatgctgctcaatacggatgaggagctctacgaattcgcgaaggcggccagagcgcatgacctgcagttctcaacacacgcgatcggggatcacgccatcgagcaggtcattcgggtgtacgagagagttttgaaggaaaacccaaaggaagatcacagattccgcatcgaacactttgagctgccgacgaagcagtctgtcaaaaaagccgcggagcttggaattgccctgggcatgcagccgttgctgatcgaaatctgtgaaggcatggatctgtccggctacgcatgtttcatcggcgaccgcgccggcaaatgcagcccgtatcgctccatcctggatgcggggattttagtgggcggcggcacggactttccggtgacaccgatgcggccgctgcatggcgcgcggatctgcatgacacagccgaccgcatcagagcgcatcacgctgatggagtgtctggagatgaacacttgcaacgcggcgaagctgggatttttggaggattgcaagggcatgctccgcccgggcatggacgcggactttatcgtgctcgatcagaatccgttcgcggttccggtcgaagcgctgtcagacatcaaagtagaacaaacttacgcgcgcggcaagctggtctacgcgcgcgcgtaa

SEQ ID NO: 776 - DNA, 3216 bp, Unknown
  Description of Unknown: Firmicutes sequence
atgtccaacgcagccattcgcatggaacagcttatgctccccacctacccggagcctgggaaggaagagatgccgctgttctccgagcatcgggttcaccagcgctccacaggccgcccctatcccaacaaggtcaccctggaagtaaaccgggaacggaagatcgagcgcagctacaccgttgttcatctggaaaacgagtatctggatgtgctggttctgccggagatcggcggccggatttttgccgcacgggataaagtcaccagctacgatttcttctaccgccagcatgtcatcaagcccggcctcatcggcgcgctgggctcctggatttccggcggcgtggaattcaactggccctaccaccatcgcccttccggttttctgccctgcgattttgaaacggaggaatgcggcgacggcagtgttatctgctggttgtccgagcacgaccccatcgaccggatgaagggcatggtgggcatcgtcctgaaacccggctgcgcttatctggaaacccgcgtgaagctgtgcaaccgcacccccgtaacaaaaagcttcctgtggtgggaaaatgccgcggttcccgtgaacgaaagctaccagattttcttccccaaggatgtcacctatgtgaatttccattacctggactcccggatctcctaccccattgccggagacgccaccttcaacggcattgatatgaccactccccgggacatctcctggcacaagaatacgaaggacgccacctcctattttgcctgtgcctcccaatatgatttctttggcggctacgaccacggcttagactgcggcgtcgtccacatcggcgatcatcacatctcccccggcaagaagatgttcacctgggcctacaaccagctgtccaaaacctgggagaataccctgaccgataccgacggccagtatgccgagctgatggcgggttcctacaccgacaaccagcccaattttgcctggctggagccatacgagaccaaggaattttcccagtactggtatcccatccagaagatcggcacgccggactacgcgaacctgaaatgcgccctgtcgcttcagccggagtatgtctggattcaggccacagaaaccttcggcagcgcccatgtaaagatcacctgcggcgatgagaccgttctgtctgagcaggtaacgctgaacgtagcctcccccgtcatgctcccctggacacgtcctgatggctatgtgaccatttccgtcaccgccggtgggaaaacaatcgcccattaccgggaggaaaagccggacaacctgaaaaagccccccgtcaaagaccccatgccgctggcgtccgaggttcgcagtgctgacgagctgtatctggccggcgtccatgtggagcagtaccgggatccggctgtcatgccggacgcctactggctggaagggttaaagcgcgacccctaccacgcggactgcctgctgggcatggcaaaatactgctatcagatgggtcgcctgtccgaggcggaacgctatgcccggaagggtcttgacgccctgacaaaattcaacatgcacactcagtccggcgacccgtactatctgctgggtctgattctggaagcacaggaacgctctgcggaagcctacgatcagtaccgcaaggccgcctggaacggcagcgccgttgccaaagccatggcaagagccgcctgtatcgccatgaagcagggcgacacggaaaccgccctggcacacgcccaactggctttgaaccgggatgcccagcatccgctggcaccggtgatcatgatcctggcctaccgggaaacggggaacgaaaatgctgcccaggccgtcattgaccgtgttatggcggaggattgcatgaacaatctggttcgctggctgggcggcgtagacgaaaaacacttcttcaccaagctggattccgcccccgaccagactgtgctggacatggtttttgatctggaatccatggggcagtacgccctggctgccaaactgctggaacagctcggcaagtaccatacccataccaccatgaccctgtataccctggcgtatctgcgccacaaacagggcatggactgcggagaagccctccgtctggcagatgccgccgggatcctcgacacctaccctgcccgtctggccgagattcgggttctgacctttgcccgggaacagaacgcccggaaagcccccttcctgctgggctgcctgctgtacgacaagcgccaatacgaagccgcagccaggctttttacggaaagcacggagaaggagccggaaaattacatgacctaccgctctctggccattgcctgcttcacccatctgaaccggaaggatgaggccgtgaagctgatggaaaaagcgcggagcctcaactactcccagcaggtgctgtatgaatccgcgatcctgatggatttgatgggcgcgcccgccggggaaaaaatcgcgcttctggagcctcacgccggtgacttccgccgggacgacctgtttgtggagcttgcgaaggcttacaaccagaatttccagccggaaaaggcattgcagcttctgctgagccatgtattcgtggcctgcgagggcggcgagcacgccattgcggatcagtatatgtacgcctggttccagctgggcatggcgagaaaagccgccggcgactatgcgggctgctatgaactgctgaaaaaggcgcttaccctgcccaagagccttggctccggcatctggaaccgctgcaaatatgttccctaccagttccatatggccgagtgtctggagcacatggggaaaaaggaggacgcccaggccatttaccggatgattctggatattgaagttgagttcttcagcaacatgcacctgcgggagttgccctactatcaggcgctctgcgccgaagccctgggattgcagcaaaaggcgtggaacatcatggcgcgagccaagcgggactggagcttcaacctgaatcggaaggacaacggcttcttctctaccacgcccttcttcatctcctttgctcaggatcccgccgttgcccaccgggcttactaccagtacctgctgggtctggtaaaactctatgaaggcgaccgggagggggcaagcgcgctgttccgggaaagctactcagggaactccgacagccacttctgtcattattacgcacatctttaa

SEQ ID NO: 777 - DNA, 1335 bp, Unknown
  Description of Unknown: Firmicutes sequence
atgctggaagggccgctgtttccgaacatcatccaatataccgtccccattattctgaccagtcttctgcagctgctgttcaacgcggctgatctcgtggtggtggggcagttctgcggcagcgtgtccgtcgccgcagtgggcgccaccggtgccattaccagtctgctcgtcaacttcttcatcggtctgtccgtaggcgcaggcgtggccgtcgcccatggtcttggcagtcgggaggatcaggtcgttcactgcacggtacataccacactgcccaccgccatcataagcggcgtggttctgactgtgatcggcgtctcctattccgaaacttttcttgccatgatgggaacccccgacagcgtgctgcccctctcctccatttacatgcggatcattttcggcggcgttaccttcaacatggtgtacaatttctgcgccgccattctccgcgccgccggagacaccaaaagcccgctgatttttctgctgttcgcaggtgtcctgaatgtggttctaaacctggtttttgtcatccggttccatatgaacgtggccggtgtggcgctggcgaccatcatttctcaggcgctttctgccgtgctggtggtcatcgccctgatgcgcagaaccgacgcctgcaagctgtatctcagcaaaatgcgcttttacaagcctcagctggagaaaattcttcgcatcggcctgcccgcaggcatccaaagcgcgctgttctccatttccaatgttctcattcagtcgtcggtaaactccttcggcgacgtgttcatgtccggcaacgcggcgtccagcaacatcgagggcttcgtctacgtctgcctcaatgcgtttcagcagtccgcagtcaattttgccgggcagaacgccggcgcgcggcaataccgccgggttcgtcagaccctgtggatttgcctgggctgcgttacggtggtggggttggttcttgggtcgctggcctacgcgcttggcccctccctgctctccatttacatcaccgactctgccgaagccatttcctacggtctgattcggctggccttcatctgcctgccctatttcttatgcggcctgatggacgtgaccaccggcgcgcttcggggcatcggcgcgtccttcgtccccatgctgatctccatcctcggtgtctgcggattgcgcattgtctggatttataccattttccagattcccgaattccacacgccccaatgcctgtatttttcctataccgtctcctggatcattaccttcatcgcccagctgattgccttcttcgtcgtgtaccgaaggcaggccagcgcagcggaataa

SEQ ID NO: 778 - DNA, 1104 bp, Unknown
  Description of Unknown: Firmicutes sequence
atgtcggctaaacggatgaatgaatcggaaaaacagacataccctaatgataccaaccgaccaggaggcaccatcatgaaaaaacaaccctctccccccaaccgccgcggcagactcgtgatgctgtgcttcgtgctggggctgatcttccttgtgatgctggtgggaacggtctacttacagcacctgctgggacgcatccactatgtggactccggcaccgcccccagcctttccccggaggagctggacgcctatcttgccacccagccggaggaaaccaacaccgcccccaccatgaaccccgaggacgtcaccttcccggactacgacgccgacatcggcaaggacagcgacatcatcaacattctgctcatcggtcaggatcgccgggaagacgagacccgggcgcggtcggattccatgattctgtgtaccttccgcaaatccgaaaagaagctgaccatgacctccttcctccgggacacctatgtgaaaatccccggctacggccggaaccggatcaacgtggcctatgccgccggcggcatgtcccttctgaataaaacattggaaaacaatttcggcgtccacatcgacggcaatgtggaggtggatttccaccagtttgccgacatcgttgatcttctggggggcgtggaggtagacctgcggaacgacgaggcccagtgggtcagccgggagaccggcagcgccctttccgagggtaagaaccgcttaaacggtcagcaggcgctggcctatgcccgcatccgcaagctggacgccgacggagatttcagccggacgaaccgtcagcgcaaggtcatcaccgccctgctggacgcctaccggggcaccagtctccccgctgccctgtcccttctggagcagattctgcccctgatcaccacggacatgacggacagggaaattctcggctacgccgtcagcctgtttcccctgctttcccggggtgagatcgtcagccagcacattcccgcaccggacacctattccagccgcagcattgacggcatggcggtgctggtggccgacctggaagccaaccgaaaaatcctgcaggatacgttgggcggctaa

SEQ ID NO: 779 - DNA, 2844 bp, Unknown
  Description of Unknown: Firmicutes sequence
ttgactgaacttgccgaaaccgaactgatttctcctttgctggacggatttgccatgggcaaccccatgagcagccatgacggcgttcgctgctgccctgccatcaaggaaaattcaggcgaaaaatacatagtcaaaatcatttccgtccctgctacccaggcgcagctggatgcgatgcttctggcaggcgcctacaaggacatggcgggcgccatggactacttcaagggcgttgccgacgacgtggaaaaggaagcggaatttttgcagaagctttccaagctggagggctttcttccctacgacggctggcagaccgtccccatcaagcgccgccgtctgggctacgaggtctacctggtcagcccctataagcactccctggcaaagtacatccgccgcaatccggtcacccatctggaagcgatcaacctgggacttgacctgtgttccgccctttccgtctgccgtcaggccggatgcctgtacgtggacctaaagcccaccaacatcttcctgaccgagaaaaagagctaccgcatcggcgacctgggcttcatcccgctggacgctctgcgctacacgtccctgccggacaagtaccgcagcccctattctcccccggagctgcacgacgccatggccacgctgaacgagacggcggacacctacgccgtgggcatgattctctatcagctctataacgacggcagcctgcccttcaaggacaaagcccccggcgaagccctcccctctcccgtcaacgccgactacgagatcgcggagatcatcatgagggccattgaccccgaccccgccaagcgctggcaggagccgaaggagctgggcaaggcgctggccgcctacatgcagcgcaattccatcaacgacacccccatcaccatctacacccccatcgaggcaaagccggaggatgtggtgccggtgcagcccacgcccgttcccgacgaagcgcctgcccagcaggaggaaaccatcgcggaggatccgcaggacgaaacccttccggagcctgcggacgcggccggccttctgccccaccagatgtctgacgaagtttcccagatcatggaggaggccgacgagctaatcgcccacaaggttccccaggcggccatcacccctgagccggaggaggattcccccgaccgcttctccttcgcccaggacgaggaggacaacgagccgctgccagacaacagcaacgaacccttcgccgacgcggaggaagaaaagcgcctgcaaaaggaagcgaaaaagcaggagcgcaggcagaaagccaaaaaggccgccacagccgttatcgctctggtaatcctcgccgccatcggcgcggggctgttctgggcataccagaaatactacctgcaaaccatcaacggcatttccattgagggcgaccagtatcagctggttgtcagcgtggacaccgcggtggacgactcccggctcagcgtcatctgcatggacaactacggcaacgccgtgacccggggcgtggtggacggcaaggcgacctttaccgatctgctgcccgataccctgtaccggatccagctggacatcagcggcttccacaagctggttggccagacctccgatatcttcaccaccaagggttccaccagaatcgccagcctctccgccgtcaccggctccgaggacggctccgtcatgctgaacttcgcggtcagcggcgccgacccggaggaatgggtcgtgacctactccgccgaggatgaggagacgaagagcgaaagcttctccggtcacaccgtcaccgtcaaggggctgaccgtaggaaagctgtacaccttcaccctggagcctgccaacgcttcctccggggagaccttcaccggggaaaataccctggaattcatggcctcccggctggttctggcggagaacctgaccgtcgccgccagcagcggcagcgacatgaccgtccgctgggacgcccccggcgacgtggtggtagagagctgggacgtccgctgctacagcgacggaagcggctacgacaagcagctcaccgtcaccaataccgaggtttacttcacggacatcgatcctgcggtggcctacaccatcgaggtcaccgccgccggcatgacccagcccgcccgtaccagcgtcaccgccaatcccatcaacatcaccggcatgaacgtggacgacagcgagccggagcagctcaccgtgacctgggaatacagcggcaccgccccctccggcggctggctgctgatgtaccagctcgacggaagctccacctccaatgtggtcaaatgccagcagcccactgcggtgatctccccccgcatccccagcgccaagtatcagttcaccattcaggcggcggacggcacctccattttcggaaacgtcaagacctacacctgccccaacgccagcgtgtacgaggatcacggcctgtctgcggacaaaatcaccgcccacctggtcaaaacgccggacacggaggactggcactttgaatccgtcggcacagccgcctacaccagcgagtttgccgttggcgacaagatctccgtggtcttgcagggaactgtcaatttctacgtccccgaggattcgctgaacatcctctatgtcatccgggacggctacggcaatgtgatccccaagtacatctccgaggataccggcgactggaaggagatctggtacgcgggcgactatcactacggcgagctggatgtccccaccgctcccgacgccgtcggcgattactccctcagcatttacttcaacggtctggccatcacggtcatcaccttcaccgttaccgagtaa

SEQ ID NO: 780 - DNA, 1713 bp, Unknown
  Description of Unknown: Firmicutes sequence
atgaagaagtttatccgcgttctggtaccgctcctgctggcggtgctgatcattgccagcatcggctggtatctgtttacctatgaccgagggttcacccgggattttctgctgacccaggctcgatacaatgacctccacggcaattcccgcctgtcctcctggttctatgaccttgcctacaacttctccaatcacgacgagaatgtggccatcgagctggcgaacctgtataaggccgacggcaactacaccaaggccgagtacaccctgaccaacgccatcaattccgaccccagcgccgagctgttcaccgctctgtgcaagacctatgtggagcaggacaagctgctggacgccgtctctctgctggacaaaatcacgaacccggaaatcaaggccgagatcgaggcgcagcggcctgacgctcccatcagcaactacgcgccgggctactacagccagtatatcgacgtcaccctgtacgccgccggaaagctctactacaccaccgacggcgaatacccctccgtgcagaaccccgtttacgaaagccccattacccttcccgccggtgagacgaccgtttatgccatcgccgtggacgacaacggccttgtcagtcccctgacggttctgggctacaccgtgaccggcgtcatcgaagaggtcaagtttgccgacccggccatggaagcggctctgcggcaggtgaccggcaccagagacggcgacagcgtctacaccagccagctgtggcagatcacggagttcaccgttcccgaggacacgaaggtctacaccgacctgacgttcatgccctatctcgaaacgctggtcatcaacaatcaggacatcgattctctggagagcctgtcctctctgaccaagctcacgtcccttgacctcagcggcagccggttcagcccggacgagctgtccgtcattgcggggcttccctctctgaccgagctgtccatggtggaatgcggcctgagtaccattgaaaagctgtccggcgccaagagccttacctatctgaatctgggggaaaacaccatccggaatctggacgtactgtcctccatgaccaccctgaccgagctgaacctccagcacaacgccgtgaccagtctcgacgcgctggcaggtctgtccaacctgcaaaccctggacgtttcctacaacgccctggccactcttgcccccgtggccagctgcgtccggctgacgaccctgctggcagacaacaaccagctcaccagtctggacggcgtgagcggcctgcaaatgctgacccggctgtccgtgaaccacaacacgctgacggatgtctctcccctggccgtctgcacgaccctgaccgagctggacatttccaacaacaccctgacggatatctccgccctttccaccctggtcaatctggagcggttcgtcttctcctccaaccaggtcacggcgctgcccgaatggccggagggctgcaagctccaggtcatcgacggtgcctacaatgcggtgaccagtctggacaatctgagcaaaatgggatccctgacctatatctatatggattacaaccagatcagcaacattgattcccttgccgactgctactgcctggtacaggtgaatgtgttcggaaaccccgtttccgacgttgctgccctgagagagcacgacatcatcgtcaactacgacccgacctga

SEQ ID NO: 781 - DNA, 2052 bp, Unknown
  Description of Unknown: Firmicutes sequence
atgcgtgccataaagaaagatcccggcaaagggaaaaaggttttacagagcatccccattcccggatggctgtttactctggtgacggtggtatactgcgaggtgctgctccatctgtggacgatggacggcttttccttcggccggttcgccgcagtggtgctgttcgccctgggcttcggcgggctgctggggcagatcgccggcttcatcggccataaaaaatggggaaaatggattaccgtcgcgctggcggcggtggtgtcggtactctacattgtggaatacttcgtcaacgacgcctaccggagcttcatgcccatgcgtatgctgctgggcggcgcgaaaggcgtcaccacggatttcggcggcgtggtcgtttcgctggttctgagcggcttctggcgaatcttagtcatgctgctgcctgcgctgctgtatgcgctgctggcacgtcccgtccggaccacgtggaaaatccgctggtttctgttggcgggagccgttgcggcgtatctgctgggcttcggcgttgtccggggcgtggggacggatgccgcccggctttccgacgcctataattttgacagcgccgtccgcgtgttcgggttgaacatcgccatccccctggacgcggtcaacggcggcgagtcctcggaggaaacgccgggattcctcgtggtggagccggtcgctgcgcctacggaagcacccccggcggtttcgacccccgagggagagatcgccccggcggaaacggagccggcggcctacggcgacaacgtgatggacatcgactttgacgatctgatcgcaagcaccggaaacagccacatcaatgccatcagtcagtatgtagcttccctgactccctccaagaaaaacgaatacaccggcatgttcgcaggaaagaatctgattctcatcactgctgaggctttctccaagcaggtcatcgacccggagctgacgcccaccctgtaccggatggccaccaagggcattcagttcaccgattactaccagcccgcctggggcggcagtaccaccaccggcgagttttccaatgtgaccggtctggttccggccgatgtgggcatgtgtatgaagcaggccatctatcaggatctgttcctgaccatggggcatcagcttcagaagcagaattactattccgccgcctaccacaaccacaacgcggactactatgaccggaacaagacccacaccaagctgggctacgaccggttcctggcgcgctacggcggcctggagggaatcaccccggtctggccggaaagcgatctggaaatgatcgacatttccgtaccccagtacattgaccagcagcccttcagcatttattacatgacggtttccggccactgcggctactccttgaaggacaatgccatgtcccggaaaaactacgaccttgtggattatgacggctccgaggcggtgaagtgctacctggcctctcagctggagctggaaaaggccatggagtccctgatccgtcagctggaggaggccggaattgccaacgacacggtgatcgtcatcagcccggatcactatccctacggtctggagcggagcgccacctggaaaaacgccaagaattacctgaaggaactgtacggcgtcacggaaatgaatcggttttccagggacagtaacgccctgatcatctggagcggctgcctggaggacaagaatctgaaggtggagacgccggtgtacagcctggatattctgcccacgctgtcgaacctcttcggtctggactatgactcccggctgctggtagggcgggacgtgttctccgatacggagccgctggttctctggccggagttcagctggaaaaccgacaaaggcacctacgaagccgagtccagaaccttcacccccgccgagggcgcggacgttgacgacggctacgtagaccgcatcaatgccatcgtgtccaacaagatcagctattcccgggaagtacagaacatgaagtattttcaggttctttccgactacctgaacgggaaataa

SEQ ID NO: 782 - DNA, 1476 bp, Unknown
  Description of Unknown: Firmicutes sequence
ttgctgaaaagaaaagacacattgttgcaatttgacatggctctagcaagggcgaaggaggaagctatggacggtgggttctatgtattttcccgggagctgaaagcctgcgccgacaggcggctgaataacgccaccattcgccggttgtggcagggcttctgctgtcaggcggggcagatcgttatggaagaagcggatggcgttttcttccgggcaggcgccatcccggtgccggaggttccgggaaaagccgaattcatcatccgggttacggagcagggcatggccgtggcggcgaaggactattccgggctggctcgcggcgtgctggtgctgatgatgcgcattgagcctgtagcgctggaggagggtcgggagcagttccgtgtggcggcgtgctctgtggaaggcaattacggtattcgcagccgcatgattcacttctgcgttttcccggagacgacgccggcgtttctgcaaaagtgcatccgtctggcgggcgtgatgcagtacacccatgtggtgctggaattctgggggatgctgcggtatgactgcctgaaggagctggcatggggaaacgcctggccgaaggattttgcaaagggcatcgtccgggagattgaggatatgggcatggaggccgttcccatgatgaatcacctgggacatgcggccggatgccgtgtcagcggcggtaagcatgtggtgctggatcagaatccccggttggcagcgctgttttctccggacggctggtcatggaacattctgaatcctcgggtgcgcgatttgctgaaggacgtgcggcgggagctgtacgaggttttccccaacgcccggtattttcacctgggctgcgacgaggtgtattcctatgaaaaaggggatgaggatcagcggcggatgcgcagcttcctgcgttccgtgatcgaagaggttcagatggaaggcgttcgcccaatcatctggggggacatgctcctgaatgccagagcctgcggtgtggacggcggacatcagccttacgtctgcggctgcgacacgccggaacacgcggataagctgatcgcggccatcccaagggataccgtcattgccgactggcactacgacattttgcaggcgcctgtcaagaccagcgtttacttaaaggaaaagggctttgacgtgctgggagcgccctggtttgaggacgccaactgccgggcgcatgtggataccgcccgggagcatgggcttatgggcgtcatggtgacgacctggcacaccctggcgcagaagatgccccatatcgtcgcagacgctctgatgtgcggcgcgttccagtccccctggtcggggccggaaagtagcaaggttcgcaccgaaaccgccgccctgctgcgcaaggtatgctttgtggacggcgactataaagaagcgggctggacggacagccagattttcatgcaggccaatcccatgacttaa

SEQ ID NO: 783 - DNA, 1314 bp, Unknown
  Description of Unknown: Firmicutes sequence
atgtattcatctgcctatgtgtgggcaaaggttttaagccatatggaagagcggctgggggctgtcaccgtttcggcctggtttgacgacgccgaggtggtggagctgaacgagaacaatctgattctgtactccccctcggacttccgccgggagatcatccgccgccgctgcaccgattacatccaggacgcgctgaaggaagtgttcaattccgacgcgaagctgatggtcttcggcgacgaggagctggacgccttcaagcagaaggggaaaagcgtctcctccatggacttcaatccccagtttacctttgacaacttcgttgtcggcccctccaaccgctttgcccacagcgcggccatcgccgtttccaaaacacccgggcaggtgtacaaccccctgtttctttacggcccgcccggcgtgggaaagacccatctgctgtacgccattgccaacggcatccgcaaggaaaatcccaacgccaacatcgtctacatcaagggcgaccaatttaccaatgagctgattgccgccattcagaacggcaaaaatatcgaattccgcagcaaatatcgggaagccgacctgttcctcatcgacgacgtgcagttcatcgccggtaaggaatccacccaggaggaattcttccataccttcaataagctctacgaggagcataagcagatcgtcatgacctccgaccgcaagcccagcgacatgctgaccttggaggatcggctgaaaacccggtttgagtggggcttactcgcggacattcagccgccggattacgagacccgtatggccattctgaaaaacaaggccaaaaatctggggctgaacctttccgatgacgtgtgcaactacattgccatcaacgtcaccaacaacgtccggcagattgagggtacggtcaagaaaattctggcctatcgggacctcaataacatgcctctggatcttcccaatatctctcgggcgattgacgatatgttcaagagcgagggcaacgccctgcccacccccagcctgatcatcagccaggtgtgcaagttctattccatcgacgaggtggttctgaggggcacccagaaaaacaagggtaccgccgaggccagacaaattgccatgtacctgattcgcaagctcaccaacctgagcctgccggacatcggcaaggaatttgcccgggatcactccaccgtattgtacgccatccggaaggtcgaagtcgcgctgaaaaacggggacaccaacatgcagaataacatccgggacatcaccgcgaacatcaattcctgtctgtaa

SEQ ID NO: 784 - DNA, 1704 bp, Unknown
  Description of Unknown: Firmicutes sequence
atgtaccaaaaagaaagaaaactgaatccggtgcttctcatcgtgcttgcggctgcgctgcttgcggtggggattgccgtgtggtttctgctgacccatgtgtgggtggcgggaacgttttattcccggaatgccgacgtgctggatctccgctttgccgacgtcacgacggcggattatgacaagctgcggaaaaaagcgccgaacagcgaaatcctctggcggattccctttcaggggaagacctatgatcaggataccgatgtgctgtacgtgacctccctcacggatgaggatgtggcgacgctggactatttcacccggctgaaaaccgtggaagcccaggaatgcacggactatccccagctggccgcgctgaccgcccgccgcccggaggtgacggtggagtacacggtgaccatcgatggcagagagtaccctcaggataccgccgtggtgagcatttccggcatcacggaagaggagatcaatctgcttacatatttaccggagctgacggcggtgacggcggtgggctgccggacgccggagcagatgacgcggctgcgggatttctgccaggagaaggggctttcctttggcctgcgcttcggcacgaagacctaccccgacacggtgcaggagctggatgtcaccggtgtgaccgacggggagctggagctgcttcagcttttgccggagctgaaaacgctgcatcttaagaaccccaaggccgacccggagacggttgcccagctgcgcagcacctatcccaaggcggacatcagctgggaggtggagatcgcgggcgtttccttcccggacgacacgaaggaggttgatctttccgccgttctggaaagcagcgctgcccagaccgccgccggtactgcggcagggacgcagactgcggccggtgcccagaccgcaaccaaaacgcagaccacaaccggcactgcgaccggaacccaaagtacgaaggaaacccaaagtacagcaccggctgttaccctgaacctggaggatctggaaaagaagatgtcctatctgtccgacgccaagcaggtgttcctgggcaaatgcggcctggacaacgaggagctggccgccctccgggagcgggtacgggacagctacaagcttgtctggacggtgcagctgggcaaaaagctcactgcgcggacggatgacaccacctttatgcctgtccgggagcatgtttactatttcctggacgaggatgcctacaacctgcgctactgcgaggatatgctctgcgtggatgtggggcatatgggtctgaccaacatcgattttgtgaagggaatgccccatctgcaaattctgatccttgcccacaacgggcagctgcaggacatttcccccatcagcagctgtaaggagctgattttcctggagctggactggagcgccgtgaaggacttcaccccgctggtgggctgcacttctctggaagacctgaacatcggcctgacctaccccagcgtggagccgctgatgcagatgacctggctgaagaatctttggatggtggatcggggcggcgcataccagctgtctcaggcactgccggacaccaagatcgtggcctcggccgacgtcaccgtaggcgcgggctggcggaatcttcccaattactacaaaatgcgggatatgctgggcatggagtacatgaggggctaa

SEQ ID NO: 785 - DNA, 1014 bp, Unknown
  Description of Unknown: Firmicutes sequence
atggtcagctattacggcctgaactatgtcgagcacgcggaagccgacttccgggaaatgctcgaccatggcgtggacaccgttctgcttgccatcaccgagttcgatatggacttctggttccccaacatcaacgccatcgtgaagaaggcgcacgaaatgggtctgcgggtcatcgcggacacctggggcatcggcaagttttttggcggcgagcaggtttccctgttcctgcaaaacaacatccatcaccgtcaggtcagcgcctacaccggcgaagtgctgaacgctgcctgcttcaacaccaattccttccgggactacttcgagcgcctgtgcctgaagcttgcccgggagacggaggtggacggcttcttctgggatgagcctcactatgcctatcccaagagctatgcctccatcaccggcggcgccggcgacgactgggcgtgccgctgccccgagtgtatgaagaagttcgaggattactatggctacgagatgcccaagtttatgaacgacgacgtcaagcagttccgttggagagaggcgctggaaaccctgagccgcgtctccaagtccctgaaggagtacaatcccaagctggagatcacctgctgcgtccacgcgaccctgaacggctactacgtcacggagctgcggggctatgacaactgggatatggtggcagcctgcccctacttcgacgtgttctccaccaccatcatcaactggagtctgccggacagcttcttccaggagattaccgaccgcaccgtggccgtggcaaagaagtacggaaaggaatccgagcggtggctgatgggctacaacaagcgccccgaaaaatgggagcagatcgaccacgttgtggacatgtacgaggcagcaggcgtagaccgtctggccacctggacataccgcggcggttatggcacgtccgttgctgccaaggacgcgctggagctgtgggacaacatcggccgcaactataagcgcgtgctgcagaagtaa

SEQ ID NO: 786 - DNA, 1533 bp, Unknown
  Description of Unknown: Firmicutes sequence
atggtaatcgtggtcggcatcgtcatggtgatggtctactccgcactggaccggaacctgatttttgccgccgactccatgtatacccgcgtgaagtccaacgccaaggaagtatacatgatgcagcagtgggaacgctacggctatgtggattacgttccctactcggactatatgcgccagcttgtccgtgacgatgagatcacccaggagcagtacggcgctgccatcacctttggcaacaaggcgagccaggacagcgacgaggccgcggagtttatccggcgcttcaccgaggaatatgaatccaagggttacaaggtcgtccgtctggacggcaaaatgaaaggcaagaccaagaaatatcaggacggcggcgagccgcgcctgtacgcctacaggaacattcccgttctcatgcgtcttgtcaactacttcaaagacctgatcaccgtcgataacatccactatgtggaggatgagatcgaggatcggggcattaccttcaccctccatgacccggtttacggcggcgaaaagttctcgccggcggtgatgggtacgggtacgcagtataagtacctgttctattttgatgattccttccccttcattcaccagaacctggtgaagatcaacctgggtctttcctactccatccgccagggtattgacgtgttccagaccatgacggaatcccagggctcctatgcctattccaccgtgacctatcccacagggtcggtttccgagtcggccgacgacctgcactcggcttcctatatctccggctcgcttgccggcggcggccccgtggtcaaggccagctttgtggatgattacaccaacatttccacaaataagaacggcatgtccaaaatcggctactccttcaccatcggtatcatcgccgtgttcctgtcctatttgatcggtgtgccggttggcattatcatggcgctgcggaaggataagctgctggatcacatcggcacgttctatattgtgtttattaccgcggttccttcccttgcctatattttcctgttcaagtctctgggcggcagattcggattgcccacgacctttgatatggagaatcccacctggctcatgtatgtgctgcccatcatctccctgtccctgccctccatcgccaacctgatgaagtggctgcggcggtatatgatcgatcagatgaactccgattacgtcaagttcgcccggagcggcggcctgtccgaaggggaaattttccggaagcacattctgaaaaacgccatcattcccattgtccatgacatccccgccagcatcctgttcgccctcaccggtgcgatcatcaccgagcgggtgtacgtggttcccggcgtcggcaacatgctgacccgcgccatcaacgcttacgataacggcgtgatcgtcggtatggttcttttctatgccgtgctgaccgtgacctccgtcatcctgggcgacgtgctgatgtccgttctggaccccagaatttcctttacggcaaaagcgaggtaa

SEQ ID NO: 787 - DNA, 1764 bp, Unknown
  Description of Unknown: Firmicutes sequence
atgaacgaagtatggaatctggacgtcatttaccgcggctttgacgaccccgcctttgccgcggatatggaaaagctggaaaagcttgtaaaggattacgcggccttcgccggggaactggacaggcagacgcccctggacggcctgaaaaagggcatcgccctggaagaagcgctgacggttttgaccgccaagctgggagaatacgcctccctgcgccagtcggtgaacacccgggacgcggaggcaggctcccgtctgggacaggtgatgcagcgaatcagcggcgccgccggcgctcaggcgcagtggcgggagtgggtgtcgaaaatccccgatttaatggtattggtagccggggacgagacgctgaaggactacaccttcctgtttgaacgcctgctgcgaaacagcacccatttgcttggcagtcttggcgagcagatcagcgccaggctgtccatgtccggctccagcgcctggagcgatttgcagggatatctgaccagcaccgtgccggtcagctacaacggcggaaccaccaatctgtccgccatccgcaatctggcctacgaccccgaccccgccgtgcggaaggcggcctacgaggcggagctgagctgctacgaccggatcaaggattccgtggcctatgccctgaactccatcaagctggaaaccatctcggactgccagctcaggggctacgggtccccccttgaccggacgctggagcagtccgacatgaagcggcagaccctggacgccatgctgggggcgatggaggaatacatgcccaaattccggcagtacctccgcgccaagggaaaggcgctggggcatgagaatggcctgccctggtacgacctgttcgcgcccatgggcaaatccgcggcgcagtataccgcggaggacgccaagaggattctggtggagctgttctctaccttcgatcaggaattggcggacatggtggcgcgcgcctttgacgaaagctggatcgacttctatccccgggacggaaaaaccggcggcgccttctgcgccggggtggagtgcatcggccagagccgcatcctgaccaatttcgacggcaccttcggcagcatcgtgaccctcgcccatgagctgggacacgccttccacaaccagtgcatccgcgcccaccgtccgctgaaccgggactactccatgcccgtggcggagaccgcgtccaccttcaacgagtgcgtggtcatggcggcggccatccggcaggcaaaatcccatgacgaggagctggcgctcatcgagtcccagcttcaggacgtcacccagatcatctgcgacatctactcccggtacctgtttgaaagcatggtgctggaaaaccgggagcagcagttcatggacgcggataccctgtgcggcatgatgctgaaagcccaggagcagtcctacggcgacggccttgacccgggcttccgccatccctatatgtggatctgcaagagccattattacggtgctaccttctataacttcccctatgccttcggcggcctgtttgcccgggggctgtacgctcagtaccagcgggagggcgcggccttcgtgccgaagtacaagaagctgctgcgcaccaccaccgtcgccacggcggaggacgtcgcccaggtggcgggcattgacctgacagacagggaattctggcgcagcgccttgcagaccgtcgctcagcagatcgatctggtctgcggacttcttgagggaggaaaccagtga

SEQ ID NO: 788 - DNA, 1356 bp, Unknown
  Description of Unknown: Firmicutes sequence
atgaagatagcagaagtacaggtcagcggttgccggtgtgagactgtgcgtctggagccggttcccagggggatcgtgggcgcggtggtttccatcgcatatacggatcccgcgtgggattctcttcggaaaaccgtggttttccggggggcggtgacgaaggatgtgctggacgccggaaatgaagtggtggttccaacggaaacggtcagcagcgcgggagtgacactctacatgggcgtatacggcgtggacgcggaaaacaatgtggtgatccccaccgtctggacggagcttggggtggtgcagggcgcagcgaccccctccggtgacgcttccaccgattcgtccctgccggtctgggcgcaggttcaggacatgatcggcgatttggatgctctgaactcggaggtcaaatccaacctcgtggcggcaatcaacgaagttctggcgaagagcggtgacgcggagacagtgcagaaaattgtggaggagtacctgaaagcaaatccgtccgaagccggttcgggtggcattacccccaccatcggcgaaaacgggaactggtacttaggggacaccgacaccggaaagcccagccggggggcggacggtacagtcccgaacattcagatcggcacggtcacgacccttcccgcgggcagcgacgcgacggccagcatgggcggtacggcggagaatccgctgcttgacctgggcattcccaagggcgcggacgggcagaagggcgacaccggaagcgcagacatttcccttggcgttgcatcggccgaggtgggacagctggtgcggatcaaggccgtggacgccgacggaagacccaccgaatgggcggcggagaaatgggagaagatcgcagagatcgtcattcccgacggcgcggaagaaaccaacgtgctgaccatcgacaaggatctgagcggacagccctttgccctgctgaaagcccggctctgcgggaagttccccaagtataccggcacgagtaccatcccgaccaacagctttgccatgctcaacgggagagccgaggaatgcccccggccgacggcgtataccggcctctggtcgaaggtcaagaccggaagctgcacgggcagcgtctacgaagtggacgtttccggcgtgcagatggtggagtgcgtgcttcgcgcgccggcgggcggctggagcgacgacaccgacaaggactacaacacctacggcgctaccagcagcgtctattcgcggtactataccgattccctttgggcgaagcccattacctccatcggcggaaccggtatgctgatttatcccggctgccggttcgtgctgtatggcgtaagagcgtga

SEQ ID NO: 789 - DNA, 1842 bp, Unknown
  Description of Unknown: Firmicutes sequence
atgagaatcctttacgacagcaagcagccccagttcaagacccccttcggcaccctgacgccggggcaggtctgcaccctgcatatccacatccccacctccgtcctgacgacggaggtcatctgcgtctttaatcacgaggacggctcctgggcgcagaacgccgctctgacgctccagatgaaaaagggcgcgtatgacgttttcgaggggcagttttccatcccctgccccggcctgtttttttactatttcgtcatcgatacgcagggcggcagcttccgtctgttcaagcagggagacgacaccaacatggaggccggtgacctctggcagctgagctgcatccccgcggatttcaccaccccggactgggcgaagggtgcgaccatttatcaggtatttcccgaccgcttctacgccagcggccaggccgacctgaccggaaagctgaagccctacaccattcatgagaactggtacgatgaggtggactggaagccaacccccgacggccaggtgctgaacaacgactttttcggcggcaatttccggggcatcaccgagaaaatggactacatcgccggtctcggcgtcaccattctctacctcaaccccatttccaagagcttttccagccaccgctacgacaccggcgactacaaaacccccgaccctcttctcggcaccgaggcggattttgccgctctctgcgacgctgcccacgcccggggcatccgggtcattctggacggcgtgtattctcacaccggcgccaacagcctgtactttaaccgggagggcgcgttcccgtccgtgggcgcgtacaattccaaggaatccccctactacagctggtacaccttctacaactggccgaacgtctaccattcctggtgggactttgacacattgcccacggtgaacaaaatggatcccgcctttatccgctacatcatcacggacgaagatagcgtcctcgcccactggctgcggctgggtgcggacggctaccggctggacgtggcggacgaactgcccgacgaatttatcaggctgctccgcagccgcatcaaggagctgaagcccgacgcccttcttctgggcgaggtgtgggaggacgcgtccaacaagttcgcctacggcaggcgccgcacctacttcaccggcggcgagctggacagcgtaatgaactaccccctccgcacggccattttgaatttcgtcaaaaacctggacggcggccggggcttcaaagaaaccgtgatgtccattctggaaaactacccgccccaggtcgcggcctgcaacatgaatctcctcggcacccacgacaccccccgcattctcaccgccctggtggacgattttgacggttcccgggaggaaaaggccaggcgccgcctgtcccggaaccagctgcctgtggccacggagcggctgctgatggcctccttcctgcaatacaccctgccgggcagtcccagcctgtactacgccgacgaagccgggatggagggctaccgcgaccccttcaaccgccgcacctatccctggggtcgggaggatccggagcttctggcgcacttccggcgtcttgggcagctgagaaagaattgcgatgccctgcgcttaggcgacattcaattcttccaggcggaggatcgccggattggcttcacccggcgctacggcgacagcgtgctgaaaatctactgcaaccgctgcggcgacccctgggatatccctgccgggaaaatcctcttgggacacaatctgcaaaccgtagccccggattggctaacgctggcgcccaagggcttctgcatcgtggagggataa

SEQ ID NO: 790 - DNA, 1749 bp, Unknown
  Description of Unknown: Firmicutes sequence
atggataatcgaaaagtattgctgtccgttgagaacctgcacgtgaatttccgggttcgcggaagaaccctgtctgccattcggggcatctctctggacttctatgagaatgaatccatcgccatcgtgggcgagtccggctccggcaagtccgtgtttaccaagacctttgccggtatgctggataccaacggctatatcagcgagggctccatcatcttcaacgacgacgagctttcggacacgaaggtttccctggacgcccaggccaagcggctgattgccagcacccgggagaagctgaacaaatacgcccagctggagtccggcgcgcagacttaccgcgccatgcgggagcttgagcaggagaaaaagtccagagaaggcctgagcgaggaggaaaatcagaacatttccgccaaaatcgacgacctgaccttccgccgcaccgagctgtataaccacaagctgaccatcgaccccaagaaggagcgggagcgccataaggaggtttccgccgaaatcgacgctctggatgccgagatcaaggcgctgcaaaaggaacacgccgccgtggccgctgcccacaagcaggcggcgaggaacgacaccgcgtaccgcaggcacttcgacgagcggatggcggagttgaaggcggagtatgccaggcagatttccacccccatttccgaggataccaaggcgcgcaacgagatcatcgccaaggaaatttacctgtccgtcggccgctatcccatgttcaagcgcttaaggctcatcggtaagctgctcagcagcttcaaggacgccatgtccgtgggcaaggatctgagcagcgacgaggtgcgcaattccgtgttcgacgaggtggtcttccgggtcaaatacctggacgagaccgaggatatgctccacggcacctgcgtcatcaacctggccaagatccggtattccaaggactggacgaagattcgcggcggcaagatcgcaaccgtgttccaggatcccatgacctccctgaaccccatcatcaccatcggcaagcagattacctccgttatcctcaagcaccagaactgttctgagctggaggcgagagagcgcgccttggtgctgatgaagaaggtgggcattcccaatgcggaggcccggttcgacgattaccccttccagtattccggcggtatgcgccagcgtatcgttatcgccatcgccctgtcctgccagccgaaaattctgatctgcgacgagccgaccactgctctggacgtgaccattcaggcgcagattttgaagctgatcaaggatttgcagaaggaattcggctacaccatcgtcttcatcacccatgacctgggcgttgtggccaatgtggccgaccgggtcgcggtgctttacggcggtcaggtggtggagctgggtacctgcgaggaagtgttctacgatcccagacatccctatacctgggcgcttctgtcctccttgcctcagctggcacagcggaacaccaagctgtattccatcaccggcacgcccccgtctctgtacaataagatcgtgggcgacgcctttgccccccggaatccctactgcctggagatcgacacgctgcgtgagccgcccatgttccaggtctccgagacccactttgccaaaacctggctgctggatcccagagcaccgaaggtggaaaagcccgaaaccatccaaaatatccacgagaagcttgtggaagcattcaacatttaa

SEQ ID NO: 791 - DNA, 1809 bp, Unknown
  Description of Unknown: Firmicutes sequence
atgaaagacaaaacaaagccaaaatacaacgccgcccaaaatgtagggtggatggtaaagatcgcctggaaggtcagaagacgggtgctgtttctctgcgtcgccatggcggcgctggaggtagccaacaatctggcgcagctgtacgtcgcgccggaaattttaagccgcgtggagcgccacgcccccatgggcgagctgcttggcaccatcggtatgtttaccctggcactgttcctgaccatgggactcaaggagtatttcaagaagatcgctctgttcccaagggtggacgtgcgctccagtattgtgggcatgatcggcagaaagtgcaacatgacctccttccccaatacgctggaggcaaagtttatcaagcttcgggaaaaggcgcatcagtcgacccaaagcaacaatgaagcgacggaactggtttgggagaccctgacagagctgatgcagaatgtgggcggttttctggtgtacctcaccatcctgtcccgcctgaacggggtgctgctgggggtgatcgttgtcacctgcgtggccggcttcctgctgtcccgccattccgacaactgggaattccggcaccgggacgaggaagaagcttattacgcgaagacgaggtacattcgcaataaggctcaatccgtggagctggcaaaggatatccggatcttcggcctgcaaggctggctgaacgagctgatggatcgcgtccagaacgtgtatctggattttctgctgcgcagcgagaaggttcggctgctgtcggatgttgccgaagcgctgctcaccatggcgcgaaacggcattgcctatgcctacctgctccatatggcgctccgggattctctgagcgtgccggaatttatcctgtattttaccgcggtgtccaccttcaccacctgggtcatgggcattttgcaggcggcgcagaagctgcacgaggaaagccttgacatttctcaggtgcgggaatttctggactacccggaacccttccggtttgagggcggcgtggccattcccaaggcggacgcctgcgagctgaagctggagcatgtgtccttccgctaccccggggcggaggaggataccatccacgatcttgacctgacggtgcgccccggggaaaagctggccatcgtgggactgaacggcgcgggcaagaccacccttgtaaagctgctgtgcggcctgttcgaccccaccgaggggcgggtgctgctgaacggcgtgaacgtaagggactttaaccgccgggaatactatgggctgttcagcgccgtattccaggaattttccattctggacgtaaccgtggcggaaaacatcgcccagaccaatgagaacattgacacccaaaagctttgggactgcatcgaaaaggcgggcttgacgcagaccattcagaagctgcccaaggggttggacacccatgtgggcagggaagtctacttagacggcgtcctgttctccggcggccagacccagcggctgatgctggcgcgggcgctgtacaaggacggcgcgattctgctgctggacgaacccaccgccgcactggatcccctggcagaaaacgacatctatcaaaagtacaaggacatgacggcggggaagacctctctgttcatctcccaccggctggcgtccacgcggttctgcgaccgcatcatcttcgtggcggacggccgcatcaccgaggaaggcacccacgatcagctgctggcccggggcggggcctatgccaggctctttgagatccagagccggtattatcaggaagggaaggcgttctga

SEQ ID NO: 792 - DNA, 1452 bp, Unknown
  Description of Unknown: Firmicutes sequence
atggcaaagcgcaaaaatgtactgctgattctgtctgaccaacagcgcatggatacgatcagcgcctatggaatgaatgatatctgcaagaccccgcacattgaccagcttgcggctgagggcatgaaattcagcaacgcgtataccccgtccgccatctgcgcccccgcccgcgccagcgtgatgacggggctttatccccacaagcacggtgtggtggacaacttcaccaacatcaaggagggtacccctctgctgggtgactgcatgcacgacgccggctatttctgcggttacgcgggcaagtggcacgttacccacaacaaggagccggaggagtgtggcttcgacatcggcaagccctttatgggctacggctttcctggcagtctggtgtttcccagcctggtattccacgcgccgcccgacaacaagccgaactactatgagctgtacttaaaggaaaacggatttgaaaatgtggatgtctcccacgggtttatgggcgacaaccccgcccttcagagccaggagatgttctgcaagcatgaggggcctgtggaaagcaccatcgagtacttcgtggctcacgagacaaaccggctgattgacaaggccaaggaggaggaaaagcccttcttcatctgggccaacttctggggaccccattcccccagcatcgtccctgagccctattattccatgtataaccctgccgacattcccgagcatcccagctattgcgacgatttgctggataagccctatgggtactatctcagtgagaagatgtggggcttgggcgactacggttggaaaggctttcaggagattgctgcccgctactacggccactgcaccatgatcgacgatatggtaggcatgatcgtggacaaattgaaggccgagggactgtacgatgacaccatcatcatttacagcgccgaccacggagactgtctgggcgcgcacaagctcattgaaaagggcgccttcaccttcgacgagatctaccacatccccatggtggtcaagggcgccggcagcaaggacaacgacagcttcgtctatctgcatgagattatgcccaccatcctggatgtggcgggcgtcaagcctccccgcccggtggacggcgagagcatcctgcccctgatgatgggtcagcgggagagcaacggccgcgaggaggtgttctgcgagtttcacaaccacttctacgttcaccgtcagcgcatggtccgggatctggactatcagttcacctttaacgagagtgagcgcggcgagctgtacgatttgaaaaaggatccctatcagctgaaaaatgtctgctacgatcccgcctatgccgaggtcaaaaagcagtacatggataagatgtccaaatatctcaaggcgctgaatgaccccgcaagcacctggttccaccgcatcaaggaattttattaa

SEQ ID NO: 793 - DNA, 2205 bp, Unknown
  Description of Unknown: Firmicutes sequence
atgaaaaagttcaacaagatcgtgagtctgctgctggctctggtcatggttctgagcctggctgcctgcggcggcaagaccaccacccccagcaccactgctcccgttgccgcgaccgaggcaactgcggctgctgagtacgtagacccctatgccgacattcgtgatgactacgacgctctgtccgaagccatctacaatgacgtgctgggcgacttcatcgcggcctatgacgccggcaaggcggtcaccgacaatgtctccgagcgttacgctctgatggccattgccgaggccaagctgctggagtccgccaccctgatgcccctgactgcaaaaggcggcaactacgccatctcccgtgtggctccctacagctactccagtgttctgtggggcaatgacgcccagcgttatcacaacgccatcgtcaccaccgagcccatcaagaccgttgaccgtgacgagctgaaggctctgtgggccgagctgaagggcaccggcacctacgctgccgaggctaccaagctgctggagagcaagggctacaccattaaggacacctacgctcccggcggcaagtttgcctccgatccccagacctgggacattctggctacctcccgtgccgccgacgccgaggccattgtcaacacctacgacggcctggtcgagtacgactgcgagaacgtcatgcagcccgccctggctgagagctgggaagtttccgacgacggcctgacctacaccttccacctgcgtcagggcgcgaagtgggttgactctcagggccgtgaggtcggcgaagtgaaggctgacgactttgtcgccggcatgcagcacatgatggatgtcatgggcggcctggagtacctgatcgagggcatcattgtcaatgccagcgagtacatctccggcgacgtcaccgactttgctgaggtcggcgtcaaggccgttgacgactacaccgtcgagtacaccctctgccagcccacctccttcttcatgaccatgctgggctacaacgtgtttgctcctatgtgccgcagcttctacgagtccaagggcggcaagttcggtgccgacttcgacaactccgctgcttcctacacctacggcaagacccccagtgacatcgcttactgcggtccttacctggtgtccaacttcacctccgagaacaccatcgtgttcaccgcgaaccccgcttactggaacaaggacaacatcaccatcaagaccctgacttggctgtacaatgatggccaggacgctctgaaggcctacaacgacaccatttccggtgttctggacggcgccggcctgaacgcctccgctgccgagcaggccaagaccgacggcgtgtttgacaccctggcctacgtttccgccaccgacgcgactaccttcagcgcgttcctgaacgtcaaccgtgccgctacctccaacgttaatgacggctctgtcgtctctcccaaagatggcgacgaggaggctatgacccgtaccaacgctgccttcctgaacgtgcacttccgccgcgccatcatgttcgcgctggatcgtgctacctacaacgctcagaccgtcggtgaagatctgaagtacgcttccctggtcaacacctacacccccggcaacttcgtctctctggaagaggacaccaccgttgacatcaacggcactgccaccaccttccccgccggcacctactacggcgccatcgtgcaggctcagatcgacgctgacggcctgaccatcaaggtgtgggatcccgaggctgaaggcggcattggttcctccactcagttcgacggctggtacaaccccgatgaggctgctgccgagctggccaccgctgttgaagagctggctgctgagggcgtcgaggtttccgctgagaaccccatctacatggatctcccctacttctccggttccgaagctttcggcaaccgcgccaatgccctgaagaagtccattgagactgtcctgggcggcgccgtgatcgtcaacctggttgagtgcgttgattccaacgcctggtactacgccggctactacaccgacttcggttatgaagccaactacgacttctacgatgtctccggctggggccccgactacggcgatcctcagacctatctggatactttcctgcccgattactccggctacatggtcaagtgcatcggtctgttctaa

SEQ ID NO: 794 - DNA, 1623 bp, Unknown
  Description of Unknown: Firmicutes sequence
gtaaatccccgtttttcattgacgaaaccggagaaaaaagatataatggttggactgagttacggaagagaggtcttcaccatgaaggagacaaacaaatctctgctggttgagcgggcagcggcatggctcctgtcccggatccgggaaaacaccgtccccctggccgcgtcgctgattgccgggtttctggcgtacacgttttcctttaccaacaagcttctgaaccacgacgaggcttactccctgttcatgaagggcgctacggtggaatccgggcggtggggactgggcggaatcgatttgattttccccaatttctccatgccgtggatttacggcgttcttaccattgcgttcatggcaatttccgtctgcatcatcgtccggattttccgaatccgcagcaaactgtttcaggcgctgctggcagggtgcattctggtgttttcctctctgactggcaccctcgcttacatgttcacctccaattccttcgcgttttcctttctgctggcagtgaccgcagtgtaccttcttcagcgtccctccgcactgtgggggcttcctgcggtcgtatgcatggtcgcgtcgttgagcatctaccagtcctacatctccgtcgcggccggtcttctcgtgctggtactcatccggcggctgctggaaggggacgaggtaaaaccggttatccggcagggcgtgtattttctgctgtttctcgtcgtctccctcgccctctactacgctgccacgcaagttgtcctccggctgaaagacgtccgtctgggggactacgccggcagccgcgtcagcttccgcttatcctccgttcccgccggaattgctcaggcttacggcacgttctttgcctttttcacccagggaaaggccgggctgatgcccacggtcttctcccggtggatgcacggcatcggcatcgtcgctaccgtggtgctgcttgtcctttgggggacaacgcatcgtcagccgggacggctcctgctgctggtcgctctggtcgcaatactccccctggccgtgaattgcatgtacctgttcaccgtccccgagtccattcacacgctggtgctgtacggcttcgtgtccgtctacgtgctgatgattcttgccgcggacatctgcctttccgtccccggcaaggcttgggatctgcttcggagatttggcctgaatgccatagccgtcagtctggcatgtgtggtcgtatccaacatctacgttgccaacgccgcaagtctgcacctgtatctccggcaggaaaacacccgcgccttttacaccgccctggtggctgacctacagcagacgccaggatttgacgaagatacctgtcttgccgtcatcggcacttaccgcgacccggaattttacgaaaagttttccttcctgcaagagctaaccggcgtcgccggtatccgccccgacagctattcccggcaaaggttcctcgaatactatctgggcttttccctgaccttcgcctcagatgaggaagccgcagcgattcagtcttccccccaattcgcgtcgatgcccgtctatccctaccatggctccattcaagaaatcggcgactgcctggtcgtcaggctgtcctga

SEQ ID NO: 795 - DNA, 1509 bp, Unknown
  Description of Unknown: Firmicutes sequence
atggatacaacacaggatagccgggaaaacggcggaaagcgtcgcccgcagacagacgggcagaatcgcgcttcccaacgacccggacaaagcaccccggagcagcgccgccgcccggcagagcaaagcgctcaggagcgtccccgccgtacagcggaacaaagcgcccaggagcgcccgcgtcgtgcgccggagcagagtacccaggagcgccctcgccgcgcagcggaacagggtgctcaggagcgcccgcgccgttcggtagagcagaaccctcaggagcgcccccgccgtgcagcagagcaaaccgctccggaacagcgccgccgtgcgccggagcaaaatgcccaggaacgtccccgccgttcggcggaacaggacgctcagagacgccccgcccggcaggagaagcctgaccgtccggccagaagggaagcacagccccggcagagagccggagaagaagcgacccgccagcggacgaggcagcccgccgattcccggcgaagcgccccccgccgcaagcccgcggacgacgatgtccccaacagaaagcgcgcctacggaaacagcaagccaaaaaagaaatcggcgctggccatgctggccgagacgcttctgagcgcaaaaaaccgaccgaagaagcgtactccccgaaaaagcgagaacagccgcccgaagacacccacacccgctgtgatctatacccagcctctgccattcaaccgtgaccggctgatcgtccagctgataacggtgacggctgtggtactggccatcgttatgggactgtcggtgttcttcaaagtaaaaaacgtcacggttaccggcgcggatacctacagcgcctgggcggtgcgggaggcctccggcatttccgagggagacaagctcctgaccttcagcaaaatccgtgccgccagccagattatggcaaatttgccctacgtcaagggtgtgcggattggtataaaattgccagatacggtcaatattatgatcgaagaagagagcgtggtctatgccgtcaagtccagcgacggacagtggtggatgatggactccgacggaagggtcgtagagcaggcgaataacgccaaggcggccacggccacccagcttcttggcgtcaccctggaggcccccgcggtcaaccagaagggcatcgccacggagatgacccccagcgagaccaacgagctgggagagctgatcccggtgacgaccaccggcgcgcagcgcctcaccgccgcgctgcaaattttcaaggcgctggaaagcaacgacatcgtgggcgaagccgccagcgtggacgtgaccagcaccgaggacatcatcctctggtatggcacccgctatcaggtcaatctgggcgatacgtcccgtctcgattacaaaatcgactgcatgaacgatgccattttgcagatgagtgactaccagagcggcgtcctggatgtcagcttcaccatctggccgaatcaggtgggctatacgcccttcgcatga

SEQ ID NO: 796 - DNA, 3456 bp, Unknown
  Description of Unknown: Firmicutes sequence
atgagctttgtacatttgcatgtccatacggaatacagcttgctcgacggcgcgtgccgcgttgacggcatcatggatcgggtcaaggagctggggcagaccgccattgccatcaccgatcacggcgtgatgtacggctgtattgatttctataaggccgccaaggcggcgggaatcaagcccattatcggctgcgaggtctacgtcgcccgccggggcatggccgaccgggttcacgggatcgacaacgacccctaccatctggtgctgctgtgcgaaaaccgcaaggggtacgaaaacctatgctatctggtgtcggaagcctttattcacggcttttacggcaagccaagaatcgatctttcgctgctccggcagcaccacgaggggctgatcgccctgtccgcgtgccttgccggcgccatcccccagtatctgatggaagaagattacgattccgcgaaggaatacgcaaaaaaaatgtccggcattttcggggaggggaacttcttcctggaaatgcaggatcacggcattccggagcagcggccggtgaatcagggcgtccagcgccttgcccgggagctgggactgcccctggtagtgaccaacgacgcccactatctgcgcaaagaggacgcagaaatgcaggacgtcctgctgtgcatccagaccggcaagaccgtggacgacaccaaccggatgaaattccagacccaggaattttacctcaaaagcgaggatgagctgaaagggctgttccccggctgcgaggaagcctttgagaacaccgtccgcattgccgagcggtgcaatctggactttaccttccacgaataccatctgccctcctacccggtgccggaggggtatacggacgaggaatacttccgcaagctgtgcgccgagggctttgcagagcggtatcccgatgcgccggaagcttaccggaagcggctggaatatgaggtcggtgttatcagtcggatgggttatgtaaactactatctcatcgtctgggacttcatccactatgccaaggtcaacggcattcccgtggggccggggcgcggctccggcgcggcttccattgtggcatattgtatgcacatcacggaaatcgaccccatgaaatataacctcattttcgagcggttcctcaacccggaacgggtgagtatgccggattttgatacggatttcagcccggaacgccggggtgaggtcatggaatacgtcatggagaaatacggtgcggatcatgtcgcccagatcgtcaccttcggcaccatggccgcccggggcgccattcgggacgtaggccgggcgctgaacttctcctacgcggagacggatgtggtggccaagctggtacccaccatgccgctgcacctgacgctggcggaggccatgaagatctcccccaagctcaaggaaatgtacgacggcgaccagcgggtgaaaacgctgattgacacggcaatgcgtttggagggaatgccccggaacacgtctacccacgccgcgggcgtggtgattacggcgaagccggtcaatacctacgtccccctgtcccggaacgacgataccgtggtcacccagtacaccatgaccaccatcgaagagctggggctgctgaaaatggactttttgggtctgcggaacctgtcggtgattcaggatgcggaagcgctggcgcagcaggaagacccagactttcagattgcaaaagcaccggataacgacccggagaccttcgccatgctggctgagggcaagactcagggcgtttttcagatggaatccaccggcatgaccggggtgtgcgtcagcatgaagcccacctccatcgaagatctgacggccattgtggcgctgtaccgccccggccctatggaatccattcccaagttcgttgaaaataagttcaaccccggaaaagtgacctacaaaacgccccttttggagccgatcctgaaggtgacctacggctgcatcgtctatcaggagcaggtcatcgagatttttaggactctgggcggctactccatggggcaggcggacaacatccgccgggcaatttccaagaaaaagcagaagatcatcgacgccgagcggaagaccttcgtttacggcgaccgggagcagaaaattgacggctgtatcgcccggggggtacccgaggcggtggcgcagtcgatttacgacgagatcgtggatttcgccaactacgccttcaataaggcgcacgcggtgtgctatgccgtggttgcctaccagacggcctacctcaagtgccattatcccaggcagtacatggcagcgctgatgacctccgttctggattccgctaccaaaatttccggctacatcgccgaatgccgggagctggggataccggttctcccaccggacatcaaccattccgaggactacttcaccgtcgagggagacgccatccgcttcggcctcggcgcggtgaaaaacgtaggccgggggctcatccgctccatggcagccaaacgggcagagggcggcgctttccgctctctggaggattttctggaacggatgggggagggcgagctgaataagcgcgccgtggagaacttcatcaaatgcggcgccatggactgcttcggctatcaccgcagtgagcttctggcggtgtacgaccaaatgatggacagcgtgtccgcctcccggaagaagaatctggaagggcagatggggctgtttgccatgctggacgaggacgacgaagcgggcaaggtgccgatccccaagctcaaggagctgagtaaggcagaactgctcgccatggagaaggagaccaccggcgtctacatttccggccaccccatggacgattaccggccgtatctgcgcaacacccacgtggtacacatcggcagtctcatggaggaggacaatggcttccaggacgaccagatcatcagcgtggcgggcatcgtccagaccgtgaaaatgaagaccacccggaacaattctatgatggcgtatgtcacggtagaagacgatacggcgtcgattgaaatgctggcgttctccaacgtgctggatcaatacgggggctatctccgggaaaacagcgccgtggtcatcaccgggcggctgtccctccgggacgacaaggagccgcagatcgtcattaaccgcgcccgccccatctcggactatgccgacggcagcgcgccgccggagcggccgcagcagacggacaagagcggcacgctatatctccgccttcccggggaggaagggacgctgtaccccaaaatccggtgcatcctgaacatgttccccggggacagcactgcggtgctttactttgcggatacgagacgacgccggggtacccggtgctgcatccgggaaagtatgctttctgagctgaaaaatgtgctcggagaagcgaatgttgtgctgaaatag

SEQ ID NO: 797 - DNA, 1362 bp, Unknown
  Description of Unknown: Firmicutes sequence
atgaaaatcatgattatcggcgacggaaaaatcggcagcgttctggcggagcagctgtccagggaaaagcatgaggtgacgctggtagaccgttccggggtcagactggatcagtccaacaatgagctggacgtgatggtcgtggagggcgacggcgcttccagggacgttcagctggaagccggagcggatcaggcggatctcgtcatcgcctgtaccggcgcggatgagctgaacctgctgtgctgccttatcggcaagaagctgggggcgcggcacaccatcgcccgggtgcgcaaccccatgtacgtggaggagctgaacctcattaaggacgacctgggtctcagcatggcaatcaatcccgaggaggcctgcgccacggaaatggcccgggtgctgcggttcccctctgccattaaaatcgacacctttgccctggggcatgtggaaattctcaagaccggcgtggcggccggttctcccctggacggtatggtgctgaaggacatcggaaagttccgcgccaacgtgctgatctgcgcggtggagcggggggagcttgacgtcatcatcccctccggcgagtttcagctgaaggccggcgaccggatctccgtggtggcaagcccccaggaggcacagcggtttttccggcaggtcggcgtggcgaagacccgtgtgcggcaggtcatgctcatcggcgggggccggatgggttattatctggcacggcagctgctggctaccggcatggacgtaaagatcatcgagacgaacgcaaagcggtgtgaggagctgagccagcttctcccggaggcgacgatcctccacggcgacggcacggatcagcggctgctgctggaagagggcatcgagcatatggacgccatcgcggcactgacgggcattgacgaggaaaacatcatcatttccctgttcgccggacggacgacccgtgccaaggtcattaccaaggtcaaccgcagctcttatgagccgctggtggccagcctgtctctggattccgtgttctatccccggaatatctgcgcggacaacgtggtgcgctacgttcgcgccatgcagaattccgacgcctatgccagcatggagacgctgtgcaagatcgtcagcaataaggtcgaggcaatggagtttcgggtcacagccagcgccgatttctgcggcatcccgctgcaagacctgcacacgaaggacggcctgctgatcggctgcatctcccggggcggcaagaccatcaccccccggggcagcgacaccatcgaggtgggggacagcgtcatcgtggtcaccacccatggcggtctgagaagcctcaacgacattttccggcggtaa

SEQ ID NO: 798 - DNA, 1425 bp, Unknown
  Description of Unknown: Firmicutes sequence
gtgaaaatcaaggcctatatctgtccgtcctgcggcgcgccgctggacgtgaactacgacacgacatttacattctgcccccactgcgggtgcaggctccacatttcctatgaagaggagacggcaccccaaaatccggatcttcgccaattcacggcgtcagacaccggggtgacgctggccagcgccgtggttcccccggactatacgctgaaaggcacgctggtttcccaatggcaatgcgacagcgttccctttaccgccaccgtccgcgccgtcagcccggatcattccaccgtgctgatgtcctcctcccgggaaaccttcgaggattaccggaaccccatgcagagaagagcggtattttccgtgccgggggtgatcaaggccgggctccgggatttcatggagccggaggcctatcttcagcagtatgcccagcaggtactgggggtgccggtcacgccggtggccagggcaacccttcccagcctgttcgggaaaaatctcccggcggaaaagacaaagcttctgtcctttttccaatcccactgcatcaatatcaacgtgcgcatcgaggtggcgaacgtagtctgtgatgggatcctgatgaaattttccgcccggctgggggagcgggatgtggtggttctggcaggcgcggattggcagggcgtggaatactacgatgccaatcatgtcttttccgggattcagaattccttcttcaatccgtttgccggtgccggttggggaacgacgaaaaatttcacggatttcctgaaacagggcggcatggtggggcagatgctgcggggcagaagtgagaccgttcaaagccctcagcagccgcagactccggcggcgattcccctgggtcacgcgaagcggtacggaaaaagcgtagatgttatccagtggggcagcaagcggcggtacctgatggtgacccctgtggaaaaggaagcggaagcgacggaaatcttccttcgttttgtgggaactctgtctccggatccggcgcttacgaagcaggaaagcgcattggtagagcagatgttccagacccgggtgatggaagcgcaggggtatgccgcccaggcgcagcagatgcggatgcagaccatgcagcggcagatggaggtatcccggcagatttcccggaacaatgacgaaatctccgcgggcattatggattcctgggaaaagcgcagcgcttctcagagccggatgagtaccgggtattccgaggccatccgcggcgtcaattcctacgccacgccctccggcgggacggttgagttccatgtgacggccgaccatgtgtatcagaaccgctatggggataccatcggcgtgtcgggcaatggggtcgacccggatgtggcggccaatcttgaccggacggaactgaaacggaaataa

SEQ ID NO: 799 - DNA, 1356 bp, Unknown
  Description of Unknown: Firmicutes sequence
gtgagtgcgttgactgagcaaaggctcttttccaatcaaaagctgatacgtctgatcatccccctggtcgtcgagcaggcgctgaccattctggtgggcatgtgcgacggcgtgatggtttcctccgtgggcgaggcggctatttccggcgtttctctggtggatatgatcaacaatgtgattctggtgctgttcgccgcgctggccaccggcggcgcggtggtcaccagccagctcttgggggcacggcagggggagaaggcacggcagagcgccggtcagctggtgctgatttcggcggttctgggtattgccgcggctgcgctgtgccttgtgttcgcaaaaaatctgatgcgcctgttctttggttccatcgacgacgacgtgatggcggcggggcttacctatctgcgcattacagcattgagcttcccattcatcgcgctgtataacgcaggcgcggcgattttccgcagcgtgggcaacagcaaggtgtccatgcaggtgagcctcctgatgaacggcatcaatgtggtgggcaacgccatctgcattttcgtgctgaaaatgggcgtggccggtgttgccgtccctacggtggtttcccggtgcgtggcggcggtggtcattttgcttctcgcggcgaaccctaagcaggagctgtgcctgaaatggggcgcgatctgtcgggcggacggtaaaatgataggcagcatcttaagaatcggcgttcccaacgcctgcgaaaacagctttttccagctgggacggctgatcgtggtgagcatgattgccctgttcggcacggtgcagacctccgccaacgcggtggcaaacaccctggacagcatgggcatcatcgttgggcaggccatggggcttgccatggtgacggtggtcggccagtgcgtgggcgcgggcgacccgaagcaggtcaggtattatgtgaaaaagcttatgctatggtcgtatctgtccatggcggtgtgcaatgtcctgattattgtgtttgtcgaagatctgatttctctttacagctccctgtcgcccgagacggtggagcttacgaagacgctggtcattattcatgagagctgcgctgttgctttgtggtcggcgtccttcgtcctgccaaacgccttgcgggcggccaacgacgtgcggttcaccatgctcgtgggtatcgggtcaatgatcgccttccgcatcctcggctcctggattctgtgcgtgcagatggaatggggcgcgattggcgtctgggtcgccatgatcctggactgggtgtgccggactgcgttctttgtgacccggatgatttcgggaaaatggcagagcaaatataccccctcatga

SEQ ID NO: 800 - DNA, 1326 bp, Unknown
  Description of Unknown: Firmicutes sequence
gtgaaaaagcgaatatggctgcttccgctgctcatcctcacgtcggttttgctgaccggctgcgccttgcagacggtgaatgaaatgtatgcgctgccaaagcggtcgaaggagtatgacaacttgcagtccgccatcgattccgccatgtacggcctgagctattccgcgccggtctccggggaaaaccggcagacggtgcagatggccgatctggacggcgacggcgtggaggaatatatcgtatttgcccagggaagctctgccaaccctttgcaggtgttgattttccggcaggaggaggacggcacgtgccgcctgatggaggtcattcagagcaacggctccgcctttgagcaggtggaatacgtgcagatggacgacgcccccggctacgagctggtggttgggcggcagctcagtgaccaggtgctgcgcagtgtgtcggtgtactccttttccggcggcagtgctgagcagctgatgatggtgggctactccaaatttctcacctgcgacctggatgacgacgggtgcagtgagctgatggtcattctccccggcgaatcggaaaccgggacaggctctgcggtgctgtaccgcgtgcaggacggcagcattgagcgctcggtggaggtcaacgtgtcggagaatgcatcccacatccggcggatcacggagggacggctgctgggcggaacccctgcggtattcgtcgccagcgcggtaaacgaaagcgccattgtgacggacgttttcgcctggcggaacgatcgtttttccaatatttcctattcccgggattcggacaccagcgtccagaccctgcgaaattactatgtgtacgccgaagacattgacggcgacggcgtgatggagcttcccagcctgatcaccatgaagcgcatttctccggaacatgagggaaagcagaagtttctcatccgctggttcgccatggacctggagggcagggagatggacaagctctttaccttccacaattatttgggcggctggtacatgcagctggcgagcagttgggcggcgcgggtctcggtagatcaggacggcggacggtatacgttctacgtgtgggacgaggactaccggcaggcgttggatgtgttttccatttatgttctgaccggcggaagccgggaggaggacgccacggtggacggccggtttgccttctatcgggcagaaggcgtggtttacgccgcaaagctggaggccaatgcggccgaattcggcattacggagaatcaacttatcaacagcttccatctgattcagcaggattggaaaacgggagagacttga

SEQ ID NO: 801 - DNA, 2694 bp, Unknown
  Description of Unknown: Ruminococcaceae sequence
gtgacggcgctgaatttatttattttgaccgttaattccgaagtcgatataggcaatactgtcaaacagggcgtttctgccgcagccgcccggacggctgacggatacagggcttatgccgaaaccgaaatgccggacgccgacgaaagcatagctcttttaaatgataaaaaagaatataaaagcggagattcttatacatataattttgacgctcctcatgacgcggtttatttcctatacatggattatgtgcttaaaagccgcagcgatttggagctggagctcaggatcgacggcaggctaccgttttccgaggctcaaagacttatttttcacggtctttgggaaaactccgagaagcgctttgacggtgcgggaaacgaaatagcgccggagcaggttttgtcggggaaggcgatatccgcttatgcggaggatatgaccggtacggaaaacgagccgtatggtatagctcttgcaggcggcaggcatacgctcacgcttaccgtaacaaagggaacggcagacattaattatataggactgaccccgcccgaaaaaagtgaaggctacaccgcgcccgaaggctcctcgggaaatagggaaacggtatgcatagagggcgaaagcgccgattacaaaacggggaattcgctggtgccgatgtcggataacgcaagcccgtcggtttcgccgaacgacccgcttaagggcaagctcaactatatcggcggttcaaactggtcggacagcaaggatacgcttacatggagcttcagcgttaagacctcgggctattattcctttgccgcaatgtacaggcagaatataaacctcggggcgatttcctaccgcagtcttaaaatcgacggcaagtctccctttgaggaagccaagcggatgaaatttaaatacagcgcctcctggagatattattccttcggcgataaggaaccgtatcttttttggatagacgcgggcaagcatactctttcgctttcggtaacctcgggcgagatggcggatatttacgccgagctgcaggatataacctctgcaatgggcgacctttacatagatataacaatgcttgtgggcgaaacggtggacacctacagaagctatgagcttttcaaccaaattccggattatgacagtcgtatgaattactgccttaattcgcttaagagagttgcggataaaattgaaaagctgcaggagaagaccggcggctctgcggtatctaccgtaaacggagcctgtgaaatattcgagaaaatgcttgcgaagccgtattccgcgcataaatataaaaccgcgttttacaatgcttatacaaacctcggcgcattgctcggcacggttgcggatatgccgcttgatattgaccgtatataccttataggcgattctgcgggggagcccgatgtgagcgttcccgtatcggagaaaataaagcacggggcggtcagatttttctcgacctttgctgcggattatgataatatttcggattccgcttcggaaaacggactcaccatttgggtaaactggggcagagatcaggcgcaggtgctgacggcgcttataaacaagagcttcaccccgaaatacgaaaccgaggtgacggtgcgcgttgtaaacgcaacgctgatacagggtattcttgcgggcaaagggcccgatgttatgctgcagatggcgcgaacggagcctgtaaatcttgcaatgcgcggcgcgcttaaaaatcttcgggaatttgaggattttgacagcgttacaaccgattttgtaagcaacgcgacaaagccgtatgaatataaatcgggcacatatgcgctgccggatacgcagacctttgatatgctgtttataagaacggatattttcgatgatctcgggcttgaagtaccgaaaacctgggaggaattttccgaaacggccaccaaaatacagcgcaataatctgcaggtttatatgccgtcgaccttttatccgacggtgcttgtgcagaacggactcaaattgtacgatgaagaaaaggggataagcacacttaccgaggcgcgccaaatacagtgctttatagaatataccgattggtttacaaaatataaattccccaaggctatggattcgttcttcaaccgcttcagaataggcagcgcgcctatggggatatcgccctacacccttataacccagattgaggtggcggcgcccgaaattgccgacagatggacggcggtaacgctgccgggtgttaaaaccggcagcggtgaaataaatttttcatcctctgcggagggcacgggctgcggaattacaaagctttcaaagaataccgaaaaggcatgggagtttcttaaatggtgggtatccgccgagacgcagacggcatattcggagaatgtagaatcgatattaggaccgataggcagggttgccaccgcaagcaataaggctttttcggagcttgactggagcaatgatattgtgcccgcactgctttcgcaaagggaaaatacggtcaatctgccgcagctgccgggcggctattatgtgacccgcggaatcgagcaggcatactggaatgtggttgagcagaacgccaatccgaccgacaccctgataaaatggggcgacattgtaaacaacgaaatgataaggaaaaaggcagaatacgaataa

SEQ ID NO: 802 - DNA, 1170 bp, Unknown
  Description of Unknown: Ruminococcaceae sequence
atgctttttatttacagatttcggcgcggctttttacgaattgaaatacgcggcgatattgcggaggcgctgcttaatatctgcgcgaaaaacggaataccgctttggagcataaggaggcgcggaagcgttatcaggagctttatttcggtaagcgatttcaggcgcttgcccgctcttgttgcgggaagcggactcagggtgcatatactcgcaaggtacggtcttccgttttttacggagcgatataaggaaagactcggaataccggtgggcgcggcgctgttttttgcatttttaagctttatgtcgggctttgtatggtcggtcggagttgaaggcaacagcgctatatcaaagaatgagcttcttgccgaatgcagagacctcggcatttatgagggcatgcgtaaaagcgatatatcgcccgcaggcgcaaagctgcaattactgcttcgggataaccgcctttcatggtgcgcttttaatatcgagggctgctatttaacggtggatgtgaccgaggcaaagagaaaggaggaggataacagcgtgccgacgaatttaaaggcggcggcagacggcattatcaaaagaatagatgtgacctccggcaactgtattgtcaaggtgggggatacggtcgcaaagggggatatattggtctccggaatcgaggaacgcgcggacggtacgaaatttgtccattcggcgggcagggtgaccgccgtaatcgagcgggaaattaccgtaaccgcaaaatacaaacagaaaaccgccgttttaacgggaaagaaaaaaaccaaaagagtgctttcggtgttcggattaaaaattccgctgtatttagggagtgaaagcaagccgtaccgtgcaagtacgcataaaaaggtgctgaagcttttcggaagggagctgcctgcagcgctttatgaaaagcgctttgaatttacagaggaaacggaaaaaaacttcgatcggacatcactcgagacagagcttgaaaggctgttttcggagcaggtgaagttagaaatttcgggcgatttttcagtcaaaaatcgtgaaattgacgaaattaagggcggtttaaggctgaaaacggctgttttggcggaggaaaacattgcgacgcaggatattatgttatttaatactggaaattcatag

SEQ ID NO: 803 - DNA, 1710 bp, Unknown
  Description of Unknown: Ruminococcaceae sequence
atgattaatgaaaaatatcaattgtggtgcgaaaaggcaacagccgatcccgagcttataacagagcttaaagcaattgcgggggacgaggctgcaatatctgacgcattttataaggatcttgaattcggaacgggcggtcttcgcggcgttataggtgccggaaccaaccgaatgaatgtttatacggtgggaaaggcttcccaaggtcttgcttcatatgtaaattccgtgaacagcaacggaaagatcgccatagcatacgacagccgaataaagagcgagctttttgcccgcactgcggcggctgttttcgcggctaacggcattaaggtttatatttataaggaacttatgccgactccgatgctgtcgtacgcggtaaggcatctgcactgcgacgcgggcgtggtggttaccgcaagccacaatcccgcgaaatataacggatacaaggcatacggctctgacggctgccagctggggcttgaggctgcggactatgtgctttcgataatgaacggcgttgatgttttcaatgatgttaaaaccgttgattttgataaggcagttaaaagcggagagatcgaatttatcggcgatgaggttatagaaggctatcttgactgcgtgcttgcatgccgcgtcgcgcccgaggctgatgtcagatcgctcaatgttatttatacgcctctgcacggcagcggcaataagccggtgagaaagattcttgaaaagatcggcgttgaaaaggttacggtagtgccagagcaggaaaaaccgaacggaaatttcccgactgcgccgtatccgaatcccgaaatcaggcaggcgtttgaatgcgccttgaagctggcggataccgtaaagcccgatctgctgcttgcaaccgatcccgattgcgaccgtgtaggcattgcggtcaatacaggcagcgattataaattgctttcaggaaacgatgtaggcgcgttgctgcttgattttgtgcttgcaaggcgcagtgaaagcggcacgcttccgaaaaatccgattgcggtaaaaacaattgttacaaccgaaatatgcagaaaaatcgccgctgattacggctgtgagctgcgcgaggtgcttacgggctttaagtttatcggcgagcagattacacagcttgaggaaaagggcgaggaaaaccgctttgtgttcggctttgaggagagctacggctacctcggcggcacatacgtgcgtgataaggacgcggttatagcctcaatgcttatatgcgagatggtggcatattataaggaaaagggtaagcttcttaccgatgttttagaggagctttataaaaagtacggctattatttctgctcgcagaaaagctttacctgcgaaggcgaaagcggcatgaaacagattgccgggataatggaaaagcttcgcacggaggctccgtcggaaatagcgggggagagggtagtgcgtgcggacgattacgaaagctccgtcagccgcaacctcaccgacggcagcgagaagaaaataacgctccccgtttccaatgttttgtgcttctattcggaggacggcagctcgcttatcgtccgcccgtcgggtacagagccgaagatcaagctttatatcggagctgtaggcaaaaccgaggaggctgcaaacgaaaagaaagccacgcttgaggattgcggcacaaagctcctcggattttaa

SEQ ID NO: 804 - DNA, 1743 bp, Unknown
  Description of Unknown: Ruminococcaceae sequence
atgcttttgaaaataataaggataattttactgctcttttcgctttacggctattcgcaatatctttattcaagattgaagcttaaagccgagcttattatgccgatgcttttaagctttttcggctcggcaatatttctcggggggcttttaaacataacaaaggagactgccgcggttattttccttttgggtgttatattgtgtgcggtttccgtaaagcgccgatatagcccgtcgggtcttattacgggcggtacggtcatatgcgccgcggctcttgcagtcttgcttgcttttacctacggcacaaaattaatggggtatgacaatttcagtcaatggggaacggtagtccgcctgatcgttaccgaaaaccgattcccgaattttgaggatacggtgatatgcttccaatcctacccggtcggcagtgcttcgctgatctattattttgccaaaataaccggaatacggagcgaatggttctttatttggatacagcaggtcgcaacggtgtgctctgcctgcagtatatttgccttttgccgcaaaaagcgtccgatagaatatttatcggcttctgctgccgttttctgtattctgttctgcgttcttaatattacagccgggcttcaggtggacgcgctgttatcctgcctcggcattgcgggaatctctgtttgcttttattacagggaaagccccgaaaccgcgctttatgcaaccatacccataaatatatttttactcgcggtgaaaaacagcggtgtattttttgcggtgataatctcgctcttctgccttttgcggataattaaatgccgcggctttaaggttgcggtgtcgcctaaaaagatttttccgcttttatcgcccttcgtcacactgctgctttgggataagcatgtcgccttttccttttcgggcggcatgaccgcaaagcattccatgtcagcggagaattactcgcaggtattttccgaaaaaactcccgagctgatttcgcagattacgcgtgactttttaaaaaaggtcttttcactcgataatgccttttttataattcttatcgcactgcttgcgtctctgctgattgttaaaattttcaggctgaccgtgccgctgtgcggtgaggcggcggtcttgattataggctcttacacggcttatcagctcggaaattactttatgtatattttttcaatgccgaattacgaagcctcgatacttgcaagctatgtgcgttatcacatgactataatagctttttcggcgggtctgctttggatattactgaatgaggtctttcagtcgttcggcttatcatacaaatgcagaggtgtaaaagccgcggctttaagcgcggtatatgccgcagccgctgcctgtgctatttggttttccgcaacgccgcacctcgattatttcaaaaaggaagcatacgagggcagcgaccgacaaatactcgatacgattgcggaaaaatatactgcaaacaatgcacccaacggctcttatgccgtcatatggcagtttgataaagagggatacagatatttcctttcaagatatacattcaaaacggggaaggttgcgcgcattgaaagcagcaatcccgatttatcggctgcggttgcgggatacagctatatcgtagttcccgagcataacgcctatgttgacgcttttctgaccgagcgcttcggaagctgcacagaggatgtttattccgtaacatga

SEQ ID NO: 805 - DNA, 3822 bp, Unknown
  Description of Unknown: Ruminococcaceae sequence
atggagccgacttcaatggtaaaaccggtacgcctgggcaataacaaccgaatgaccttctcgaagatcaacgaagttattgacatgcctaatctcattgaaattcagaaggattcgtacaaatggtttgttgaggagggtttgaaagaagtcttcagggatatgtccgatataacggactacagcggaaacctgaggctcagctttgttgactaccgccttgacgatactcccaaatacgatgttaccgaatgcaaagcgcgcgatacgacatatgccgcgccgcttcgcgttaccgcgcaccttgtaaacagcgagaccggggagatcaaggaaagcgaggtctccatgggcgatttcccgctgatgaccgaatccggcacctttgtaataaacggtgcggagcgcgccatagtttcgcagcttgtgcgttcgccgggtgtttatttcgccgaaaagaccgatgaaaagaccggtaaacggcttttttcctccacgataatcccgaaccgcggcgcatggcttgagtatgaaacctctccgaacgatgtgctttatgtccgcatcgataaaaaccgcaagctgcccattactacctttgtgcgttcactcggaatcggtacaaacgatatgataagaacgcttttgggtgaggacgagcgtctttccgcgacccttgagacggatgataccaagtcggttgaggacgcgcttgtagaggtctataaaaagctccgccccagcgagcctgtaaccattgagggtgcaaaggcttatcttgagcagcttttctttgacccgcacagatatgatatttcccgcgtgggccgctataaatacaataaaaaattggcaataggcgccagaatccgcggcgccgtgctttcgcgccctgtggcagatccgatgaccggtgaaattcttgccgaggcggatgtgaccgtcagccgcgagctggcggataccatagagcgtaagggcgtaagggaagcctatatcaatgttatggactttgagggcaatgttactgaggtaaaggtgctctcaaacggtatggtaaggctttgcgattttaccgatttcactgccgatgaactcggcgagcttgacgggctcggcataaacgaaaacgtttcgtttgaggttcttaaaaagctgcttgaggaaacaaacggcaaggaagagctgcgcgaggcaattttggctcatgccgacgaccttattccgaagcatataacgcttgacgatatatttgctaccgtaaactattttctgggacttcctcacaatgtgggcacggttgacgatatagaccatctcggcaaccgccgtatccgttcggtgggtgagcttctgcagaaccagttccgcataggtatatcccgtatggagcgtgttgtgcgtgagaaaatgaccctgcaggcgcaggatcccgacagtattaccccccagtcgcttataaacatccgtccggttgtggcggctataaaggaattcttcggctcgtctccgctttcgcagtttatggatcagaccaaccctctgtcggagcttacccataagcgccgtctttcggcactgggtcccggcggactttcccgtgaccgcgcgtccttcgaggttcgtgatgttcactatacgcattacggacgtatgtgcccgatagagactccggaaggtcctaacatcggtcttatctcctatcttgcaacctttgcgaagataaataaatacggctttatagaaactccgttccgcaaggttgataaggaaacaggcagagttcttgacgaggtttgctatatgactgccgatgaagaagacgaatacattgtagcacaggcaaacgagccgcttgacgaggcaggtcattttgtaaacaaaaaggttactgcccgttatcttgacggtttccgtgaggttgagtcctcccgtgccgattatatggacgtttcgccgaaaatggtggtttcggtagcaaccgccatgattccgttccttgagaacgacgataccaaccgcgcgctcatgggctcgaacatgcagaagcaggctgtgccgcttttacgccccgaaaacccgattgttgcaaccggtatggaatacaaggcggcggttgactcgggcgttgttgtgcttgcaaagcgcgacggcgaggttacctatgtcagcgcggattacattaagattcgcgcgacaaacggcgaaattgacgaatataagcttataaagttcctacgttcaaaccacggaacctgtataaatcagcgcccgatagtagcagtcggtcaaaaggttaaggagcacgaggttattgccgacggtccggctacgagcaacggagaaatatccctcggcagaaacgccctcatcggctttatgacatgggaaggctacaactacgaggacgcagttcttataaacgagcgcttggtgcgcgatgatgtttatacctccattcatattgaggaatatgagcttgaagcgcgcgatacaaaactcgggcctgaggaaataacaagagatataccgaacgtaggtgaagatgcgcttaaggatcttgacgaccgcggcattatccgcgtcggcgcagaggtcaccgcgggcgatatacttgtaggaaaggtaacgcccaagggcgaaaccgagcttaccgccgaggaaagactgctccgtgcaatattcggcgaaaaggcgcgcgaggtaagggatacctctctgcgtgttccgcacggcgaatacggcacaattgttgatgttaaggtattcacaagagaaaattcggctgaattaagccccggagtaaatgttgtcgttcgctgctatatagcgcagaagcgcaagatttccgtgggagataaaatggcgggacgccatggtaataagggcgttgtatcccgcatacttccgagtgaggatatgcccttcctgccggacggcactccgcttgatatagttctgaacccgttgggcgttccgtcccgaatgaatataggtcaggtgcttgaggttcacttaggatatgccgcgaaagcgctcggctggaacatctgcaccccggtatttgacggtgctcatgaggatgacatccgcaagtgctttgcaatggcggaggaattcacaaaatccgacgaatataaggataagaacagcgcgaagcttgacttctcacgcatcccgctgacggcagacgccaagacccagctttatgacgggcgccccggcgagccgtttgataacccggtaaccgttggctatatgtactatctcaagctgcatcacctggttgacgataagatccatgcgcgttctacaggtccgtactcccttgttacccagcagccgctcggcggtaaggcgcagttcggcggtcaacgtttcggagaaatggaagtttgggcgcttgaggcttacggtgcggcttatacgctgcaggaaatactcaccgttaagtcggacgatgttgtgggtcgagtcaagacctatgagtcaatcgttaagggtcagaatattccgaagccgggcgtgcccgagtcgttcaaggttcttattaaggagctgcagtccttgggtcttgatgttaaggtgcttgaccgtaacgatgaggagattgacttgaagcagagctttgaggatgacgacgacatcggtctcggaacaccggcaattcccgaaaacgagggtaacgatgttgactttgacggtcagtcggttgctgacgatttgaccggattcggtcttgaggacgaaaacggcgaagcgatagccgaggatgaatatgacgaattcgcatcagacgatgaattcgacgacgaaaattaa

SEQ ID NO: 806 - DNA, 1542 bp, Unknown
  Description of Unknown: Ruminococcaceae sequence
ataaaattgcagtataatcgggaggaagcagaaatggcttattatttcaacgaggtttcacacacttttaacgagtatcttttggtgccgggttattcgtctgccgagtgcataccggcaaatgtcagcctaaaaacaccgcttgtaaagtttaaacgaggcgaggagcccgcgatttcaatgaatattccgctgacctccgctataatgcaatcggtttcaggggacaggcttgcagtagcgctagcgcgtgagggcggcgtttcgtttatctacggttcacaatctatagaggacgaggcggctatggttgagcgcgcaaagtcgtataaagcgggctttgttgtgagcgaatccaatgtaacgcccgacagcaccttaaaagatattttggagcttaaagccaaaaacggacactccaccgttgcggtaacttccgacggagagccgaacggcaagctgctcggtatagtcacaagccgtgattacagggtgagccgtatgtccgaggatacgctcgtaagcgattttatgaccccgctcgcctcccttatagtaggcgaagaggaaaccactctcaaacaggccaacgatattatatgggatcacaagctgaattctctgccgatagtggacagagacggcaatcttaaatattttgtattccgcaaggactatgacgcgcacaaggaaaaccccaatgaattgcttgacagccacaagcgctatgttgtcggcgcgggaatcaatacccgtgattacgaggagagagtgcctgcgcttataaatgccggagcggatgtgctctgcatagattcatctgaaggcttcagcgagtggcaggctcgtacgcttaaatttatacgcgaaaaatacggcgataccgtaaaggcaggcgccggaaatgttgttgaccgcgagggctttttgttcttggcggaagcaggcgccgactttataaaggtaggtataggcggcggctctatatgcattacccgcgaaacaaagggcataggcagaggacaggccaccgcgcttatagaggtatgcaaggcaagagatgaatattttgaaaaaaccggcgtttatattccggtttgctccgacggcggcattgttcatgaccatcatatgactttggcgcttgctatgggcgccgactttatgatgctcggcagatattttgcccgctttgacgaaagcccgacaaaccgtgttaccataaacggcaattattataaggaatactggggtgaaggctcaaaccgtgcgagaaactggcagcgctacgatctcggcggcgataaaaagctctcctttgaagagggtgtcgactcctatgtgccttatgccggcagtttaaaggataatgtaagcctttcgctttcaaaggtacgctctaccatgtgcaactgcggcgcgcttactatacccgagcttcaaaagaaagcaaagctcaccttggtttcggcaaccagcattgttgagggcggcgcgcatgacgttattcagaaggacacctcatcgggtcttgtaaaataa

SEQ ID NO: 807 - DNA, 3561 bp, Unknown
  Description of Unknown: Ruminococcaceae sequence
cacggcgaggttacaaagccggagaccattaactaccgtaccttaaagcccgagcagggcggacttttctgcgagcgtattttcgggccgcagaaggactgggagtgccactgcggaaagtacaagcgcatccgctataagggcaaggtctgcgaacgctgcggcgttgaagtgacccgcgcgaaggttcgccgcgagcgcatgggttcgattgagcttgcagccccggtttcgcacatttggtatttcaagactatcccgtcaagaatgggtcttgtgctcgatatcacgccgaaggcgcttgagcaggtgctttatttctcgcagtatatagttaccgaccccggtactactccgcttgaaaaaaagcagcttttaaacgaaaagcagtaccgcgatatgcgtgaaaagtatgaaaacgactttgaagcgggcatgggcgcagaggctataaagaagctgctttgcgaaattgatcttgataagacctgcgacgagctgcgcgccgagcttgaggacgcaacgggacagaagagcatccgtcttttaaagcgtcttgaggtgcttgaagccttcaggcagtcgggcaaccgtcccgagtggatgatacttgatgttattccggtaattccgccggatctccgcccgatggttcagctggacggcggccgtttcgcaacgagcgatctgaatgatctttacaggcgtgttatcaaccgtaacaaccgcttgaagagacttcttgagctgcgcgcaccggatataatcgtccgcaacgaaaagcgtatgcttcaggaggcggttgatgcccttatcgataacggcagacgcggcaagcccgtaacaggcccgaacaaccgcgcacttaagtctctttccgatatgcttaagggtaagcagggacgcttccgtcagaatctgctcggtaagcgtgttgactattccggccgttcggttatagttgtaggacccgagcttaaaatgtaccagtgcggcgttccgaaggaaatggcgctggagcttttcaagccatttgttatgaaacgcctggttgaaaccaaggctgttacaaatattaagtccgcaagaaagatggtggagcgtgcgtccaccgaaatctgggacgcgctcgaaatggtcatcaaggagcatcccgtgctgcttaaccgtgctcctactcttcacagacttggtattcaggcatttgagccggtgctggttgagggtaaggcattaaagctgcacccgctcgtttgtacggcatacaatgccgactttgacggcgaccagatggctattcatattccgctctcggcagaggcacaggcagaggctcgtttccttatgcttgcggcaaacaacctcttaaagccgtctgacggcaagcctgttaccgttcctacgcaggatatggtactcggctcttactacctcactcttgttaagtccgacgaaaagggcgcaaacaagatattcagagataaaaacgaggctataatggcttataacgacggtattgtgggtcttcacgcgcctatcagagtgcgtatgaccaacgataagggcgagcacggccttgtttggtgcacggtcggctttataatcttcaatgagtcgattccgcaggatttaggctttgttgacagaaccgaccccaagcacgcacttgaccttgaatggacctacaccgttaaaaatcccgataccaacgttattgagagcaacgacgatattattcagaacaaggtcggcaaaaagcagctcggtaaaattatcgaccgctgcattacaatgcacggaacaagcgaatccgctattgttcttgataatatcaaggcgaccggctttaagtactccaccaagggcgctattaccgttgcggttatcgacgcggtaatcccgccggcgaaaaaggaaatacttgcaggcgccgaatctcagattgatttggtaacccgcgattacagacgcggtcttataagcaacgacgagcgtagccgccatgttatagaaatatggaacaaggcgaccgaggatgttgccgacgcgctgaagggcaaccttgacgagttcaacccgatattcatgatggcggactccggcgcgcgtggctctatgagccagataagacagcttgcgggtatgcgcggacttattgcgaacacggcaggtaaggttattgaggtacctatccgcgctaactaccgtgagggtcttaacgtacttgaatacttcatttcctcacgcggtgcgcgtaagggacttgcagataccgctttgcgtacagctgactcgggttatcttacccgccgtctggtcgatgttgcgcaggatgttatcgtccgtgaggacgactgcggtacggaagagggtcttaccgtcaccgatattaaggacggaaaccacattctggagccgcttgcagagcgccttgagggcagatatctgctccatgacgctattgatccgaataccggcgaggttatttggtcgcatgaggatatggttacgggcgagggcgccaagaaaattgttgacgccggaatcgaaagcattgagatacgctcggtactcacctgccacagccaccacggcgtgtgcaaaaagtgctacgggcgcaaccttgcaaccagcaagcctgtcaccacgggtgaggctgtcggcatagttgcggcgcagtccataggcgagccgggcacacagcttaccatgcgtaccttccatacgggcggtattgcaagcacggaggatattacacagggtcttccgcgtgttgaggagctgttcgaggcacgcagaccgaagcgctgcgcacttattgctaaaatggacggtactgttcgcattgccgaggaaaagaagagcaatgtaattataatcaccaacgatgagcttaaaaccgaggaaaaggtcaccattccttacggcatacgctgccttgttaaggacggcgacgaggttaaggcgggcgatatgctgattccgggcgctaaatatccgcaggatattttggaggcgcaggggcctgaggctgttgaggaatatatcatagccgaaattcagaacgcctaccgtacccagggtgttgatatcaacgataagcacattgaggttatagtccgtcagatgatgcgcaagctgcgcattaccgaccccggatcaaccgacctgctgcagaatgtcagctacgaatacaaggagatcgcagaagcaaacgccgccgttcaggcgcgtatcgacgcgggcgaggaggggcttacaaaagcaacctaccgcgcaacgctgctcggtattacaaaggcatctcttgctaccgaatcgttcttatcggcagcttccttccaggagaccacacgcgtgcttaccgaagccgccatcaagggcaaggttgatccgctgttcggtcttaaggaaaatgttattatcggtaagcttgttcctgcaggtacaggtatgcgctgcgccgagataaatcctccggaatatgatgaggatatgctcgatgacggcattccgacagattccgaagcgggtgatatgcccgaagcttccgctgaataa

SEQ ID NO: 808 - DNA, 1329 bp, Unknown
  Description of Unknown: Ruminococcaceae sequence
atgttaaaacaactgttattacagcttattcttatttttctcaacgcgtttttcgccgctacggaaatagcggtaatatccataaacgaaaaaaaggtgcgcgcactggcagaagagggcgataaaaaagccgcaaaaatgctcaagataattgaggagcccacgcgcttcctttccaccatccaaataggcattaccttagcgggctttttgggttcagcttttgcggcggataactttgccgagggcttttcggcaaaaataattaagaccttttcaatttccgaaaagtacacaagcaccgttaataccgtatcggtagtgcttataacaattattctttcatatttcacccttattttgggcgagcttgttcctaaaagaatcgccatgaagcacaaggaaaagcttgcaaacggcgtttgcggcattatttcttttttggcagcggcgctgagacccataatctggtttttaaccgtttccacaaacgcggtgctgcggcttataggtattgatccgagagagaaggatgaacccgtttcggaagaggacattgtgcttatgcttgacgcgggagcggacgaaggctcgcttaatgaaaacgacattgagtatatcaaaaatgttttcaagcttgatacgcttaccgcagaaaatgttatgacctctcgcaaatcgatagtttccgtctcgcttgacagcaccgataaggaaataatggaaattatcgatgaggaaggctattcgcgcataccggtctttgatgacgatatcgaccatatagtgggcatacttcacacccgcgattatttaataaagcgcacagagcctgattttgatcttaaatccatgcttcaccaacccgaatatgtgcccgaaacggtaagccttgattcgcttttcaaggatatgcagaagacccacacccatatggtgattgtggtaaacgaatacggcgagaccgcaggaattgtcacaatggaggatattttagaggaattggtgggcgaaatatgggatgagcgcgatgaggagataaccgagttttcaaaaatcggcgaaaacacctatcgcgtgctttccaccgcctcaattgaggatttcaaggaattcttctcgattgacgatgatgagcttaaaaccgactccaccacagtgaacggctggcttacggagatggcgggatctattccggaaacaggctataagcttgaatataaaaatctttgcatcaccgttaccaaggccgatgatattatgacccacgaaataaccgttgaggttaaaaacgaaagctgcgaaacggaagaggcaaaagccgaataa

SEQ ID NO: 809 - DNA, 1752 bp, Unknown
  Description of Unknown: Ruminococcaceae sequence
atgatttccgtggaaaaaaccaaaaaaggtctgttcaaacgctttatgccatatctgttggcttataagaaaacggttgcgatagatctgctctgcgcttccctcacctgcgtttgcgatttggtgctgccgcagatactccgaacaataaccgacacggcaatgaacgatatttcctcacttactgcgggtcttattttgaaaatggcgttcatatatcttattctgcggcttattgacgcggcagcgcagtattacatggcggatatggggcatgtaatgggcgtttacatagaaacccatatgcgccgtgacgcattcgctcacttactgacgctcggacacaattactattcaaacacgaaaatcgggcagataatggggcgcattacaaacgacctgtttgaggtgactgaattttctcaccattgcccggaggaatttttcatcgcgtttttaaaaataaccgtcagctttactgtactttgcacctacagtgttccgctcacgcttataattttcctgtgcgtgccgcttatggttgtagtttcggcgcatctcaataaaaaaatgcgcagtgccttcagaaaccagcgtgttcagataggtgagcttaacgcacagattgaagacagtcttctcggtgagcgtgtggtaaaggctttttccgccgaaaaagccgagcaggaaaaattcaatatcggcaacaaaaaatttgaaagcattaaaaaggctacctacaagacaatggcacttttttctgcggcaacacatcttttcgacggtcttatgtatattgtggtgattctcggcggcggactttttgtgctttacggtaaaattactccgggagcgcttgtcgcctatgtcctttatgtttccaccctcattgcgacaatacgccgtatagttgaatttgcagagcagttccagcgcggaatgaccggaatcgagcgcttcttcgagattatggactcccctgttgaaatcacggaaaagcctgatgcccgggcgcttatctgcgaccgcggtgagattgattttaaggacgtaagcttcaaatacgaggaagacagtgaagaggttttagagcacatcagcctgaaaataaatgcgggcgagcggctggcgcttgtgggcacatcgggcggcggaaaaaccacgctttgcagccttgtgccaaggtttatggatgtaagcggcggcgcggtgcttattgacggtcaggatgtcagagatgttacgctggcaagtctgcgcggagcgataggcatagtccagcaggatgtttacctgttcagcggaacggtgagtgaaaatattgcttacggcaaggaaaatgcgtccgcagaggaaatcaaagctgctgcggtgcttgcgggagcagacgaatttatatcacgcctgccggacggctacgatacatatgtcggcgagcgcggagtcaagctttcgggcggacagaagcagcgaatctcaatagcccgcgtatttttgaaaaatccccctgtgctgattttggacgaagccacaagcgcgcttgataacgaaagcgaaatacttgtgagcgaaagccttgaaaaattagcgcataaccgcaccaccctcacgattgcacatcgccttaccaccgttaaggattatgacagaatagtggttctcggagatgacggaatcgaggaaatcggcacgcatgaggagttgcttttgaaaaagggtacatattataagttgtggaataagatcagatag

SEQ ID NO: 810 - DNA, 1353 bp, Unknown
  Description of Unknown: Ruminococcaceae sequence
atggtttacataatgtcaattaattccgttgaagacatttgggcagccgtttgcgaggaatgcaaaaaaacgatttcagaggttgcttttaactgttttctcaaggatttgaagccggtatcgcttgaagccggcgagcttaccctttcaattgataacgaatatatgcgcggcgtggttgagcagaattatacggacatactcaagggtgcaataaaaaaggttatgggtattgaaatcggagtaagaattatttgcgaagacgaagaggaaaaaattcttaaagccgagcagttcagcgacgggctttcgtttgaggactttttcaccttttcaaattttgttgtaggctcaacaaaccgttttgcctacgccgcctcatattccgtagcgaccaatcccgcaaatacctacaacccgcttgttatttacggtccctcgggagtcggaaagactcatcttatgcttgccataaagaacgaaataaagaaaaactttccctataaaaaaatcgaatacataaggggagaggattttaccaatcagcttataaaggctttgcaggagggaaagctgggactcggcacgattgacgatttccgcaacaaattccgcaatgtggatgtgctgctgatcgacgatattcattttatcgccggaaaagaacagacacaggaggaatttttcaacacctttaatacccttttccaaaacaataaacagatagtggtaacccttgaccgtcctattaaagaaatcaaaacgctggatgacagaattcgttcacgctttgaaagcggacttcccgcagatattaccgcgccggattttgagacccgcgtaggtatcataaacaagaaatgtgagcaaatgggcattgagatagacgaaagtctggtttactatattgcagagcatataaaggtaaacaccagacaattggagggcacggtaaaaaagctgcacgcttatatatcaattcagaataaaaccccgaccatgggggtggtgcaggggcttataaaggatgttattaacgacacacgccccgagcctattaaaattgaaaagataatatccgaggttgcaaaaacctataatgtgtccgaaagcgatatactctccaaccgcagaacggcggcgctggcgctggcgcggcaggttgcaatgtacatagcacgcgagactacaaacctttcgtataaagcgataggagaaagcttcggtaaggatcacacaacggtacttcacaatgttaaatgcattgagaattttttaagggacaagccatatcaaaaggagcttgtggacgatattataaagaatcttaagagtgataacacggcttattaa

SEQ ID NO: 811 - DNA, 1419 bp, Unknown
  Description of Unknown: Ruminococcaceae sequence
atgaagcttaagctttttaaaaaatattttttcacaaccgcgctgattattattttcagtcttacggttatgatgatgatactttcatttgtgctcaataattacctggcgcgttcaaaatacgaaacactcggcaaatgcacggatgaggctacggattatatagccgaggcgtcctcgggcgatatgaatatgcaggagctttataaaaccctgaacgctatctcggcggtttcggatgtcgatatatttttagccaacaagaccggtgcggtagtgctttgcagctgcgaggaatgggggaaaaacggcgagtgcactcattcgcagcatttaattccggaatcggagcttgcggctgatgaaaatgaaccgttcaggcttaaaaccctggatgtatataaaaatccgcattatgtggtttcaaagcggataacaagcagcggtggaactgcggtcaccgtgttcagcgccgcgccgctttcttcaatacggctgctaatgtctaccgtgacaaagctttatttgttttcggctgccattccgcttgtaataatgttttttgcgctttatgccatgacctacaggctcacgaagccgctcaagcaaatgtccgaagcggcaagggcgatggcaaagggtgatttttcaaagcgcatacccgtaacgagcgatgacgagataggagagcttgcggtttcatttaatcaaatgaccaattcactggtgcagcttgagggaatgcgtaaaagctttgtcgccaatgtatcgcatgagcttaaaactccgatgactacgataggcggctttatagacggcattttggacggcaccatagagccggacaagcaaaagtattatctccagatagtgtccgacgaggtgaaaaggctttcgcgccttgttcaatcaatgctcagcatggcgaagcttgaatcgggcgagtttgttttaaagccggagcttttcgatttcagggagctgttatgcaccatagtcgtaagccaggaacagcgaattgaagctgcgaagcttaatataaccgggcttgatgagattcagagtatctctgtaaacgccgataaggatttaatccatcaggtaatatataatttggtagataatgccgttaaattcacaaacgaatcgggtacaatagattttaaggcgaaggcagacggcaaaaagctcacatttacgataacaaatacggggaagggaatccccgaaagtgagctgccgtatgtttttgagcgcttctataaggttgataaatcccgctccgcgaataaaaacagcacgggtctcgggctttatatcgtaaaaacaatagtcaaggcgcacggtgggagcatagccgcgtcgagccgtgaaaatcagtttactgcattcagcgttgtgctgccgctcaataattaa

SEQ ID NO: 812 - DNA, 1551 bp, Unknown
  Description of Unknown: Ruminococcaceae sequence
atgcatccgatcttatatgtcgtttttgcggcagctgccgtcctgctcggcgttataggcttttttgcaggctcggtctaccgccgcaaatcggctgaaaatgccatcggctctgccgaagacgaggcaaagcgtattttaagcgacgctatgaaaaccgccgaatcaagaaaaaaagaagctcttgttgaggcgaaggacgaaattcatcaaatgcgccaggaagcggagaaggacatccgtgagcgcagaagcgaggttcagcgtcaggagcacagacttcagcagaaggaagaaacgcttgacaggaaaaccgataacattgaagcaaaggaggaaaaattaagcgcgcgtgccaaggagattgacgcgagaatcgccgaatgcgataagataaagcagagccaaatggagatcctcgaaaaaatttccggctttacgaaggaacaggcaaaggctcatcttttagagctgcttgacggagaactcaaccacgaaaaggcggttaagattcttgattatgagcagcggcttaaagacgacgcggacagaattgccaaaaatgttataggccatgcaattcagcgctgcgcggctgaccattcctcggaaatgaccgtttcggtagtatcgctgccgaatgatgaaattaagggcagaatcataggccgcgagggccgcaacatccgtgctctcgaagcggctacgggcgttgatcttataatcgatgacacacccgaggccataaccctttcaagctttgatccgatccgccgcgaaattgcgcgtgtgacgcttgaaaagctgattcttgacggccgtattcatccgggcagaattgaggataccgttgcgaaagcaacagccgaggttgaagcgaccataaagcaggagggtgagcgcgccatgatagacgcgggcatccacaacctgcaccccgagcttgtaagattactcggaaagctcaaataccgcacaagctacgggcagaatgtgcttaaccattcgcttgaggtatgccatctttcggggcttttggcgtcggagctgggggcggatgttacccttgcaaagcgcgcgggtcttctgcacgatataggcaaggcgcttgaccacgagcaggagggcactcatattcagctcggcgttgaggcggcgaaaaaataccgcgagagcgaagaggtcattcatgcgattcaggcgcaccacggtgatgttgaggcgaagaccgttattgcctgcatagttcaggcggcggacgctatttcggctgcgagaccgggcgcaaggcgcgagaatatagagaattatatcaagcgtcttgaaaagttggaggaaatcgccaattcctttaacggcgtcgaaggctcttatgccattcaggcaggccgcgagattcgcattatcgttaagcccgaggctgtaagcgacgatgaaatggtgcttatggcgcatgatatttcggcacgcattgaaaatgagcttgaatatccgggtcagataaaggtaaatgttataagagaaagccgcgcggttgattacgctaagtaa

SEQ ID NO: 813 - DNA, 1617 bp, Unknown
  Description of Unknown: Ruminococcaceae sequence
atgaaaagaatattgacggtattattaacggcagtattgattttttcgctttccgcctgcggaaaggataagggcagcaccgataatagcaagggcggaacgagcaataccgatgtgacctcatcggagataatatcgaccggcagctcatcgaccgatacctcctccgccgatagcacagcctccgtttcatcggggagcggcaaaacggtaagctatgtcacctccgaaataaccgtgaagaagccgaacccgaatattcccgcgaatacagaccgctcatggcatgaaaacccggcggggctttgcttcccggttacgggtacgcttgataacgaggcggatgaaatgcgctcgaaaatactttcttcaaacggcagcggcgttaagatcaccggaactacctactatgtttcggaaaagggcgatgattcaaacgacggtaaaagcccgaagaccgcgtgggctacccctgcgggagcagaggtacacaacgcctcccttaaaagcggcgacgcggtgctgtttgagcgcggcggagttttcaggggaagcatgaagcttgcaagcggcgtatattacggcgcctacggcacgggcgacagaccctgcatttacggctctgcacgcaattttgccgacgctgtcttcacaagcgacggcaagaacgtttggagactcagggaaatgttcgcaggcgatgtgggaataatcgtattcaaccacggcgaggcagtgggcaaccgtgtttcctcaagggcggagcttaaaagcaattacgactttttctgcgacacaagcgataaaaaccgcgtttacctctattttgaggaggatccgtccaaggtgttcataagcatcgaaatcggtgcggacagcgttctcttccgctttgacgggcagaaaaacataactatcgaaaatctgaccttcaaatataccggcggtcatgcggtgcgcggctcaaacaccgagaacataaccgtgaggaactgcgaaataggctatgtcggcggctcgtatcttgacggctacggcgacggaaaggttcgctacggaaacggaatcgagcttatgagcaacagcaaaaacacactgctcgaaaacaactggatctatcagatatacgacagcggaataacccatcagggcgacaactgcgttgttgaaaacttcacggcaaaaaacaatcttatagaattctgcggcatgggcgctattgagtattggcacacaaagggcgcggttatcaaaagcgtgctttatgaaggcaatatgctgcgttttgcgggctacggcttcggcggacttcagcgacccgataagaacatgagcgccgcaatacagagcaacgcaaagccgacaggctcgaactataattacgccgaaagctttattataaggaataatattttcgagctcagcacatatcagcttgtaaacgcggcgtccgctgcgggcactccgcccacattggacggcaacacatatatacaggtggacggcagatggctcggctattacggcaagaacaccaatatacgctttaacaaaagctcggagcttataattaaaaatacctggaacgacgcttcggcaaagcttgcttttgcatga

SEQ ID NO: 814 - DNA, 993 bp, Unknown
  Description of Unknown: Ruminococcaceae sequence
attaagctgttaaaaccgattataaggagtttttatatgtatccgcttttattaaagccgcccgtcaaggattatctgtggggcggcacaaagcttaagactgactatcactttgaaaccgataaggctgttgccgccgaggcttgggtgctttcctgccataaggacggcgcctgcactgttgaaaacggcgagcttgcaggcaagacgttgcccgaggcattggagctttggggagcttcctccctcggcaaaaacgcggcggcgtttccgtattttccgctgcttataaagcttatcgacgcgagggacaggctttctgtccaggtgcatccggatgatgaatatgcccttaaaaatgagggtgaattcggcaagacagaaatgtggtatgtggttgactgcgaggagggcgcacagctgatatacggctttaacaaagaggtttcgcgtgaggaattcgagcgcagaataagggataatactctgccggaaatctgcaatttcgttcccgttcacaagggggatgtgttctttatctccgccggtacgctgcacgcgataggtgcgggaatactcatagccgaggttcagcagaattcaaacaccacctaccgtgtttcggattacggaagactcggtgcggacggcaagccacgccggcttcatatagaaaaggcgcttgatgttacccggcgcacaaagcccacgcttccgttcggcagtgtggggcagattgaaaaaaccgatttcggttctgtgaggcagcttgcctcctgcaggcttttcaccaccgagcttataaagcttgacggcagccttaagctaaaggaggacggcagctttatgtccctgcttgtgcttgacggcgaaataggcgtggaatgggacggcggcgacctgcttgccgcaaagggcggaagcgtatttgtaccggcggggcagagcgtgaccgttaagggaaacgccgatgtgcttttaagccgtgtttga

SEQ ID NO: 815 - DNA, 1539 bp, Unknown
  Description of Unknown: Ruminococcaceae sequence
atgtttcgcgggtataattataataggaacggacaaaaggagggcgtatttttggaacgcagttatatcgcaatagatttaaaaagctattatgcgtcggttgaatgcgccgcactttgccttgatccgctgacaacaaatctggttgtggcggattccgaaagaaccgaaaaaacaatatgtcttgcggtgactcccgcgcttaaagcatacggaataggcggcagagcaagacttttcgaggtcgtgcagagggtgaacgagataaacgccgacaggcgccgaaaagcgccgggcggaaaattcaccggatcttcaagcgataaaaaggagcttgaggctcacccggaactggagcttgaattcataaccgcaaagccgagaatggcgctttataaaaaaataagcgttgaaatttacaatatatatcttaaatatatcgcacccgaggatatttacccctacagcgtggacgaggtttttatagacgcaacgcattatcttgacacctataaaatgtcggcgcgggagtttgcaggcgcaatgattgcggatgtgctgaaggaaaccggcataaccgcaactgcgggaataggcacaaatatgtatctttgcaaaattgcgatggatattatggcaaagcacatagagcccgataaaaacggagttcgcatagcggagcttgacgaaatgagttaccgccgtttgctgtggcggcaccgtccgcttaccgacttttggcgggtagggcaggggtatgccaagaaattggaggcaaatgcgctttacacaatgggggatattgcacgctgttctcttgaaaatgaggaaatgctgtacaggcttttcggtgtaaatgccgagctgctgatagaccatgcatggggctatgagccctgtacaatagcggagatcaaggcatataagccggaaaacagcagcacaagctcagggcaggttctgcagtcgccgtatccttatgaaaaagcgcttattgttataaaggaaatggcggaattatcgaccctcgatctggtagaaaaggggcttgtcaccgaccaactggtgcttgatatcgtttatgatgttgaaaatcttaaatacggcggaaaatacggcggcgaaattgtatccgacagatacggaagacttgctccgaagcccgcgcacggaacggcgaacttggggagatattcctcctctacacgggaaataacggataaaaccgtggagctttttgaaagaatcgccgataaggggctttcggtgcggaaactgaatcttacctgcaatcacctgataagcgagtcggaggttcgcgtgcggcacgagcagttaagcctgtttgacgattacgaggcggcagaaagggatcgagcaaggtacgcgtctgagcttgaaagggaaaagaaaatgcagaaggcggtgcttaaaatcaagggcaaatacggcaagaatgccgttataaagggtcttgatctgcaggagggtgcaacaacgcttgaaagaaacggtcagataggaggacatagggcgtag

SEQ ID NO: 816 - DNA, 1404 bp, Unknown
  Description of Unknown: Ruminococcaceae sequence
atgatattttacgggggatatatgacggatataaaggcaactaacagggatttatatgttccggccgcagagataatcaactcaagaaaaattcccgaggcgacaaataagcaggtggattcggaaaccgagaaactgcgaaacgaaataggcgcgcttccggacacggtgaagaatacgggagaatgccgttatatatcggtatcgggcagccgtgacaatgacggaaaaacacccgaaaccgcttgggattcgcttgaaacgcttgaaagaaaccgtggggagcttaaggcgggtactgccgttcttttccgcagaggagatattttcaggggctgcataacagcagcggacggagtaaactacggcgcttacggcagcggcgaaaagccgaggatatacggctctgcaagggattatataaacgacagctggtacaggctccctgacggtctgtggacggtggacgcggatttccccgcggatgtgggcaacataatcttcgataagggcagggcggtcggcataaaaaaaacaaaccgtgccgatatctctgaggaattcgatttttggagcgaccacaaaaacggcaaccgcatagtaatcaggctgaaggacgatcccgtacttaccttcaaaagcatcgagatagcgcataatctgtggcttttcagaatggactcagtcaaaaatgcgctgattgaaaatctgaccttctgcttttgcggcggtcacggaataagggcgacggaagtgcgcgatgttcgcataacgggctgcgagttcttctttataggcggctgcttccttacggaatacaaaaacggcgatgtgcgctacggaaacgcgatcgagtttatgcgcgggtgcaaaaattccgttgtgaaaaattgcattgcctaccagatatacgacagcggaataactcaccagggctacggcgattactgcgcggaggatatggagtttaccggaaatatattggaatactgcggtatgggctctgtggaatactggctcggtcaggattcaaaatgcgtaaatatcacctacagcggcaatataatgcgcttcgcgggctacggcttcggcgggcttcagcgccccgataaaaatatgaccgcacacatccaaagcaacggcgcgtgccttaattttgctgagaatttcgttattgaaaataatattttcgagctcagcacatacgaccttataaacgcgcagagcaggatgaacaccctgccggtgcttcggggcaatacatacattcaaaacgaaaacaggcggctcggctcttattcgggttatcttgactgtatgtttgacagtgcggtgggcggaaccgtaaaaaagctttggcacgatgagggagcaaaaataaattcacccgcttcatactcttaa

SEQ ID NO: 817 - DNA, 2223 bp, Unknown
  Description of Unknown: Ruminococcaceae sequence
atgtttgtaaatatgtctttcggtaaagcaggaaatgctatcctactttttttcagccgtactctcccacgcttttttacggagaattttgaaataacaagcacaaagaaatcaaaaataatcggcacggtcatatgcgccgtgacccttatagccgtaatactcgatgtcaacgcctacacctcgcaggaatttgcctcaaaatgggtgctgctcgcgtttgcgcttatgtgtccgtttattctcggaatcgccgcggcatattctgttgtaatcaaaaccgaccgattaaataagataatgcattttacggggctttttctcatgccgttcgtgaccatcacgatgaccgagtgccttaataatgtgtttatttacaatatgacctatttgggcttcttcgggaattacatgcttgtgataataatgtatttcctggtcttcgccgtttcgggcagcttcaggctttcgtatcttataatcaacccgatacttttcggcttcggcgttgcgcacagctatattatggatttccgcggtacgccctttatacctatggactttttgggaataaagaccggtataggtgttgcgaacacatataattatactcccacatataaagtaatgaccgccgcacttatatttatttttattataatcataggcgcaaaaacgaaaactcccaaatataatattcttacaagggtaatatcgcgcacatttgcgggcaccttttcctcggttattcttattcttttctattttacaagcatttttgccgatatgggcattaagccggatttctggaatcagtcgaggggctaccataattacggctttgcctttaatttcttctgcaatacgaaatatctttatatgtcgcagccgagcgattacgaccccaagcagataaagaattatgtgagcagcgtcataagcgataccggcgataaaaagaatgaggaggacaattatacaaagcccaacatcatttgcataatgaacgaatcactttcggatctgaaggtactcggaagccttgaaaccaacgaggattatatgccgtttatgcgcagtcttaccgaaaatacaattaagggcaacctttatgttccggtaataggcgcgggcacctcaaataccgaattcgagtttttgaccgggcacacgaccgcatttttgccgtcgggcagcaacgcgtatatgctttacatcaaaaatccgatagcctcgcttgtttccacccttaaaggacagggctattccgccgcggcgcttcatccgtattatgccgagggctggaacagaaccaaggtctacaattatttgggctttaataaatttacaagccttgaaaatattattgatatttcacttatgcgcgaataccaggcaaacggcagtgacccgaattacctgcaatccttaatagaacagaattatccgggcgaaaatatgctgatacgccagtatataagcgattcatatgactataagcttttaataagggactatgaacagcgggataagtccgttccgtttttctgctttaatgttacaatgcagaaccacggcggatacaccacaagctgcgtaaactttgacgaaagcatttacgccacctcggtttcaaagccgtataccaaagcgaataaatatctgtcccttgtaaaggcgagcgataacgcctttaaggagctgatagaatactttaaaaatgttgacgagcctacggtcatctgtatgttcggcgatcaccagccctctgttgaatcggattttatagccgaggtcataggtacgagcggtttgtcggggcttaaccctgcacaggagcagagccgccatgtaacgccgtttataatatgggcgaattacgatatcggctcgcagaccattgataaattaagctcgaactatttgtcatccttggtgcttaagacagccggagttaagcttacggaatataacaagtatcttttgaagctttcggagacactgccggtcattgatacggtgggatatatcgacagcgaaaacaactactacaaatggagcgatgtatctccctacagtcatctgctcgctgaatacgagaagatacagtacaataatattttcgatcaggccaacgccgattccgacatattctatattaacggatatgtgcctaaggctgccgaagaagaagcgtcaagtgagaacggggaggaaaattaa

SEQ ID NO: 818 - DNA, 1350 bp, Unknown
  Description of Unknown: Ruminococcaceae sequence
atgtcggatccggcagagaacagaaaaatatggttgaaggcggcagaggaaaaccgcgcgctgcttgacggcagagttaaaaatgatatagagaaataccgaaagcgcccgtgtaagctccgcttcatcggcgcggatgggaagcctttaaaaaatatcaaagtgagaattaatcagacatcacatgatttcggcttcggcgcaaacatttttatgctcgatgaatttgacaacgaagagtataaccgaagataccgcggggaatttaaaaaatactttaaccttgcaaccgttccgttttattgggacggtcttgagccggaagagggtaagccgcgttatgataaaaacagcccgaaggtgtggcgcagaccctcgccagagctttgcacggaatactgtgaggaaaacggcataatgccgaagctgcactgcctggtttacgataaattcatccctgagtggctgccgcgcggtgatatgtgcgggatggaaaggctttatgaggagcgcttcaggcagatttccgagcgctttgccggaaggctgcttgaatttgaggttatcaatgagctgctatgcgagcaaggatggagctataaaagcgcaatcagcagtaagcgtgatataatagaatgggcgtttgctttggcgagaaaatatttcccgaatgatacacttattataaatgaagggaatccgctggttgatttaagtcgggcaaaataccgcagcagcttttttatgatggtggaaaatgcgcttaaaagcggtgcgggaattgacaagctcggcttacagcaccatattttcaccggtgcaacctgtaaaaccgaggaagcctatgaaaatgccgtaaggtgcggcgatcctatggttgatcccgcgaaaatacttaagggacttgatgttattgcagagctcggtctgccgcttgaaatgaccgaggttaccttgccgaccttcggcgagaccgaggaggatgaggagctgcaggcggatctgattgaattgctttacagcgtatggttcagccaccccgctatgcaggatatagtttactggaacgttcccgacggttatgcctatgacgacggctcgggcgactggaacgagaacaaatgccgcggcggtctttggcatcatgatctgacacctaaaaagtctgctttaaggcttcatacgcttataaacgaggtatggcataccgatttagaggctgttaccgatgaaagcggctatatcgaattccgcggattttacggaggttataccgcttcgggcaatgatttcaccgccgaattcggtatacacaaggacggctctgcggtaaacgaaataatactttga

SEQ ID NO: 819 - DNA, 2694 bp, Unknown
  Description of Unknown: Ruminococcaceae sequence
aaggacgggaaaacagtaggaacggtaaaattcaccgaggttttatccgccgaaatgaagaccctaacctacacgaagtcatctgccgaggaggacagctcggtttggaatataggcgcgggcaagtatcttaattactataacggctctgccgataagcttataattcccgagggcgttgaagaggtaaacagcaagaccctcggcgagtggtacaagggtgataaaacaaaggttaaaataatcgtttatccgtcaacaatgaaaaaaataatgccgtggacgatgaacggctttacgaatcttatggcggtttacatacccgacggctgcaccgaaataggcgagcgcgccttcagcggctgcacctcgctcaggtatgtccgtctttcggaaaaattcaccgccattcccaaatactgctttgccggcacacaggcgctcacaatgctttatctgcccgcggcggtcaaaagtgttgccgaccgcgcgttttatggcagtgccgcaagggatcttatcatcacggcggatgattttgcgggcgacggctacgatacccataaaaaatatgttacttcacttaatgaaagcataaacgagcaggttaaagaggatgtccgcgaggatcttattgccgatgtgggcacaaatctttcaaacagaagctttttctacctcggcaaaaacccgacggtcaaatcaagctggctctggtattcctgcgatatggataacggcccggattatctttggtatacatatatatacgctttaaagggcaacagcatcgagaaatttataaagacccagacctcgaacagtcttgaggatgaatataccgcgctggataacgaaacggccgagcttttaaagacgcagcatgataaatacatgctgaacggcagatatccgaaggaaataaacaccgaggtcgttcaggcacttataaaggactatccgttcacaaataacggcagcgcggcggagttttctctttatcttgaaaagaagcttgccgatacaggatataaggctgccgtgagcaactggtataagctgagggctgttcccggctgtgaggacaccgacgggataatgtttgagggctataacggctatgttaccgcggatataaggcttacctctgcggttgatacaaaggatatttctatatacggcgtaatcaagcccgaaatttacagctacagctttgagactgtggcaaaggcggataccttctatcccgaaaccgtggacggcacggacggactgcgcggagataccggcgcagagggagagttcttcctgctttcctccgacggcacggtgctgctcgattattacggcactgcggaaaagattataatccccgagggcgtcgagtatctcgatcagtcatggtggctcgataccgaccttacaaaggttcgctgcataattcttcccgattccttaaaggttctgcccgaccagttcggcgttccgttcagcagcaatatagaagtaattatcatgggtgataatgtcgtgaaggcggagggcaagcattcgttctggaagtgctataagctcaaaaatctgcggctttcggaaaatcttgaaaatcttaacgaggaagcgctttttgaaaccctgctgcttaccgatctgcatcttccgaacgctttgaagactatagataagggcagcttccatttgtccgctttgcgcgatatagttatacccgcgggcgttgaaagcattgcaaacgaggcgtttgcgtggccgcttaagacccttaaatatcttgttgagggcgtcagaacgcagggcaacgccatttcacaggagctttgcgatgagcttgacccgattcttcaaaagaaaatagcaacaagccccggcgtttatattccgcgaacgattaccgtattaagcaaaaatgcggaatatgccgaaaggcatgatttctggaattcagacctcagctggatacaggtaaaggttaattacctgcccggctcgtcaaccgaaaagcttataaacagcggctacgcttcggatgcaaataaatactcgtattcaacacttggactctccgaaaacgagctgaaggtcaatatgatgctttattccgaaagagttccggtttattcggatataaaggcggaggatatagagaaatatttctcttctgcgctttccgatgagtttgtaagcaaggttgaggtaacggagctttcggttaccgatccgtcaaaggacggcgcgggctcgcttaccgcaagggtgaccgcaattatgaagagcggcgaaagggtcggcgttgatatttcaaggataataccgcttattgagaattataagaccgatatgaaccgcggcggttggacaggtaaggaatataaatacgataataaattcgtgccgagcataacccgctatgaggatgaaacggttaccgaatatgttgatgttccgattgaggtgccgaacgaaagccgcggcgaggaaatcaaaaacaccgacggcggcgacggagaagaggagaccgttacaataacaaaggttattaaaaagaaaaagaagaagcctgcggcggctcaaacaaacatcgtgctgccgatagtgctttcggttgcgggctttgttctcgtgtgcggcgcggttgtgctgttctgccttataaagcggcgcaaaaagcgcgcttaa

SEQ ID NO: 820 - DNA, 2589 bp, Unknown
  Description of Unknown: Ruminococcaceae sequence
atgtataaaaaaataacagctttgattttgtgctttgcgctttcgggcattttattaacgggcgcgtttgaaaccggcgccgccgcagatgtttgcgccgtttacctttcgagcgacggcgatgattccaacagcggtatcacagccgataaaccgcttaaaactctgaaagcggcggtaaatacggtaaatcggctggagcttgtcggctataacagagtaataaatattataaaatgcggctggaacggaatttcctttgatatgtcgggctgcacgccgtataccgaaatgattaccctgacggcgccttccgggcttacggtatggtcgacctcggatatgtatctggcgggtcctttgacgctcgatgcggattacggaaattcccgcactcagagtgcacttaatatttataccggcggttaccccttcactctgctttcaaaggatcaaaagggaaattcaaacatatatgcgggctttaacagccgcttggggctgacagccgatgaggaaagcggaaatatagagtggaaaagcgatttaaaaataacgcttgcgggtgagcgcgaaatgacggtcggcaaggttattgcgggaaactgcagcgatcccggtcacaatgtgatatacggtaccgccgatattctcattgataaccccaacctcaccgtttcctcattaaagctcggcagcaacggaaacttcacaaacaccggcacgcagtctaaccgctttaagagtataagcataaccgtaaacagcgttaaggaaatagcaacccttgagggtgctacatattataatgcggtatataccgaagaactgcggctgatattcaacaacggcacggcggacagggtaacagatacgcttatttacggcaaatacggaaacaccaatatacagacagctaaaaaatggattgtcaaaaacgggacggatacgccgatcaaagcgggatccgagtcgggagtatttacggttgtcggcggcagcgccgtgatcttcacggatgatgaaaatccgaagcttacatatacatccgaaaaaggcaatataactgtccctgcgggcagctacaccgtaacggtatcagacacggaggaatatacattttccgaaggtgtttttaccgccgtcaccgatttaaaggactttaatcttacagatattgcccccgcacagtcgggcgggaagatattgctcggctttaaagatgaaaacggcggatatttaaaccgtaccgcaaatttaaaaatcaaagccggtgaaaggctttacgccgtatatacagatttccaggtaagcggcgaaaacgcggtattttcggtatcgggctttgaaaggcgcggcggcgaaaagctcggaatacggtttattcttgaaaaaagaaacggctttgaagcggcgacagccccgctttcaggcatgaaatacggctttgcggcaatgcccgagcattttctgaatatcggagaggcgctcacggtcgataacgaaaacgcggctgtaaggactgtcggcggccccggcttcgtcttttttgacggcagggaaaaattcaccgcctgcattaccggtattcccgaaaagcactatgcggagggctttgcggtacgcggctttgttacctataccgatcttaacggcaacagccgcaccgtttataccgaagtatcttgcgcctcattaatggaggcgaccgccgattcggcactgaacggcggtcttaccgattcggaaaaagcggagactgcaaggcttgcggacaattccctctcgcttaaaagggcgtctcttgagagcagtatttcaaattgtccggacatcgtaaggaattcggtttcgggtaatatttattatgtttccgaaagcggcagcgactcaaacgacggtctttcagaattaaagccgctcaagactctatatggggtaagcggtctttccttaaatgcgggagacgcggttttgtttgagcgaggcggcgtataccgcacctcaaaaaaatataccgacggctcttcctttatacttaaaagcggcgtttcatacggtgcatacggcaaggggcaaaagcctgttataaacggctcgtttgaaaattacgccgaaagaaagtggagaaaatacgccgataacatttggcacataagcatttcaaatatctcggcagatcccggtgttttgcgtgtgacgaccaccaaaaattattcgtacacgggctgtgtcaaggaaagcattgacgcgcttgcccgcgaatgggatttctgcagagacggcacaaatttatatatgtactgccagtacggcgagccgacaaatcttttaaacgcgattgagataggcttcggctttgatatgtttaaaatagataacgcaagcaatataacgattgaaaatttgaccttcacctgcggcggcagacacgcagtgggcgcttcaaacggcgctgcgagcgttacggtaaggggctgcgaattcagctatatcggcggcagcctgatgagcggctcagacggtacacgtctcggtaacgcggtggagtttttgggcagcagctcggatatacttgttgaaaaatgc

SEQ ID NO: 821 - DNA, 1290 bp, Unknown
  Description of Unknown: Ruminococcaceae sequence
atgaagaaacttacagctatgcttctctgcctcgcaatgctttttgcttttgcaggctgcggcagcaaggacacgggctcgggctcaaacgcaggtaccgccaagaagggcgtcacagaggatgtgcttccgcgtcttgacattaaatccgatgttaccgtaccggatgatttcaagatcggtatgatttgccttcacgacgaaaactcaacctatgacaacaacttcatccaggctcttaagtctgttcagaagggtatgggtcttaaggacgagcaggttgttatcgttaccggcatcggcgaagacagcaaatgctacgacgccgctgttgaccttgccaagaacaagggctgcaaggttatattcgcagattccttcggtcatgagtccttcatgaagcaggctgccaaggaattcccgaatgttcagttctgccacgctaccggcacatccggcaaaattgcgggcatcgctaacttccacaatgcttttgcttccatttacgagggcagatatcttgcgggtattgctgcgggaatgaagctgaacgaaatgatcaaagccggcaagattaaggctgaagaggctgttatcggctatgtaggcgcttacacctatgctgaggttatctcgggcatgacctcctttttcctcggcgcacgctcagtttgcgaatcggctacaatgaaggttcgctacaccggctcctggtacgatcagggtaaggagcaggaggctgctaccgctcttatcgaaaaagacaagtgcgtgcttataagccagcatgccgactccctcggcgctcccaccgcttgcgagcttgcgggcgttccgaatgtttcctacaacggcagcacctactctgcaggcaaaaacacctttatagtttcatccgccattaactgggctccctacttccagtacatcattgagtgcgctgttaagggacaggctatcgattccgactggtgcggcgatatagctaccaactcggttgttataagcggactcaatcagggcgttgccgcagagggcaccgaagcaaagcttaaagaagctatcgacgccttcaaggcgggaactcttaaggtattcgctaccgataagttcaccgttgacggcaagaagctcgatcagtatatggctgatatcgacggcgacttcaagggcgatactaatgtaattcatgacggctacttcgatgagtccaacgcaaagagcttccgttccgcgccttattttgatattatcatcgacggagttacaaaccttaataaagaggtttaa

SEQ ID NO: 822 - DNA, 1305 bp, Unknown
  Description of Unknown: Ruminococcaceae sequence
atgctggacattaaatttatttgcgaaaatccggaaattgttaaagaaaacatcaaaaagaaatttgaagataaaaagctgccgcttgtagacgaggtcatctcgctttacggcgaaaaatgcgccgcaaacaaccgcgcgaacgatctgcgtgcaaaccgcaacaaggtgagcaagcagataggtatgcttatggcgcagggaaagcgtgatgaagccgaggaaatgaaacgccttgtaaacgagcaggcagaggagctgaaagcccttgaagaaaaagaggcggagcttcagaaaagggtcaccgaaattcaaatgaagattccgaacattgtagattcaagcgttcccgtcggcaaggacgacagcgaaaatgttgaggtacagcagttcggagagcaatctcaccccgattttgaaattccctaccataccgacattatgcagcttttcgacggaattgataaggatgccgccggcagggttgcgggcgagggcttttattaccttatgggcgatattgcacgcctgcattccgcagttcttgcctatgcgcgcgattttatgattgacaagggcttcacctactgcattccgccttacatgatcagaagtaaggttgtaaccggcgttatgagctttgaggaaatggacgccatgatgtataagattgagggtgaggatctctacctcataggcacatcggagcattccatgataggtaagtttatcgacagcatcacccccgaggaaaagctgcccctcaccttgaccagctactctccctgcttccgtaaggaaaagggcgctcacggaatagaggaacgcggcatttaccgcattcaccagtttgaaaaacaggaaatgatagttatctgcaggcccgaggaaagcatggaatggttcaacaaaatgtggagctactcggtagagctgttccgcagcatggatataccggtaagaacgcttgaatgctgcacgggcgatttggctgatttgaaggttaagtcctacgatgttgaggcatggtcgccgaagcagcagaaatatttcgaggtctgctcctgctctaacctcggtgacgcacaggcaagaagactcggcataagagtaaagggcacggacggtaaaaaataccttgcccacacccttaacaataccgttgttgctcctccgcgtatgctgattgcctttcttgaaaacaatctccgctttgacggcgagcattacagcgttctcatccccgaagcgttaagaccctacacgggcggtaaaaccgtgcttacaagcgataaaaagatttaa

SEQ ID NO: 823 - DNA, 1131 bp, Unknown
  Description of Unknown: Ruminococcaceae sequence
atggcaagtatcaatttcaaacacacccccttcggggatctggctctgataagcatgcgcggctgtgaggatattgcgtcgcaggtggattattaccttaagcaatggcgcagcattcccgatgatgaatcctttgtggttccggcaaactgcccgcgtttcggaacgggcgaggcaaaggcggttttaaagcacaccgccagaggacttgacgcatacatcatctgcgactgctttaattacagcgtaacctataaaatgtacggtcagaccgtccccatgagccccgatgaccattaccaggatctgaagcgcataatagcggcgctcggcggcaaggcgagaagaataaccgttataatgccgatgctttatgaaggcagacagcacagaagaaccacccgcgaatccatggactgcgcaatggcgctgcaggagcttgtggcaatgggcgttaagaacatcgttacctttgacgctcacgatccccgcgttaacaatgcgattccgcttgacggctttgacaatgttcaggcagcttaccaaatgataaaggctcttttaaaaaccgttcccgatatcaagcttaaccgcgaccatacaatgatagtttccccggatgaaggcggaatgggtcgctgcatttattactcctccgttttagggcttgacctcggtatgttctacaagcgccgcaactattccgttgtggtaaacggcagaaacccgattgaagcgcatgagttcctcggaaatgatataaccgggaaagaccttattttggttgacgatatgatttcctcaggcgaatcgatgctcgatatagccgcaaagcttaaggaaaagggagcgggcagaatattcatcttctccaccttcggtctttttgttgagggctttgaaaagttcgatcaatactatgccgacggtaaaatagataaaatattcaccaccaatcttatataccagccacaggagctgcttgaccgtgagtggtactgcagcgttaatatgtcgaagtacatcgcgctgctcgttgagacactcaattacgataattctatcagcagccttttggatcctgttgaccgcattaagaaaatcgttgcaaaatacggtcaggataaataa

SEQ ID NO: 824 - DNA, 981 bp, Unknown
  Description of Unknown: Ruminococcaceae sequence
atgttaactgtcattaactttatccagcgtgctgttttgcagggcacacctttgctttacggggctaccggcgaaatcctgacagagaaatccggcaaccttaacctcggtatacccggcattatgtatatcggcgcaatatcgggcgttgtcggcggctttatgtaccaaacctcgaccgatgaggtagtgcctataatagcggttttaattccgtttttgtgctgccttttgggctcgctgctcgtgtcgctcctttattgcttcctgaccgtaacactcagagcaaatcaaaatgttacgggtcttgcaattaccaccttcggcgtgggctgcggtaacttcttcggcggctcgcttattaagatcgttaaaagcgatgttccgtatcttgctttggtcgatatcgcgcgggcatttaaaaccaccctgccgtttgcggaaagcatgggggatataggcaagctcttcttctcctacggctttatggtgtaccttgcaattatcattgcgattatttccgcggtattccttaaaagaacaaagcacgggcttaaccttcgcgcggtgggtgaaaatcccgccacagcggacgccgcaggcattaatgttacgcgatataagtatttcgctacctgcataggcggcatgatagcggggctcggcgggcttttctatgtaatggattactgcaacggcatttggtcgaacaacggcttcggcgaccgcggctggcttgcaatagcaatagttatctttgctacctggaagccctcgcttgccatactcggctcttatctgttcggtgcgctttatattctattcaactatataaatgtgcccatgcagatgattccgctgattcagatgcttccttatgtggttaccataatcgtacttatagtggtgagtatccgtaagcgccgcgaaaatcagccacctgcgcatttgggactttcatatttccgtgaggagagatag

SEQ ID NO: 825 - DNA, 966 bp, Unknown
  Description of Unknown: Ruminococcaceae sequence
atgcggactaattatacaatatccctttctgaaattatttcggagttttctcttgagacccttaatatgccgtccgatcccgaaaaaattcagataaccacaaccgaggtcaaccgacccggacttcacatggcgggctattttgaatttttcgatgagaaacggatacagataataggcaagagcgaggaaagctttttactgcggtttacgaccgaaaaagccgaaaagcggctcagagaatttttttcccataagccgtcggcggtggttatatgccgcaatatgcaggtagatgaggtgtatgccaaaatcgctgctgaatacggagtgccgcttttgcgcaccgccgaaacgacctccgatttcacatcggccttaatagcgtttttgaacctgagccttgcgccgcgcgttacgcgccacggcgttttggtggaggtttacggtgagggaatactgctgctgggtgaaagcggagtgggtaaaagcgaaaccgcaatcgagcttataaagcgcggtcaccgccttatagcggacgacgcggtggaaatcagacgtgtatcgaacaaatcgcttgtcggcacggcgcccgataatataaggcattttatagagctgcgcggaataggtattattaacgcgagccgtattttcggcgcgggcgcagttaagcttaccgagaagatagaccttataataaacctggaaatatgggatgtaaacaaggtctacgaccgaatggggcttgataatcagacgacggaaattttggggcttgaaataccgtcgctcaccattccggtaaagccggggcgcaatctggcggttataattgaggttgccgcaatgaacagcagacagaaaaaactcggctacaacgcggcgaaggatcttctcaaacgcctcggtatgaccgatgagccggaggatacaaatacaaacgaaacggttaacccgttctga

SEQ ID NO: 826 - DNA, 2346 bp, Unknown
  Description of Unknown: Firmicutes sequence
ccggggctccaggtgtcttatctcctgcaaggccggaagctcaaggaaagcttggttttcgatcggctgccggatcaggagtccttctcatttgctatcgacagcggagagctgaccggcattctgctggaaaacggggcggtggagttccgggatggggagacgtgcgtcttcaccgtccagcctccctatatgtgggatgcggcggaaggcgcgagcgacgccattgaagtgcgcctggccccgaatccggaaggcggctatacgtatacactgatccccgaccgtgcttggctgcaggcggaggaccgggtttatccggtgacgttggacccgtcggttctggtgggaagcaccgatacgattgacgacaccaccctggtgtatgggcccaccatcacgcagccggtcctcaatcagaaatatctgtatgtcggcaacgtgcatggcaccaagctgtcggtggccgtgcgcgcccagatcccgcagaaggtgctcgaaagcggccggatcctcgaggccaggctggttatgcagtatgaacaggataataccagtaccaagccgtcgccccaggtcaacgcctatcgcctgaccagcgactgggaggatcccggaaacaagcagatcctcaacgccggcaactgcattacttttgatggtacggcactggactatcagatactgcaaaaccatacgtcggagctgcaaaacctcgtcccgtatgtcttcgatgtgaccaaggcagcccagctttggctttcggacgccccgaattatggaatcgtactggagcagaccgaaaatccggaggcactcaactatttcaaattcgtcagcagcgataacaccgactatcctgtcggggatccatacagcccgacagcgtctccgctctaccagtttgtttaccgggatatgacggggctcgaaagctactggagctataccacggcatccgcgggccgtgcgggatcggtatatgtcaacaactatacgggagaggcaaccgtcactgccggcctttcctcaaccgatcacaaccgcatgccggccgctctgggccttgtctataacgggagtgaatacaacgagaggatgtcggccggcatgggctggcatctgaattacgcggacgttctcgtagagccctccgatatcccgggctacccgtattatctccgggatatggatcatacgatccattatttcctgccggacaacgacgggagcggctatgtggacgaggacggtctcggcttaaaattgtcggaggaagccaacggcgacatcaccattcaggataaatccgggacgaccatgcattttccttcctccggcctgcaccagattaccgacagcaatcacaacaccctgaccctgaaccacggctacatgcagtcggagctcgtcgacggcgcgggtatgcgccacgggctgatcttttccaaggtgaacgacacgctgtcaagggtgttcgatcctgcaaaccgggagatatcgctcggctataatacctgggatcaattgacgggcattacgtacccggacggggaacgggtgcagtatgaatatacctcgggacgcctgagcgccctccaagatgtggacggcaaaaggctcagcatctcctacgatgccgcgggccgggtatccaccctgacggaatacggggcggacggcagcatcggggagaagctgacgtttgattatacacaggcgaggcatacccgtgtcaccgaccgcaggggacggaacctccgctacaatttcgacatgtacggccgggtgaccgacatcgcggacaacgagggctatgcgcatttttacaaaatgactcccgcggccgaggatctcagtcagcctggcgtatcccccgccatgcggaacaaactccagcttcagtcggatctccaaaagaccacgattaattatgcattcgatctcctgggctatttctggaccggcaccgatgtcgaggggacgccggtggccggatcgtacgccaacgggacggataacaccacccggtttataaaccgtgcgtcccatcggagcagcatcaacaatctgaatggaacgagccggatgttcgtctattcctgcggggaagtgatcctggaaccggggacctataccttttcggcatatgtacagaccaatttttccggaaacagccagaatccggccggcggagccaagatgcaggtagatctcgggggtggtctgaccgcgacggcggagccgattacccgcggggacaccggctggacgagacagagcgtcaccttcacggtgccgagcacccgcactgtgcagatgcgggtgggaatagaggaccgggtc

SEQ ID NO: 827 - DNA, 1722 bp, Unknown
  Description of Unknown: Firmicutes sequence
catggcgggtggggccatatcgactgctcaaaaacagataacaaccacgatgacaaccggcagttgcgcaaaaagcactttgcgcgttgttgcgccggcacaaaagggttgatatcatggatccataaacaagaggaggcggttatcttgacgatccgacatatgataagccggctgcgggtaagcgccgggttatctcaggagcagtttgccgcgctgtttggcgtttcaagacaatcggtacagaagtgggagagcggcgtttcggtgccggagctcgaaaaactgatcaaaatcgcgaaatactttgacgtttcgctcgatgctctggcgctggagagcgatgcccgtatccccgaggaactggacttcagcaaaaggctgaagcctaaatacgccaatttacatgaatgggaatcctattcctccaatctgcttatagagtatcagcaggccgtcgaagaaggcctggatatacagccttacgaggatgtattcgcggcggttgcacgtcttccgaaaaatgagataaagaagagactcggcgacatcttattcgatgtcgtcctccaggcgaaaacagcaaaaggataccagtatatcgagccctctacgctcgaggaaataaggcggttgagaaatggtaccgggcaacggctgtccgttgataaaaaaacgctggaaaacaagattcacggggcgtggatgggcagaatttgcggatgtcttctaggaaaaaccgttgaaggcattaaaacgaaggaattgatccctttcttgaaagaaacaggaaattcccctatgcaccgctatatccggcacaccgatctgaacgacgggatagtagacaagtacaatttccgctttgcaggccggtgctatgcggatacggtagacgggatgccggtggatgacgacaccaattatatcgttctggctcaggaaatcgtcgaaaaatacggcagggagttttccccctacgatgtctccagggcatggctggatctgcaaagcaaagacgcctattgtaccgccgaaagggtcgcgttctgtaattttgtcaagggatttgagccgcctgaatccgccgtataccaaaacccgtaccgtgaatggataggcgcacagatccgcggcgactatttcgggtatatcaatcccggaaaccccgaacttgcggcggaaatggccttccgggatgcctccatctcccacgtcaaaaacggtatatatggggaaatgtttgttgcggcaatgctggccgttgccgcttgcaccgatagtatccacgatattctttcaggcgggctagcacagatccctcatacgtcgagactgtatgaaacgattacccatgttttgaccggctttgaaaacggcgtttcgcagcaagactgttttaaaacgattcataaccgctatgatgaatattcagagcatggctggtgccataccctatccaatgccgcgatcgtagcggcgtccctgctttatggaaacggccgtttcggacattccatctgtatggccgtggaagccggttttgacacggactgtaacggggcaaccgtgggctctgttttgggaatggcaaaagggatcggcagcatcgatgaacgttggacagagccgatacacgatacgctccacacctctattttcggagtgggaaccgtcaggatttccgaccgggtaaaacggacgttaagccacattccataa

SEQ ID NO: 828 - DNA, 3498 bp, Unknown
  Description of Unknown: Firmicutes sequence
atgtataagttgaaaaatattatgcatgatgatgatacaggggaaatgcaaatgatagaaaggtggtcagtaagagtgaagtggaaaagaagatggcgtaaaatcatcgcaggactaaccctcgtggccatgacaacctgtcttgttccagggatggacgcattggttttccgaggggccgccgagacctaccaaccggcaagggtggtccagatcgatgccgtgtcggacatcaacccgacggcacacctgattttcccgtcctcgtggcagaatgcgggaacgataacggtgacgggaaaaattcggatcgagtccatgtcgtccctgggggcgggcgccggcttttttgtcaacaacgcagcagcaaaggaattggtcagctataaaggcaacaccaacggctgggtcgatctctccctgaccgttacatacagcgatgcccggctgatcttcggcggctggtatgcgggcggcaagatgagcttcgccgacctggtcatcaaaaaggcggacggcacggtgctgtattctctcgccgacgacagcgtgttcgataccttcgcccacggtgaaaatctgcgcggaaggcgtggcgactggattttccaaacctataacaatgtttctaaatttactgtggaagccggcgcttatcagccggaaagaaccgtcaccattgactccacatcggacatcaatccgacggcgcattttatttttccttcttcgtggcagaatgcagggcctctgacagtaacggccaaagtcaaggtgacttccctgtccgcgctgggatccaacccgggctttttcgtccacaacgccgccgctcaatccaaagcgaattataatgcggtgaccgacggatgggtggacctgaccctgaccatgacttacagcgacgcccggctgatcttcggcggctggtatgcacgcggcaaaatgagttttgccgatctggtgattaaaaaggccgacggcaccgtgctctattctcttgccgacgatacggccttcgacacgtttgccctcaatcaggacataaaagggggacggggcaactggattttccagacctataacaacgtctccaaatttaccgtaaaaggcggggctgcccggcctgaaagaatcctcacgattgattccacgtcggacatcaaccccaccgcctacctggccttcccctcgtcatggcagaatgcgggaaccatgacggtcacgggcaagatcaaagtcgactccatcgcctctctgggatcgggctgccactttttcgtcaacaatctcgccggaaaagaactcgcgtcctatccaagcaataccaacggctggattaacttgtccttaaaggtgacgtacagcgatgcccggctgatcttcggcggttggtatgcgggcggacagatgaaattcgccgatctggtcatcaaaaaaagcgatggcaccgtgctctactcccttgccgacgacacggtgttcggctcgagttcttttgatcagcttctgaccgggacaaccggatactggaccttcacaacctataacaacgtatcgaaattcatctgcactacggtggaggaggcgccggtcatccgtgaatacgggccggagcgggaactgattatcaacagcacctccgacaccaatcctacggcggaatatacgttcccctccgcttgggcaaaccaaggaccattccggatgacgggcaaggtccgggtcgagtcgatatcgtccctgggcagcagcccgcgctttttcctccaaaatgcgcaaggagacaccctcgcgtcctacgaagccgccacgaacgggtgggaggatttgtccgtaacggcggcttacagcgacggtggtttcacatttggcgggcaaaatgcggccggcaggatgaaaatcgccgatttgaagatttatgcctccgacggaacgcttttgtaccggctgtccaccgatccggtttttgaatcggtatccccggacgcagacattgtgggaagcaaaggggactggatgtttgagaaaaacagccaggtttccaaattcagcgtgacgacttggattctcccaaaccggtatctgatgatcgattcctcgaccgatatcaacccgacggcccacctgattttcccgtccgaatggcaaaacaagggggatttgacggtcacgggcaaaatccggatcgagtccctggcgcttatgaatgatggcggaaagttctttgtcaacaacgccgcggcacaggagctggtcacgtatacggcagataccaacggctggatcaatctgtccctcacggtggattacagcgatgcccggctgattttcggcggctggtatgcgggcggacagatgaaattcgccgatctggaaatcaaaacctccgacggcacggttctttattccttgaacgacgacgatacctttgccgtgtacagcgacaacgacaacatcgtgggcggccggggcatgtggatcttccagacctacaacaatgtctcctccatgcacgtgatcgcgccgccggtcgatgccgattatgtcccggacagaagcctgtatgtcagccccgtcgacgacatcaacaccaaggcgcatttcatctttccgtccgactgggcatcctacgggaccatctatctgacgggatacctgaaggtggaaaatttccgcccgcagaattccgacgcccgattttcggttcataacagtccgggtgtgaactacttcacgccgtattatgccgataccgacggattccaacgggtggtcatccccgccacatacagcgacgaacggtacatattcggcagctggaaggcatcgggagactttatcctggcggatctggaaatccgcaagcaggacgggacgctgctgtattccctggcggaggaccggaactttgacaatatcggcacaaatgtcgatatgctgggaagccggggctactggatttttcagaattacaacgatgaggcgggattcaaggtccgctcaaaggtcaatcccgcacgcagcttggtaatcgagtccacgagtgacaccaatccgaccgcgcagttcgttttcccgtccgcgtggcaggatgccggacgcctgcatctgacgggaaaaatgaaaatcaacggcttcagcccgctcggaagcgacgccaacgtgtatatcggcaacgcggcgggggccagcttcaaaacctttacaggcaacacgaaaaattgggagacactcgccatcacggcggaatacggggacggacggtttgttctcggcggctggaatgcggccggaaaaatcacctttgccgacctggaaatcaccaacgacaaaggggaagtcctgtacagtctcgccgacgacccggccttcgacgggctggaggcgcagaccgatatcgctggtgaacggggcggatggagcctccagaagcatgatcatgtttcccggtttgtcttgctcgacggcaggcagtgggattacacgatgacaagc

SEQ ID NO: 829 - DNA, 1521 bp, Unknown
  Description of Unknown: Firmicutes sequence
atgatgaaagcggatgttcttgaaaactatatcgaaagggtatatggctttgccgtcaatcacacattttcaagagaagaagccgatgagctttcgcaggaaattttgtttacggctgtacgggaactgcccaaactgaaggattgcagccgattggagccctggctttggggaattgcaggcaatgtcacaaaagtattccggcgccgcatgggacggcagcgcgcgatgtattcctatgacacgcttgaacatgttccgtatgaagacgaatacggcgatgagaatgaggagctgtacgatgcgctccggaccaaaatcgccatgctttcggaaacatatcgccatatcatcattcttttctattacgacggcctttcgacaaaacggatttccgaaaagctcagcattccggagggcaccgtcacatggaggctttcggaggctcgccggaaactgaaaaaggagtgtgtggaaatggacaaagcggcgttaaagcctgtaaagcttaccatccgcatcaatggagacggcaattacaaggatccgataagccccttcccgcatgtctacatccaggatgcgttatcccagaacatcctgtatcattgttatgagacgcctaaaacggtggaagagctggccaggcactgcggtgtgccggcgtattatattgaagactgcctgcaaaatctcatataccgcgaagccatgtccgagatttctaaaggaaaataccaaaccgattttatcatctattccgacaagacaaacgcgtatagtgacaaggcaaaggggatcttcacgccggtcatcgaccgctttgtccagtcgatgaaggcgctcgcagacaggacggacgcgctcggaatatacactgccggaaaggcagcggacgagcggatatatctttacgggttgatggctctcgaacatctgagccaacagcacaatcccgtcaggtgcacggctcatccggtgagatacgacggtttccggtggagctaccatgcgtaccgaatatccgatacgcaatacccgatacgcggccttggccgtgagcagtcggccaacaagggaagcagagggacatatcaacacatatcgtatcatttcggcggatttgcataccgtgaaatgatgctgagtgaccagatcaatgtatgtgaggacatcctgcggggaaaaaccgtcaccgatacggaggccgcggcatcggcgatcgaacgtggattcatcgcacgggatcaaaacggcaagctgtctgtcgctgttcccgcatttacaaagaagcagtatgaagcgttcacccgcttggcggaagaggattttgcgtcctccatcggcatgtacgcgggcgcggtatcggagtatgtggccggatatcagaagctgtttcctgcgcgtcttgaggaagaggtcaaacgagcgtgccactacatgtttttgacggtctatgccaccattatctgtgatatggccagggagagaggcttcctccgcgccccctctcccgatagt

SEQ ID NO: 830 - DNA, 1860 bp, Unknown
  Description of Unknown: Firmicutes sequence
atgagcgacgaaaaacgtccccccgcccgtccgggcggcatgggccacggccccggccgcttcggcggcgaaaaggccaaggacttcggcggcaccatgaaaaagctcctccggtatatctcacgctacaaggcgtcgatcatcctggtgctggtcttcgccgtgggcggcgtgctgctgaacatttacgggcccaaggtgctcatgtacgccaacgaggccattgtcgacggtgtcgtggagatggtgtctggggttcccggcggcggcatcgacttcgtgtacgtgggccgcatcctgctgatcctgctgggcatgtacctgctcagctcggggctgacggtcgtgcagggctttctgatgaccggcgtgtcccaaaaagtgtcgtataacctgcggcgggagatctcccggaaaatcaaccgcctgcctatgaaatactttgataccaagacccacggcgaggtgctctcccgcgtgaccaacgacgtggataccctcagccagagcctcaaccaaagcatcacccagctcatcacctccgtcacccaggtggtcggcgtgctggtgatgatgctgaccatcagctgggagctgaccctggcggcgctgtgcatcctgcccatatcgatgctgtgcataagcttcatcgtcaagcgttctcagaagtttttcaaatcccagcaggaatacctggggcacatcaacggccaggtggaggaggtctacggcgggcacaacatcgttcaggcgttcaaccatgaggacaaaacggtcgagcggttcgatgaaaccaacgagaccctgtacaaatcggcttggaaatcccagttcctctcgggtatgatgcagcccatgatgcagttcatcggcaacctcggttatgtcgtggtgtcggtgctgggcggttggctggtcatccggggccggatcggcgtggaggccatcgtctccttcgtccagtatgtccgcatgttcacccagccctttgcccaggtggctcaggtggccaacatgctccagtccacggcggccgcgtccgagcgggtgttcgaattcctggaggagtccgaggaggacattacggtggagcatcctgtatcgatcgacggcctggaaggccgggtggatttcgagcatgtcagcttcggctacaacccggataaaatcatcatccacgatttcaccgcccacgtgaagcccgggcagaaaatcgccattgtcggcccgaccggcgccggcaagaccaccatgatcaagctgctcatgcggttttatgacgtgaacgcaggcgccatcctggtggatgggcatgacatccgggacttcaaccgcagcgagctcaggcagatgttcggcatggtgctccaggatacttggctgttcaacggcaccatccgggagaatatccgatatggacggctggacgccaccgatgaagaggtcgtggccgccgccaaggccgctcacgtgcaccactttgtccagacgctggcaaacggctacgacatggagctcaatgaggaggccagcaacgtctcccagggacagaagcagctcctgaccatcgcgagggccatcctggccgatcccaaaatcctgattctcgacgaggcgaccagctcggtcgatacccgcaccgaggtacggatccagaaggcgatggataacctgatgcggggccggaccagcttcatcatcgcccaccgtctctccaccatccgggacgcggacagcatcctggtgatgcgggacggcgatatcgtcgagcagggcagccacgaggagctcctcgccaaaggcggcttctacgcccagctctacaactcccagtttgaaaataccgaggaagcgggctga

SEQ ID NO: 831 - DNA, 2082 bp, Unknown
  Description of Unknown: Firmicutes sequence
gaaccggggaagagctatacagcctctgtgtacgcctatgccccgagcctcaacggcaattcggtccacatcgggctgtggtgcccgaacccggacggctcgggaacggtggtatattccgaaccgctgagcatgaacacggtggacggctgggaacgcctgagcgtgaccattgacgtgccggcggacgcgggcaccaccttcggctgcgtgtactttttctataacggacaaaacacgggagaggtgtggttcgactgcgcccaactcgaagaaggcaccgctgccaacggctacaacctgttggaaaacggggatctcgaaaaagggagcggaaacggcttcgacagctggaacgcccagggctcgtatgagcaggcatgggccgtcagcggagacgccgccacgggccggatggtacgcctgaacggacagcgcacgtcgcgctcgcagttgtctcagacggtacaggtgggtggcgaaaaacgggacacctacgtattgggaatgtgggggaagggctccgcggtcaagcgcggcggcaccttcggggcagaaatcaccatacactataccagcggcggggataaaaccctgacccagcaattcgagctggaggcgaccggatggcagtacctgacgtacggattcaatctggacgacgggagccgcaacagccggaggccggtgagcgtgaccataaagctggtatacgagaaccagctcaacggcgcgtatatcgacagcgtgcagctggtcaaggagccgttcccgagctacacatacgacaagaacggcaacctgatcagcgcggtggacaacgcacggagccaggaattcacgtcggacaacaaaaaccagttgacccggatgaccgatccctcggggaacttcatgtattacgattacgccgtggacaccggccggatggagtgggcggtcacgacaaacggcgtggaatacagcttcgactacgacgaatacgggaatgcgacgggggtgcgggtcaacgcccgggaattcacgagcatagggacgatcacgatccggaacaggaaaacgggtcagtttctgtttgcagcgggcctgccggaacagacggaggcaacgctgatgatgacaaaccgggacaaagagatgaacggcgtctggacgaacgaccagttccagatgcagtacttctcgaagggctaccggatcaaatcggtggcgcatcaggggtatatatacagcaattgcccggggaccttcctgcgggtgatcaagaacagcgccccgagctttggggagttcctgctggaattcggggattacacaacaagccagggcgcgtactgccggatcaagcacgagtcgagcgggaaatatatcacatacgacgaggcacacggctgggtgacgttgatggagggggatgaggataacgcggcgcagtactggctgccgcagaaggtggaagaggcgtccgcgcggtcgctggtgagcggtgcggaatacagcgcggacgggcggtacctgaccgacgtgaccgacacgcgcgggtacgtgacgtcgtatgaatacgacgaaacgcgcggcgtgcagacgagggtgacgagcgggaaggaaagcaaaacagacgccacgggcggccggacggtgaattacacctacaacgcgcagaacgacctgttgacgggcgtgagccagcagaacgggacggggacggcgcaggtggggtatacgtacgacgggacgaacgcgctgtcgtcgatccagcacaacgggttcgaataccggttctcatacaacccgtacggccaggcgcatcaggtgcgggtaggggagccggaggggggaaggaacgtgctgctgagcacgtcgacctacctgcaaaacggggccggaaagctgagccggatgagctacgggaacggcgactggtatgtggactacgggtacgacgcgctgagccggctgacgcgccagtcgtataacggggtgacggcgttcgaatggggatacaacaacaaagggcagacggcgtgggaaaaagaccacgcaaacggccgcgagacgcggtacgggtacgacacgctgggg

SEQ ID NO: 832 - DNA, 1149 bp, Unknown
  Description of Unknown: Firmicutes sequence
atgaaaaagaaactctccttgaatatcctgttgcataacgataagctcatgatggggctttctctggtgatcgccattgtcgtctgggctttggtggttaacggccctgccaacgtcaagaccaaaaccatccggaaggatgccgcgatcgatctgaccgatacctatgcggagaacaacaatatccgcgtcatcgagacccccgatctggcggtggaaatcacggtcagcgggccccggtcggtcatcgactacctaggaggcgaggatatcaccgtcaaggcggaaacctacctcatccagacggcaggtccggcggtgctcaatatctcggtgtccaaaaccaacaagaacgccgatttcgaaatcaccggctacaccccctccaccgttacagtacagtgcgattactgggataccgtggatctgccggtgcgtatggatatatcctccgtacaggtagaagacccggatacccagcagctgggggagcctatgctggacaggacctatttccaaaacagtatggtcaagctggaagggccgcgtgccacggtgagccggatcacgtccattgtcgcgagggtagaggcggataaacccatcggtacggttcaggtttacgctgccaggctggtggcgttggacgccgatgggaatgaagttgatctcaagggctgccagatgctcaacccctcgacgggagaaccgatccagtccgagacggtcaatgtcacggtgccggtctacatccaccggacgatcgattttacctataaccttctccatgtcccgcccgcgattgcctccaatccgaaccttgtagccttgtcagccacttccatcaccctggtggggccgaaggagtcggtcgacagcgcggcggagtccctggccaatctcggcgatatcgacttcgatcatctgacgccgggggatacactccgcgtgattcctctcaatattcccgcgggcgtaacggtgctggagaatatcagcgaggtcatggtcaggctggacatcggcggatatgtcgacaaaacactggacatgaccctgatgaccgaacgggacgtggttttccagaaccggccggccgatctgtcaatatccgtgcagcagcaggtgatcagcaatatccgcatctgc

SEQ ID NO: 833 - DNA, 1335 bp, Unknown
  Description of Unknown: Firmicutes sequence
gccaccgagtccgggacttccggctcggagacgaagaaaaatgtaaccctcactctggcgagctgggaggtcaacgccctgaaagccccctggatggccaaattcaccgaaaagcacccggaaatcaaggtggagctggcggaagaaggcaaatggctcggcaccgaggatctggccaagctggccgcggccaataagatgccggacatcatcaacgtcgagaatatttacacccctgtcaaaaacaactggctgatggatatctcgtcctattatcagaacgacccggacaaagcggcgatttacgagaacttcatcgagttcggctccatcggcggcaagctttatgtcctgcccagcaacgtctttttccatggcatcaaggtcaacctcaccctgctggaggatctcaacattccgaagcccggctatgactggaccatcgacgatttcatgaacatcctgaaagcctcctccgtcaaaggcgagagcatcggcaccaacaatatcatctggctgatgaaacatctgcccgctcagatgaacgatgaactcggctgggctgcctataattactcgacccagacgtacagcctgggcaacgagtggatcgaaaccgtcaacaaaatgaaggatatcgtcgacaaagaatacgttatctgggaaaacatcgacaaattaggcaaacccgatgattttgaagaagattccgcggactataacgcggtggtcgaaaaacgcaacgactacctgatgaaggccgtgggcaccaccgaggtgccgtggccgctcggcaaggtcgccatgcaggaggatttctcctggaccctgcggtttgacaagaccgatccgtcctataccggcttcgattgggattattaccccttcccctcctccggcgccggtgacgtctcccgtccgggcctcagcgtggactattacggcatcaccaccagctgcaaaaaccccgacgcggcgtgggagctcatcaagtacatgtcctatgatctcgaaggcttccgcgacaaggtgggcatcgtcaacgcctacgacaaggcagaaaccgcgaaaaactaccccgatatcgcggccgacctgcctgagaagatcgaatccctctccttgccccccattaacaaccccgaagccatcgagctctggaagagcatggacgtcggctacaagccgggcctcgactacatgctggagaacttctcccgcggctacgtcgactgctggcggatcgtccccgaatacgccaacacctgggaaaacctcgtgaccaaccgggtgctcaaggacatcctctacaccggctccaagaccgccgccgac

SEQ ID NO: 834 - DNA, 2700 bp, Unknown
  Description of Unknown: Firmicutes sequence
atgaacaaacagcagctggcaagtaagatttgggaatcggcaaataagatgcgttccaaaattgaggcgaatgaatataaagattatatccttggtttcattttttataaatttttgtctgataaagagatcgagttcctgaaaaaagacggctatgaagagacggacattgcatccgaagtgcatgaaaataatgcgccgttggtcgagtattgccagcagaagctcgggtatttcattgcttacgacaacctgttttctacgtggatagccaaagggaacagctttaccgtcgacaacgtgagggttgccctttcggcgtttaaccgtttgatcagcgtcacacataaaaaggtgttcaataaaatttttaatacattggaaaccggcctgagcaagctcggtgacagcgctagcaaccaaacgaaatcgatccgcgacttgatccagctgatcaaggatatccccatggacggcaaacaggactatgatgtccttggttttatttatgagtatctgatcagcaactttgcggccaacgcaggaaaaaaggccggggagttctacactccgcacgaggtgtcgcagctgatgtcggagatcgtggtcaatcacctcaaaaacagggaaaaaattgagatttacgacccgacgagcggttccggttctcttctgataaccatcggcaagagcgcggccaaatatatcgcgaacaaggataacatcaaatattacgcgcaggagctgaaggaaaacacctataacctgacgcgcatgaatctggtcatgcgggggatcaagccggacaatatcctgacacgctgtggggatacgctggaggaagactggccgtggtttgatgacgccgacccggcgaatacctatcacatggtggatgtggatgccgtggtatccaatccgccctattcccagcactgggatccctcccacaaggagaccgacccccgctacagctatggcatggcgccgaaaggaaaagccgactacgcctttctgctgcatgaattgtatcacatcaggcgggacggaattatggccatcgttctgccccatggggtattgttccgcggggacgcgacgggcggcatggacggagaaggccgcatccgccgaaacctgattgaaaacaaccatatcgaagcgattattgggatgcccgcgaatatcttctacggtaccgggattcccacgattatcatggtactccgccgggagcgcgaggattcggacgtgctgtttatcgacgcctccaaaggttttgccaaagccggaaaatccaataagctgatggcttcggacatcaaaaggattgtggacactgtcgccgcgcgcccgcaggaaatcaaaaagtacgccaggcgtgttaccaaggcggaaatccggaaaaatggctataacctgaatatcccccgttacatcgattcttccgaggaagcggaaacctgggatatttatgccaccatgttcggcggcattcccaaccgggaaatcgaccggctggataaatactggacggcttttccacggctgcgggaggatctgttttcctgcgacgggacaccgtattccacattggcagcggaaaaaatcaaagaggcgatcgacggcagtgcggacgtgaacgcctttatcgacgcctatcaggccgcctttgccgatttcgattcctatttgaatgccgagctgattgaaaaaatgcaggaactgagtgtctcccaggaagaagatgcgattacacagaatatttttgaccgtgtcgcaccgttttctgtggtggacaggtatcaggcgtatcagctgctggacaaccagtggggacaaatctctaccgatcttgaaatcatacagaccgaaggctttgccgccgccaaacaggtggatcccaatatggtggtcaggaaaaagggcgatacggaagaatacgtacagaatggctgggtcggccatgtgatcccctttgaattggtccagacgaccctcctggaaaaggaatatggggcggtaaaggccaaggaagcccggctggacgagatttcgtctgagctggcggaaatcatcgattccattgacgagggcgaccgtggggaatttttgaacgaggacaacacggcctttgttgcaaaagagtttgccgccaagctggcggaaatttatatggatgtctcttccccggagctctccggcctgcagggatacatggatttgctggactcaaaagcggggacggcggccaagctgcaatatatggccgatcaccatgaagtggactggacagcggtggagggaacggccccctacgccaaaggcaaggtcatggcatacatgaaaacgcggcaaaccgcctacgtgttcccggagggctctttcgaggcgaagatggtaagggcgggcaggctgatggacgaggagaaggccgccaggcgggaggccaaggagatggccgccgcactgcatctgctgaccaaagagacgatcgaagggctgaccgacgagcaggtccttgatttgctgcgcctgaaatggattgcgccgctgtccgcctctctccgcgccctgccggaagcgattgtcagcgggctggagcaggcgatccaggctttggcggataaatacgccgtgacctatctggaattggaaaaacagatggaagaatccgggaaaggccttgccgctatgatg

SEQ ID NO: 835 - DNA, 1161 bp, Unknown
  Description of Unknown: Firmicutes sequence
atgacttggaaaattgtcaagctctccttaaagacaatctttaataacaaaatgcgatcctttctgacaatgctcggcatcattatcggtgtaatggcggttgtgattctcgtttcgattactcagggagccgcaagcggcattaccgacagtatttcggatatgggttcgcaacagattacggcaactatttcgagcgaggaggtttcgattacagcagattcggtagaaagcctttcttcctatcccaccatcagcggcattgcacctgtcatatccacaagcaaaacggttaagaaaaacagcaacacaggcaattactcggttgtcggcgtgactccttcttactttaccgttcaggatatggatattcagcgtggcagaaagatcgtagactccgatgttgagtggaatacaaaggtttgtgtaatcggtacagaagttgcaacggatttatttggaacttgggatgctgtaaatggcacgattattgtaggcgatagcctctataaggttgtgggcgttttggaggaacaaggctcgagcctcgcaggaagcgatgacaataagattttaattccttattccaccgcttcccgtatgatcggacagacgggtgtgagccggttttatatcaaggcggcaagtgagaacaccgtcagtgcagctatcagcagtgttgagatgtttttactgcaggccacccgtgacgaagaggcctatgatgtaagcaatcagtccgatgtacttgacacaatggatgatgtgacaaatacgatgtccttgcttcttgcaggtattgccgcgatctctcttcttgtaggcggtatcggtattatgaatataatgctggtgtcggttactgagagaacccgtgaaatcggcatccgcaaagcagtgggtgcaaagagaaagcatattatgcttcagttcctatgtgaggcgtgtattctttcagtgctcggcggtttaataggcttggcactttctatagcaattatagagttctataacctaatagccaaagccgctgttgcaatgaactggtcggttgccatcgcggcaattgccttttgtgcactaatcggcgtattgttcggcggatatccggctgcaaaggcatcccgtctccagccgatcgatgcgctccacacctcgtaa

SEQ ID NO: 836 - DNA, 1452 bp, Unknown
  Description of Unknown: Firmicutes sequence
atgccgaaaccggtcagtaccgtattccgcatcgtgtatggcacatacgcgggtcttgaaaagaaggctgtggacatcgtatccgaaaccctcggtgatttcacgccggttccggccgccgccgtggcagggcgggatctggatgatacggccagggctgcggactctctcgttgtggtagggacacgggagagcaaccctctgctgcgtgagctggcggaacagcggttctacgagccgggggacgatgcggaagggtacaccctccgcatcgcgccgagtccctacaatgaggagatgcagatcgtcgtcatcgccggaaacgacgcggcgggcgccctgtacggtgccttggatttcaaagccttcatcgtcccggccgcccgtcagacgcataatcatctgcattaccggcggcagcttttcatgggcgaagccctgcccgagaccattcggatgtcggcgccggcggtccgtcatcgcggcttctggacctggggtcatgtgatatacgatgtccgccgccatatcgatcacatgatgcggctgaaactcaataccctaatcgtctggaacgagtttgtgcccctgaacatccgggagataacggactatgcgcatgaatgcggcattcgtctcatcctcggatgcacctgggggtggaacgactggttcgatatctcggatgaagccgagctgcgagcgcgggaggacgcgatctgcaagacgtatgaaacggaatatgcgggccttggggtggatggtatctatttccaatcctttaccgaaaccagtgacgagacccttcatggccgggtcatcggggaagccgtgacgcggttcgtcaaccgcgtcagtgccaggctgtggagccgccatccggacttgaaccttctgttcgggctccatgccaccagtgtgtcgcgtcaactgaggtatatccggcaggtggatccgcggatcaccatcgtgtgggaggattgcggcgccttcccgttctcctatgttccatcggatctcagacggttcgaggaaaccgaggcgtttgtaagggaaatcgaggttttgagaggggaggaggaacgcttcggtgcggtgacaaagggccttctctgcttggattggccctccttccgtcatcagcaggggcggttcgtcatgggctgtcattcgcggccctttatccgccgcagggccgaggaaaaacgggagctgtggcggtatgtggaaggatattggctcaaaaacgtatcccatgcatcccatatgctccgcgccatggcggacatccgccgggatatcctgattaccgggctgctcgaggacgcgctgttcgaggaaaacatctggtttccggccgccctgttcgcggagatgctgtgggatccgcgttccccggcggaggaactgctcgtccgggtggccatgaggccggatgtggaaaaagcgtga

SEQ ID NO: 837 - DNA, 1545 bp, Unknown
  Description of Unknown: Firmicutes sequence
gcggtggaacgggtctatgtctgcgtccctgcaccggacaagcagtcctaccgcatcatccgcagctccagcccactggaccgccccgccttttcactggggcgtgacaatccggtcgtgttgtggctcaaggagcacgatgaatgcctcctgctcagcgagttccgcaggaccaccgcctataaatcgatgtgggaagccgaaaaaagggcgctcgaggaccttggcatcgaatgcctctcccctctcaaggacaaggattcccttgtggggatcgttctgctcgccaccaaggataaagggcgccggtacagctatgaggatctcaacttcctcgcgtcggtgaactcgatcagctccatcgcggtgaaaaattcccgcctttatgaacgtgcctatctagaagcccggaccgacgaactgaccgggctgctcaaccgcaaatatttctatgagaccttgcaaaacgcctatgacgagcatcgggatgagggtctctccctcatcatcctcaatctcgacgatttcaagctgtacaatcagctctacggcaacaaggaaggcgacatcgccctgcagaaagtagcccgcctgatccaggcgagtgtgggagagcacggccatgtcgcccgttacagcgggaaagaatttgcgatcatcctgccaggctatgacctcctctccgccaaggagctggccgagaacatccggcggcaaatcctcgatatgaacaaggccgccaccgactacaccctcaaggtcctgaccgtcagcggaggggtttgcgcgatccctcacgcggccagcacggtcaaggagctcatcgataacgcggacatggcggtgtatcacgtcaaacacaacgggaaaaacgctatcctcgcgtatacgaccggggattaccgctttgaaaaagcatcgccggaaacagcggaccggcacagcgcctattcggaatatgaaagtacgatttacgccctgaccgccaccatcgacaccaaggatcactataccttcaaccattccaacaacgtcgcccattacgccacggagctcgcacgcgccatccacctgaatgcggaccatgtggaaatgatccgggaagcggcgctgctccacgacatcggcaaaatcggcattcccgagcatatcctcaataagcccggccgcctgaccgaggaggaatacgaggtcatgaaatcccacgtggaaaattccatagggatcatccgccatctcccctccctcgactacgtcattccctctgtgatcgggcatcatgagcattacgacggaaagggttatccccgccggatcgccggcgaggatattcctctcggggcccgcatcctctgcatcgcggattccttcgacgccatgatctcgcagcgttcctacaaacagccctaccccctcgagaaggcactccatatcctgctggaggaagccggccggcagttcgatccgcagcttgtccctgtgtttgtggagcttgtccgcagcggccgtgtacaggtgccggaaaatggaacggagccctcctga

SEQ ID NO: 838 - DNA, 1260 bp, Unknown
  Description of Unknown: Firmicutes sequence
gcttacctggagctgctctcccgccagtatcccaccgtggaagcggtgtgcagcgagatcatccagttgggcgcgaccctgagcctgccaaagggcaccgagcattttatgagcgacctgcatggtgaggatgaggccttccggcatatcctcaacaactgctcgggagtcgtccgggaaaaggtggacgccgcattcgggcacacggtgccggaacgggagcgtgcctggttcgccgccatgatctattatcccgaggaaaaaatcgaggaggtcaaaaaatccggcgcggacatgaccgattggtacagcatcaccctctatcgcctgaccgagacagcccgcttagtcgcgtccaaatacacccgctccagggtgcgtgccgcccttcccgaaggctatgccgatgtacttgatgagcttctgtacacgagtctcgaggaaaaggacaaggccgcctatgtgcagaacatcgtgaccaccatcgtcgaaaccgactgcgcggacgaggtgatcggggcactctgcgccctgatcaagcgtctggccgtggaccggctgcacatcgtgggggacgtgttcgaccgggggccgcgtgccgaccggatcctcgacctgctcatgcggcaccactgcgtggatgtccagtggggcaaccacgacatcctgtggatgggcgcggccgcaggcaatgaggcgtgtattgcctgcgtgctcaacctcgctctccagtacaacaccctggacatcgtggaaaacggatacggcatcagcctgcgggatatgatcgccttcgcgcaggaaacgtaccgtgactgcacctggttcatgccgcgcacgcctgatgacaaggagtatctcaaaaccagcatggataccctttccaaagtccataaagccgtcgccatcatgcaattcaagctggaggggcagctcatcctccgtcatcccgaatacgggatggaagaccgcctgctgctcgacaaaatcgacaccgtccggaagaccgtcaccatcgacggcgtggactacgcgctcaacgacgcgcattttcccaccgtcgatccggaaaatccctttgaactgaccctcgccgagcgggagctgatggcctccctgcgccacgccttccgccacagtgcccgtttgcagcagcaggtggcgtttttgtacaataagggcggcatgtataccatctacaaccggaatctgctctatcacggctgtatcccactggatgaggaggggcagttcctggcg

SEQ ID NO: 839 - DNA, 1197 bp, Unknown
  Description of Unknown: Firmicutes sequence
atgaaaaaagtgctatccatcggtctggcctcgatgatgatgctgggtatgttcgccggttgtaaagcgccggaggacgacggcggcagtggaggcgccaaatcgcagaccctgaccgtctacgcactcgaatccgcctatggcaccaacatctggaaccagatcgcgcgggcctttgaaaaggccaacgagggcgtgaccgtcaaggtcaccaccagcaagaccctcgaggacaccctcggctccgagatgaaatccggcgcctatcccgacgtggtgcatctggccacaggacgcccggatgcgctgactgaaaccatgataaaggacaacgccctgcgggatctgagcgcggtcatggatatgacggtcccgggcgaaaccgtcaaggtcaaggacaaaattctgcccggattcctcgacacctcgctgaccaagccctattccgacggcaaaacctatctggcgcccatgttctacgggccctgcggcctcttctacaacgccgggctgttcgagagcaagggctggtccgtgcccaccacctgggatgagatgtgggccctgggcgaaaccgccaagaacgaaggcatcgccctcttcacctatcccaccaccggctacttcgacgcgttcttctacgccatgatgtatgcggccggcggcgaggatttcttcaaaaaagccaccacgtacagtgaaggtgtctgggacaccgcggaggcgggcaagctgtttgaaaccgtcagcaagctggcgccctataccgagaaaaccaccgtggccaatgccaataacgacaactatctgaagaaccagcagctcattctcgacaacaaagcgctgtttatgcccaacggcacctgggtcgtcggtgagatggccaccgcgcccaagtccgagggcttcaagtggggcttttcggccatgccggcctttacggcgggcgacgcgcagtattcctataccttcttcgagcaggtgtggagcccgaaaaaagccaagaatcccgaactggcggacaaattcattgcgttcctgtattccgatgaagcggccgatatcttcctcaacgccggcaaggaggaggaagatcccaaaggcccggcgatccagcccatcaaaggcatcaccgataagctcaccggcgaagataagctgatgtacggcatctatgacgacggcaaggtcaagccg

SEQ ID NO: 840 - DNA, 1302 bp, Unknown
  Description of Unknown: Firmicutes sequence
atggtgtattccaccctgtcccaatacgatgagaacacgggggaataccatcccctgctggcggattcctggtgctatatcgataaggaggggaatccgatcgtcaccccggacggcggggtggattacgaccggctggaggaggtctacgggggggacgacaccgcctttttccctgtccggttcgagctcaaccccaacgcgacctggagcgacggggaaccggtgacggcggaggatatctatttcaccttcgacatcgccgccgaccagacccgttccaaccatgcgggcgcccttgcgtgggtcagcgatctgctgcacaagtacgacagccagaccgggcggatgacccgccaggggatttacacctacgaccacggtgcgaatgaagccgggtatcccatctcggaagaggaacgggaccacgttttctatttcgaggtaaacaaagtcctcggcgcgatcacccctttagtgtccaccgtcctcgtgctgccggagcatatctacgctccgatcctggcgggcggcagcaccctcaacagcaccagtccgaacgaggcgctcgcccacgcctaccggaatccggtcggctgcgggccctataccctcgatgcggagctcaccaattcccaggaaattgtgcttcgccgccgggaggactactacctccgcggggcggacggcggggatctctacgccgtcgataccctccgcttcattctgtaccaggatatcaacgtggcgatctacgctttgaaaaaaggccatctcgatgtgctggacagctcgatcagccccaactacgccgggctgttcgagcaggaggaggacgtcgcgctgctctcccctccggggttgtttgtccaggcgctggttctcaacgtcaatccgcccgcggatcagaaaaccgcgatgcgggagattctcaccgacatccgggtacgggaggccatcgccttggcggtggatcaggaggagctgatccgcaatgtcctcaacggcgccggtgccacggtgccggccggcctgattctcaagagcatgccggatctgtacaatcccgaggccgatatcctcgccggggatatggaggaaaagcggacgagggccaacgcgatcctggatgaactctatccgcagaaggatgcctccggctaccgcctgaccccggagggcacccggatttccttccaaattctcggttcgcccggcgagcaggagaccatcgggtttttgcaggttctattccaaaagatcgggatcgaggtcaagttcgcagccaagggcagctcgcct

SEQ ID NO: 841 - DNA, 1767 bp, Unknown
  Description of Unknown: Firmicutes sequence
atggattatgatctgcattacaagttaaggcgtggaaatatcaaagcatttcgggagctttacacgcttgatctgcgcagattgtggtttatctgctgccacatcacagaggatgtgaaaaaagcagcccccttgcttatcaacagttggaaagccgcgatagacaaaacggtcaataccgacactccgcccaaagaaagctttggtgtattggtatcagcggaaatactcaaggccgtgtcaaatgaacttgaaagcgatgacaactacgaaacattgcctgctcccattatcccgaaagaatacaccgtctttgtgaacggcatcaaacaacttgattacgaggaccggtatatgtatcttttgacaacctttggcggcttaagtgcccatgcagtcgcgaatctaacagagatgccgttagagcaagccaagaacaggatttcgtcattatcggcaaaagcgcaggatactcccgaaataaaaggacttggctttgctttatcagtccggctgttaacagagttcaaaagcccaaacggcaatccgttttcaaagataaatatcccacagtttttaatcactactctggaacacgattatcagcttgttatgcggaagcaaggcaaatcgaccacggcatcaaatgttggaaaggaaacaaaaaacatgaaaacacctgtaaaaccaaatcaaaaaaccgccgctaaaagcaagggatttaaatatacgaagccgattgtagtaacagcggtgtctctggcagtggtgattgccgccgttatcattttgccgaaagtactcggcggaaatgcagcggttacgagaatcaccacatacaacgtggatgaagttgcctacggtaatgtaacacagactatcagcggaagcggaacactcacccccattactaaggaaacacttacatcttccaaaggcggtgaggtggaagaagtcaactttaccgttggggatgaggttactgaggatgctgtaatcgctgtgataggcgatgaggaaatcacagccccttgtgatggtattcttttggaacttcctatcgccgctggcgatgaagtggctgttggcggctctgtggcaatggttatgggcaaagatggatttacaatgggaatcgccgttgatgaaacagaaatctcttctgtagcactcgaacaagacgtcacctttaccattgatgcgatcagcgaagaatataccggaaaagtaacccaaatctcttataacggctcctcaagcggcggttccgtagcgttccaaattacggcggctgtagaatatgttgaagatgtttatccaggcatgagcgcatcggcggaaatcgttatcgaggatagtggagaaggcttgcttgtccccgttgatgctgtaaggacttctggtgacgacaactatgtatatcttgctccttccggcgcggaggtaggtactgtttatgaagaaggggatatggatgtcagcgatttgacgagagtcaccgttgaaaccggcatgtctgacggaacgtatattcttattgaaagcgatgagcttgccgagggagacctcattgttattaccaaaattacttctaccttaaccggctccgtcaacgaaggcgaagacggcggcaggggtggaatgggtggattccccggcggtggcggcggaatgaacttcggtgatttcgactttgaaaactttgatcccaatcaaatgcctcaaggcggcggcggattcggcggatttggcggattcggcggttaa

SEQ ID NO: 842 - DNA, 1083 bp, Unknown
  Description of Unknown: Firmicutes sequence
cctccccgccggccgggcgctgctgataacgataattcgaacggccagaagggcgtggtgataaggatgacgaaatcaaaaccgggatcgggcccattgtcggccatcgtgtccggatacagggacaaaaggctggcgatcaatcacacggcagctcgtgtgtttacggtgatcctgcgtaccgtttttctggtcggcatgtgttttgttatgctgtatccggtcctctgcatgatttcttccgggttccggaacctgcaggatgtgtacgatcctactgtggtatggctgcctaaacactggacgctggattcgctcaagcttgcggcgacggcgatggattatggagagtccattgtcatgactctcgtcaccgtcatccccagcgtgctgctgcagttgattaccgtgctgctggcgggctatggattcgcccggtttcattttaggggacgcggcctcttgttcggattgctgatattcacaatcattgtgccggtccaaagctatattatccccttgttcagtacatttacaaatttcgactttttcggtatcgggtctcttgtcggcttgttcacaggagaaaagctgaccatcagcctgatcaacaagcccgtggtcttttatttgcaggcatttttgggtatggggatccggtccgggctctacatattcattctccgacagttctaccgcgggttccccatggagctggaagaggcggcgatgatcgacggatgcggccctatgcgtacctttttgaagatcatgcttcccaatgccacatcgatgattgtgacggtcatgctgttttccgtggtatggtactggaacgattattatctgtcctccatgttttatcagacgactttcccgatttccgtcaagctgaccgatttgggaacgttgctccaatggagtgacaccatcaccggctacgcggcgcaggaactgacgtttatgcgcgaagctatcctcgcgtgcgggtgtttgataaccgtactgccgctgctcgtgctgtatgtgttcgctcagcggtttttcacagaaggtattgaaagaagcggtattgtcggttaa

SEQ ID NO: 843 - DNA, 1470 bp, Unknown
  Description of Unknown: Firmicutes sequence
atgagcaaacaagtgcgcaccctgatcctggccggggttgcggtggtcgcgctggtcgccctgctgctggtgctcgtgtttctccttcccggcagcggtggggaagatgcttcttccaccgccgtctcggacacttccgtgacagtgctcgacaaatccaccgacgccgacggcaaaaccgttgacaacccgattaaaagtatccagatcacgctccgggacgagacctttactttctcccagaacgaggacggcgatctggttgcggatccttacaaggacctccccatcaacacctctgagatctcctatctggtcagtaccctaaaaaccgtgaccgcgaccaaggagatctcctccaatccggaatccccgtcggattacggatttacgggtgaatttgcagctccggattcttcggatgcctccgctgtttccagcagcgtgagctcggcggctaaggccgaaaaggccgtggggctgaccgcgcagatttcggtcacctatcacgatgattccatccattccttcgaggtgggacgggagtcccccacgaaagagggctattatctgcgggaggtggggaccaatcccgtttatctggtggattccacctttgcctccaccatttcccagccgtctaccgcctatatcggccggaatgtcgtgacggcgccgacggtgaaaaccgacgacgacaacggccaggccattcttcgggagattgaattgaccggccgggtgcggacctcgcccctgatcctgcggcggtccacggcggacgacaatctgaacaattcctcgaattatgtcatcaccaagccctatttccgcgccgccaattcgtcgagcgctgtagtcacggccctcggcacctatacgtcggtcacggcgtcgggggtggaaaagccttatcccaccgccgaggacttgaagcggtacggcctggacgatccgtattcaacggccgtcttcaccctggcggtcgagacgactgaaacatccgagacttccggggaatcggccaagacctcctattacaatatccaaaagcataccatccagttgggcaataaaaacgacaacggagagtattacgccctggtttacaacgaggatcagcggattcccgtggtctaccttttctcggcttcctccgtggcctgggcggaagcccagtatgacgatgtcgcggagacactgctgttcctgcgcaacatcgattctctgtccaacgtcatcctcacggcgggcggccgggagaccgactttgctctcgagcacttcccggatgcatccgagaaggacgatcagatgaaagtcaccgctgacggccagcagtacgacaccgacaatttccggaacctttaccaggtgctcatgagcatttaccgcaaaggggcggctccggccgaaccggcgggggatccggtcctttctatcaagctggtgccgaccaccgcttccgac

SEQ ID NO: 844 - DNA, 1230 bp, Unknown
  Description of Unknown: Firmicutes sequence
atgcaaaaacgtgcgtatatccatgcgatgctttcctatattgaagaccatttatcggaggacttgaaacccgaaagcatagccggcggacacttcatctcggtgagtcagttataccgggatttttacgcttttacaggccattccgttaaggaatacatccgtaaacgccgcatttcaaacgcttgtgaaaaaatcaagtgttccgagctgcctctcactgttatcgcggatgaaagcggatatcagacgatccaggctttttataaacagttcagaagcaccgttggcatgaccccactcgaataccggaggaacgacagctatttttatttttatccttttgtgctggatgaaatgagccttgccatcaaggtgggtatggaaacgattcctccatgcaatacgatgcgtttttacgattactgcctgaccggtattgaggacagggcgcttgcggcggcgggggagatttccggccgggttttcggccggaatggcaaacaggtcggaagccgattgtgctatgaagtgatgacggagaaacccggcgaaggcaacacggatctgtacgccacctgtaccgttaattataaagaatcagaaatcaacgacggatggaattatttgtatcataactggctttccgccagtatgttcgagaaatccggtgaccggtattttgaggaatatctctttcaaaacggtaaaccgcggaagttgaagttatacctgcctgtcaaaaaacgaaaaacggagcagcacattaccattacaacagaaccggagcggacatttatcgccgcgaaagagagtgggtataacgccgagagaaaagcctccgaaaaggtggtatcttttctgcaggagcaccatccattgctgattcgccatgcccaaaacttttatgtttgcatatatgacagcgtttatgcgtgcgggctcgaatgcggcggcggtttccggatgacggcactgccggagcagcatatgaacagcggagtgagcctcatccaaatgccggcgggccgatatgccgtactgccggacgactgttttggcgatatccgcatcggcagcgagaaaatggacttatggctgaaaaagaatgcgattctccatgaaggcgagcctgtttttgccgtttatacgattctgaacggcagatacgataacgaacacatccaaatgaggctgtataagcggttgaaaaatgacaaaaacggataa

SEQ ID NO: 845 - DNA, 1236 bp, Unknown
  Description of Unknown: Firmicutes sequence
ggcgtgatggaacgcaacgtttgcagcggggccttcctgctgctggacgcgacggtgaacccggctctccccgatgcggcggattcccgggcgggcatatacctgataaaaacgcagccgagcgccgtggattccgtcgggtccaaactgcattacctgcgcggcccggccggcatcgccagagaaaacggcatcgaactgttaggacaatggaaaatggaattcaacatccaaaaccaggcgtttttccgttcggtgatggaaacggcgcgggaacatcccgacctccccttgtcccgcctgtattactggacagaccggatcgtgctcgaggggaacagcgaaaccgggttcctgctctgcttgcccttgaggagcgcggacggcaccgtattcggggtttgcggcatcggggtgagcgaccggcttttcaaacaggcctacagcccggataatgaagcctttcctcacgtattcgcggcggcggcgccggcggaggaaacggtgctgcatctcgaccgggggatgcttgctgggaattcgtatctcaccagcgcccgcatggagcatccgtttcaaatccaatgcggcaaggagggcttctgcctctattcgggagaagacggcgccttcggcggtctccacaccgggctgaagctgtatccgtcggggtcggtctacgaagatcaggcgtgggcggtttcgatcctgatgccggagaagacgctggacgacgccattcaaggcaacagccggtatctgctgctcatcgctctcgtccttctcgccgtcagcctgcttctctccatcttcatcagccgccggtatctccgcccggtcactgaagcgctcgaccgcatcaaggccagggattacgcggggccggggaaaactccctacctcgaaatcaacgacctgatggaattcctcacccagcaggacgaagagctgaaaaaacgcagcctcgccatcgcctcgcccccggatgaaaccgcgcccatgttcgagcagttcctccaaaacgtcaaaaccctgtcccaggcggaacggaacgtttttgacttgtacatacgcggatacaaggcgcaggagatcgcggatgagctccatttgtcgatcaacaccatcaagacgcacaaccgccggattttcgccaagctgaacgtctcgacgcgcaaagagctgctggtttacatcgatatgatgaaagagctgaacatgatacacgaggagtga

SEQ ID NO: 846 - DNA, 1800 bp, Unknown
  Description of Unknown: Firmicutes sequence
aggagtgattcgatgctcaaattggtcaaatacctgaagacatccatcctgcccatcctgctcattgtgcttctgctggtggtgcaggccatgtgcgacctgtccctgcccgattatacggccaaaatcgtcgacatcggcatccagaagggcgggatcgaggacgcggtgccgacctatatccgccagagcgaaatggaaaagctctttttgttcatcggcggggaggaccggcaacgggtggaggcgtcgtataccctgctggacaaggacagcctttccgataccgtctacgacaagctgcggcgccagattcccgcgatcgaaacccagcccatctatgagctcggcaaggtcacagaggacgagcgggaaatcctcgatgggattttcaaaatgccgatgctgatcgtgtcgggattttccggcgggggcggcgcgtcggaggagatgctcgggatgttcgccgcagacatgccggacgggctgctcgagagcggccaggatatgttggcgttgttcgcggggatgcccgaggaagggcggctttcgatggtggatgccatcagggacaagatggccgtcctgcccgattcggtcctcgactcccgcgccgccgcctacctgaaggaggaataccgggcggaggggatcgacgtcgacgggatccagaacggatatgtgctgctttccggcgccaaaatgctcggaattgcgctgctgagcatggcggtgaccatcctcgtcagctttttggcggcccgggtggcggccgccctcggccgggagctgcggggacgggtgttccgcaaggtcgtgggcttttcccataccgagttcgaccacttctccaccgcctccctcatcacccggagcaccaacgacatccagcagatccaaatgctcttcgtcatgctgctgcggatcgtgttctacgcccccatcatgggcgtgggcggggtgttcaaggtgatgagcaccaatgcgtcaatggcctggatcatcggggtggcggtgctggcgatcatcgcgatcgtcttggtgctgtttgtggtggccatgccgaaattcaatctcatgcagaagctggtcgataagctcaacctggtcacccgtgaaatcctgaccggcctgccggttatccgggccttcagcaccgaaaagtacgaggaggagcggttcgacaaggccaaccgcaacctgacccgcaccaatctgtttgtcaaccgcgtcatgagctgcatgatgccggtgatgatgctggtaatgaacggcattaccctcttgatcgtctggaacggcggccatggcatccagaacggcactatgcaggtcggcgacatgatggcgtttatccagtatacgatgcaaatcgtcatggccttcctcatgatctgcatgatgtcgatcatgtggccccgggcggcggtgtcggccaggcggatcgaggaggtcatccagaccgaggcggtcatccgggatccggaggttcccgcctccttcgatgaagccaggaagggcgtggtggagttccgggatgtcagcttccgttatccgggcgccgacgaaaacgtgctcaccggcatcagcttcaccgccaagccgggcgagaccacggccttcatcggttccaccggcagcggcaaatccaccctgattaacctgatcccccggttctacgacgtgtccgagggaagcatcctggtcagcggcgcggatgtccggcaggttcccctccacgacctgcgcgcccggatcggctatgtgccgcagaaaggcatgcttttctcggggacgatc

SEQ ID NO: 847 - DNA, 1065 bp, Unknown
  Description of Unknown: Firmicutes sequence
atgtcaaacaggctttttcaaggtgttgtccatcaaatgcgggaggccattgaccgcaccattggtgtcattgatgaaacgctgtccgtcatcgcctgcagcgatctcgggcggatcggcgaggtgtccgatgctgtgacggccgagtccttttccgcgcaggacctgttcgtcaagggcggctatacgtataagccgttcggttcccgtccccgcgccgagcacatcctgtttgtggagggcacggatgaccaggcggccaagttcgcggcgctgctggcggtgtccctgtccagcatcaagcaatattatgatgaaaagtacgaccggggcaattttgtcaaaaatgtcattttggacaatatcctgcccggcgatatctatttgaaagcccgggagctgcgcttcaacaacgatgtcaaccgggttgtcctcctcatccggatttccgccagaacggacatctcggcctatgacattgtgcaaaacctcttcccggataaaaacaaggatttcgtcatcaatatcaatgagacggatatcgcgctgattaaggagatccgcgccggcatcgaatccaaggatttggaaaagctggcccgttccatcgtcgataccctgggcggcgagttctatacccaggctacggttggcatcggcaccgttgtcgaagggatcaaggacttggcccgttccttcaaagaggcccaggtcgccctggaggtcggcaaggtgttcgacacggagaagaacatcgtcagttacgacaacctgggcatcgcccggcttatctatcagttacccaccaccctgtgcgagatgttcctgcgcgaggtgttcaagaagggctccatcgactcgctcgatcaggaaaccctctttaccatccagcgcttctttgaaaacaacctgaatgtctctgaaacgtcccggaaactctttgtccatcgcaacaccctcgtctaccgcctggaaaaaatcaagcggttgacaggactcgacctgcgcgaatttgacgacgctatcgtgtttaaggtggctctcatggtgaaaaagtatctgatg

SEQ ID NO: 848 - DNA, 1002 bp, Unknown
  Description of Unknown: Firmicutes sequence
ttgcaaataaatccctttggtttcttcgttgacttcacattaaaaaatcggtatactgaaaaaaagatgcgcgaaaggagatacggcatgtcggaacagcctggagggatcccgtacgaaccagattcgttcaccaatatgataatttcggataaaaacggcaacaatctgatcaatatgggcaaacatcatatcgtggggccgtatgtcgcggaaatccacgtccatccccaattggaaatctcctgcgtccaactgggcgagtgcgcctatcatgtgggcgggcagttgtatgatatccgcccgggcgatattttcctcttcaacaacaccgacccgcacggcctggtgctgcaggaagggcagtctatcacccatctggtgattcatttcgatccgtccttcatctggaattcgctctccaacgacctcgattacaattttctcctgatcttttttgaaaggagccagaaattcagccaccggctggaccgggacaatccggcgacccatcggatcgccgagctgatgcaggagatttaccgtgagttcctcgaacggaacctctgctatgagctgatcgtcaagatcaagctgcagacgattttcaccgaaatcatccgcaactacgattacatcgacagcaaaaaagcaggccgtccgctgcacgacaccgatattgcgcagttgaacgcggtgctgcagtatatcaatgagcatctcgacggcgagctccgcctggcgcagcttgcctccatcgcccatgtcagccctgcgtatttttccaccctattcaaacggttcaacggcctctctccggtggaatatatcgtccacaagcgggtgcagcgggcgattgaatacatccgcaccacgagcatgagcatgaccgaggtggcgatggcctgcggcttcaacaacagcaccaatttttacaaatccttccgcaaggtgaccggccgaacgccggtgtcctaccggcaggatcccgggctgctgtag

SEQ ID NO: 849 - DNA, 1080 bp, Unknown
  Description of Unknown: Firmicutes sequence
atggcgcaaaacatggctatgtaccaggcgtacggcatggacccatgggcgcagaccgtcccctacggcgagggggacgccgccgaaaatatttccaccgccgagttcatcaaacggacggctcaggattccatcatccggcagaaggccatcgagaacctcctcgaacagaaaaacatcccgctcgacgcggaaaagctcgccgaggtggaggagacgctggccgagctcggatccaatgcctatatcgcctacggtttcaataacgagagctttgccaaaatgtacaaggccacccagctcaacgagtggtccctcttctacggcacctatgacaaaggcggtgtcaacccgatgtccgaagaggagatccggaagtatttcgacgacaatttcctcagctacaagatcatcgaattcaagctcgtcgacacctccaaccagccgctcgacgacgatgtcatccaggattaccgcgaccgcctggccaaatatttggctgaatttgaaaagctgggcgtgaccagcgacaatttcgacaccgtgatcaagatgaaggaagaggacgacatgcccgacgactccgaagatagcggctcttccggcgagtcctcttccactacgaccgcttcgtccggcacgacctccacttccgccaccgatggaaccaccgccacaacaggcaccggcgatgcaggggacagcggcgatacggaggacaccgattccaccaccgatcccaaccggcaggatatcgacgcgaatatctatggggatgaggatttcaccaacgcggtcaaaaaggtggagatcggtacggcctccatccaggaatataaaaagaacggcaccaccgacaccatcgccctgatttaccgcatggatccgcagcaggaccgcaaagacggcaaggatttcttcaccgaaaagcgcagcgacatcatctacggcgccaagtatgaggaatacgacaaggaagtcaccgactatatcaaaacgctggaggtttcctacgtcgaccgtgccatcaaggcctgtaagcccgaaaacttcgaagctgtcgctcgaaacaacgcctga

SEQ ID NO: 850 - DNA, 1245 bp, Unknown
  Description of Unknown: Firmicutes sequence
atgatccggaagctgcggcggaaatttgtcttgatcaatatgctgttcgtcagcgcggtgcttctggcggttttcgcgacgctctgcctgtcgacctatcgccagatccgcaccgacagcgacgaggccctcacccgtgccctcgccatggataccgctgggggcaaagccccgccccgttttgagatgggggagaggaagccggacaggcacacgcctttcctgccggttttctgtgtccggacgggggcggacggcgctgtctccgacatctacggggagacggtgagcgtcaccgacgaagaagccgcgcaggccgtctcccttgccttcgcacacggaggcaaaacgggtgtgctctccgggctcggactgcggtttttgagggaggaaacccctgcgggtactacctttgcttttgtggatctgagcagcggcagatccaccatgcagcggctgctgctgacttcactgctcgttgggatcggcgggctcacagctttttttgtcatcagcctgtttctctccgcctgggcactccgtccggtggaacgcgcctgggaacggcagcggcaatttgtcgccgacgcctcccacgagctcaaaacacccctaactgtcattcttgccaacaccggcatcctgctctcccatcgggaggacaccatcaatgcccagcggcagtgggtggaaaacaccaaggaggaagccggccggatgaaaaccttggtagacgagctgctttttctggcgagggccgacacggcccacaccccggctatgcttcccttggatctgagcgacgtggtgatgagccgtctgctcccctttgaatcggtggcgtatgaacagggactgacgttggacagccgggttgcccccggcatcaccgtcacgggggatgccgggcagctcggacagctgaccgccatcctgctggacaacgcctgtaaatacgccgaccgggagggtcgggtgctcctcacccttgataccgcccagtccatggcccggctgcgggtgcacaataccggcgtccccattccgcccgcgaggctcgagcacctgttcgagcggttttaccgggcggacgattcccgttgccgcgaaaaaggtggctacgggcttgggctttccatcgcgcagagcatcgtggaaacccacaaaggaaaaattacggtccgcagcggggaggaggggacggtttttaccgtcctgcttcccctgaaccggcaaagtgggtga

SEQ ID NO: 851 - DNA, 3924 bp, Unknown
  Description of Unknown: Firmicutes sequence
atgagctatgcaacatttgacgcaatcaaaatcggtattgcttccccggataagatccgtgagtggtcttacggcgaggtaaaaaagccggaaaccatcaactaccgcacactcaagcccgagcgcgacggcctgttctgcgaaagaatctttggcccgacaaaggactgggagtgccactgcggcaagtataagaagattcgctacaagggcaaaatctgcgaccgctgcggcgtcgaagtcacgcgcgcaaaggtccgccgtgagcgcatgggccacatcgagctcgccgcgccctgcagccacatctggtatttcaagggcattccttcgagaatgggtctgcttcttgatatcagcccccgcattctcgagaaggttctctatttcgccagctacatcgtcaccgaccccggcgactgcccgctgtcgaagaatcagatcctctcggaaaaagaataccgcgacatgcgcgaaaagtatgaggacgacttcaaggccggtatgggcgcagaggccatcaaggagcttctgcaggagatcgatctcgaatcgctctcgagccagctgcgcgccgaattgaaggacgcttccggccagaagaagcttcgcatcatcaagcgcctcgaggtggtcgagtcgttccgcaagtccaataacgatcccacgtggatgatcatggacgtgctgcccgtcatcccgcccgagcttcgcccgatggtgcagctggacggcggccggttcgcaacctctgacctgaacgatctgtatcgccgcgttattaaccgcaacaaccgcttaaagcgcctgattcagctctcggcgccggatatcatcatccgcaacgaaaagcgtatgctgcaggaagcggtcgacgcgctgatcgataacggccgccgcggccgcgccgtcacaggcgcaaacaaccgtgcactcaagtccctttccgacatgctcaagggcaagcagggacgtttccgtcagaacctgctcggcaaacgtgtcgactattccggccgttcggttatcgtcgtcggcccggaactcaagctctatcagtgcggcgtgccgaaggaaatggccattgagctgttccgcccgttcgtgatgaaaaagctcgtcgaggacggcctggccaacaacatcaagtctgccaagaagatgatcgacaagggcaaggacgaggtctgggacgcactcgaagacatcatcaaggaccgccccgtcatgctcaaccgcgcgccgacgctgcaccgcctcggcattcaggcctttgagccggtgctggtcgaaggccgcgcgctgaagctgcatccgctttgctgcaccgccttcaacgcggactttgacggcgaccagatggcaattcacgtgccgctgtcggcagaagcccaggcagaagcgcgtatgctgatgctctcggcgaacaacctcctgcgcccgcaggacggcaagcctgtcacggttccgacgcaggatatgatcctcggcacgtattacctgacctatcagcgctacgacatcgacgcgtttgagacgctgcatgagattttcccgctgctcgattgcggcaagctaaagcccgaaaagcccatttgggtgaagaacatctgggacgacgcagaagcggcagactatcagatgtaccttcgcacgaagggcgagctgctgcagaacgagacggaccgtcccgagacgattccgggctcttaccagacgctcgagcaggccgtgcaggcgctcgacaagggcgaaattgccgcggacgacgtgatttatatctggaacgtctgggacaaggcggccgatatcaaggaagaaaaccatatcttcgtgcgcaccgtcggcgcttacgccgaagaagcgtataacaacggcggctccaagccgaaggaatacttccacatgttccactccgaggacgaggccatgatggcctattccgacgggctcatcgacatgcacgacccgatcaaggtctggaaggaactcgaggtcgaaggccagaagcagcaccgcatcattgacgcgaccgttggccgcctcatcatcaacgatgcaattccgcagaacctcggctttaaaaagcgcgaaacggtggatgatatgttcgggcttgagatcgactttgtcgtcggcaagaagcagctcggcaagatcattgacaattgtatccgcatcaacggcttcaccctgtcgaccgaaatgctcgacaaggtcaaagcgctcggctacaagtactccacgagagcttccatcacggtctctatcgccgatatggagatcccggagaagaaatacgagctcatccacgaggcggaaaaagaggtcgtcaagatcgaccgccagttcaagcgcggctttatcacgaacgacgaacgctaccgcctgaccgttcagcagtgggagaagtccatcaaggacgtgacggacgcgcttcagtcgaacctgaagcggttcaacccgatcttcatgatggctgactccggcgctcgaggcagtatgaaccagattcgtcagctggccggtatgcgcggcctgatggcagatacgaacggccgcacgatcgaaattccgattaaggcaaacttccgtgaaggcctttccgctctcgagtacttcatttcctcccgaggcgctcgaaagggcatgaccgatactgcgctccgcacggcggactccggctacctgacccgacgcatggtcgacgtgtgccaggatgtcatcatccgcgagtttgattgcggctcgacgaacggcagctggaagggcgactactatgaaaagggtcagctgattgattcctttgcaaaccgcatccgcggccgctatccggtacacgacatcaccgacccgcagacaggtgagctcctgcactccaaggacatcatgctccgcgaggacgacgcgaagaagttcctggcgcatggcatcgacaaggtctatgtccgctcggtgctcggctgcaaggcacgttccggcgtgtgcgcgaagtgctacggcatgaaccttgcaacctccgagcttgtgaaccccggcgaagcggtcggcatcatcgccgcgcagtccatcggcgaacccggtacgcagctgacgatgcgaaccttccacaccggcggcgtcgcgggcgacgatatcacgcagggccttccccgagtcgaggaactgtttgaggcccggaagcccaagaagatggcgcagatctcggaaatcgacggtgtggccgatgtcgacgattcccacagaaccgcgcttcgcaacattacgatcaccgccgacgatggcgaggtcaagcagtatcaggtcccgtattccgtcggtcttaaggtcgagcatggcaagcgcgtgaagaagggcgatcccatcaccgatggcgcactgaacccgcatgacgttctgagaatttcgggcgtcgaggctgtgcaggactatctgacgcagggcgttctcgccgtgtaccgtcagcagggcgttgacatcaacgaaaagcatatcgaggtcatcatccgccagatgatgcgcaaggtgcgcgtggaagagccgggcgatacgaagcttctcagcggcacggtcgtcgatgtgtacgaatttgaagacgcgaacgccgaggtgcaggcacgtatcgatgcgggcgagaccgacctcaagctcgcgaccgacagcctgatcctcatgggcatcacgaaggcttcccttgcgaccgagtcctggctctccgccgcttccttccaggagacgacgaaggtcctcacggacgctgccatcaagggcaaggtcgaccatctggtcggcctgaaggaaaacgtcatcatcggcaagctcattcctgccggcgcaggtctgcaggcctaccgcgacttcgagcccggcgtgacgccggagtcggtggtcacggaagaaatgattgacgacgaaagaatgtaa

SEQ ID NO: 852 - DNA, 2079 bp, Unknown
  Description of Unknown: Firmicutes sequence
atgccaagacaatattcacttgagaatacgagaaatattggcatcatggctcacatcgatgcgggcaagacgacgacgaccgagcgtatcttgttctacaccggtgtcaattacagactcggcgagacccacgacggtacggccaccatggactggatggagcaggagcaggagcgcggtattaccatcacctccgctgctaccacctgccactggaagggcgtccggatcaatatcattgatactccgggtcacgtggactttacggtcgaggtcgagcgctcgcttcgtgtgctcgacggctccgtaacagttctgtgcgccaagggtggcgtggagccgcagaccgaaactgtatggagacaggctgacaaatatcatgtcccgcgccttgtttacgtgaacaagatggacatgatgggtgccgatttctacaatgtcctgaagatgatggacgaacgcctcaagtgcaatgcagttcccatccagctgccgattggcaaggaggatacattccgcggcgttgtcgacctcattaagatgaaggcatttatcttctacgatgatttgggcaaggatatgcgcgaggaagaaattccggcggatatggcggagcttgcgaagcagtaccgcgaccatatgcttgagtccatctcggacgaggacgaagagatcatgatgctctacctcgagggagaagagatccccgagcagatgattaagacggcgcttcggaaggcgaccatcggctacaagatcgtgccggtgacctgcggatcgtcctataagaacaagggtgttcaggagctgcttgacgcaattgtcgagtatatgccgtcgcctctggacaagaaagccatttccggcgtgaacccgaagaccgacgaagaggaaacgcgcgaaccgtccgacgacgcgccgtttgccgcgctggccttcaaaattatgacggatccttatgttggtaagctcgcgttcttccgcgtctactccggtacgctggagtccggcaagaccgtcatcaataccaacaagaaccagcgtgagcgcatgggccgcattctgctgatgcacgcaaaccatcgtgaagatctggactgtgtgtactcgggcgatatcgccgcagcagtcggcctgaaaaacaccacgaccggcgatacgctctgcgacgctgcgcaccccatcatccttgagtcgatggagttccccgagcctgttattcgcgtggccatcgagccgaagacgaaggcgggtcaggagaagatgggtctggcgcttgccaagctcgcggaagaggatcccacgttcaaaacctacaccgatgaagagaccggccagacgattatcgcgggcatgggcgagcttcatctggaaatcatcgttgaccgcttactgagggagttcaaggtggaggccaatgtcggcgcgccgcaggtcgcctataaggagacgattacaaagtctgtcttccaggagaccaagtacgccagacagtccggcggcaagggccagtacggccatgtcaagatccaggtggaacccaacgaaagcggcaagggctttgagttcatcaacaagaccgttggcggctcggttccgaaggaatacattcctgcggtcgaacagggcgtcaagggcgcgatggagtccggcgtgcttgccggcttcccggttgtggacgtcaaggtcacgctgctcgacggttcgtatcacgaggtcgactcgtctgaaatggcctttaagatcgccggatccatggcgttcaaggaggcgtgtcagaaggcaggtcctgtcgtgctcgagccgatcatgaaggtctgcatcattgtcccggacgagtatatgggcgacgtcatcggcgatgtcacttcccgccgcggcacgattcagggcctgacgcagcgcaatggcgcgcagcaaatcgactgctttgtcccgctgtcggagatgttcggctacgcgacgaaccttcgctcccgtacgcagggacgcggccagttcaccatggagcccagccactatgtggagctcaacaaggcgctgaccgaggcggttgtttccaagcgcaagggttattga

SEQ ID NO: 853 - DNA, 1401 bp, Unknown
  Description of Unknown: Firmicutes sequence
atgaaaaaagttcaaatcactgaaactgtccttcgtgatgcgaatcagtccctgatggcaacccgtctgccgtacgccgattttgaggaaattcttcccgaaatggacaaggccggttattattcggtcgagtgctggggcggcgcgacgttcgactcctgccttcgctatctcggcgaggatccgtgggagcgcctgcgcaatatccgcagactgatgcccaacacgaagctgcagatgctccttcgcggccagaacctgcttggctacaagcactatcatgacgacgttgtggaaaagttcgtcgagctgtccatcaaaaacggcatcgacatcctgcgtatcttcgacgcactgaacgacttccgcaacatcaagaccgctctcgaggccaccaagaagtacggcggcaagaacaccgtcgcttccggctgcatctcctacacgcagagcccggtccacactgtggaaaagtacgtcgagatgtgcaaggagctcaagaccatgggcttcgacaccatctgcctgaaagacatggcgggcacgatgagtccctatgaggcagagcacctcatcaagggcatcaaggacgcagtcggcgatatgccgctcatcctccacacccactgcacgaccggtatggcctacatgaccgtgacgaaggccatcgagtccggcatcgacgtcatcgactgcgcgacctcctgcttctccaacggcacctcgcagcccgcgaccgagacgatgttctacgcgcttcagcagtacggcatcaaaactggcctcaacgaggacgtgatcaacaaggtcaacgatttcttcaagcccgtcaagcagaagtacgtcgactccggccgtatcaacgccaagtccatggcgaccgacgcgcaggcgctggtttataaggttcccggcggcatgctttcgaacatgatcgcgaacctcaccgacatgaaggccatggacaagttcgaggccgctctggcagagatccccgccgtccgtaaggacctcggctatcctccgctggtcaccccgctgtcccagatggtcggcaaccaggccgttaccaacgtcctgctcggccagcgctacaagcaggtctccaaggaagtcaaaaactacttcaagggcgagtacggcattgcgcccgctcccgtttccaaggagctcgagacgcagatcctcggcgagggcggcaagcctgttgactgccgcatcgaagacgcaaagcgcaccggtgaggacttcaagaaggccaaggaagcgctcggcgatcttgcaagaagcgaagaagatatcatgagctacatctgctatcccgatcagaccatgaagttcctcaccgaccgcaaggccaaggaagagaacatctgcaagtactcgatcgtcgaagcgtaa

SEQ ID NO: 854 - DNA, 2139 bp, Unknown
  Description of Unknown: Firmicutes sequence
gtgcgcggattgcgcgcggaaaaggaggatgcagacatgagtgaactggccaatcgaattcctgccctgtttggcagctgcgtatttaatgaggagacgatggagcagtacatccagtcctccgccatggacgcatggcgctcgtgtttgcaggagggcaaggcgctgagtctcgccgtcgccaacgacatcgcggacggcatgaaggcctgggccttagagcacggcgcgacgcattttacccactggttccagcccatgaccggctacaccgccgaaaagcacgacagctttatttctcccgccggacacggccggattgtcatggagttttctggcaaggagctcgtgcgcggcgagccggatgcgtccagcttcccctcgggcggcctgcgtgcaacgtttgaggcgcgcggctataccgcgtgggaccccacggcctacgcctttttgaaggacaacacgctctatatcccgacggtcttcttctcctactccggagaggcgctcgataaaaaaacgccgcttctgcgctcgatcgacgcgatgagccggcaggcggtccggattctccgcctcttcggcgacacgaagaccaaaaaggtttcagcaaacgtcggccccgagcaggaatatttccttgttgataaggagctctatttaaagcgcgaggaccttcgcatgtgcggccggacgctcttcggcgcaaagccccccaaggggcaggagctggacgatcattactacggctccattcgcccgcgcgtgacggcctatatgcaggacctggacgaagagctctggaagctcggcatctactccaagaccaagcacaacgaggtcgcccccagccagcacgagatggcccctgtgtactgcgactgcaacacagcctgcgaccagaaccagctgacgatggatatcatgaagaaggtcgctgaccggcacggcctcgtctgcctgctgcatgaaaagcccttcgcgggcgtaaacggctccggcaagcacgacaactggtctttatccaccgactccggcgaaaacctctttgcccccggcaaaacgcccagccagaacgcgcagtttttgctgttcctcacggccttcattgagggcgtcgacgagtatcaggagctgcttcgctcgacggttgcgtttgccggaaacgaccatcgcctcggcgcgcaggaagcgcctcccgccgtcatttccatctatcttggagacgagttgagcgacgtcattgactccatcatcggagagaccgactacaccgaccgcaaaaagggcgcgcttcgcatcggcgtggacgttctgcccacgattccgcaggacacgaccgaccgcaaccgcacctcgccccttgccttcacgggcaacaagtttgagttccgtatgctgggctcgagccagtccatttccgggcccaacatcgtcctcaacacgatcatggcagaatcgctccgcaaatacgcggacgttctggaaaaggccgagaattttgagacggcgctccacaccctgatccgcgacgcgctgcgcgagcaccgccggattttatttaacggcaacggatatgagggaagctggctcgaggaagccgcgcgccgcggccttgcaaacctcgtctccaccgccgacgcgctgcccgcgttcattctggagaagaacattgaccttctgtcccggcacggcgtgttcagccgcagcgaaatgatggcgcggcacgagatccacatggaaaactacagcaaggttatcaagattgagacctctacgctcatcgacatcgtccagcacacgctgttaaatgccgcaacggcttatacgcgcgatctttgcaccacgattttgcagaagaaggccgcgcttccgggcgaaacctgccgggtggagtccgcgctcgccgcgtccgtcagccggttgggagaagacctgctcgaccgctgcgccgcgctcaagaccgcgctcgacaccatgcccagggaccttgacgcggaagctgagatgcactactgccacgaccagttagtgcccgccatgggcaaggtccgcgagacgatcgaccatctcgagacactcgttgccagcccctattggccggtccccacttattgcgatttacttttctctgtttaa

SEQ ID NO: 855 - DNA, 1971 bp, Unknown
  Description of Unknown: Firmicutes sequence
ttggattataccaagtacgtgttaaagagccaggaagagcttgaaggcatgctggcggggaaggacaatctcttcgtcgtcgcctgcaacaagtgcttcaaagagttcgaaaccacgcaggagccggattgcggctgctttaccgccatcgctgaggcgcagggcaagcacatcaccggttctgtcaaggtagacttcctgtgcaacaaggtccagaccgaaaaaacgcttgcaggccttgtccccgagggaacggaaaacgttgttgtcgtttcctgcggactgggcgtgcagacggtggccgatcttgctgcggttcccacgtttaccgcaaccaattctctgaattatgtcggccatcatggcatggcgctcacgaagaagacctgcggcgcctgcgcccagtgctatctgaacgcgacaggcggcatctgtcccatcgtggactgctcgaagagtcttgtcaacgggcagtgcggcggcgcgaaaaacggcaagtgcgagatcgatcccaaaaaggactgcgcttgggagaagatctatcagagactcgaaaagcagggtcggacgaaggaattcctgaaccagccggtgcagctgcgggactactccgtggctagcgtcgatgagatccaggcctacgtcgccgaagccagagccagacgctttgagggcttctacggcggcgtgcatcccaccgagcacaaggattataccgagcatctggcgctccagaagttcccggagcccgatactgtcattctgccgctcgccatgcacatcggcgcgcccgcaaatccggttgtgaaccccggcgactatgtgaaggtcggccagctcatcggcgagcaggcgggctttatcggtgcgcccgttcactccagcgtcagcggtacggtcgtggctgtcgagccgcacacgcatccgaacaagggccccggcattctgagcgtcgttatcaaaaacgacggcaaaaacgtgctccatgaatccgtcgttcccaacaagcccctcgaggagctgacggccgacgagatcatcgagatcgtcaaggaaaagggcatcgtcggcatgggcggcgcaacgttcccgacctatgtcaagctgaagcccggcaagcccattgacgcggttctcatcaacggctccgagtgcgagccctacttaacggcggaccaccgcatcatgcttgagtacgccgacgacatcgtcttcggcctgcgcgccatgatgaaggccgtttccgcgcccgagggcgtcatcctcatcgaggacaacaagcccgacgccgtggcgctcatggaagagaaagtcgcgccctacgataacatccgtgtggtcgctgccaagacgcagtaccccgagggtgctgaaaagatgctcatcaagaaggtcatgggccgtcaggttcccagcggcaagctgccggcagatgtcggctgcgtcgtgagcaacacctcgaccgccaaggccatttccgacgcgatccagaagggcatgccccttgttgagcgcgcggtatccgtcacgggcgacttcatccgaaaccccggcaactacatggtcaagctcggcaccaacgtccaggagatcatcgaccactgcggcggcgtgacgggcgaggatatcgtcctcaagatgggcggccccatgatgggcgctcccatcaatgacaccaacgttcctatcatcaagggctccaacggcatcatcgccattgccgccgaccacacggaggaaaaagagtgcatcaagtgcggccgctgcgtagacgtctgtcctatggagctgaagcccttggaattctacaagtacggccagctgggcgacgcggagaagcttttgtctctcaacatcatggactgcttctcctgcaagtgctgcgagtacatctgctcgtccaagattcctctggtatcgaaaatcaacgccgccaagggtctggtcatgcccctgctgaagaagaaataa

SEQ ID NO: 856 - DNA, 3306 bp, Unknown
  Description of Unknown: Firmicutes sequence
atggacggcaacaatgctgcggctcatgtatcctatgcgtttactgaagtcgcgggcatttaccccatcacgccgtcgtcccccatggcagacctggttgaccagtggtctgctaccgggctcaagaacatcttcggctccaccgtcaaggtcgtcgagatgcagtctgaggccggcgcatccggcacagtgcacggctccctcggcgccggcgctctgaccaccacctacacggcgtctcagggtcttctgctgatgatcccgaacatgtacaagatcgccgccgagcagctgccctgcgtgttccacgtttcggcacgtaccatctcgacgcacgctctgaacatcttcggcgaccattccgacgtgatggcttgccgccagaccggcttcgccatgatgtgcgagacgaacccgcaggaagtcatggatctggctcccgtcgcgcatctggccgcgatcgaaggcaaggttccgttcctgaacttcttcgacggcttccgtacctcccacgagatccagaaggtcgctgtctgggactatgccgacctcaaggaaatgtgcaacatggaggctgttgcggccttccgtcagcacgcgctgaaccccgagcatccggccatgcgcggctctcacgaaaacggcgatatcttcttccagcaccgtgaggcctgcaacaagttctataacgagctgcccgcagtcgttgagaagtacatgggcaaggtcaacgaaaagctcggcaccaactatcagctcttcaactactatggcgcgcccgatgctgaccgcatcatcatcgccatgggctccatctgcgacgtggcagaggaagtcatcgactacatgaacgcgcacggcgagaaggtcggtatcgtcaaggtccgtctgtatcgtccgttctgttccgacaagctggtcgcggccatcccggcaaccgccaagaagatcgccgttctcgaccgcaccaaggagcccggctccctcggcgagcccctctacatggacgttgtcaccgcacttgccaacgccggcgtgcaggctaccgtcatcggcggccgctacggtctcggctccaaggacacgccccccgcatccgtcttcgctgtttacaatgagctcaagaaggatcagcccaagcacgagttcaccatcggcatcgtcgacgacgtcacgaacctctccctcgaggaagaccgcaactgcccgaacaccgcagcagaaggcaccatcgagtgcaagttctggggtctcggcggcgacggcaccgtcggcgcaaacaagaactccatcaagatcatcggcgaccacaccgacaagtatgtccaggcctacttccagtacgactccaagaagaccggcggcgtgaccatcagccacctgcgcttcggcgacaagcccatcaagagcccgtactacatcaacaaggctgactttgtcgcctgtcataacccgtcctacatcaccaagggcttcccgatcgtccgtgacgtcaagcccggcggcgtgttcatgatcaactgccagtggacgccggaagagctcgctcatcatctggacgctgcttccaagcgctacattgcaaagaataacattcagctctacacgatcgacgccattgatctggcacagaagatcggcatgggcaagcgtaccaacaccatccttcagtccgcgttcttctcgctggccaaggtcctgcccgaggcagaggccatccagtacatgaaggaaaaggcaacgcagtcctactctaagaagggcatggacgttgttgagatgaaccacaaggccatcgatgccggcgctactgcgtacaagaaggtcgacgttcctgccgactgggcaaatgcagaagacgttgctgccgaccacaagctcgaaggcaagccggagcttgtcaagcaggtcaagaacctcctgttcccgatcgacaagatggacggcgacagcctgcctgtttccgcgttcatggatcatgtcgacggcgagttcgagcttggtgctgccgcttacgaaaagcgcggtgtcgccgttgccgttccgacctgggactccgcaaagtgcatccagtgtaacaactgcgcttacgtctgcccgcacgcgaccatccgtccgtttgcgctgaccgaagaagaagcaaagaatgctcccgcagctgccaagatcgttccggtcaaggccggcaagggcaagggcgtttatcagttcaccatggccatctccccgctcgactgcatgggctgcggcgtctgcgtcagcgtctgccccgagaaggttcaggccatcaagatggttccgcaggaagaagagctcgcccagcaggatgtgttcgactactgcgtttccaaggtttccgagaagaaggaactccagactgccgacgtcaagggctctcagttcctcaagccgctgcttgagttctccgtctcctgcgcaggctgcgccgagacgagctacgcacgtctggtcacgcagctctacggcgaccgtatgtatatctccaacgctaccggctgctcgtccatctggggcggtccgggcgctacctctccgtactgcacgaacgctgagggtcagggtcccgcatggtgcaactccctgttcgaagacaacgccgagcatggcttcggtatgtacgtcgcacagaaggcaatccgcacgcatctggctgacctcaccaagcagctcatcgctgtcgactataccgacgccgatctgaaggctgccgcgcagaagtggctcggcaccatggaagacggcgacgcgaacaaggccgctaccaaggcttatgtcgcagagcttgaagcttccgtcatttccggctgcgattgcgacgcctgcaagctgggcgctgaaatccttgccaagaaggattacctctccaagaagtccgtctggatcttcggcggcgacggctgggcatacgatatcggcttcggcggtgtggaccatgttctcgcttccggtgaagatgtcaacgtcttcgtcttcgataccgaggtttactccaacaccggcggacaggcttccaaggcttccaacatcggtcaggttgcgcagttcgcagctgccggtaaggaaaccaagtcgaagtccctggcggagatcgccatgagctacggctatgtctacgtcgcgcaggtcgccatgggcgccaacgccgcgcagaccctcaaggccatccaggaagcagaagcttaccatggcccgtcgctcatcatcggctacgcaccctgcgagatgcactccatcaagggtggcatgcagaactgccagaccgagatgaagaaggctgtcgactgt

SEQ ID NO: 857 - DNA, 1779 bp, Unknown
  Description of Unknown: Firmicutes sequence
atggatatggagccagacatgagtatttcaaatgtgatttctctgctcagcggtatcgcactgttcctgttcggcatggcgctgatgggagacgggctgaaaaaagtcgcgggcaacaagctggaagtgatcttatatcagttgaccggaaagcccctcaagggctttttgcttggtacggcggtgacggcggtcatccagtcgtcgtcggcgacgagcgtgatggtggtcggctttgtcaactccggtatgatgcgcgtgcggcaggccatcagcatcgttatgggcgcgattctgggcacgagcatcacgggctggatcatctgtctttccgacctcggcggaggcggcgggtggatcgaccttttttccacggcgacgctcacgggggtcatttccgtggtcggcattgtgcttcgcatgttctccaagaaccagacgaagcagcacgtgggcgatattctcatgggcttcgcggttctgatgttcggcatgtcgacgatgtcggcggcggtgtctccgctgcgcgacgagccggtcttccttcgcatcctgacctcgttctccaacccgctgcttggcattttatttggtacgctctttacctgcgtgctgcaaagcgcgtcggcggcggtcggcattttgcaggcgctggcatctacgggcgtgatcgatttttccatcgcccttcccatcatcatgggcattgccatcggcgcggcgctgccggtgcttctgtccgcagtcggcgcgaacgttgacggcaagcgcacggccatggtctatctcgtggtcgaagtcgcgggcgttgtgttctgggcggcggctttttatctcgcgaacgccgtgttccggttcaattttatggatatgccgatgacgagcgtttccatcgcgtttgtcaacaccctcttccgctttgtgaaggtcgtgatcctgctgccgtttacggatgtgattgaggcagttgtgaacgcgctcgtcaaggacaagggcgaggaaaagaacgccaacgagcccgccgcgatgcacctggaagagcgctttttgcagcacccggcgcttgccatcgagcagagccgcatcacgatcaactccatggccgccgacgcggagctcaacttctcgggcgcgctggcgcttctggaaaactactccgacgaggactttgccgaggtgcagcggatggagggcgtgatcgaccggtacgaggacattctgggcacgtatcttgtcaagctgaccggccgcgagctcaccggccgccagagcgcggacgtttcgaaattcttgcatacgatctccgattttgagcgtatctccgaccacgcgctcaatgtcgccgaggctgcacaggagatccaccagaaggggatcactttctccggcgacgcgcggcacgagctttccgttctgacagacgccctgcgcgaaattctgcacaacgccatccgcgcatttattatggaggaccttgagcttgccaagagagtcgagccgctggaggagctcatcgacgcgctgtgcgacgagatgaagctccatcatgttgacagacttcaaaagggcgtatgtacgctcagccagggcttcgtcttcaacgatcttctgaccaactacgagcgtgtcgccgaccactgctccaacatcgccgttgcgatgatcgagcttgaggcagactcgttcgatacccacgaatatctcagcagcgtcaaggccatgaaatccgcggcctatgagcgctattatgaggaataccggcagcagtttgcactgtaa

SEQ ID NO: 858 - DNA, 1830 bp, Unknown
  Description of Unknown: Firmicutes sequence
atgaaccaatcctcaaccctccgcgcaagtaaaacgaccatcgcgctcaacaaggtcaaaaccttcttttcaaagccccacaacgtcattcttctgctgctgggtatcgttctgaccttcaccaccgtcgcgcccatcgtcgccatcgtggaagacaccttcaagatccacgccggcactatcgacgcgcacctgaccggtcaagcctccggctacaccacggtcaactacattgacctcttcaccagccgcatggccaagacaaacctctggacgccgcttggcaacactgtcctgctcgctgtcggcacgtgcgtcgtctccatcttatatggcggcctgttcgcgttcctcatcacaaggaccgacctcgcctggagaaaatatttaagctccattttcattttcccgtacatcatgccgcagtggacgctcgccgtcgtgtggcagaacctgttcaattccaacgccgttaccggcacgtccaacggtctgcttgccgccctctttggcgtcaacatgccgatatggtggtgcaagggcctgttcccgagcctcatggtccttggccttcactacgcgccgtttgcttacattttaatcggcggcatcttccgcaacatggacgcgaacttagaggaggccgcaaccattctcgatacccccaagtggaagaccatgttccgcatcacgctcccgatggtaaagcccgcgattttgtccacgatccttctcgtcttcggaagcgccatgggctcttacccggttccccattacctcggcctcagcacactctcgacaaaatacgtctcgatgaactccaagtataccggcgaagcgagcattcttgccatcatcatgatgatcttcggcgtggcgatcatgctgctcaaccagctttccttgagaagccgcaagaactacaccaccgtcaccggcaagtccggccagatctccaaaatcacgcttggaaaatacggcaagtacatcatcgccatcattcttgtcatcctcacgttcttcacgagcatcttccccatcatctcgtttgcgtttgagaccttcctcccgaacccgggcgactattcgttcctctatacgggagacgcttcgaacctcacgaccaagtggtggctcaccagcgaaaacgtcactgaaaacggcatgtacggccagaagggcatcttgtataacgagacgatctggcgcgcgttcaagggaacgatcctcgtctccgtcgcctgcgcgctgctcgccggcaccatcggcacgatgatcggctacgccgtctccaaaaaccgccgcagccgctgggcaaactatgtaaactccgtcgcgttcctgccctacctcatgccgtccatcgccgtcggcgtcgcgttcttcatcctgttctcaacggaaaagctgaacctcttcaatacctatacgctcctcatcatcgtcggcaccgtcaaatatatcccctttgccagcaggagcagccttaactccatgctccagctctcgggcgaaattgaagaggccgccatcattcaggatatcccttggatcaagcgcatgacccgcatcatcatccccattcagaagtcctccatcatctcgggcttcctgcttccgttcatgacgtgccttcgcgagctgtcgcttttcatgctcctttgcgtgcagggcttcatcctctcgaccacgctcgactacttcgacgaaatgggcctctacgctttctccagtggtatcaacctgattctgatcattacgatcctcatctgcaacacgctcgtgaacaaagtcaccggcgcaagtctcgacaagggaataggaggttaa

SEQ ID NO: 859 - DNA, 2667 bp, Unknown
  Description of Unknown: Firmicutes sequence
atgagcgaactgaaacggacgattttgtaccaggcacatctcgacgcaggcgcgaccatggtcgacttcggcggctgggatatgcccatccagtatcccgaaggtatcatcgcagagcatctctactgccgccgtcactgcggcatctttgacgtgtcccacatgggacggatcgacgtcgaaggccccgatcaggtagcgttcttgcagcatgtgctttccagcaacgtgcttgcgctcgacctcaatcaggcgcagtactgcatcatcccggacgcgaacggatacgccattgacgacgcgtacctgtaccgctttgaagagggcaagtacttcctcgtcatcaacgccggcaacatcgacaaggactgggcacacctgatgaacgaagcgaagaactttgacgtcaagctcacgaacgtctctgacaagtacgcggccatcgccgtgcagggcccggagtccaagaagatcctcatgacgctttccggcggccgtcagctgacgcccgagaacgtcaagaacgcgctgaacagcctgacgatggaaggcaagcccgtccgcatcgcaaagaccggctacaccggcgagcccatcggctacgagctgtactgcaactcggaagatgcgcggtacttctgggaccgtctcatcgagcttggcgcaaagcctaccgcgctcggcgcacgtgacaccacgcgtatggaagccgcgctcccgctctacggccacgaaatgggcgagtgcgaaatgggcggcgagatccagatctacgccgtgccgctggcaaagttcgctgtttccttcgacgaggccaagggcgatttcatcggccgcgaaccgctcaagaagcagtttgaggcgctcaagaagatcatgaaccgcgactattcctcgatcgaggacctgccgtaccgcatccagcccatctatctcgagggcaagggcgttctgcgtaagggcttcccgatctactgcaaggacgcatgggctgagggcaagcagatcggctatgtcacctccggcaccatgatcccgtattacaagaccgagggccagggtcttgagagcgtcttcaccgacgagaccggcaaacgctcgatcggccttgcttacatggacagccgcatctgccaggacttcgacattgaaatcgacatccgcggccgccgtcagcctgcaaaggtcgtcggctaccatatccgtcaggacgccgcgccctatgtccgcccgatccttcccgatgtgaagatcgaaacggcttctcccagcaccgattcctatcccgagaagatgaagaacctcgtcgccgccgccaagcagaaccatctgtggcgccagaccgagtgcatcaacctcatcccgtcggagaacacgcagtccagagccgtccggatgctctccgcgtccgacccctgcaaccgctacgccgagcacaaaaagcagaaggcgttctacgacgcagagattttctactatcagggcacgggcttcatcgcttccgtcgaggcgatgctcgttgaggaaatgaaaaagttcctcggcgcatcgcaggtagaaacccgcgtcacgtccggtcagatgtcgaacacggcggtgttctcggcgatgatggactttaaaaaccgcgtcgaccgcaagcgcaccccgcagcgcctcggctgggtcatgaacaaccacatcgtccgcggcggccacctctcggcgcagcccatgggcgcgttccacgactacgtcgccatcgaccccgtcacggaaaagcagatggtcgtcaacttcccggtctgcgaggataacccctacaagatcgacgtcgagaagacgaaggttctgctcgcgcagtacaagcccgagttcatcatcttcggtaagtccatggtcctttataaagagccggtcgccgagatccgcaagtttgtcgatgagcagggcatcaagaccaccatcatgtacgacatggcgcatgtgctcggcctcatcggcgatcatttccagaagccgtttgaagagggcgcagagattgtcacgggctcgacccacaagaccttcttcggcgcgcagcgcggcgtcatcggcgtcaactacaagcccgaggacctcaagtggggcctgtgggagaccatcgaaacgcgcaccttcccgggcagcgtctcgaaccaccatctcggcacgctccttggccagctgatggcagcgtacgaaatgaacgcgttcaaggacgagtaccagaaggccgtcgttgaaaacgcaaagcactttgcaaagtgcctggccgccgagggcctcgacgtggcgggcgatcctgccatggattacaccgagacgcatcaggtcattgtcaaggtcggctatgcgcacggccccgaggttgccgatcgtctggaggccaacaacatcgtctgcaactatcaggcgacgcccgaggaggaaggcttctccgcttccggcgcgctgcgtatgggtgtgaacgaaatgacccgcttcggcttcggcaaggaagacttcgcgaagctggcgcacctgatcgccgactgcgtgctgcatcacgcaaacgtcaaggaagaggtcaagaaactccgcgcagagcatctggagatgaagtactgcttctccgacaaggataccgaagagcttctgaacgccttcgcttccgcaacgggcatctga

SEQ ID NO: 860 - DNA, 2058 bp, Unknown
  Description of Unknown: Firmicutes sequence
atgattttggtaggaggaaaaggaatcatgaaaacaagtaaaagattactgagtatcgtcctgatgctcgccatgcttgtgagtatgttcacagtcatggcctttgccggcgataaggtaaaagttacctttgatattggcaagggcggaacagcctcgatcggaaataaaacactgaaaagcagagagtatagcttcacgcttgcggaaatcaacaacgcgtatgtcgttgtgagtcccaagtccggctacgtcgcggacgtgacgatcggcgacacgaagctggatcaggcgcaggcaaactatggcttcagcctgtcgtccgatatggatggcaaaacgatcaagattacctttagcgagaaggatgccggcggagaacccgaacccactcccgatcccgaaccctctacgaatgttaatctgagaatcggcatgtgggcaagcgatgttcagaacgccgaaatcctgcgcgatggcaaagcgcttgacatcacgacagcagtttcctttactcaggaagagctcaatagaggcgttacgctgacagctcgtgcagacaacaaaacgtattcggtcaagtggacgctgaacgaaggtgcgccggtagaaggcaaaacgttcacgcttccgacagacctcaagggtggcagcaagttgtttgttgagtttacggtcgacaccaagccggagcctgaaacaaaacatacgctgacggtttcctcgaaagatgactcgatgggtcttatccagtatggtgagaacgagaagaaatccattgacttcagcctcgaaaagaaggaaaaggttactgtaaaggctgttgccaagaagggttacgagtttgtcgagtggagatcggatgacatcaagcttacccccagccagaagcaggatgccacgctgaaaatcactatgcccgacaatgacgtcaaggttacggctgtgttccagaagaaaactgtttccggagactacaagctgacgctcgacgtgagcagacatggcgacgtttatgagaacagcacaagaggcgacgccgcgaagagctattactggctcgacgatgacgacgagctcaccttcaaggcagttgccgacaagggctacgaggttcgttggcgcattgacaagggcagatggaactacacctcgaagatcaccgtcaacgcgcgcgacatgggctgggacaacgcgacgcttgatatcgactttgtctcttccagctccacgcctagctccaagaactacacactgagcatcgacatcaccggcggcaagcacggcacgctcagctacaagaacagcaccgtttccgacggcaagacctactccctcgaaaagaacgacaccatgaccttcaaggcagaacctgataagggctacgtggcggcatggaagttcggcaccgagacttatgtcggcagcagctacaccgtcaagatgggctcaaaggacgcgacgctctatgtcagcttcgttgacaagaatgactatcgttggggaaatctgccgttccacgatgtgacgaaccgcgactggtactatgacgacgttctgtacgcctacatcaacggcctcatggacggcatctccatgacgagcttcggcgcggaccagaacaccacgcgcggccaggtcgtcaccattctgtggagactgaccggcgaacccagagcggccagaaacaaccagttcacggacgtttcgtccaacgcgtattacaacaccgcgatttcgtgggcagccgagaacggcatcgtcaagggctatgattccaagaccttccgtccgaacgcgaacgtcacccgtgagcagctggcagcgatcctgtaccgctacgccgagtacatgaacctttccacgagaggcgcttccaacctcaccaagttcgatgactactactccatcggcacgtgggcaagagactccctggcctgggcaaactaccatggcctcatcaacggcgttgacagctaccacatcgacccgaagggcaacaccacccgcgcacagctggcagccatcctgcaccgcttcgccgtggaattcgcctga

SEQ ID NO: 861 - DNA, 2184 bp, Unknown
  Description of Unknown: Firmicutes sequence
atgaagaaacttgttgcacttctgctttgcctcatcatggttctgagcctcgggaccacggctctcgcggcagacggaaaatccaacgacattgtcatcctgcacaccgacgacgtgcactgcggcgtatccgacggcatgggctatgccggcgttgcggcgtacaaggccgagatggagcagacgcacaattatgttgcgctggtcgactgcggcgacgcggtacagggcggcgcgatcggcacgctttcgggcggggcgtatctggtcgatatcatgaacgagaccggctacgactttgccaccttcggcaatcacgagttcgactacaagatcccacagttgaccaagctgaccaagcaggccaagttcaaatacctcgcctgcaacttcaagtacctcggcaagggtacgtccgacatcgcctacaagccgtatgagatcgtcgattacggcggaaccaaggtcgcttacatcggcatcgccacgccggagtccttcgtgaagtccacccccgcctacttccaggacgcaaacggcaactacatctattcgttctgcgaagacgacgacggctcggcgctgtataaggctgtgcagaacactgttgacgaggtcaaaaaggccggtgccaactacgtcatcgctcttgctcacctcggcaacgaaggcacgaccgaccgttggagctccaaggctgtcatcgccaacaccaccggcatcgacgcgatgctcgacggtcatgaccacctgacgctgacgacaaaggtctctaacaaggacggcaaggaagtcatcctcgccgaggctggtcaggaagagggtaagctcggtatgcttggcaagctgaccatcgccgctgacggcacgatcacctccgagctcatctccgccaaggatttcaccaaaaaggatgaaaccgttgcggcgtatgtcgaaaacatccagaactccttctccgacaccgtttccaaggtcgtcgccaagagctccgttacgctcaatgactacgacgaaaacggcaaccgccttgtccgtaattccgagaccgcgctgggcgatctcgcggcggacgcttaccgcgtcatgatggacgccgacattggcatcatgaacggcggcggcctgcgcgctcccattaaagaaggcgacatcacacttaacgacatcctcaccgtcttcccgtggggcaacctcccctgcaagatggaagtgaccggccagaccgttcttgacatgctggaaatgggcgcaatcaagtacccgtccgagtccggcggcttcctgagcgtctccggcctcaagtacaccatcgtctcgagcatcccctcttccattgagctgagcgacaagggcgagttcgtcaaggtcgcaggcgcgcgccgcgtgcagaacgtccaggtgctcaacaagaagaccggcgtctatgagccgatcaaccccaacaagacctacaccctcggcggcatcgactacaccatcacctactgcggcgacggcttcacgatgttcaagaactccaaggttctcaaggccggtgatgcgaccatgaccgacgcgcagacggttctttcctacattgagaccaagctcggcggaaccatcggcgagcagtattccaagcccgctggccgtatttccatcgtgaagtacaccgacgttgtccccggcaagtggtatgagaaggctgtcaactatgtcagcgacaacggcctcatgaacggcgtcggcacaggcttcaatcccgacggcgctctgacgcgcggcatgctcgtcacgatcctctaccgtcaggccggttcccccgctgtcgagacgaaggtctccgccaagttctccgactgcgaggaagacagctggtacgcacctgctgttgtctgggccgctgaaaacggcatcgtcggcggctacgcggacggcacgttcgcgcccaacaaggccatcacccgtcaggaaatggcgaaggtgctctatggctatgacaagaccatcagcaaggccaagaacgaggcggcaaccgagctgacctacaccgaccttacctccatcgcggactgggcgctcgagggcgttcactactgcacggcggccaagtacctttcgggctcgaacaatgcgttcaaccccaacggcacggccacccgcgccatggtcgcacaggtcttcatgaacatggcggcctga

SEQ ID NO: 862 - DNA, 2394 bp, Unknown
  Description of Unknown: Firmicutes sequence
atggcacgcaaaatcattcccctgagacggaaaaagcaggaaccaaagctatcgcgcgccgagcagtcgcagcgtgccaaccggacgattctcagacggacgcttgttctgatggcgctgttcggcgtggtggtattcataccgcttattgtgacgctctacaatctcatgatccgcgaccacaactattatgaggcgcaggccatcgacaaccagacgcgctacacaagcttatctgcctcacgcgggcagatcttcgaccggaacatgaacgtgttcgcctcgtcgaagacggtggagacggtctttattgaccccaatgagatcgcgcaggagatggcaaagcccgaaaacagcaatcttctggaccacatcgcgcgcggcttatcggaaatcttagacgtgagcaccgattttgtctacaagcaggcttcggacaaggcgttccgctacaaggtcatccgtcggaagatcccggaggagattgccgacgaggtgcgcaatttcgtctcagagaacgagatcaagggcgtgtacctcgagaccgacgcgcagcgctattatccctattcgtcgctcgcggcgcaggtgatgggcttcgtgtcgacggataatgtcggctcggagggcctcgaggcgtactacgactcgtatttgcagggcacggccggcaaggtcgtcacgacaaagggcaactacggctcggagatgctctatacatatgaaaaatactacgatgcgtccgatggagacagtctggtcacgacgatcgatcagaccgtgcagcattatttagagaagaacctcgagacggcgatcgagaaatatgatattctgaacggcgcgttcggtatcgttatggacgtgaattccggccagatcctcgcgatggcgaacctcggaagctacgaccccaacaattatcaggagatctacgatcaggagcttgctgagcagctggaggagcagtatcaggacgcgcttttgctcgacaaagactcggaggcttataaagaggcaatgagcgcctacaaccaggccgttgcgaccgagcgcctgcggcagtggcgaaaccgctgcgtctccgacggctatgagccgggctcgacgttcaagctcgtgacgctggcggcggccttggactgcggcgcggtcacggaaaacagcaccttctactgcggcggccacgaaaccttcaatgaccgcgagcaggaggtcagctgctggaaggcggcaggccatggcatgcagacgacgatggaggctttggggcattcgtgcaacatcgcctttggccacatcggcgtcaatatgacgagaaagacgtttgtggaatatttcaaggcgttcggctttctggagaagaccggcgttgatcttccgggcgaggcttcgggccttttctgggatgagaacgacttttccgtcgcgaacctcatttccgcgtctttcggccagaccttccgcgtgacccccatggagcaggtgcgcgcgatcgcggcgatcgtcaacggcggatatcttttaaagccatatgttgtcagccaagtgttagacagcgacggcagcgtcgtgaagaccaacgagcgcacggttctgcggcaggtcatcagcgaggaaacgtcgaagaccatgcgcaagatgatggagtacgtcgtcaccgacggtacggcgggctctgccaagactccgggctaccgcgtgggcggcaagaccggtacgtccgagaaaatcgacgtgtttgatgaaaacggcaatccggtcgaggacaagatcgtctcgtttatcggtgttgcgccgatcgacgatcctaagtacgtcgtgctcgtcgcgctcgatacgccaaattacgtggccggaacgagctacaccccgcataaccagtatatttcgggcggccttatggcggcgccaacggtgcgcgatgtgttcctcgatattctgccgtatctcggcgtggagccggattactcctccgacgacatccggggcgtcaacattacgcttcccgatgtgatcggcatgacgcaggacgaggccgcaaagctgctttccgacaagtccattacctaccgcaccgtcggtcagggcgataccgttaccgaccagcttccgagcccgggcgcggaggttcccggcaattccgagatcatcctctacttcggcaacgccgtcaagacgaccgagcaggtcgaggttcccaacttcgtgggctacggcattgcagacgtggattatctggcgacaaacgccggactttacattcaggccaagggcaccgatcaccgcgacgaatacgtcacggtcgcatatcaggacattgagcccggaacaatggttgacagagggagtacaattacggtagaatttactaccggcggagcctccgactaa

SEQ ID NO: 863 - DNA, 1500 bp, Unknown
  Description of Unknown: Firmicutes sequence
atggagcaaaccgtactgcttcagatgaaagacattacaaagaacttccccggcgtcagggcgctcgataaggtcagcctggaggtcaaggccggaacggttcacgcgttgatgggcgaaaacggcgccggcaagtcgacactgatgaaatgcctgttcggcatttacaacaaggacagcggccatatctatctcgaaggccgggaaatcaatttttccagcagcaaggaggcgctgaataacggcgtcgccatggtgcatcaggagctcaatcaggcgctcaagcgctcggtcatggacaacctctggctgggcagatacccgaaaacagccggtttcgtggtcaacgaaaagaaaatgtaccacgataccgttgaaatcttcaacgagctcggcattgacgtcgatccgcaccggatcatgagcacaatgccggtttcgcagcgtcaaatggtggaaattgcgaaggcggtttcctatcactcgaaaattattgtatttgatgagccgacgtcgtcgctgacggaggaagaggtggagcatctgttccgcatcatcaacatgctccgcgaccgcggtctcggcatcatctacatttctcataaaatggcggagatcaagcgcatctccgatgaaattaccatcatgcgcgacggccagcatatcgcaacgaagcctgctgcagagctggagatgaacgacatcatccgcctgatggtcggccgtgagctgggcaaccagttcccggagaagacgaataagccgggtgagacctatctcgaggtcaagaatctttccggcatgtataaccagctgcacgacgtgtcctttacggcgcggcgcggcgagattctgggtctggctggtctggacggcagcggccggacggagacgctggagacgatcttcggcgtggctacgcgtaaaaccggaacgattttgctgggcggcaaggaatgcaagaacaaaaacccgcgccagtcgatcaagaaccgcttcgcgcttctgaccgaggagcgccgcgcgaccggtatcttctcgatcctgaacatccgggaaaacacggtcatctccagcctcaaaaagcataagcgcttcggctttgtgcttagctcgaagtccatgaaggccgatacccagtggtcgatcgatgcgatgcacacgaagacaccctcgcaggaaaccaagatccgtgcgctctccggcggcaaccagcagaaggtcatcattggccgctggcttctgacggacccggaggttttgctgctcgacgagccgacgcgcggcattgatgttggtgcgaaatatgaaatttatcagctgatcctcgaccttgcgaaccgaggcaagacggttctgatggtttcgtctgaaatgccggagctgctcggcgtgtgcgaccggattctggtcatgtccggcggacagctcgccggtgaggtggacgcgaaaaccgcgacgcaggaagatatcatgcgccttgcggccaagtatgtataa

SEQ ID NO: 864 - DNA, 2097 bp, Unknown
  Description of Unknown: Firmicutes sequence
atgcaaacggtttctgattatttcggaagtctggtgtttgacgacagagtcatgcgcgcaagacttccggccaaggtctacaagtccctcaaaaagacgattgacgaaggggtgagtctggataatcaggtggccaatgctgtagccgaggccatgcgcgactgggcagtcgagcacggcgcgacgcattttacccactggttccagccgctgaccggcattaccgccgagaagcacgatagctttatttccccgtcgcccgacggcggcgtgattatggagttttccggcaaagagctcatccagggcgagccggatgcgtccagcttcccgtccggcggcctgcgcgcaacgtttgaggcacgcggctacaccgcttgggaccccacgtcctacgcgtttttgaagggcaagacgctctgcatcccgacggcgttctgctcgtacggcggcgaggcgctcgataagaaaacgccgctgctgcgctcgatgcaggccatcaacaagcaggcgatgcgcgttctgaagctctttggcaacgaagacgtgaaatgcgtcaagacctccgtcggccccgagcaggaatacttccttgttgaccgcgagatgtttgacaagcgcaaggacctcgtcttctgcggccggacgctctttggcgcgaagcccccgaagggacaggagctcgatgatcactatttcggctccatcaagccgcgggtcgcggaattcatggaggacctcaacgaggagctctggaagcttggcatccttgccaagaccgagcacaacgaagtcgccccggcgcagcatgagctggcccctatttatacaacaaccaacatcgcaaccgatcacaaccagctgacgatggagatcatgcagaaagttgccctccggcatggtctcgtgtgcttgctgcatgaaaagcccttcgcgggcgtcaacggctccggcaagcacaacaactggtcgattgcgaccgacacaggcgtaaaccttctgacgccgggcgaaacgccgtatgaaaacgcgcagtttttgctcttcctgtgcgcggtcattcaggccgtcgacgattatcaggatttgctgcggctcagcgttgcgacggctggcaacgatcaccggctcggcgcaaacgaagcgcccccggcggttgtgtcgattttcctgggagatgagctgaccgcgattttagacgcgatcgaagccgatgcaccctacaatgcggcggagaagacggtcatgaagctcggcgtgcatgtgcttcccaagttcctgcgcgacacgacggaccgcaaccgcacttcgcccttcgccttcacaggcaacaagtttgagttccggatgcttggctcggccaactccattgcctgcacgaacattatgctcaacggcgctgtcgcgcagtcgctcaaaggttttgccgatgcgctagagaaggcagatgactttgaaggcgcgctgcacgatctcatccgcagcacgattcacgcgcacaagcgcatcatcttcaacggcaacggctacgacgacgcatggatcaaggaagcaaccgaacagcgcggccttctgaacttaagaaccacgcccgatgcgatgccgacgctgctggaaaagaaaaacgtcgacatgctgaccggcctcaagattttcacgaaggcggagctcgagtcgcgctacgagatcatgatggaaaactacgtcaagactgtcaccatcgaggcgcagacgatgctggacatgacgcgcaaggagatcctgcccgccgttgccggctacacgaaggagctcaccgagacactggctgccaagcgcgcgatcttaccgtcgctgccggcaaaatacgaaaccggcacgatcacgaagctctcttcgcttctcgaccagatcgacgcggcggcagacgagcttgaaaaaacgacgctccagatcaaagccattgacagcgtcaccgagtccgcgttccagattcgcgacgcgatgctcccgagaatggcggcgctgcgcgtggtgtgcgatgaggcagagcctctgaccgctgaacgcttctggccgttcccgacgtacgacaagcttctgtttggcgtgagataa

SEQ ID NO: 865 - DNA, 1983 bp, Unknown
  Description of Unknown: Firmicutes sequence
atgtccgccaacaagaacgaccccaaggacgccgtaaagatgacctccggtcttgacagccagacgcaggcagacctcgacgcgctgatgcgcaaatacgaccgtgagtccaatacgcgcgtgtgggagggctggcagcgctgggctgtcggcgcgatcatggttattttcagcctgtactgcatcggtatgacgctgttctattccggccttcccgaaacgagacttgccgcgtttctggcgatgatcgtattcatcggcttcctcacctaccctgtcaaaaagggtcacgtgaaggtgaactctatgccgtggtacgacatcatcctcatgctcgtaggcgcatcgtgctttttgtacttcgccttcaacgcccttcccatcatcaagcttgcaaccagaatccagacgcaccatgtgatcatcggcgcgatcggcattctggtcctcatcgagctctgccgccgctgcgtcggcgttccgatcctgtgcgtgctgggcgcgcttctcatctatacattctataaccagctgagctacaaccccagcctctatcaggcgctcaagaacatcgtctataagctcttctacaccacaaacggcgtcattggtacgcccgtgaacgtctgctacacgtacattgtcctcttcatcatcttcggcgcgttcttagagcgtaccggcattgcgaacttcttcattgcccttgcaaaccgtttggccggttggtctgccggcggtcctgcaaaggtcgcggtcatctcgtcggcgctctgcggcatggtctcgggctcttccgtcggcaacaccgtgaccacaggctcggttaccatcccgatgatgaaaaagaccggctatcacccggactttgcgggtgcagtcgaagcggctgcctccacgggcggccagatcatgcctcccatcatgggcgcggcagccttcctgatggctgaatacatggatcttccctacgcaaccgtcgccgtcaaggcgattttacccgcggttctttacttcacgggcattttcatctccgtgcatctggaggccaaaaagctcggcctcaagggtctttccaaggacgaaatgcccaagtggagcttcctgctgcggaaaatctacctgctcgcaccgctggtgcttctcgtctggcttgtctcctcgggcgcaaagaccatgcagttctctgccgccgtgtcaattctggccgccatcatcgtaggctttttgaacaaggacgagcgcctcacgctcaaaaagatctttgaagcgctggaggcgggcgcgaagggcgcaattaccgtcggcgtggcctgcgcaattgcaggcatgatcgcaggctgcatcactgtcacgggccttgcatccatcctcatcaacgccatcgtccagctcgcgggctccgcgacctttattggcctcatcctcacgatggtctgctgcatcgttctcggcatgggcgttcccacgaccgcgaactactgcatcatggcctcgacctgcgcgccgattctgattaaaatgggcttcccgctcgtcgcggcgcacttcttcgtattctacttcggcatcgtcgccgacatcacgccccccgttgcgctggccgcctacgcgggttctgcgattgcaaagggcaaccccatgaagaccggcatcaacgcgacgaagcttgccatcgcggccttcatcgtgccgtatatcttcgcctatagccccgccatgctcttcgtgaacgtcacgagcgtgtgggcggtcatccagattgtcctgtcggcgcttcttggtatctttggcgttgctgcgggtctggagggcttcatgctgcgcaagatgaactggctgttccgcctcatctgcatcggcggtggcctcggcctgatgatccccggcgcgctctccgaccttgtcggcctcgtgctcatcggtggtgtgttcgccatccagtacgtccaaaacaagaaggaagcgctttccaaggactga

SEQ ID NO: 866 - DNA, 5916 bp, Unknown
  Description of Unknown: Firmicutes sequence
ttgtgtgcagcgctgcgggaaaaggcggcgggcatacagtttgcgcagaaaaacggctgctgcaccgattgggtgcggcagcttttttgtttgcggaaggcttcgaaggcaggggcttggtttccgggaagacaggcgaaatacgccgggaacatggaggaaggtatgaagaagagaattgtctcgctggtgctggcgctggttctggtgctcgggctgctgccggggtcggtgatggccgcgtggcccagcttccggggaaacggaagcaacatgggcattacagacgtgcagacgcccgcgcctgactatgcaaagctccaatgggcggctaaaatcggcacgtcggcggagagcatgacgacaagcaccgtctatgccgggcagccggtcgtggagggtgagtttgtctatgcgacggcggggcggacgctttataagatcaaggcgctggacggaagcgtggccgtgcagcaggtgatggacgggaaggaccgttttggcacgatcccgccgacgatcgccggggacatgatctatgtggcgctggacggcggcatggtcgaggcgttcgacaagaatacgctcgtaaggaaatggacgcttggcgggctttccgccggagggcagaacagctgcccggttctggtgtccgaaggccgggtctatacgggattttatgattcggagaccggcacacagaactatgtctgcctgacgacggcgggaaagcgcgtctggagctatgaaaatgcgggcggcttttactgggccggcgcagtcgcggtcggggactatatttttgtcggcacggacgacggcgcggagagcggtgtgaacggaacctcgcgcattttgagcttccgcaaggacgagacgagcaaaaatcccgttccgcaggtgctcgagctgcaagaccttggcgaccagagaagctcgctcgcgtattccgaacagaccgggcggatttattttacgacgaagggcggctatctctgctcggcgaaggtggacggcaaggccggtacgctcacggagctcaggacctgccttctcggcatgggaagtacgagcacgccggtctattataagggctatgtctatatcggaaccggcacgggtccggggccgagcggtgggtttgccattgtgaaggagaacgcgcagacgggtgatctgacgcttcaaagggagctcacgatgcccggcagcacgcagggctcgccccttctgagcacagcgcgggaggcggaggggtatctctatttctatgaatgcgcaaactataagccgggcgggcttatctgcatccgggtgaacgcgaatagcccggagagcacgactgcgtcggacgtctttacgatctttgacgcggcggattatccggagtactgcgcggcaagcccggtctgcggagacgacggcaccatttattacaaaaacgactccggctatctgttcgcggtcgcgaaaacgcaggctccggcggtcaagtttacccggcatccgcagagcgcggcatatgcgcccggaaagacggcacaggcccttacggtgacggcagtggcggcagacaatgcggcgctcagccatcagtgggagaagtcttcagatgaaaaaagctggacggccatcgaaaatgcgacgacgagcagctatgtcccggaaattccggcgaaaatcgagggcgagcaggtaacctattaccgctgcaaggtgacgtctaccctgaacgggaagacggcgtgggatgtgtcgcacacggcggccatcacggtcaaggcgctcagcgcggacacgacgatttcctatattgtgaccgacggcaacgaggaaccgacaggcgcaccgacggcggcttcggtcagtgaaacaacagttgtgctcaactatgcggagttgggggcgaagaaaccgcgcgtctggttccagccgccgcaaggcggcacgctgcgcgtaacgcttggtacgtgcgacgacccggcggcgcgctatgacggttcgggtgattataccgaccgcgtctacttccgaagtggtataacgggcacgaatatcatccgtgtcaccgcgacggcggaagatggcgtgacgcagacgacgtatactttcgttttgacaccggacggaagttatgacggcctgcggagcgtctatgtgacgatcacggatcagggaagcgtcgctgtggcgcagaagaagctttctgtggacgaccggaacggggacggcaaaattacgaacgacgacgtgctccgtgcggtgcatgcgaaatactgcccggacggtgtgagcggctatcaagcggcggatagcgaatacggcgcatatatcacgaggttctggggtaaggataccggcaacaccggctactggaatggcggccggatgtgcatgggacttgacgaggaggtctcggacggcgaccactttgtcgcgatggcgtatgtcaaggcctatccggagacggaaagctacgcgaagttcggggaattttcttacactgcgtccgcaaacgcggcggtttcaatctcgctggaaacagtgaccggctatgacgcctcatataacccggtcttcggcggctgcgagggcgcacagatcacggcctatcgcgccacggacggcgcgacgggagaggcattggaaaagaatctctatacagtcgcagaaacgggaaacggatattataccgtgacgttctcgcaggcgggagagtattatctggttgccgcgaatgcagcggggacgatcgtcccggcggtctgcaccatcagcgtttcggacggacaggcaccgggcgaagaggtcaccgtgacattctcgctgctgggcgatgaagcgcacggcgcaggcgaaacggcgcacacgctcaagggcggcaacttaacgacgtggatcgacaaggccagcgtgacggttccggcgggcgcgacggtgctggatgtgatcgaaacagcgttcgttgcgcaggaggacccgacgtatagctggaagggcgacccggggtatatccgctcggtgacgagatcggtcaagggcggcaccacgacgacgcttgccgagggaagcaacggcacaaactccgggtggatgtacacgttcaatggcgttcataccaacaaggcggtaaacgagcaggtcgttggggacggagacaaaattgtgctccactatacggacgactacacgctcgaagccggcatggtctacacgccggcggacgtgatggagcggatcggcgcgatcggcgaggtgacgaggctgagcggccccgccatcgacgcggcaaggagcgcgtatgacagcttgaccgatgaagaaaagacgcaggtcaagaactatcagacgctgctggacgcggaagaagcgttccggaacctttcttccagcgtcgactggaaaacagcctaccgcgagacgggaacaaagctgctcgacttggtgctgcagggcaagtggacgacgggctcggtcggcggagagtggatgatgctcggccttgccagaagcgagcggctctatggcggcgacgtggaggactatatcaaggcgctcgagtcgtttgtcaaaggcaatatcaacgccagcggccaaatccggcgaaacggcgacgcgagatccacagagaacgcgcgtgtggcgctggcagcgtcggcgctcggctatgacgcaaggagctttgcgggctatgatctgctcgcggcgatggcggataccgcgtgggtcacgaaacagggcaacaacgcgtctgcgtttgcgcttctggcgatgaatgcgaagacggcgtatcttgcgggcgatgaagcgctgcagcgcgcggcggaaacgctggtcaagagccttgttgacaagcagaatccggacggcggctgggcaaatacgacgggaaacagcgaccttgacaccacggcgatggccctcacggcgctggcagcctatcggcaggacaaccgggacgctgcggacgcgatcacgctgggcctttcctatctggcgggccagcagcttccgagcggcgcgatcggaaccacggcggagacgtcggcgcaggcattggtcgccctgagcacgctggggatcgacgcggcgacggatgcgcggttcagcaaggacggaaagaccgtacttgacgggctgctgcaatattatttggacggcggcgggttctatcacgcggcgagcgcagcgggctacaaccagatggcaagcgagcaggcgtattatgcgctggcagcttacgcgaggctcacaggcggcaatgcgcacgggctttatgacatggacgacgcaaagaagctcgacgacgcggcgctggaggacgttctgcgcgagatcgaagcgctgggcgagatcaccgacgcgagccgggagacctatgtcaagctcgagaccatccggcagaaaatccgctatctgaaggacgaagacaagaagaccgcgcaggacgcgcttgaagaaaagcagagcgcgttcgatgagattctcgcggagaagaagcagacggcacggacggtttcactttccaaggtctatgacgcggtcattgatgcggcaaagaaggaggacccctcgcttctgaccgacgcagcgctcgaagaggtgcgcaaggtgatggcgcaggcggagaaggatatccgggacgcggcgcacaccggggagatcggagacattctcgccaaagcgaagaccgatatggaaaacgcgctgcattcgatgaaggtctcgttccggctgatcggagactttttgcacgaggaccagggagacgagcacaaggactatgtgacgtggatcgaaacgaagacgtatacgctcagcgccggagcgacggtgaaggatttgctggaaaaggcactggatgagacagggcttcaggagaccggcgcggacgacggctatgtgagcgctattctggcgcccgaggcactgggcggctactggctgagcgagatggacaacggtgcgaattccggctggatgtacaccgtgaacggcgagcatcccgatcaggcgctgaatgacttcacgctcgaggcgggcgacaaggtcatctggcactatgtcgacgactatacgaccgaggccgatgcggagacgtggctcaaggcggcggatatttcgccggaggaatacgcgaagcagaagctggcgcggatcgtgcaggtgatcggcggcggcacggtggagccgactcttggcttttcgcagctcggcgcggatgtgacgtttaccttcgagccggatacgaaccagcagctgctggaggtgacagtggacggcaagtccatcgggacgccggagagctatacgtacaagaacctgacgttaaacagccggatcgtggcgacgtttacgggcgcgatgctcttcttggatgtgcggcgcgaggactggttctacagcgatgtgcgctatgtggtcgagcatgggctgttccacggaacgacgcaggagcgcttctccccgaacgcgccgatgacgcgcgggatgctggtgacggttctgtaccggctggcgggaagtccgaaggccgcagagaatagcggctttgccgatgtggcggcgggcaagtattacgcagatgcggtctcgtgggcggcagaaaacggcattgtgagcggtgtgagcgacggatgctttgcacccgacagtcgggtgacgcgcgagcagctggcggcgattttgtaccggtatgcaagggacaagcgctatgatacaggcaagacggccgatctgacgggctttgccgactacggccaaatctctggctacgccgccgaggcgctcagttgggcgaacgcggaagggctcgtgaatggcagaagcgaaacggcgctctctccgcagggacaggccacgcgcgcagaggttgcggcgattttgcaccggtttgcggaaaatgttgcaaaataa

SEQ ID NO: 867 - DNA, 2508 bp, Unknown
  Description of Unknown: Firmicutes sequence
atgcgggcgcgttttgcgataaaatggaggaaaaacatgcgagcagataaaaatacacagccctccggctctgcggcacggcggattttgaaaggcttcggaaaggtattcggcacgatggtactggtgctgtttctgacgacgctgatttttgcgtgcctgtttgccctgtacgtcaaaaacaatctctccgcacaggtcgactcgatcgacggctttacgcttgaccagacctccgtcatttattatgaagacccgaagaccggacaggacgtcgttctgcgcaagctctacggcggcgcgaaccgcacgtgggtcaagtacgaggatatccccaagaacctcattcatgcctgcatcgccatcgaggacaagcgatttgaagaccatcagggcgtcgactgggtgacgacgcttaaggcctgcgtcaaaatgttcctcggaagaggagaagcgggcggttcgacgatcacgcagcagctcgtcaaaaatatcacgggccgcgacgaggtcacggtgcgccggaagcttgttgaaattttcagcgctttggaacttgagaagaagtacacgaaaaagcagatcatggagctctatctcaacgtcatcgcgctcggcgaaaactgcgagggcgtggagtctgcgtcgcaggtttatttcggcaagagcgtgagcgagctcgatcttgccgagtgcgccgcgctcatcggcattacgaacaacccctcgatctacgacccgtatatcaacgccgacaagaacaaggagcggcaggtcatcattctcgaccagatgctcgagcagaagtatatcacgcaggagcagcacgacacggccgtcgcggaggagctggtgctccataatgccagcggcgaagcgtccggcgatgaggactactattcctactttgaagatcaggtcatcaacgacgtcgtgcgggacctcagcgaaaagaccggctacgatcagacgatcgtccgcaagatgctcatgacgggcggctataagatttattcaacgctcaaccccgatgttcaggcggcagtggaggcggtctatcagaacctcgacaacatccccaagaccgcaagctctcagcagctgcaatctggcattgttatcattgataataagacgggagacgttgtggccgtggccggcggcgtgggcgaaaagcagggaagcctgatcctgaaccgcgcgacgcagagctatctgtccccgggctcgaccatcaagcccgtttccgtctacgcgcccgcgctggagctcgggctcatcacgcccgcaacggtcatggacgatacgccgtattcctttaccgacgcgcggcactggccgaaaaactccgattcgatctacaggggcctcatgaacatcaacgaggctgtgggtctttccatcaacacgatccccgtcaagctcgtcgcgcagatgaccccggaatacagcttcgagttcgcgaaggaaaaaatgggactcagcacgcttgtatcgtcctatgtaaacgcggcgggagacacgttctcggatgtggacctggcgccgctcgcgatgggcggattgacccggggcgtgaccgttaaggcgatggcgcaggcttacgcgacgtttgcgaacgaaggcgtgtaccgtgaggcgcggacgtatacgaaggttgtagactccgacggtaaggtcgtgctcgataatacgcagcagtcgcacgttgcgatgaaggacatgacggcttggtatattacctatatgctggagaacaccgtcgaatccggcaccggcacggcggcacaaatcgcaaacatgaccgtcgcgggcaagaccggcactacgacaagtgactttgaccgctggttcgcgggctatacgccctattataccggcgtcgtctggtgcggctacgacgaccccgaggaggtcgtgctgacggattcgtcgacgaatcccgccatcgtcctgtggcagaaggtcatggagcaggtgcacgacggccttcccaacaaggaattcaacaagcccacaaacgtggtcgagtgcacggtctgccgcgacagcggcctgctcatgacagacgcctgccgcgaagacccgagaggaagccgcgccgtgactgtggagctcagtctctacgatgtgccgacgcagaactgtgatgtccataaggaagtggagatctgcggcgcgtcggggcacgtggtcaatgaatactgcaagcaggtcgagggcaatacgacgaaaaccgtgggacttctggatgtttcgcgagccttcccggtgcgcgggatcacggtgcaggaccaggcctacgccgtgccgaacgactctctgcccgcgggctattacccggcattgagcccggatgtggacgcgatcaatgtcgagtgctacatccacacaagagatgatctgcccgagcccgaagcgccggaagacgaggaagaggaagacagtgcaagccgcatttccgccgctgtgcgcgatatcctcacgggcggcagccagaacgattaa

SEQ ID NO: 868 - DNA, 1389 bp, Unknown
  Description of Unknown: Firmicutes sequence
atgaaaagattcttcgccttgctgctggcgctgctcatggtcctgtctttgacggcctgcgtttccagcaacaatgccgcccagactacggccactgaaaccgcagctctgagccccgaggctgcggccgaacaggctgcggcggaaaccaaggacaccacgagtctgtccgatatcatccgcgtcccgttcggctatctgctcgactggctgtatgtcttctcgagcaactacggcgtggcgctgattttgttctcgctgatcgtcaagctcgtgctgcttccgatgagcatcaagagcaaaaagagcatgctcaaaatgtcccgtcttgccccgctggcccgttccatcgaggcgaaatacggcgacgaccgccagaaagcccagatggccgtccagcagatgtataaggaagagggcgtctcgatgggaggcggctgtttgtggtcgttcatcccgctgctgattctcttcccgctctactacgtcatccgtgagccgatcacgtatatgctgcacaactcgcgctcggtgtcggctgccatcgttgcgttcattcaggccagcggcgtcgatcttggcaagaacacgtactatgcccagctggccgcagccggtcatcttggcgagttcgcagaggccatcaagtccgtcgccgttatggcaagcgcgaaattgcaggatatcgatttctcgttcctcggtgtggacctcgcagccatcccgtcgttccgcttctggcagtgcgaaggctggagcgagatcggtctgttcctgatcccggtcttttccggtgtgttccagatgttttcgatgttcatcagccagaagatgaacaaccaggtcgcgaccaacgcagacggtgaggtcgatcagaatgccgcgcagatggcaaaccagaccaacgcgtcgatgatgatcatgatgccgctgatgtcgctttggatcggcttctcgatgccggccgctatctcgatctactggatcgcgcaggccgtgttcggaaccgcccaggacgtgatcctcaccaaacactaccgcaaagtctatgacgcagaagacgctgtccgccaggaaaaggctgcgcttcgccgcgccgaagaggcggaaaaggagcgtcagcgccagcttcgccgtgagcagaaccccgacggcattctcgcagataacgtgagcaagaaaaaggtccgccagcaggagaaggaagcggcagagaaggcggccagagagtacgccgccaagaagaatccggaactggaacaggacgaaaagaagccgctgtccggcattgccgagcgtccctattgccgcggccgcgcgtatcaggcggaccactatggcaagcgcggcgcgcagaaggaagcctcttccggagagaacgaggagtaa

SEQ ID NO: 869 - DNA, 1689 bp, Unknown
  Description of Unknown: Firmicutes sequence
atgaaaaagcgaagcctcagcatgaaccagatcatgattttgtctctgacggcgatcgtggtcgggattctcgggtgcgccatcgcgtttttcctgcaaacgtaccagcgctctctcatccgtaacgcgcagaccgacggccggcgcacgatctcgcaggtgaccagtaccgtagacggctatctcagcgatatgaacaacgtcatggagctgctggcagacgagctcgtcacgccgtcggacgaccgcgagcacttttttgaaacgttccttaaaatccgctccgacgtggtcgctgtgacgatctatgacgaggcggggtacctcatgaactgctacagcttagaccacgaggtgcggccggtcgtgcgggaaaatctgtcctttgaccggacgatgctggatgtatacgcagacggctatgtctccgcgccgcacgtgatgtccctttttgaggggtactatccatgggtcgtaacgatcatccgcccggtggacgcgggcaagtgggaaaaatgggtggcggtcgatatcagctgcacgaacatttcctcctatattaacggcatcggcatcggccagcggggctactgctttctcgaagacacgaacggaaacatcgtctaccacccccagcagcagctgatctattccgacttaaagcaggaaaataccgcgctgatttcgaacctcgacgacggcagccacgtgatcggcacgatgatctacaccgtgcagacgcttgcaagcggcagctggcgcgtggtgggcgtgagctttgtgcaggagatcattacggataacctgcgcgagattgcgcggcttctggcgctggcggccattgcgattgtggcggcgacgctcgcggtgagctttctgttttcaagagttctttcccggccgattcacgaccttatttccgcgatggcgcagtttgagaagaacgcggacaattttgtctatgagccagtctccggcgtgcgcgaggtgcagaatctgtcttcctcgtttgcgcacatggtgcggaaaatccagcagctgatggcgaccgtgcgcgccgaagaggtgaacctccgcaaaacggagctcagagcattgcaggcgcagatcaacccgcattttctttacaatacgctcgactccatttcgtggatgtgcgagcgggggaagaaccaggaagcggtcgtgatggtaaacgcgctggcgcagctgttccgcatcagcatcagcaagggccatgagctcatccccatccgcaacgaggtgcagcacgcgaagagctacctgcaaattcagtccgtgcgctacaaggatcagttctcctaccgcttcgaggtcgacgagagctgcctcgattatctctgcaacaagattaccctccagccgatcattgaaaacgcaatctaccacggcatcaacggccttgttgacgagggtgagatcgtcatccgcatcgagtcgcagggggacgatattctggcgaccgtcgaggataacggcgttggcatggagaaagagcagattgacgcgattttccgccgcagcgactccaaatccggcatcggcatcaaaaacgtcaacgaccggctcaaaatctggttcggcgaggcctacggcatcaccatcgagagtgtccccgacgagggaacgcgcgtcatcgtgcgcatgccgaagaagcagaaggagtga

SEQ ID NO: 870 - DNA, 2070 bp, Unknown
  Description of Unknown: Firmicutes sequence
atgggctatactgccaatgacattcgcaacatctgcctgctgggtcacggcggcgacggcaagtccgcgctgtgcgagagcatgctctttaccaccaaggccatcacgcgtcttggcaagcgtgccgacggcacgacggtttctgacttcgacgacgaagagaagaagcgccagtattccatctctacgtcggtaattccggtggaatataataagtgcaaaattaacgtcctcgacaaccccggctacttcgactttgccggtcagatcgtgcagtccctgcgcgtttccgacgcgggcatcatctgcctgaccgccaagagcggcatcggcgtcggcaccgaaaagggctggaagtacctcgcaaaggccggccttcccgccatgttctacatctccaagctcgacgaagagcatgcaaacttcttcaatgtctttgacagcctgcgcgaaatgttcggcgcgtccgtcattccgttcaccttcccgatccttaagggcgagcaggccgtgggtctggtcgatctgatcgagaagaaggcttatgacgcaaacggcaaggaaatccccctgcccgccgaggccgaagaaaagatcgaagagtacatggcagagctcaatgagcaggtcgccgagaccgacgaagcgctcatggagaagttcttcatggaagagcccttcaccgaagaagagctcctgaccggcatcaaggccggtatccgtgaccggagcgtcacccccgttttctgcggctgcgcatacacgggcctcggcacaaccaaccttctgtcgaacctcgtgaagttcgcgcccaacccccttgagggcaaggcgatggcgcaggtcgacgaagagggcagcaccaaggaattcaagctcgacccgaagggcagcccgatggtcttcgtgttcaacacgctggccgaccagtacggcaagaactcctacttcaaggtcatctccggcgacgtcgaggacaccatgtccttcgtcaacgcgcgcacgggcgacgcggagaagctcggcaacatgttcttcccgaagggcaaggacaacaccaagacctccaagatctgctgcggcgatatcggtgtcttcacgaagctcgcctccgtcaagaccggcgacaccctgggcttagcgggcaagaccgttaccatcgctcccatgaagtacgacgagcccatgtacaagatggcgatctacgccaaggtcaagggcaccgaagataagatcgcggccggtcttgtgaagctgaatgaagaagacgcttccttcacctatggcaacgatcccgaaaccaaggaactcatcatcgcgggcgcgggcgacatgcagctgtccgtcctgatggccaagctccagagcaagtacaaggtcgaggctgtgctcaagcccgccaagatcgcgtaccgcgagaccatcaagaagaaggtcgagatccacggccgtcacaagaagcagtccggtggccacggccagttcggcgacgtctacatccgctttgagccgcagtccgaatccgaagagatgatcttcgcggacgagaccgtcggcggctgcgtgccgaagaactttatcccgtcggttgaaaagggcctgcgcaactgtgtcggcaagggtgttctggcaggctacccggtcgtcttcctgaaggcgacgctgtacttcggctcctatcaccccgtcgactcctccgatatggcgttccagaccgctgccggtatcgcctataaggaaggcctgcccaccgccggcccgacccttctcgagccgatcggcgaactgaaggtcctcattcccgacgccaacatgggcgacgtcatcggcgacctcaacaagcgccgcggccgcgtcatgggcatgaaccccgatcccgagaaccccggctatcagaccgtcgaagcggaagttccgatgggcgaaatgagctcctacaccatcgacctgcgcgccatgagccagggccgcggcagctacacgctgaagttcatccgttacgaggaggttccgcagatgaaccaggccaagatcatcgaggacgccaagaaggacgaagaagaaggctaa

SEQ ID NO: 871 - DNA, 1701 bp, Unknown
  Description of Unknown: Firmicutes sequence
atgcagctttcttttggcgcatcccacaagaaaaagtccgtccgtccggtagaaattttgtttggtttcctgtataataaaaataactatccgccgcgccccggaaacgtttccgcgtgcgcagaccggaacttgcctccgcagtcttttgcggcgaacaaaggagtgaagaatttggccgaatcggaatatgtcattgagatgctgaatatcacaaaggaattccccggcatccgcgccaatgacaacattaccctccagctgaaaaagggggaaattcacgcgctgctcggcgaaaacggcgccggcaaatcgaccctgatgagcgtgctctttggcctgtatcagcccgagagcggcgtcatcaaaaagaacggacaggtcgtcaggatcagcgaccccaacgacgcgaacgatcttaacatcggcatggtgcaccagcacttcaagctggtcgagtgcttctcggtgctcgacaatatcatcctcggcgtggagcccaataaggcgggctttttgcagaagaagcaggcgcgggagaaggttctcgccctgtcgcagcagtacggcctgcgcgtcgacccggacgcaaaggtagaggatatctccgtcggtatgcagcagagaaccgaaattctcaagatgctctaccgggacaacgagattctgatcttcgacgagccgacggcagttctgaccccgcaggaaatcgacgagctcatgcagatcatgaaaaatctcgcggcggaaggaaagtccatccttttcatctcccacaagctcgcagaaattatggccgtcgccgaccggtgcacggtactgcgcaagggaaaatgcatcggcaccgtcaacacgcgcgagacgaccatggaggagctctcttccatgatggtcggaaggcaagtcaacttcaaggtggacaagcaggataaagcgcccggcgaggtcgtgctggaggtcaagaatctcacggttccctcgaagctccacaagaataacgccgtcaagaacgtgaaccttcaggtgcgccggggcgagattgtctgtcttgccggtatcgagggcaacggccagacggagtttgtctacgcgctgacgggccttgagaagcagtcggcaggcgagatcacgctctgcggcaaggacatttcccacgcgtccatccgccagcgctcgaaggacggcatgagccacatccccgaagaccggcacaagcacggcttagtcctcgattttacgctcgagcagaacatggtcctccagcgctactggcagccggagttccagaaaaacggctttatcaacttccccgccgtccgggcgtattccgaccgcctcatcgagcagtacgacgtgcgctcgggccagggttccagtacggtggtgcgcagcatgtccggcggcaaccagcagaaggcgatcgtcgcgcgcgagatcgataagaacccggaacttcttgtggccgtgcagccaacaagaggcctcgacgtgggcgcgatcgagtacatccacaagcagctcgtctccgagcgcgacgctggcaagggcgttctgctcgtgtcgctggagctcgacgaggtcatgaacgtctccgaccgcattctcgtcatgtacgagggcgaaatcgtcggcgagtttgacccgaagaatgtgaccgtggaagagctcggcctgtatatggccggcgcaaagcggatgtaa

SEQ ID NO: 872 - DNA, 1326 bp, Unknown
  Description of Unknown: Firmicutes sequence
aacatgaatgtaaagagcgtagaaaaagaaaacggcaaggccaaggttgtcgtcgagatcgacaaggccgaatttgagcaggcgctgaacaaggcgtacgccaagtgcagaaaagacatcatgctgcccggcttccgcaagggcaaggctccgcggaaaatggttgagagcatgtatggcgcgaccgttttctatgaggacgccgtgaacgaaattttcccggacatctacacgaaggccatcgttgagcaggagctcaaggccgtcggttccccgtccgtttccaacatggacacccccgacgagggcggcgttgtcctgaccatcgagaccgagctctaccccgaggtcaccctcggccagtacaagggccttgaggtgcccaagcacgaggtaaaggtcgaagagagcgaagttgacgcggaagtaaatcgtatggcagagcgcaacgcgcgcatcgagaccgtcgaccgcgcagcagccaatggcgacaccgtcgtcatcgacttcgagggctttgtggacgatcagcccttccagggcggcaaggcggaggactactccctcacgctcggctccggctcgttcatccccggctttgaagatgcgctggtcggcgcagtcgccggtgaggagcgcgatgtgaacgtcacgttccccgaagactacagcgccaaggagcttgcaggcaagcccgccgtcttcaagtgcaaggtgcacgaggtcaaggagtccatcaagcccgagctcgacgacgagttcgcaaaggacgtctccgagttcgatacgctggacgcgctgaaagatgacatccgcacccgcttcacgaagtcccgtacggagcagaacgagcgcgcgtttgagtctgccgccgtgcagatggcagcagccaacatgacctgcaacatccccgcctgcatgatcgacgagcaggttgaccatcagatcgagcagtttgcctatcagctgcagtctcagggtatgaagatggaggactacgtcaagatggtcggcggcgacctttcgagcctgcgcgcttccatgcgcccgatggccgagcagaccgtccgctccgatatcctcctgagcgaaatcgcccacgccgagaacctggaagtgaccgacgaagaggtcgaagaagagctgaagaagctcgccgagcagtatcagatggagcttgacaaggtcaaggccgctgtcgataccgccgccgtgaagtctgacctcatgggccgcaaggctgccaagctcatcaccgacagcgccgtcgccgtcgctcccaccgaggagaagaaggaagacgacgcgacctccgagaaggagtaa

SEQ ID NO: 873 - DNA, 1266 bp, Unknown
  Description of Unknown: Firmicutes sequence
atggcaagagattccatccgctgctcgttctgcggcaagcggcaggaacaggtcaaccggattattgccggcccgaatgtttacatctgcaatgagtgcatcgatttgtgctcgagcatcctgcgagacgaaatgaaaaacggggaaacacaggacttggagcttcccgataccctcccgaccccgcaggaaatcaaaacgtacatggaccgctatatcatcggacaggacgaggcgaaggtcgcgctgtccgtggcggtttacaatcattataagcgcatctacttttcgcaggagacggacgtggagctccagaagagcaacattctgatgatcggccccacgggctccggcaaaacgctctttgcgcagacgctcgccaaaattttgaatgtgccgtttgccatcgccgacgcgacgacgctgaccgaggccggctatgtgggcgaggatgtggaaaatattctgctgcggcttttgcaggcggcagactttgatgtggagcttgccgaacgcggcatcatctacatcgacgaaatggataaaatcgcgagaaagtcggaaaatacgtccatcacgcgcgacgtatccggcgagggcgtgcagcaggcgttacttaaaatcctcgagggcacgatcgcaaacgttcccccgcagggcgggcgcaagcatccgcagcaggagttcatccagatcgacacgacgaacatcctgttcatctgcggcggcgcgttcgacgggctcgataagatcatcgagcaccgcacggacaagtcctcgctcggcttcggaagtgaaatccagagcaagaataagcgcgacgtcggcaagctcttcgagctcgtgcagccgcacgatcttttaaagttcggcatcatccccgagctcgtcggaagacttccggtcattacgtccttgcagagtcttaaaaaggaagaccttgtgaagattctgaccgagcccaagaacgcgctttgcaagcagtaccataagcttctggagtatgacggcgtgacgctcagcttcgagcagggcgcgctggaggccatcgcggaaaaggcgattgaacgccagatcggcgcgcgcggccttcgcgcgatcatggagtctgtcatgacggacatcatgtacaaaattccgtccgaccccgcgattcagagcgtgctcatcaccgaggagtgtgtccgcaacggcaccgagccgcaggtgacgcgcgacgaagcgcatccgcgccagccgatcaaaaacgccggtatcacgttataa

SEQ ID NO: 874 - DNA, 2091 bp, Unknown
  Description of Unknown: Firmicutes sequence
atggtcgtgctcattggcgtgatcgtcgccatcatgtgcgtgtttctgctgcgcatgtatacgctcgcggcggtaagcccggatgagcgcgctgtggcggacgcggactccatgacctatcagacgacggtggaaggcgcgcgcggctgcattctggaccggaacggcaacgtgctggtctcgaaccgcgcaacgtataacatcgtcatcatcaactacgtgctggccaacaccggcgcggcgaatgaaaacattctgaagcttctgcaaatgtgcgagcagctcggcatcgagtgccagagccacttccccgtgacaaatacccggccgtatgaatacgacatgcagagcctcagtacgacgtggcagacctatttccggcagttcctcaacaaccgggactatgacctcgacatttccgcgtcgactctgatgcggaacctgcgcgaggcgtataaaattccgaacgactggtcgcaggaggatgtgtacaaggtcatctctgtacgctatgagctcgagcttcgaagcgttgcgacgaatcttgaaaactacatgctcgcagaagacgtggacgcggagtctctggctgcggtcgcggagctcggcatcccgggcgtcatcgtccagtccggcacggtgcgcgagtataagacggcctacgccgcgcatttgcttggcacgctcggcgcgatggatgctgacgaatgggaggtctatcgggaaaacgacgattacaacatgaacgcgatgatcggcaagagcggcattgaaaaggcgttcgaggagtacctgcacggcgtgtccggcaccaagattacaacggtgtccacgaccggcgatgtgttaagcgaatactatacaaaaatgccagagccgggcaacaatgtcgaaaccacgatcgatatctccctgcaggccaccgctgagcaggcgctcgagaaggtcattctcgatctgcgcgaaaacggcgtcggcaaaaacaaggagggcaaggacgcagagggcggcgcggtcgtggtccagcaggtgaaaaccggcgaggtactcgcctgcgcgagctatccgacttttgacctcagcacctaccgcgagaatttcaaggagctgagcgaggacgagtattctcccttatataacagagcccttctcgcagcctatccgcccggatcgatctacaagatggtcacggcgattgccgccattgactacggccactacagcccctatcatatcatcaccgatcagggactttacacgtattacgactcgttccagcccaagtgctacgtctggtcgcgcgcgaccggcgcgacgcacggccccatcgacatgcggcaggcgattgcgcattcgtgcaactactatttctacgaagttggccgcgtgacgtatgatacggcgcagaaggaggtcggctacaaccccttcgacgtgatcgcgaaggcgctcggactcggcgagcccacaggggtggagctcgatgaggaaaccggcatgcgcgccaacgccgagacgaaaaaggaaatgtacgtaaacgaggattccggctggtacggcgcggacgttctgcaggccgtcatcggccagagcctgaaccgctttacgccgatgcagatgtgctcgtacgtgcaggccttggcaaatcagggcacgcgctattccgcgacgttcctctcccgcgtcatctcgtgggactatcaggacctgattctggagcacgagccggagatcgcgagccagctcgagatgtccgacgacgcgaagctttgcatctccgaaggtatgtatatgacgacgcaggaaggtactgcagaggaatatttcaaatattaccccgtgaaggtcgcctgtaagaccggcaccgcgcagtggcagggcacgacgtcctccggcgcgttcggcggttccgaccatgcctcgttcgtgctctacgccccggcggacgatcccgagatcgccatcgcggtatacgtggaaaagggctcgaagggcggcaatctgtcgaacgtctgtatcccgattctcgacgcatatttctcgtccgccacgcactatgagacggttatgaccgaaaacacggcggactga

SEQ ID NO: 875 - DNA, 2892 bp, Unknown
  Description of Unknown: Firmicutes sequence
atgaagaacttcaaaaaggttcttgcgctggttctggttctggcatccctgctgggtctggcaaccatggccggcgcggcgactgagtacaaggacgccgacaagatcaacgcggattacaccgaagcgatcaaggtccttgatctcatcgaaacaatgcagggctatcccgatgggaacttcaagcccactgcaaccatcactcgtgaagaggctgctaaggtcatcgccatctttgacaacaaggatgcagacatcagcacctactacacctccatcaacccctttaccgatgaaaagggtcgttggggcgagtcctatgttggctacggctatcgcgcaggcatcatcgccggcatgaacgccaccacctatgctcccacctccaacgtcaccggcacccagttcctgaagatggctctggtcaccctgggctacgatcaggagaaggaaggctttgttggcacttcctgggcagtcaacgttctggcgcttgccaagaagatcggcctgatcgacaatctggctgacggctggaagcccgagcatgacctgacccgtgaagaggctgctcagatccttctgaacgctctgaatgctgagactgttgagtacgcacaggaagcaaagtccgctgacttcaagcccactactaacgctgatggtgcttgggtcttcaagggcaagctgtacctcaccgttgctggcgctgtcaagactggcaacaagctgtacaaagacttcgacctcaagaaggaagactccaccgacgctttctatcgtccctacaccaagtggaccaaggataatgtctctgttgagatcatgaaggccccgaaggtcaccttcaccaagaagttctccgcttgcgaactgcttgtcgctctgggcgtcaaggagtccgacaccaagaccaagatcttcatcgataaagtctactgcgatggcgacgacaccgttgatttcgacgactacgatatctacgatgacgcttacaagaacgctgatgacgaagcttactggaagcacggcaacagcaactgcccggatgctaccggtgcaaagcacggcgcacagggcactctgacccaggtcttctacaacggcaaggacgctgatggcaacaagcactacaccatcacctccatcgagacttggctcggcaaggtcaccaaggtcaccaataagaccactgctcacgacaaccacgtcaagagcgacggcgctgtcaagctgaacgcttacttcaacaacctccagaccctcgaagagaacaactacgactactgcggcacgatggacgaagccggccacaccggtcactgcgcagccctcgttgatggctatgagcagaacgaagatggcacgactccgctgaccttcgacgatcccaccggtctgaagaaggacgactatgtcctgttcacctactccttccgtacgctcgatgatgacggcgacgagacggacgactataagtgcgtccagactgtcgatgtcactgaaggtaagaacggccgtctctccggctacaagttcggcacctccgctggctccgatccttccgagacccgcattgacagcgaatacgtcaaggattcccagcacttccacatgggctatgatctgtccaagaccaaccagtacggcacctacaccttcttctatgacgcttacggcaacgtgatcggcatgaaggacgctgctgactcctccaactgggctgtcatcgaccgcgcttgggtcaccttcgagaacaagggcactgctgtcatgaacgctgacgtcgttagcgtcgatgatgcgaagaccaccaccagcactgtcaagaagttcacggatatcaccgattacattgaggctattgaggaatccatcaacgactcctccgcgaagaacttcgcttatgatctggctgtgtacctgaaggacctcaccaacggtgaaggctacaaggacttcgacccgatttacgatcacctgttcaaggtttccaccgacaaggatggcgtcttctccgtgaaggttgctaagaattccgatggtgagtacgttgtcaacggatacggcgatctggaaagcactgatgacaccatcaagactgtcaacggcaagccgtatctggagatcaaggaaggcgacgcggatgctgacaagagcatttcgctgacctccaacaccaagttcctcgtccacaacatggacggcacttactctgcatacaccggctacaagaacgttccgtccctgattgcccactatgctgaggttgtcttcgactccgactatgctgacaagttcgttgctgaggttgtctatctgaccaaggatgtctacacgacagacagcaaggttgtcgcttatgttggcaacggcgctgatcgtagcaacatcgaagttgttgaggacggcgacacgtactacaacctgactgcttatgtcaacggcgaagagaccaacgtctatgtcgacgaggccgatatgaaggcatacttcgacaagaaggccgattccttcgtggctggcttctatgagctgcagtataccgagatcgacggcgtcaagaccgcgaaggtcaccaagaactacaccgcttctaccgacgatgatgacaactacctggtcgagccggttgaggctgagtacttcaacggcactgtcatcaagatcgatggcaagacctacgctctgactgatgattgcggcctgttcgcgatcaacggcaagaaggtcgaaaagagctccgcttccgagatcgaagacctgtacgatgatttcgacagcttcgacgataccaatgacgacaacgagaacgctcacaaggtctacgttgctctcaacgataaggacgaggctaccgcgatctacatcaagctggcagtcaacgactaa

SEQ ID NO: 876 - DNA, 1272 bp, Unknown
  Description of Unknown: Clostridiales sequence
gaagcggagcttgcggacgcaaaacaggaactggctgatctggaagatccggatgtgtatgttctggacaggagcaccaacaccggatatgtgtgctttgaaagcgattccgatattatagaagccgtttcccgcgtgtttccggtttttttcttttttgtcgcagcgctcgtctgtattacaacaatgacacggatggttgacgagcagcgtacacagattggcgtactcaaagcgcttggctataccaactttgctattatgtcaaagttcatgatctattccggaagcgcgtcgttaattggctgcgtagttggctttgttggcggctccattgtatttcctacggtgttgtggtccgtctatgacattatgtatggcttcgcagatattattttggtttttgataacggactggcggtctggatggtggcggcttttatgttctgtgcgttgggtgcgacgtggtttgcatgccgcagcgaattagctgacgtgccggcagaattgatgcgccctaaagcgccaaaaagcggaaaacgcgttttgttggaacggattccttttatttggaatcacatgaaatttttgcacaaggtttctatccgcaatatattccgttacaaaaaacgccttattatgatgattcttggcatcagcggttgtacggcgctgcttgttacgggatttggtattcgggattccattaagaacgttgccgactatcagtttaatgaaatttcgctctatgattattccgtaacgctttcaaacggcgcagatgcagatacggaggcgaaactcctggagacgggtggcggtacgattcaggaatgtacgttcctgaatgagagcacattggatcttttgggagaggacgagacaaaatccgtcaatatggttgtgtcagacggtggactggacgcgtttattgatttgcattacgaaggggaaaaaattgcgtatcctgggccaggggaggtggctatctgtgatgcattggcagaacgcctgggcattgcagtcggggacacggtgacactgcgtacaaacgacatgcagtcgcttgaggtgaaggtcagtgccatattccagaactatgtattttactatgtctatgtaaattctgaaacttgccttgaccaatggggctatgcgccggaatataaaacagcatacgtcaatgtcacggatggcacggatgtccgtgcttctgcggcgaaggtgatggacatggatggcgttgccgcagtcacagtggttgaggatctg

SEQ ID NO: 877 - DNA, 1101 bp, Unknown
  Description of Unknown: Clostridiales sequence
ttgaacgctttagtcgataggctttttgtaaaggacaaacatttttataagaccattttgttccttgcgcttccgattgtggcgcagaatatgattaccatcggcgtcagcatcatggataccgttatgctgggcagctatggcgagacacagatttccggatcgtctcttgccaatgactttatcaatatttttcatattttgtgtatgggtatgggcggcggcgccgccgtgttgacggcacagttttggggcgcgggagatcgtgactcaatccgaaaaactgtgacgattatgctgcgaatctgtttgggaattgtcgctgtttttacagtggtgacaattttctttccggcagagattatggcaatttttacggatgatcctgcggtaattgaaaagggcgccatctattttcgttggagtatcccgcagtattttctgcttggcatatccctgacgctcaccatgattttacgttccatgcgtaaagtgacggtaccgctgattacgtcgattatcagcttttttgtgaatatcggatgtaattacatctttatttttggtaaactgggtttcccggaaatgcagatcgcaggtgcggcgcttggaaccgtatgtgcccgtgtggtagaggtcctgattattggcggatacttcctggttgttgagaaggaaataggatatcgtattcgcgatttgttccgtccctgcggcgacgttgtcaaccgctatttgaagtatagttttcccgttatctgttcggacggcctgcttgccatcggcaattccatggtatctattattattgggcatatcagcacggagtttgtcgctgcaaacgcaattatatccacgattgtacgcttaagcacggtgttcacgcagggccttggccaggcgtcttccaccattacgggcaatacgcttggagagggagaccgtgaaaagacctatcgtcagggtgtgacgatggtcacactcagtgtgtttatcgggattttagcaggcggcattattttggctttggcgccatggattattgatatgtacgacattacggacgtcaccagatcggtcgcatgggaactgatgtatgcg

SEQ ID NO: 878 - DNA, 1200 bp, Unknown
  Description of Unknown: Clostridiales sequence
atggatcgtgaacaatataaaaagtatatcatgattggcgtcattgcgttctgcgtggtggctgccagtatcttactggtttttgctatttttaagtttgaggtgattaaggaattctgcctgatgatttggcgtattttaacgccgtttttgtatggctttgtcttggcgtatctgcttttaccggtttacaattttctggtaaacttgctgcaaaagactttttgcaggaaggagcggacaaaaaagacagatcacaggctgcgtgttttagcaagcgctgttgccgtaacccttacaatgctgtttttcctggcgcttgtagtcgggtttggcttccttgtcctaccggaattggggcggagcattgtatcaattgtaggaagcgcgcctgaaacagggaaaaaggtgttagactgggcagagaaggtgttgcaggacaatccggagatcgaagctacggttacagatatcatctcgcgctatgttgggaacattaatacctgggccgagacttatcttttgccctatgtcacggaaatggtgaacgggctttccagcgggattgttggcacgcttacgggaacatttacgtttttgaaaaacaccctcatcggtttgattgcggcaatttatatgctggtgagcaaaaatctttttgccgtacaatcaaaaaaactggtttacagcatattcaaggtgaagaccgcgaacacgtttcttgagaatatgcggtttgttcataaaacgttcagtggattcattaccgggaagttactggattcgttaattgtcggttttgtgtgttatgcgtttatggcaatttgcaatatgccgtatgcaatgcttgtcagcgtaattattggcgtgacaaacattatcccattttttgggccgtttattggtgcgatccccagcgcacttctgattttaacggtaagtcccatgcaatgcctctactttgtcatatttatcgttgtcctgcaacagtttgacggcaatgtgctggaaccgagaattatcagcggttccgtcggtatatcaagtttctgggcgatgttttccattcttttcttcagcggattgttcggattcctaggcatgattattggcgtgccgttgtgtgcgttgctgtttagcttaattgcggcgctgtgcaaacggtccttggaacgcaaagcgttgccggttcattcgtcg

SEQ ID NO: 879 - DNA, 699 bp, Unknown
  Description of Unknown: Clostridiales sequence
atggatcaaaacggatattcttatacgcctcccaaaccaagagggccgaagctggagccgggaaaaatcaaacggattgtgctcctggctgtaatcgtgctccttgccgtggcgattgggacctcatgctggtatacggttgatgaaaagcagcaggctgtcgtcacaacgtttggcaaggtgacggacgtcacggaggctggtatacattttaagctcccgttgggaatccagcaggtgcataaggttgacgtcaatgtctatcaaaaaattgaacttggctaccgaacggatccgtacaacgagtcgggctatgatgtggttgagagcgaaagcaagatgattaccggcgactataatatcgtcaatgtggagttctttgttgagtataagatttcagatcctgtcaaatatctattcagctcttatgagccggaagatattctgcgtaatcttgtccaaagtcaggttcgcaatgtggtaggctctacgaatgtggactccgtgctgacagatggtaaagaggccattcagatgcaggtaaaagatctgattgttgaaacattggaacagtatgatattggtctgatgcttaacgacgtcaagatacaggacagcgatccgcctaccgaggaggttactgcggcgtttaaaaatgtagaaacggcgaaacagggcgccgagacggttgtgaatgaa

SEQ ID NO: 880 - DNA, 906 bp, Unknown
  Description of Unknown: Clostridiales sequence
atgatgcggaagtttgatacaaaagtacaatacttaaaatacaaagtgctgcgcgaagtcgcgcgccaggcctggaacgacacgctgcttgagcacgtgctggatattccgaagatcatcgttcccgggaaagagccgaccatgcgttgctgcgtgtataaagagcgcgccatcctggaagaacgcgtcaagcttgccatgggcggcgataagtccaatcccaatgtcattgaagtgatcgatatcgcctgcgacgaatgtcccgttggcggttacgaagtcacggatgcgtgccgcggttgtctggcccaccgctgcgaagacgtttgccgccgcggcgccatcacctttgaccgccatcaaaaggctcatattgacaagtccaagtgtattgagtgcggtcagtgcgccaaggtctgcccatacagcgcgattgcgaatcacaagcgcccctgtgaaaacgcctgcaaggtaaaggccattgcaatgaataacgacaaggccgcaaagattgacaacgataagtgtatttcctgcggtgcatgcgtctatcagtgtccgttcggcgcaatcagcgataagtcctatattttgaatgtaattgatatgctgaaaaaaagcaattgcaatgaggcttacaaggtctacgccgttgtagcgccctctatctccagccagtttacgtatgcaaagcttggtcaggtgattaccggcatcaaaaagcttggcttcttcacggtagtcgaagccgcgctcggcgcagatatggttgcggacgccgaaagcgaggagcttgtagaaaagggctttttgaccagctcctgctgcccggcatttgtcgattatatccgcaaacagttccctgcgctcgtggagcacatttcccacaatctttcccccatggcc

SEQ ID NO: 881 - DNA, 579 bp, Unknown
  Description of Unknown: Clostridiales sequence
cccatcgtatgggagtctaaggatgccgaactggaatccgggaatattgactgcatctggaacggctttaccaagagtcccgaccgcgaggacgactatacctggtccgttccctatgttgacaattcccaggttatcgtcgtaaaagacgacagcggtatttcttctctgtcggaccttgccggcaagactgtgatggtgcaggccggatcttccgcgctcagcgcgcttgagggagaagactgcgcggagctgaccgcgaccttcggcgagcttttggaggttgccgattataacgcgggctttatggagttggaaaacggtacgattgacgcgcttgccatggatatcggcgttgcaaactaccagattaatacgcgcggcggcggatataccatccttgacgagtccattgcgacggaggtgtactgcgttggtttcctgctcggcaatacggagctgatgtatacggtgcagggcgttttgcttgagatggccgaagacggcaccatgcttgagattgcagagcagtatgtcgaccgtggactggtgatcgattctctctgcctgctcgactaa

SEQ ID NO: 882 - DNA, 855 bp, Unknown
  Description of Unknown: Clostridiales sequence
gtgaacagtatttatgattatcaatcgcccgaggcgcgcgtcaggactgcgcagttcttatttgcatatgcgaagagttatcgcgctgaggcggatgaacggtggcaggtgtgttatgagtactatgcagggcggcaccgtacgcagcttgaaattgccgagagttgccgtgatgcgggtattccatggattgctgcaatgtctcccgatccttatttgcaggtggaaagtcagattacctcggagctgcctgattttacgtttcggggacgcgacgatgacctggacagcatccgtgccagacagcgggaagacgtcgtgcggtatatcctgacacagaatcgcgtggcggatgagatggcgtcaaacgaccggcgctgcctgattacgggaagttcggcgtggaaagtctactgggatgacgccgggaatggcgatgtgcgtgtggtaccggttgacccgcgctctttgtacccggatccatctgcaaaacgtctggatgagtgcgaatatctccagtttgtgtatcctgtacaccggcgtgcgttcgagcgcacgtatggacgagagttgaagtgccttggcatagacatcgaacagttggcacaggcggccgatccatacctgacgcctgaaccggagacgtatacggctcaggatgatgtgattgccgtaacggaacactggtaccgcgatgaggacggcgatatttgttgcagcattcaggccggagggtatgagctgcggcatattgaaaagtattggcagcgcacggcactttataataccagctatccgtttgtaattcagtaccgtgtatcaaacccggacggcttttggggctccggggatatc

SEQ ID NO: 883 - DNA, 1317 bp, Unknown
  Description of Unknown: Clostridiales sequence
gaaagggttgcgctggagtatctcggtacttatgacgacgagtacaccaacgaagaaatcgaggaatttgaaacattcaagcaaatctatgatattgttagtaatatctataacattgattatacctatacctgcgtctacagcgaggcgtatctgaatacgttaaacggcttaatcgcaggcggcaccctccccgactgtttcaatacccgcgaggtgctctcggatcagcagattctgcagatgatcgaaggaggaagcctggcttccatggacgagattctggagtattccgacggttccgccagaggctattataatgatgaagatgcgcttttgtacctgaaagcgtatgcgaccgttgacgacggcaactggtactatgtgccgctgccaaacagcacgggctcctctctggatttctccaccaatgagtatgacacgcgtgcaaacggacagatccacggtgcgtattccgtgtgcgtccgtcaggactggctggataagctgggtctttccatgccggcgactacggatgaattttatcaggcaattaaggctttccaggatgaagatattaacggtaacggttccgccgatgagcgttacgttggcctgctgggaagcgacttccagacttccggcgtaggccagtggttcggcctgccgtatacggactttattgaggatccgtctaccggcgtgattgaggtttcagcactgtcaggcggctatgcggaattctgtacgtatatgaacatgctgtataatgataaccttgtctacgtcgagggtacacatccttggggtaacggaactacggttgcggcaaacgtcgtttctgcaatcggtatgatgccgtcgaacctgcagttctgggacaccggtgatccggaaggctattatatgccgatgccgatcgtgcaagccgtggaaggtgtagagccgcgcctgttgatccaggaatctctggcgttctttacaggattttcctttgcctctacctgtgattatcaggctgccggaagctttatggacttcctctgccgcgaagacgtctttatgctgttccgttacggcgtagagggtgttgcgtgggattatgacgagaacggcgatttcgtccagtatgtcatcaatgatgaggatgaactgcacagctatggcgctgcgggtacatattggcttaccaataccctgttcccgattaacggtgcacatcatggtaacctctgggccccgattaagaacgtatacgacaatgcgcaggatgctcttgatgccggcgagccctatgcccaggataaccagaccatt

SEQ ID NO: 884 - DNA, 690 bp, Unknown
  Description of Unknown: Clostridiales sequence
gtccttgcaaagacggcattttcagcattgatgagcgtaatctcatacggttttcatgactggagaacctttctacggcgaacattgattttttatgtagtcagttttgcgttcgccggcgccatgatggcgcttttcaaatttacaaacccggaaaatgccgctgtgcgcaacggcgtcttgtacgcagggatctcttcaaccgttctcattgcagtagcgcttggcgcctacttgattatgacattgctcctgaaaaatgcgccgaggctctctgaacatgcggtactgcgtaccgttgtagcgatcacactgtttggaaaaacgattgaactggaggcaatggtagacaccggtaaccggcttaccgatccgcttacaaacggccgtatcgtcgttgtggaatacacccgggtacgtgatgcatttccacatggcatgcgtgcgatctttgatgtgtttggcgtttccgatgcggccgaaacgctcaggatgcttgcaggcgcagggtacggtgatgggtttcgcctgattccctatcgtgccattggcacaaaacatggtttgctgctggccctgcgggcagacagcgtccgggaaaacgacaacgcattggaaggcgcgcttgttgcgcttacggaaacagaactatcggaagaaacaggatgcggcgcagtaattggcgcatga

SEQ ID NO: 885 - DNA, 1182 bp, Unknown
  Description of Unknown: Clostridiales sequence
gatggcctttttaacacccataaggatgtcggtttggttaacgacgtgtttacacagcgtgtcatggacaggcttggacagggtaatatggcgattggccatgtgagatatgccacaaccggtgattccggacgtgtcaacgcgcaaccgattgtagtaaatcatatcaaaggccgtatggcgttggcgcacaacggcaatttggtaaattcgcaggagctgcgtcgtgatttggaattaaagggttccatttttcacacaacaagcgatacggaagtgatctcctacattattactaaggaacggctcaacgctccgtctattgaggaagccgtcaatcgtgccatggaccagttaaagggcgcttattccatggttatcatgtcgcctcgcaaactgattgcagtgcgcgacgaacacggattccgcccgctgtgcttcggacagacgaaggcgggggagtatgtcgttgcatctgaaagctgtgcgctggatgcggtcggcgcgaagtttattcgtgacgtggtgccgggagaaatcgtgatatttgatgaagacggcgtgcggtcgattgcggatcatgtgggaaaaacgccgatgcgctcttgcatctttgagtatatatattttgcgcgtcccgactctgtcattgacggtgcgtctgtgcattcggcgcgtgtgcgtgcgggagcatatctggccttggagcatccggttcaggcggatgtggtcattggtatgccggattccggacttgacgctgcgcttggttttgcgcgccaatccgggataccctacggtatcggctttattaaaaacaagtatattggccgtacttttatcgcgcctggccagaaacatcgcgaggatctggtgcgcatcaagctaaaccctgtttccgagacagtgcgcggcaagcgggttgttttggtggatgattcggtcgtgcgcggtacgaccagtgcgagaactgtgcgtctgctgcgggaagccggcgcaaaggaagttcattttcgcctttcttccccgccttttttaaatccctgctattacggcacggatattccttcgcgtgaaatgctgattgcacataagcatacggttgaagaaatggcagagatcatcggtgtggacagcctgggctttatcagcatcgagagtgtgaaaaaaattgcctgcggc

SEQ ID NO: 886 - DNA, 1059 bp, Unknown
  Description of Unknown: Clostridiales sequence
cttggctttgaaaagattgccgtgatggaccgtcccttaccggaaaacagacggtctgtaaagagctgggcaaggcgtgcgacgatggaacagctcctgttgctcaaaaaaccggaggcagaggtcggcgtgacgctgatcccggcgccgtataagctgtggccttatgagaaaaaaatgagcgatctggagagaaaggccctggcggacgttgacgcggacgcctttgcagtctccccgtacggggtcaatgcgcttaagaaactgacgttttatcaaggctttctgtatgagggctcccggttggaaacctggcagaacacgctggaacatggagaggaggacgggccgaaccgaaaggaccccaaataccttacgcatggcatccacccgtataaaggcaaattctatccgcagctggttcgtccgctgctcaatattttgaaaattcccgagggcggtgtggtgtttgatccgttttgcggaagcggcaccgttgcgctggagtccgttttgaatgggtatgatgcatacgggtgcgacgtgaatcctgttgcggttgaaatagccacggcgaaaaatacggttttcacagtttctccctatgagtttgaaaagcatatcgccgtgtttttgcgggggctttcgcgatatgaagagggcgattatacgcgtgcatttgcccctgacgccatggatgaaattcgcagctggtttcctgataatgtgatatcaaaaatgggatttctcctcacgcagattgacagtgtgccggacgaacgaatgaaatgctttttgcgggtgattttaagctccattatccgggaaatatcacagcaggatccgtcggatttgcgcatccggcgaagaaaagaagcgatttccgacgcccccgtatttgaaatgtatacaaaaaatctgcagaaacaataccgcaatatcatggcgtattataaggttcgcaatttggcgccgaatccgattgggagggcggtaatttggagaggtaacgcaacaaaaacggcagatatgacgtctcatcttcccggaagcggcgtt

SEQ ID NO: 887 - DNA, 1269 bp, Unknown
  Description of Unknown: Clostridiales sequence
gaaaatgggttttacgtacagaggactgtcagcatagaagaagctgtttcggcggatacggggtttgctaccaaaatatatttggtgcttccaaacgcacggtcgctgtatgatatcaattgttttgctccgggcgcatggtatcagcaaaatgaatttgtgccgcctcattttatcgggtatcataaggaaatccagtatcactggatgtacgagacgcagtatgcgctgcccatgtttgccgctcaggatatcagcgctcatgacgtggcatgcatttcccgtctccgtgcggatatgggcctgcgcgatataacgacaaggcttcatgatctgatggtcgacgaacacattacgtttggcagcatcggcgttagtacggcgggcgcagtgtctctggactatatttatcccggcgcacgcggaacttccaccagaaaattgccggatggcttcccgcttgagcatatttacagcaatgaatatcaccctgtccgaaaaaatggaggggactgctatgccgtttcccttgatttcatgaactgtcaggattttgccacgatgatgaagacgctatggcgcagtgtgtatgaacggatcaatgaaccggttgtgccgctggacaatgaactgctctataaaaacgccatgctgacgctgcgggatcagacaaattgctatgagggaagttggggactgccatttgccagtatgctgccgagcggggaaccgatgaaggtggcataccagtttggttttgtcggacagcagcccaatattggataccagctcctgcgttacggtacactctatgatgatcaggaggcgcaggacaagggccgaaacgtcatacagttctgggtggatcattcgctgaccgagtggggcgcgcctcacatctggtataatccgggcctgcacacctttgaggaccgccccttctggatccgcatgattggtgacggtatggaaggcatactggatgcctatgtgtttgaaaagaagcacggagaggatcacccggattggcttgcttattgcagaacggttgcggactggctggctcgcgcacagaatgaagacggcagctggtaccgttcctatgatgcagagggcaagatgctgatggagtccaaggcgaatacgagcaatgtgatccgcttcttggtacagctttatttggtgacggatgaggacacgtatcgggatgccgcgcaaaaggccggtgtgtggagccttgcgcatattacacggtatctggagtaccgc

SEQ ID NO: 888 - DNA, 1572 bp, Unknown
  Description of Unknown: Clostridiales sequence
atcggccctgtgtgggagcgtcctggccacctgctgatgtggcattaccggacctacaatggaattggctttcatgagtaccttcagctttgcgaggatctggacatggagccgctttacgttttcaactgcggcatgacctgccaggcgcgttgcgaagtgtattttgagggcgaggaactgcaatccatgatccaggatacgctcgacgcgatcgaatacgccgtcggccctgccgatagcgaaatgggccgtctgcgcgccgctgccggacatccggaaccattccgcatgaactacgttgaaattggaaacgaaaatcatggcccgggctatgaagaacgctatttactctgctaccatgcaataaaagagcgttatccgtggatgaaattcgtcgcgaatacgcatgtggaagaacacggactgccggtggatatcgtggacgaacactactatgcaactgcggaatactttgcagagaacattcacatgtacgacagttatgaccgaaacggcccgggtgtattcctcggagagtttgccgtattgcgcggcgcggtcggacagctttatgctgcgctgggcgagggcatgttcatggtcggtatggagcgtaatcaggatattgtgaagctcgcttcttacgcgccgctccttgaaaatgtgaattattattcctggtatccgaaccttgtgatctttaataatctgcaaagctacgtgattccgacttactatgcatggaagctctttggcgcggcgcgcggcgaccatgtcgtgtattcggaagacgaatcaaaaattctttaccgtccgttaaagggtatgccttctctcattgcaacgcacggcatgcgctataaaaacgctcgttgggatggcaagcctgtcgcaccggtgcacaatatcatcggctatgttgaagaggatggcgatgcctttgtcacggtgggcccggatgaaatgcagacggcggagtgtgcagtcattcacagcccgacggatcgctccctgattgttttgggagacggtgaggaggttaagacaggaacctttgatattgaggtttttgcggaagagggccgcgatattgcaataggactttacacctcgcgtatgccggacgaggtctacaaaaatgacgagacgcatccgcctcgtgaatggaatgcaaagattgtgcgtcccttccgttggacgattcagaacggcgtcagtacgctgacggagccacgcttccctgaaccggtgaatcttacagagccgaaagctgtttccctgcgtatgggcgaatataacacgctgcgctatgtgacgacagacgaatatatagagctttatgtaaacggcgaactgatccagcgtgcgcagaaaccgcattttgccgcatttgcttccgtagtctgtgacgacgaccatgaggtcatcattaaggccgtcaatatggatggaaacatagacgatgtagaaattacgctggattgtgctgtggaaagcgattatgaagtattgctcttgaccggcgacccgcatgcggagaacagctttgaaaatccggagaatgttcat

SEQ ID NO: 889 - DNA, 1026 bp, Unknown
  Description of Unknown: Clostridiales sequence
actgcggagcttgtcgcgtccggcctttctgagcttctggacgtagactatgatacggtttatcaacgtgccatgaaaaccggaagctattatgaatatgtaaaaaagcggattgaagcggatgaggcggacctggttcgtgaatttatcaatgaaaacgacctggatggcgagatcttccttgtcgaagataccaaacgctattatccgtatggttccgtcgcgtcgcaaatcctgggctttgttggcacggacaatacaggcctttacggaattgagtatgcttacgatgaaacattacagggtacgccgggacggatcattgcggcgaaaaacgcgaagggtaccgacatgccctttgaatatgagcagtactacgatgcggaagatggcgacagcctggttttaacgattgacgttgtgatacagagctacctggaacgtgcgctcgaaagcgcgcgggagaatgccggtgcatccagtgcggttggcatagtgatggacgtcaatacggcagcagtgcttgccatgtcctcgaaaccggactttgacccaaacgatccgcttaccatacaaagcggcgatatcaatgaatctctctccctcctctcaggcgatgcatatactgaggcgctcaatctggcacggcagagcatgtggagcaattccgcaatcagcgatacctatgagcccggttccgtttttaagattatcacggctgccatggcgcttgaggagagcgtgacctctctgaacgacaactcctttatctgtaatggcgcgagatccattacgatctatgaccggcaaatcggctgctggaaggacggcggccacggcgtacagacctttacgcagggcgttatgaactcgtgcaatcccgtctttattgcgcttggagaccgtcttggcggatccacgttttttaaatacttcgaggcgttcggtctgacacaaaagaccggcattacgttgccgggcgagggcggcggcgcttcgacgctgtatcactctgaagagtatctg

SEQ ID NO: 890 - DNA, 621 bp, Unknown
  Description of Unknown: Clostridiales sequence
accgtcccggcagacgaagatacgccccgcaagcctatcgacgattacgggcgcgataaaatccggagtatcgaatacctgcacggcgaatatgaaaagcacggattcccgtataccgctgttatgcccgggcatatctccggccccggctggacctgtatcaatcccaccggcaatcatgacccgtctgtattcaccgccattgcgcacggcgagcgcatctacgttccgaatttcggcgtcgagtgcgtacatcacgttcatgcagacgacgtggcgcaggtgttcgagctcgccatccgccaccgcgacgcagcacttgaccaggatttcctcgccgtggcgccaaaagcaattacgctgcgcggttatgccgagcatatgtatgagtggttcgggaaagaggccaacatcgaataccttccatggcccgaatgggtgaaagtaacggcagacgaagaaaaaatcaaccgtacctggcgccatatcacgcactgcaacaattactcctgtgaaaaagcgcgccgtatccttggatatgtgccgctgtacagcggcatggatgccgtccacgaggccgtccgctccatgattgaccgtggcgttgtcgaaactgattga

SEQ ID NO: 891 - DNA, 546 bp, Unknown
  Description of Unknown: Clostridiales sequence
tttgacaagaccggtacgttgacactaggtaagcctacacttacggacgtggtggcgtacggcgttgaccgtgacgaggcgctggccctgtgtgcagccgcggaaacgcgctctgagcatcccgtgggacgtgccatctgcgatgccgcctctggcgctgcaacgcatgaggttacggagtttacggcattacccggacgcggcgtggaggcaaaagtggacggcagacttctgctggcgggtacccaaacgctgatggaagaacgtggtatagatatttctgctgcgtcaacggatgaaaaacgcctttacgaagagggaaagaccgtcgtatacgccgcatgtgacggcaagctgtttgcactgtttgcggcggcagacgaattgcgtccggaaagccggatgctcatacagcgcctttcggaaatgggtgtgcagtcgtatatgttgaccggcgataatatgatgtccgcacgtgctgcggccgggaagtgtggtatcccggagtcgcgtgtaattgcgggtgtcttgccggggaaaaaggcc

SEQ ID NO: 892 - DNA, 819 bp, Unknown
  Description of Unknown: Clostridiales sequence
atgctgccgtatttggatacagacccggttgcgttgtttggctttttctatttactgaaaacggaggtgcgtggtatggagaaactttatatgggtgccgctttttatccggaagtgtatggaaaagatctcccaacatttgaaaaagacgttgagatgatgaaaaaaggcggcttcaatgtcatgcgggttgcagagttttcctggagctgtatggagccgcacgacggtgtctttgatttcgcatggctgcacgaacttgtggaccggctttatgaaaacgggatttataccattctgtgcacgccgtcggcaacgcctcccgactggctgaccaagaagtatcccgaaacgttgaagatgaacgacgacggcaaccggaaacaacatggcgcgcgccgccactgctgttcgaattcccgtgtttaccgcaactatgtgcgccggattaatacgcgcatggcgcaggagtttgcaggtcatctcgccgtcatcggctggcagctggataatgagatttctccggagcgccgcggatgttcgtgcccggcctgcatggcaaagtttcatgagtatctggcgcaaaaatttggtacggtagaagagctcaacgcccgctggtatctgaaactctggagccaggagtacgagagctttgaagatgtgccgcatccgcatgagtttacctggtcgcatccctctttgattgcagaatatttggagtttcagtctgatacaaacgcagaattcctgcacgaacaggcggaaaccctccgtgaaaacggcgttactgtgccgattggtacagatatgatgccg

SEQ ID NO: 893 - DNA, 738 bp, Unknown
  Description of Unknown: Clostridiales sequence
gccaatgaagcgctatacacccgtgaggaggaacaggggatccggcataactggctggtaggttccatggcgacatccgtcatgatactcacgggatgcatgttgctgctgatttgtggcgtaacgctttttttctacctctccctccgaagcgagttgacttcctatgcagagggagcagccgcttacctgacgaggtattctttctccgatcagaatgcagtccaggccggcgcacgcagttatattgcttcctttgaggaacgcgatatcatggaaattcaatatttagacgccgacggcgtgttgattcagtcctcgctcgggcgcgctgcaggaattagtcctcagggttcggacattaccgatgtgttggccggggaaagtaccgccatgtggcatgggcgggacaggtctaccggagaaacggtcatgtccgtttccgccgcgcttctcacatcggaggggagcgtaatgggcatcatacgttgtgtcagctccctgcgtaccgtgaatcttcaaatcattgaatattgttgtggcgcacttttactctgtatcctgattttggcgctgatctatttttccaaccggcgctttgaacggtctcttatggttcccatccgtcagatcaacgacactgcacagatgattgccgacgggctctacggcgtacacatcgatcctgtctatccggatgagatcggcgaactatgccgcacactcaataacatgtcc

SEQ ID NO: 894 - DNA, 897 bp, Unknown
  Description of Unknown: Clostridiales sequence
tacccgggcgcgcagatcatccggcttgaacagaactaccgttccaccaaaatgattttaaacgccgccaatcgcgtcattgcacacaacgagggccgccgcggcaaggaactctggaccgggaacgacgagggcgaaaaaatcgggttttaccgcgcggccacggaacaggaagaggcgcaatatatcgcaagccatattctctccgcttaccagcgcggtttcacgccgcgtgactttgccgttttatatcgcatgaacgcacagtcaaactcgatagaaaatgcattcaagcgcgcggacataccataccgtattgtcggcggcgtgcggttttttgaccgcgccgaggtgcgcgacatgctttcctacctgtgggcggtcgtgaaccacaacgacgaactccgcctgcgccgtattatcaacaatcctgcccgtaagatcagcgaccgtcgtgtggaagacgcgttggaattggcaagagccgaacaaattggcctttacgacgttttgcttcatgcaaagcagtataaccgttttgaccgtgcggcagcgcccatggaacagtttgccgccatgctggaggagttgcgtcttctttccgatacgatgccgcttgacgatttttatgatgttctgcttgaaaaaacggggtacgttgcagcgcttgaacgcaaaggcgatccggaatcgctgggccgtattgacaatgtgatggaactcaaaaccaacattgtcgaatatacgcgtacgcacgatacgccttcccttgagggtttcctggaagaaactgcgctttttaccgacattgaccgctatgatgaaggggcggacgccgccgtcatgatgacgctgcacagcgcaaagggacttgagttccccgttgttttcctatgt

SEQ ID NO: 895 - DNA, 771 bp, Unknown
  Description of Unknown: Clostridiales sequence
atgaatagaatcaacaatgcttttagaaatggaaaagcctttatcgccttcctgacaggcggggatccggatatcgaaaccacggaggcgttaattcccgttatggaggctgcaggagcagatattatcgaaatcggaattcccttttcagatcccatcgcggaagggccggtgatccaggcggcgagcgcccgctcgcttgcagccggctgcacggtaggccgtctctttgatatggttgcacgcgtgcgaaaaaccgtcaaaattccgcttctctttatgacttatgcaaatccgatctacgcctacggaacacagcggtttatggagcgttgccaaacctgcgggatcgacggtatcattgtcccggatgtcccctttgaggagcgcgatgaattccgtgacgcatgccgggcataccacatcacgcagatttatcttgtcgcgccgacatcggaatcccgtgccgccgacatcgcacgagaatcagagggctttctttactgcgtttcctctcttggcgttaccggggtacgcgccgagattgacgacagcattgcggatatcatacgcattgcgcgcagcgtcacagatacctcctgcgccattggtttcggcatcgcaacgccggaacaggcggcgcacatggcaaaatatgccgacggcgtcatcgttggcagcgccattgtccgcatcatcgcggcgcacggacgcgatagcgccggacctgtgtacgactacatgaaaagtatgaaagaagccattatataa

SEQ ID NO: 896 - DNA, 1104 bp, Unknown
  Description of Unknown: Clostridiales sequence
atgcagtcaactatcgtagaggcccgcatcgagatccccatgggcagccagaacaaatatgaaatagaccacaaaaccggaaagatcaaactcgaccgcgtgctctattctgcggcgttttatcccgtcgagtatgggtttatcgacgatacgctgagcctggacggcgacgcgctcgacattcttgtcctgacctctgctcccacctttccaggctgctatatcgactcgcgtatcatcggcggcatggacatgattgacaacggtgaattcgatgttaagatcctcgccgtaaatatcggcgatccccggtatgaacatgtgaaaacgctcgacgatctccctccgcatttattgcgcgagctgcaaaattttttctccacctataagacgcttcaggggaaggaaaccgttgtcaaacgtttttttgatattgccacagcactggaaattctggaagagtcgcgcgtgcgctatcgcgaaagtgccgaactgccctattccgaacagcaaatgccgggagataagagcatggatgcaaaaaacatgatgaaatttcttggcgtattggagcggctgaaatgcaatacgcgccacgcatatacatccaccatgcggcaggagagcgttgccgaacatagctggcgctgcgcagttatggcgcacttattgcgagatgaattcccggatgttgacatcaaccgcgtgatcgccatgtgtctggtgcatgactttggcgaagccgttaccggcgacatacccacctttctcaagtctcaggacgatgaggcagccgaggacgacgcaatttgccgtatgctcgccccgctgccaggcgggctccggggtgagcttaccgcacttttgcatgagatcaaacaggggaagactgcagagtcacgtattttgcgtgccattgaccggcttgaggcagtcattcagcacaatgaatcgcccctttcaacgtggattcccctcgaatatgagctcaatcttacttacgccataccggagtgcgcagagtttcccgcgctggccgcactgcgcgaggaagcaaggcaggaaagcctgcgtaaaattacagaagaaggaaaaaacgtatga

SEQ ID NO: 897 - DNA, 579 bp, Unknown
  Description of Unknown: Clostridiales sequence
acgttgaccgccggtgactcggccgccagcgctaaaaccggcgccgatggcgtggcatccatctcctaccaggaaacggacgccgcctatgcagaacttcgcgtctcatcaggcagccgcacgtttgtggattacgtcggcatagacggtacgactgacaccgatgtgtccggcgattactacacgtatatttatttggatcgtgaggtctatcaacccaccgatacggttcactactggggagtaatccttcctaaaaacggaacttctatcccatctgagctggaagttctggcatcttccgtcggagagccgcgcagtgtcggcacggtagaagtcatggctgacggcacgtttaccggcgcctattccttcgaaggaaacgtctccggctatgtatcactttcttttgcggcaaatggcgagacgctctgctcgactgcgtatacagtaatggagtatacaaagccggcctatgtgctcaccgtagggtttgaccaggactattatcgtgcaggggaaacgctcgacgttgcgatatccggtcagtttttcgatggtacgccggctgccggcctc

SEQ ID NO: 898 - DNA, 918 bp, Unknown
  Description of Unknown: Clostridiales sequence
cgtgctattggcgactcccgcaggccgctttatttcctgtgtgtctcttcgctaattaatgttgtccttgacctgctatttgttctgcagttcaatatgggaattgcgggcgtcgcctatgcgacaattattgcccagtttgtgtccgccatactggtcctgattgtactgtcaaataagagcgagccctatggtattgtttggcgtgaaatgcggctttccaaggcaatcttaaaagtaatcgtccgtgtcggcatgcctgccggacttcaacaggctgttacctccttctccaatgtctttgtccagtcttatattaatgtgtttggttcgtcctgtatggcgggctggacttcctattccaagattgatcagtttgtcatgttgccgatgcagagtttggcactggcgtctacgacatttgttgggcaaaacctcggtgcgcaccagcttgaccgtgccaaaaaaggtatgcgtacgtctctttacattgccatcggcacgactgcggtgcttgctatcctgctgaatatctttgcatcccagctcttacagctttttaaccaggaagcggatgtgctacattacggcattatttttgtgcgttttatgtcgccgttttatgttctgtgttgctggaaccagattttttccggcgcgttgcgcggagcgggagactccacggggccaatggtcattatgctttccagctttgtggtattccggcaggtctatctcttcattgcatcccgtctctttgattccatttatgtgactgcgctggcctatccgattggctggttgttgtgcagcctgctggtgtatattcgttatcgccgcggcaagtgggaaaagaattactctctgcttgttgataccgaaaaagcacagcagacagatgagccacagaacgcataa

SEQ ID NO: 899 - DNA, 771 bp, Unknown
  Description of Unknown: Clostridiales sequence
gttcaaaacgcggatcctatcgatgccattcgtaagagttatgccgacggcgttacggatgaattcattaaacccgttgtctgcaccgataaaaaaatctctgcaaacgactctgttattttttataacttccgtccggaccgtgcccgtgaaattacccgtgcctttgtggacgaggcgtttgacggctttacgcgtcgggcttttttcccgctgtactatgtctgcatgacgcaatatgatgccactatgccaaatgttcatattgcttttaaacctgaaaccatcgacatgccgtttggtgaagttgtcgcaaagttgggtatgaagcagctccgtattgctgagtatacaaaatatgcgcatgtaacttatttctttaacggcggcgttgaaacggtcttcgacggcgaggaccgtgttctgatcgattcgccaaatgtcccgacgtatgatctgcagcctgaaatgagcgcttatctagtaacggatgaggtcatccgtcgtatggatacccgcgaatacggcgcaattattttaaattttgccaactgtgatatggtgggacataccggtgtgatggaagctgctgtcaaagctgtcgaggctgtcgatacctgcgtcggtcgcgttgtcgatcacatgatagagttgggtggtatcgctgtcattacggcggatcacggcaacgcagaacagatgctcgatgccgacggcgttacgccgtttactgctcatacaaccaatctggtacccttctgcatttgtggt

SEQ ID NO: 900 - DNA, 765 bp, Unknown
  Description of Unknown: Clostridiales sequence
atcggcagcgcgcatacggaaatcatcatgactcgtgaggatgtcctttcttcgctggaaaaagtgatctctattctcggtacctatgacattaccacaatccgtgccagcatggggatgtatctgctctgtaaagcaattcacgagcaaaccgacgtccgggtacttttgaccggcgagatttctgatgaactcttcggctataaatatacggattttgcaccgtcagccgaggccttccaagaggaatccgtcaaacgaatccgcgaactgcacatgtacgatgttctgcgtgccgaccgctgtatctccgcaaactccatggaggcgcgcgttccttttggcgatctcgattttgtatcttacgttctctcgatcgatccggagaaaaagcgcaacacctatgggaagggaaaatatctgctgcgtaaggcatttgaaggcgactatcttcctgaggatatcctgtggcgcgaaaaggccgcgttcagcgatgctgtcgggcactccatggtggattatctgaagctctatgcggaagaggtttattccgacgaggaatttgccgagcgctgtaccgattatgatcacgcgcaaccctttacaaaggagtccctgctttaccgcgagatttttgaaaaatattatcccggtcagtccggcatggtagtggatttctggatgccaaaccgcagctgggaaggctgcaacgtgaatgacccttccgcgcgtgtgctgtcaaactacggcgcgagcggtcaataa

SEQ ID NO: 901 - DNA, 3690 bp, Oscillibacter sp.
ggacagacttccaccggcagcgcaccggtcgcaaggggtgaaaatgctcagaccaccgccacctatgaactgactgcaacgaataacatagagggaactgtcgttgcaggcaagaaatacgagaatggtgtctcagcaacccttaaaaacaccgcgtctgtggcaggtattacagatgccgtgttgaagttcgaacttacagaacaaccaaatggctccaatcctcagattctggccaaagacagcgaggatcaggaatggaatctggcggaaattggccagtgggggccgccacagggcttctcggttggagcgaattatgatgtaacaactaattttaccgtccagttcgacaaggcaggcacctataccgcggaattcaagctggtgagcgtggcaaagccggacgaagcgttggtaaccggtacgatgacgattgacgttgctgtatctgaagatagtgcaattcaggtagagtatacgaaagacagccaaagcaaaaccgtctattacaccggcttggacaatgatgatcgaaataacgatcattactgggatgttatcagcgatttgagcagcggttatctaaacgctgataccaatgagcccataaccgttactctgctggatgacattacccttgcagacaccaccattctggtggatgctgggaaaaaggtcaccatcaacggcaacggtcatacaattactgctacgatgagcagctttgcagcggccggcaagccaggtgctgatgctgtctctatcaccaacgacagtacgctgacactgaacaatgtcaaactcaacattaaagccgctgatgccgttgtgctgaatggagaaacttcgacacagggtatttacaacgatggcatcctaaccctgacgggcggcacacaggtaacgataaacggcgtatcgaagaacggcattaacggcagcggcgatatcacgatcagcggcgagaataccaagatcgaagtaacggacgttggcggctcagcgatcaaatgtgatgatctgaaagcggatgagggcgcaacaatcactatcagcaacacgccttatcatggtatcactggtaaaaacgtgaccatccagaatgccacggtttcggtggatgatgctgattatattggtatcgcggcgaccggtgatgtatctgtcaccggtgaaggcacgaatgttaccgttcagaacagcggcagcaatggctccggctatcctgcggttcgcgtggatggcggctttaccatgacggaccgtgcgaacctgacgatgactggcaatggcccggccgaaagcggcgccgatttcaacgctgttcgactgaacgctgttgaggcgactgctaccgttgagggcgcgagcctgaacggtggtattgacggcacgaccatttcagaccgtaccggcagcatctcggtttccaatgcaaccgtgaccggaaacatcacgaacggtggaagcgccagcactgtactgctcaacagccagattaacaaagccccggagggcgcaattgttatcggctgcacagatacaaccggcgagaaaatcgaagattctgtgagcgagggcgtggttgccgtatacaatggaaccccctatacttcgctgaaacaagccgttgaggccgccactggcgatgatgcaaagaccggagacattacgctggtagcggacgtatccctgaccgaaaaaatttcgattaccaaggacgtcaccattgtcggcaacggaaagaccatcgcaggcaaaacggacagcacggaggtctattttgagatcaccgccggtacgcttaacatctccaatgccaagttgactggcttcggagacaccgctgcgacccagacaggcttcggcgtattcaagattccgaacacggcaagtaatgccaaaattattgcctctagcttgaccgttgaaaagtttaaccgcgcggcatttgatgtgcgcaacggcgcatttgaaatcaaggactgcgtgattaactgcgacaacggacaggaagcggctctgaccaagggtattgtcgccggttatgatacgactggcacagtgacaggcagcgtagagggctgcaccattaccggctctaactccacctacgagggctggagttccaacgggatcgaaatcagcgccggggccgaggtcaaaatttccaacaccagaattgacagtatgaagggtggcatcagcgttgcccgcaactatggccatggcgaggccaaggtgacactagagaactgtaccgttaccggcaaggactatgccctgcgcatttttgagagcaataacagcagcgaaccagtcacaggatcttctgccagtctgaccgttcagggtggcgcctataccggcgatgtgcgcatcagccgcaaggacgctgatacaaacggggaaaataacgcaaatggtagtaccattacagtaacaggcggcagctttgattcctcggttgcccagtatgcagacagcagcttgcagtatgaggcggtcactgcggacgggaaacagtttacctaccacaaaacggtggaagaagcgattgcagcggctggcagtaacggcaagatcactctgattgctggagaaagtgcagaaaaggcagataccgtgacgctggattatggctatgacaatatcaagtacacggtgaaagttcctgctggagagaaactcagccttcccacggcgaaccgcactggttataccttccagggatggtatctgaataacagcaagatcacggaatacaccgctgcgcaggagggtggacagacggttatcattaccgcacagtggtcctacagcggcggcagctctggcggcggtggcagctctggcggcggcggttcctctagtggcggaggcggtggaagcagttctgcttcttacgccatcacggtggataaggccactggcggtactgtcaaggtcagccccacccgtgctgacaagggcgacactgtgacgattaccgttagtcccaacagcggttacgagctggacaccctgaccgtaaccgacaagaacggcgacgaactcagcctgaccgagaaatcggacaacaagtttacgttcaagatgccgggcagcaaagtgactattgaagcgactttcgccaaggtcagcgagcagacgaccccgggcatgtcctttaacgatgtgtctaccggcgtatattattataatgccgtaaagtgggcggttgaaaatggcattaccagcggcaccagcgcgactacgttcagcccgaatgcttcctgcacccgtgcgcagatggtgacgttcctgtggcgtgcaaacggctcgcccaaggcgaccggcgcaaacccgttcactgatgtgcaggccggctcgtactattacgatgccgtcctgtgggcggttgaaaagggcatcaccagcggcaccagtgcaacgacctttgcacccaatgctactgtgacccgcggccagaccgtggcgttcctgcatcgcgcaaacggttccccggcagcttccggcaacagcccgttcactgatgtagcttccagtgcgtattatgcggcggctgtccagtgggcggttgcggaaggcgtcaccagcggcaccagcgcgactacgttcgccccggccgctccctgcacccgcgcccagatcgtgacattcctatatcgggatatggccgaataa

SEQ ID NO: 902 - DNA, 4515 bp, Oscillibacter sp.
caaaatcccctgtcctatgacctccacgaactgatggacggcgaggagatccaggagatggcccatcaagtggaggcgctgcggaaggagttgtatgaagccgctggacgcaaccgggactaccatgtgaaagcggaggatgtaaaaaatctgctcccagactgggctggggccgatggctgcattgccaccaaccgcatcacagtggagggctgcaaggttggctactgctaccgggagaagccggacggcgactgggacagcggctggcgcttcactgcccgggacgaaagcgagtcttacatggatgaccccaacaacgccggcgtctataagctgaacaccatctgcaacgacgacccggagatcatctccctgctgaacacccccgccccctgcgcctttgagcgggatgagaatggtatgttccagcagatcaaagactggaagccggaacaggacgaggaggacttggatatggacattttggagcggtgccagaagtggcatgaggaggacaaattccagaaaatcattgacgcgctggaggccattcccgcccaggatcgcacccctgagatggatagtgagctggcccgcgcctataacaactggggtgctccgcgttccaatcgggaggcccttaaaaaggccattgccctgctgaagccccatgaagaatactttgcgggtgatcacttctggaacttccgcataggttatgcctattactatctggatcaggagggccgcgctctgcgatactttgaaaaggctttggaagcccgccccgacgatgaggataccaaagaattcattgattggtgcaagaaaggcatcgtcctgcctcagtttaataagtgcttccgagagcgaacgaaagattggtgggaaacctttgccgagatggaagggtcactgcgccaaatgatgaacgatgacaaagaccatacccgtggcgcagagattgtggcccagatggagaatgtcctgaacctggtctttgatgatatttccttcgagatgggtttcaatggagaaaaatatgagctgatcctcaccccggagggagacaaggtcaagctgtttgagttagtctatttccaaaagcacgcgactaaagaagtgctggagcactggaacatcctggtgggccgtcagcccatccagaacatcggcctgcgcaccgatgacggctgggaaatctccggagaggatgtgcaaatttggctggagaggcagggcgaaaacagttttgccatctccgcctactgtgaaaagctgctgcctatgcttggggaggaagaaggccgggcctggtggatgctcactaccctcaccgaccaggtgctgggtgagatcccccacatgcggtacatagacagcttcgatgtgctggaggaacccaaagaggaaccgtccattctcatgtctcagctccccgaaaagctgcgggaaaaagggctggaactctccaccgacccagaatcctttttggaaacctatatgggctaccagatgaagccccatgaggacccggacgccgactggcgcttggatgtggtggttggctccacctgctgcgcccctcttgtcaacggctatctgaacgcggataacgattttatggacaatctccacgccgacggcgtggtggcgggcttcttctgctaccccctggataccctgcgggaggaggaaggcagtgaaaagatcttcgacttccgggacaggctggaggaatccctcgccactgaggacggcccggaggcgctcaccctcactggcggagccaccggcctctactgcggctatgtggactttatcgcctgggacatccggacggcactgaacaaggcgaaggagttctttgaggggacggacatcccctgggccagcttccacaccttccgccgtgaggcgggctcggtaagcctgaagcagcaggaggatgaaccggatgccaaggagcaggagaacgagcttgaggaaaccctgacgggcatggactatatcccctacaccccggaaaatgccgaggcgttcttcgcacagatcgagcagtggaacgacgaggacgagtacacccgctgtatccaggcattgaacgccatcccggaggattggcggaactaccgcaccgcctatgctctgacgagggcgctggaaaactacgccatcatcggggaccatgaccagggcacccccaactacaagggggacaaggctcttctgcgggccattcaggtactggagtccgtccgggaggaaggacaggacaaggcggagtggaatatgcgtatggcttatgcctatcagtatctccacggtcaggaggaaaaggccatcccctacgcccagcggtgggcagagctggagccggaggatgaaaatgccccggcggtgattcgggagtgcaggacggagatccggaaacgccagcgcagccggaacaaaaaggccaagttcattcctggggatacccctttcgagggcttcgatctcaccaacttctgggatgacaatctgtatgcgcaaaaagagtatatcagcgagccgccctctgacgggctgatcgccagcgtggaggaggagctgggctacaagcttcctgcctcctacatctggctgatgaaacagcacaacggcggaattccagtaaacacctgctatccctgcgatgagccaacctgctgggcagaggatcatgtggccattaccggcattttcggcatcgggcgggaaaagaactgctccctctgcggaaacttaggcagccagttcatgatcgacgagtgggagtatcccgccatcggcgtagccatctgcgactgtcccagcgccggacacgacatgatcttcctggactaccgggcctgcggcccccagggagagcctgcggtagtccatgtggatcaggagaacgactacaagatcacccatctggcagacagcttcgaggaattcatccgcggactggagcatgaatctctctatgatccggatgaagatgcagacgatcttgacgaggaggatgatgctgacgaggaggaaaccgaccgcacgggcccctttgccggttttgttttgctgtccaagggagcatgggacaaacagcagttcatccgggacatgaaggagacatggaacatcaccgtggaggaatgcgacgccagtgaggagaaggacgacgatgcgctggtattcgaggtaggcgatatgcttgccgctgtcagtctggcgacttatcctatccccaacggcgaagcggaactgaatgccgagaataactatatgtgggaggatgcggtccaagttgccagggagcaccgcgcccatatcatggtggctgtgctgggtaaagaggaaaaggttctggagaaaggcaagctcttcactaagctggtggccgcctgctgccgccaggaatacgccaccggcgtctacaccagcggtgtggtatttgagccccggttctacgagggctttgccgatatgatcaaagaggacgaactgcccatcttcaattgggtctggttcggcctgtatcggagcgagggcggcttgaacgcctacacctacggcatggacgtgttcggcaaggaggagatggaagtgctgaacaccgacgccgagccgggggatctgcgggactttttggccagccttgcctcctatgtgctggcgtgtgatgtcatgctacaagatggcgagaccatcggcttttccgcggacgataagcacaccatcacccgcagtcccggcgtctctctgccggaggagcagatgaccctgaaaatcagctgggaaccgctggatggcaatccggatgagggcggtgagaacggcccggagggtgacggtccccaggaggaaagcctcggcgagactgaggtctacactgaggaggagatgacggccgtcgaggggcacattgagcagtatttcggtgaagttgagaatgtgttccacgagctggtctccccggacatccatgtggacatctgcatcgtgccgccctctgagaagcgggactactacaccctagtgacgatgggtatgggcgctcaccgcatgaaggtgccggaggaattggcggaatacaagctggaacgggcggagcttgccatcgccctgccgagggactggaagctggatcaggaatctatgaaggatgagcggtggtattggcccattcgcctgctgaaagtcctggcccgtctgcccattgccagcaatacctggctgggcttcggccataccatggacaatgagcagccctttgcaaaggacacaaagctgtgcgccgctattctgaccggcccccaggacaccgaagatggcagcgaagtctgcatcctgccgggcggcgaggaggtcaacttctatcaggtgatccccctctatcgggatgaactggaatataaggtggcccatgacgcagacgctctgctggacaagatgaacggcatcagttttgtcgtaaaccccacccgccagaacgctatcactcgt

SEQ ID NO: 903 - DNA, 1350 bp, Oscillibacter sp.
atgaatgggtatctggcaagagtgatcgaagaagtgaaggggaaacacggagacgaaccggagtttgtacagacggtggaggaggtgttctcctcgttggagccggtgatcgagcagcatccggagtacgaggcggcggacctgctgagccggatggtggagcctgagcggacgttcagcttccgggtgacgtggatggcggacgacgggacgtggcacacgaacacggggtaccggacgcagttcaacggagcgatcgggccgtacaagggaggattgcggttccggaaggacgtgaacctggggatcatcaagtttctggcgttcgagcagacgttcaagaacgcgctgacgggactgcccatcggcagcgggaagggcggcagcgacttcgatcccacggggaagtcggatgcggagatcatgcggttctgccagtcgttcatgacggcgctgcaccggttcatcgggccggacgtggacgtgccggcaggtgacatgggcgtggggacccgggagatcagctatttgttcggccagtaccggcgtctgcgcggcgcatgggaaaacggggtactgaccggcaaggactttgcctcgggcgggtccctggtacgtcctcaggcaacggggtatggcgcggtatactatctggaaaacgtcttgaagcacgaaggcgagagcattgagggcaagaccatcgcgtgcgcggggtttggcaacgtgacatggggcatctgccagaaggcggcggatttgggcgccaaggtggtgactctctccggcccggacgggtacatctatgatccggacggagtgaccaccaaggagaagatcgactacatcgtggagatgcgggcgtccggacggaaccaggtgaaggactatgcagataagttcggcgttgccttctatccgggtgagaagccctggggagtgaaggtggatgtatgcatgccgtccgcgatggagaatgacgtgcacttggagcatgccaggcagattgttggcaatggggtgaagtactacattgaggtggcgaacatgcccaccaccaacgaagcactgtcgtatctgatgtctcagccgggggtgattgtggcgcccagcaaggcggtgaatgctggcggcgtggctaccagcgcgctggagatggcgcagaatagtgagcgtctggtgtggacagaggaggaagtggaccagcgtttgcggcagattatgaacaacatctacacgatgagtgtggaggctgcggagaagtacggcctcgggtataatctggtagctggtgccaatattgcagggttccagcgggtggcggatgcgatgatggctcagggcatcttctaa

SEQ ID NO: 904 - DNA, 3105 bp, Oscillibacter sp.
atgaatacggcaaaattttgtatccagcacaaggtcaccaccttgctggcagtcatcatgatcgccatattcggcgtggtcttcaccacccagttgcagatggccctgctgcccaacatggaagctcccatggctgtggtgatgtgctactataacggtgccacgcctaacgatatcgaggagcttgtcacccgtcccttggagtcggccatcatggccgtccccggcgtggactccgtctcctccacttcgtcggacggtgtcagccaggtgcagattacctatgtggaggacacggacctggacatcgccgccaccaagctgcgggagaaattcgacatgctctcgctcccggatggtgccatggaccccgtgattgtcaacatcaacgtcagcgacctgatgcccaccgccatcatcgccctgatgggcgaggacctgtcctctctccaaaccttggcggaggacaccgtctcccccgccctggagcggattgacggcgtagcctccgtcacagtcagcggcggcgtaggccagcagatcgaggtgcagattgaccccgcccgagcagccggcttcggcctttccaacagctacatctcccagttcctggcagcagaaaacctgctctatcccggcggcgatatgcaaaacggctccaagacactgaccgtcagcacagacgccaagttccagtctgtggaggacgttgaaaatatgctcctggctcttcctaccggcggcattgtccgtctgggtgatgtggccaatgtctccctgcaggcacaggataccgacaccatggcgcagatggatggcaccgcctgcgtaattttacaggtttccaagcaatccggtgcaaatgaggcatccacggctcaggcagtggatgcgcggatggcggagctggcagaggagaatcccggtattcgctacgccgcaccctatcttgcctccgactacatcaacctggtggtggagtccgccctgcaaaatatcgtcctgggcgtggtgctggccgctgtggtggtctttctgttcctgcgccgctggggcgccaccatgacgatcgcggtctccatgccggtgtgcattctcgcggtgttcgtcctgatgaacgtgtttgacctcacgatgaacatgatgagcctgggcggagtcgccatgggcgtgggcatgattgtggataactccattgtcgtgctggaaaatatctaccgcttctccgccgaagggcatgaccggctaagcgcctgtgtggatggcaccaaggaggtgactacctccgtggttgcctccacgctgaccacggtggcggtctttttgccgttgggccttaccggcggtatggccggcatgctgttcaaggacttctgtctgacgattgccttcttaattctcggttctctcgtgatcgccctgacgtgggtgccgctgctgtgctatctgctgctggatgaaacaaaggcccggcagcaccagctgaaaagagcaggcagccgctccattattgcccgctgcggccagtgggtccgatggctgtatgaccgttacctgcggctgttggactatttcctccgtcatctgaaagtcggtatgctgacagctgttggccttgttgttttcttcgcggtgtgctgcctaagcaccaacatggtactgctgccagaaatggaccaggggcaggtcagcatcagcatcacaactcccattggctctgatgtggatgagaccacagcctacgccgaccgggtggtatctatcgctcaggaacaggtgccggagctggagagcctctactacctggcccagccggaatccgcctctgtctccttgatgctggtggaccgcggcgaccgaagccgcagcagcagtgagattgctgagagccttcgccccttcctgcagaacattgccggctgcgagatcaccgccagcgcctctgacatgaccgccatgctgggcggcaatgatatcagcgtggagatcaccggtgacgactatcgcattctcacggcaatcgcggatgatctgctgcgggaaatctcccagttggaggatgctgtggatgtcgtcagctccgtgtcggagcaggtcccccaggtggaggtcactatcaaccggcaggccgcctcgcaatacggcctcactgccgccagcatcggttctgcagtccggtcggagctgaccggtgagactgccaccactgttaccatcaataacaaggagctggatgttgtggtcaagggtgacggctcctatgccgccagcctggatgccctgcgctccatgcctgtgtctaccgccatgggcggctatgtgccgttaagctcggttgccagcgtggacattgttcaggctccccagaccattacccgcgtcaaccagtcccgccaagtgacgatcacgggcgataccgtgagcggcaatgccacggagatcaccaagcagctcacccggattttggacaattaccagatgccagagggctacaccgcagagctcaccggcagttattctgatatgacggagaacttttctgatctgctgctggctctgctggtggccatgggccttgtgtattttgttctggcggcgcagtttgagtcctttctgatgcctgttattgtgatgctgatcctgccggtggcctttaccggcgcgctgttcgccctgcctctgacgggacgggacctgtccatgatctccctggtgtctttgatcatgctggcaggcacggtggtgaacaactccatcattttggtagaatatattaaaatccgccggcagatgggcgaggagcgggagaccgctatcatgaaggcctgtccccttcgaatccgccccattatgatgacgacgctgaccaccgtccttgccatggtccccatggcgtttggcattggggacaccaacgaaatgatgagcgacatgggcgttaccatgatgagcggcatgatcatttccaccgtggtgacgctgctgttcacgccggtattctactccgtaattgatgacctgcccaagcatttccggcggaaacatcagcgtccaccggacatctcccagactgaggcaactgcggagcccgttgaaatttcctga

SEQ ID NO: 905 - DNA, 2463 bp, Oscillibacter sp.
atgattgtagacaagcggaacctgatctttttcctctatttctgcgctgcgattttttcgcttttttccagagggtgggtagccgtctgcaatgatattacagagtatctgccggctaccacagaaacccggcagggcctgaccattatggaagaggaactgaccacctttgcaaccgcccgagttatggtgtcccatgtgacgccggacattgccagatctctggcggagcgtatggagagcattgagggcgtctcctctgctgtactggggggaagcgccggtgcaaacacaacggccgacgatgacgcggaggagacgccggaggatatcgccgcgtattttaaaggagcggacgcactgatctccgtgacctttgacggtgaggaggatgacgacatcagcctttccgccctgaacggcatcaaggaattgctggaaccctacgacttttatatagactcgccggtgggagcagatcaggccgataccctgggacaggaaatgggagtgatcctggcgattgcggcggtagtgattctgctggtgctgctgtttacctcccggtcctatgccgaaattccggtgttggtgattacctttgcgtcggcggcgctgttgaacctggggacgaatttcctctttggagagatctcctttgtctccaactccgtcacagtgattttgcagctggctctggcgattgactacgccatcattttactgcaccgctttctggaggagcgggagcacgccggagatcgagaggcatgcattaccgctctgagcgccgcgattcccgcgatctccgccagcagcctgacgaccatttccggtttggctgccatgatgtttatggagtttcgcattggctttgatatgggtatggtgctgatcaaggcaatctgcctgagcatgctgtctgtatttactctgatgccgggccttttgatgattttttgcaaggcgatggagcggacccggcacaaaaattttgttcccagcatcgaccgctggggggcctgggctgtgaagctgcgcttcatcggggtgccggttttcacattgtgtctggtgggcggctttctgctctccaaccggtgtccttacgtctacggctacagccagattgaaacggcccgtcagaacgaggctcagatcgcccagcagcggattaacgagacctttggcccccaaaatgtgatggctctgctggttcccaagggggactatgacagtgaaaaggcactgctggagcggctggagacctacgagcaggtggactctgccatggggcttgccaatattgaggcgatggacggctataccctgaccgacgcgctgacgcccagacaattttccgagctgattgatatggactatgaacttgcctgccttttgtactctgcttatgctgccgatcaggaggagtacgggcggattgtggggggcgtggacgactacaccattccactgatggacattttcctgttcatccacgactgtaaggaggaaggctatgtctctttggacgagggtctgaaccaggacattgacgatctctatgaacagttgatggacgcccgggttcagatgatgggagagcattactcccgcatggtcatcagcctgaatctgccggaggagggggaggagactttcgactttctcaaaactgtgcatgcggaggcggagcgatactatgagccggacagtgtctatctggtgggagactccaccagtgattatgatctgtcggtttcctttgccagggataatgtcatgatcagtgtactgtcggtggtgtttgtcatcatcgtgctgctgttcacctttatgtccgtagggcttccgattctgctgattctggtgattcagggcagtatctgggtgaactttgccttcccgggcatcacgggaaagcccattttcttcatgagctatctcattgtcaccgccattcagatgggcgccaatattgattacgccatcgtcatctcctcctggttcaatgagctcaagggctccatgtccaaggagcaggccatgatccgcgcgctgagccttgcctttccaaccgtcctcacctccggctctatcctgtccgtagcggcgttcctcattgcaaaaatcaccacggaggctagcatcgtcgggattggagagtgtctgtgccgaggaaccttgatctccatgttcctggtgatgttcatcctgccgcagatgctctatttgggagaccgcattgtggagcgcacccgcttcaatctcaaattcccggagcatgagcgctcaagtctgctcagcggcggcacggtctatgtcagcggccgggtgcggggacgggtcagcggtattgtggacgccacgatgcatggtgtcatccacggagaggtctctgcaatggtggagacgggagacgaggaacattccaaggaggaagagcatgaaacgcatacatag

SEQ ID NO: 906 - DNA, 2253 bp, Oscillibacter sp.
atgcaaaacaatcaggaaaaaacaagaaattccgtgtttatcaaaacgctccgcaggggggtgctctgttctctgattcctctgctcttcatgagcacttgtatttttgttctggatttacagcggtccttggagcagcttggcagcgtgacagtgaatatgctggctcagagcgaccaaatggtgcattacatgatggaggacgtcatgcgcagcatcagcaccttggccaaagacccttctgtggtggacttctccatgcggccctatctgcgggacacagagcgaaacagcaatctctgcaccctcctctccacactgtccgattcctacagctatgtggaggagtccattctctactccccctatgagtccttgcagatcagctcatccgggctgattgcctacggtttgcaggaagagctctccgataacttccagcaggcaaaggacacctgcactgcctgtatgcagatcagctctgttgaaggcggaatgcaaaagatgtttcttaccatcggaattcccgcgtattccaacgatccgcaggccattgcagttttacagattgatccgggcgccttttttacgctctccatgggcggtgatctgaaggacaatatcaagcggaatctctacatctctgatcgggatgggaatcttctattttccgatcaggaactggagttcagccagaaaatcactctgccgcattctgatctatctaccggttcccacctgacactggcagggtctgccttgctgcgatactctgtatttaccaatcctcagctggggtggcgctacacctatgtcacgggcgctttatccggaaacaacagttggcttcctctggtgattcccctattgatcagtgtgctggccagctgtgtcatcggcttactgttggcttatcaaagcaccaaggtcctgtatagccctctggagcagctgatttccgcacttccagagccagaagcagagacctcccaggatgagtaccagcgtcttgcgggctattacgatcagcttcttaaccaacgggatgaggtctatgaacaggtagaggcgatccgacctctgctcctgaaaaaattcctggtctccctggcagacagcacgcaaatttcccgggacgaagttttatatcaagtgcgtattttggaggtccccttccaggcgacgcttttcaacgcctttttcctacagattgacaactactatgccctgccctattccgagcaggaaaagcaggagctcaaagcgcaaatgcaggcgcaaatctctgcctgtgccagcagcatcgcctactgtgcggccacagagctcaatgatgaaaccctccttatcatctgcaatcttcactcggaggagccgccagagatcggaaagcagagtttccgagcattggccgaggagattcgggaggagctggaggggctttggccgatcactgtgacgctgggaattggccagatctgccgctgtgtggaagacctgcccctctcctgccagcgggcaaaagcggccctggcttacaagctgtatcgggggcagggcagcatcattgattttgaagaagtgcaggtggagccccaccagatttactatgattttgaaaccgtgcatcaggttgtcaatcgtgttcggacgggagatggaaggggcgcagtccatctgctccaggaaattttccgcacctttgcctcccagcagcaggtccctccaaaacaggtccgggccgttctgcagtatttgacctccggcattggggaaatcattcagtccgcgcagctcccactggaacctccggcggagctggagtccgagctttccaagaaggcaacccttccggatatggaagtctggctgacagagctgtgcatgcgcacggcggaagccatgaggcgcacttcttccgaccgcgtccgtcaaaacgcggagcggatcaaggcgtatatcgacaacaatctgacccaggatatctccctgtcctccatctcggaatatgtcaattacagccccacctatgtaagccgggtctttcgccagcactacggtgccagctacattgactatctgaattccagccgtgtcaagctgtcccaggaactgctctccgcccgtggagacttatctgtcaaggagattgggttccaggtcggcttcaacaacttgcagtccttttttcggatcttcaaaaagtacaccggtatgacaccattgcagtaccgggaaaggcaggatcgatga

SEQ ID NO: 907 - DNA, 2115 bp, Oscillibacter sp.
atgttgattcaagcacaggtattagctgccagttcccttacaacagatcagatcattgacgtcgtagcaatccttgttcctttgctgattgcatttgcagggggaatctttctgatttacaggtggaggcacagagcggagcgaactgtgcggattgacgcatataacaagctccaccatgacgcacaggaaattgtcaagagtcatgagcgggaaagcgtcttttttcaagaggaccgcaccctgcaaaagagcttttcaaagaatatgacgcttatcaatgtggacacggacagtcagtatacgaatgagctgccccattttgaggggtcctatttgattaccggtgaggcgggctgtgggaaatccgaaattttgaagcatgattttcatacatgctggcgtcggcaatgcaggaggcgccggctctctgccaagacaggcacttattattttgacgcggaagcactattgaatttgctcaaggaggacggtagacggagaagagaggagcttttggcaagaatcaaagcggcaagacttcgtaaactgcttttgtatgttgatggtgtggatgaactgacagatgacaatatggagcggttccggcagatcctggcggaaatccaggacagtgtgcaggtgttggttccacggttcagctgccgcacagaatttgccaataaacatttgcgggagaagcattttgaccatcgatatgcagtaaagccctgggaacaggtacagctggccgtcctttcagaccagattctcgacagtttgaaggaggagcactttcccaggctgcaagctgtcagaaatgatatgaggcatggagaaattccgtggaactttatcaactctccactgctgctaaagctgctgctttatatgaaactgtatgggcagcacgatatcgcgctaacttcaaacaagttttccttttactcggaattcttccgtacgttgatcagtgtttatcaaggccgaaaccaccatgcctcctatgatgtggaccatgagattgacgaggttgctaaagcggttttcgatgcgtatacgaatggggaaaaaacggtttcgtcttttccgtccctggcaccgattttaaagcagagatctggccagagaggcgagaaggtagggcttacccatgagaccttttatgagtatcttgtggccagatactatcacatccaatttcaaaaggatacgttgtccagagagtgcgtggacgtgatgaaaagtccctattcgaatgactttgcggattttatcacagacgccttttccgctgactcggaaaagcagcagattcttacaatgaaattgatggtccggctctatgcatataccttactgccgtctgttagggacatgcttcagcggcaatttgcaatcgagaatctttgcgaccaaacactgtccgactccatgaatgacacgctgtctgcagtcagcgaaaagcaaaatccgtttctgaccctgaaatacgagattatcttccgcatggggcggtttccgccggagatcgaacgggatatgcgtatccgttttctggagtttgtctatgaatatgataccaacacaggtgcaaagtatgatcagccctatttcgaagcggttttgaagcgatgctgtgcaatcagtgcatcttttcttggaggagagcgagtggaactggactatatcaggcatatgctggattttggaacctatccgtatgacgagaattatgatttggcaaaccgttcccacacattggtgtattactccgatgtgccagacagcaatcttgatacattccgggaccgccatgcggaaaactcgtggtcgtttgcccgtgccaagcggatggaacggcttgcctttccactgccggattccatttccgatatgacagccaaagagaaaaagaaattttatttccgggcctttgacattgcgaccatctacacatttttgcgaagccggcctcaccagaccctgagcccggaagaacttcacatccttacagatttcaagattgatttcatagggatgagtgacgagcgccgaaccatcctgcgggatatgaaggaggagaccttgaggctggctcaaagcagaggatga

SEQ ID NO: 908 - DNA, 2475 bp, Oscillibacter sp.
atgaccacctcaagccatgctttagatgagttgattacaacgccgcagcaggatcaagctcttttaaacatttttcgctatccactgactatcattgccgcgccggacggctaccgcaaggtctccatcctcagacacttcgcggcccagcacggtgctctcttcgtctgggttcgccttttctggagccaggaatccggcgagggcttttggagggagtttgtcactgccattggcaagctctctcccactgttgccagagagatgtcaaaatttcagtatccggactcttttgaggcttgttccacggttgtcggtcttctggaagggctatgcagggacgggcacctcgtgattgttctggaggactttgaccgcgtggaaacgcagagggttgataaactcctgcaacgtatgctgcagtgcgcctccagccagttccatcttgtcacgatcagccagagcccgccgcttttgtacagcgatggttatctgctctttccggactgcaattttatcggcaaggacattttgcagttcagcagggagcagacagaccggctggccacttccctcaacaagcggtatgccgcctcagactctttctggctggcggagtatgcgggagggtggccgcatctgattgtctatatcctttcggagtcccgtgacaaggttttaaaccgctattacgccgcgcgcctggcctcccaaatgtacagaatcgccttttcccgtgagctggacccgcaaatggcggatattctgctggtactttgtgagctccagcagttcacgctggaagatgccattgaaattctggataaatatgaggatgccgacaccatccatcaatggctggacactctggcggcggaaaccgtttttctcagccgccaggagaccacctataccatgtgtccctctgctgttgaatttttgcaggaggaatcccggaaggtccactcctccatggtccggatcgggctgcagaacatcgccttgaaatacttttccgccggcagtccctccctggccatctccctgctgtttcggcaccatgatctggacggactgctgagcctgctggatcagcacgtggtggaggaattcagtgagttggtcatcacaacgcttttccagtgcagcgaggatattggaattccccagatggcggttcaccccatcgctgtttgccagatcgccttcatccttttgaaatcggacctctatgcgcaaaccggcatccgccttctggagagtctgcgggagtatacacttcatacagaaaccttgtcctatgaccgggaggccgttcttggccagattgaactgacgctggccaaccggcagagcgggcagatttactcaaaggggctcattcggctgaccgccgcctctcctcagggaggtgtctatccctcctggattgcaccgagtcttctcggaagtgtccacagctctgttggcagtatggtggaggaggtggctgcgttccagtccctttgcgcttcggacggggctgattacctctcccccatcaagtgtgccaacatcacccaggcggagtaccagctggaaactggctatccctccaaggccatctactatgccctggagagcatcacagattctgaccgcaaatccgccagcctcatctccctctatgcgtatttcattattgggaaggcctctatcatgaatggcgacccagccaaggctgaggagctggccgaccggattggttccatgttttcctcctctcgggacgcgcggctctccagcctgagcgatatctgccgcggatatatttatacttgcctaggtcagtgggaaaaggtccctgaatggattcacagcgagcacgccaatcgcctctctcagcactcctcctacgcttatattatcattggcaggatgatgcttcaccggaaagatttcattggctttgagatgatgtccaagcagtggttaaaggtgctgaaaagcagcagtaatctgctgacagaaatccactatcggattgaaaaggccatttccgcctatgctctctacggcaccgcccaggcagtgacagagctcagcgccgctttatccctggctcttcctgacgaaatctgcgctccatttgcagagaacgggaaaaagctgcttccgattcttcaatacgccattgccaaccacttcattgacctgccgctgtcctactccgaccggctgaattcattgatgagccatgtgatttgcagtcccacggatatcactggggaaggagcctctttgactccccgggagaaggaaattctctctctcctgtgcaagggaatgaattaccgggagatcgccaacacgctagtcatctcgcaattcacagtacgcaagcacattcagaatatttatgcgaagctcaatgtaagtgatcgtgtcaatgcactgattcgcggcaaggagattctgtttgacagcgacctgtag

SEQ ID NO: 909 - DNA, 1353 bp, Oscillibacter sp.
atgacaattcaggaatatgtggagagaggccgggaggccgtggaagcgatcaaggattacgaccaggcgcagaccgacaaactggtgtacgaggcggcgaagatcatctatcagcatgctgctgaactggcccgggaggccgtggacgagacggggctggggtactatgaggacaagatctgcaagaatacggacacgccggcggcgttttgggcatacctgagggataagaagtccgtggggatcatcagcgagaacaaggagacggggattatcgaggtggcgcaccctgtgggtgtgatcgcgtgcgtgacaccggcgacgaacccaaatgtgaccccgctggggaacttcatggacgcggtgaaggggaagaacgcgatcatcgtctctcccgcgccccgtgcggcgaagtccaccacccacacggtggagctgatccgggcggcaatggtgaagtgcggcgccccggccgacctgatccaggtgctgagcgaggtgacgctggcgaactcacaggcgctgatggaggcgtgcgacctggtgatcgccaccggcggcagcgggatggtgaaggcggcgtactccagcggaacgccggcatacggcgtgggccccgggaacccgccggtggttctggaccgtgggtatgacctgaaggaagcggcgaagatgacggtgacggcagtggggagtgacaacggcatcctgtgcgacggggacaacctgctgctctatccccaggaggaagaggagaagttcttccaggcactgaaggacgagggcgtggtgctgtttgaggagaagggggatgtggaaaagtttggcgcggtgctgttccacgacggacatcccgtgccggagctggtggggaaagacgcgccggtgattgcgaaggcggcgggctttgacattccgaaggacacaaaggtcatgggcttgaagatcgacgcggtggggaaggcgaatgtgctgaacaaggagatcatgggccccattgtggtgctgaaggggtatgagagctttgaggaggccgtggcgatggcgatccagaacatggaggaggccggtggcatcgggcacacggcgggtatctttagcaatgaccgcaagcatattgagtactatggcgagcggattcctgtggcgcgggtactggtgaaccagccgactccggacgcatggggcccgagcacgaacgggctgagtccggcggtgtctgagagctgcggcacgtgggggaataacattctgtgcgagaacgtggactacatccacctcatcaacgtctcgaagattgctctgcccctggatgttcaggtccccagccccgaggagctcttcaaggactga

SEQ ID NO: 910 - DNA, 1998 bp, Oscillibacter sp.
atgagccaaagctataatcccttttataatattgaaaacccccaattaatgggatatgagtatgcgtggagcagctttatgcgtgggcaggggctgaacaatgcgattatctcccaggaaatcggacaatcgtgggaacggtgcaggaacggccgcattcagatgaatttcaaaggaaatacatcaaacacgcccggggaggcaccaaacacgcaggagacatttttaaagcagacaggcggcaagatgattgcagacattttggaggcgtgggataatgactgcttctatggaatcatcacggacgcacatggaaaaaagctgttcggaatgagcaatacccaccgaaacttttctaaaaaattggagaaggttggtgagattgaagatttttctgaaggctgtgccggaacgaactgcttctccctggtctcagagacctgccgcccatttgctaccgcgggggcgcagcattattttgaatgcttccacggacttgcaggctatgcagcaccgatcttttccgcaaattatcagatgattggcatggttggcttctacaccattgcggagagaatggatgagtatatcctttcctttgcggtcgccgtggagcgcgcgattgaaaacagcctgcgctggtttcgcagtcaggcgctggtggaaaaggagacggaagaaaagcagctcattcttgacacagtttcagatggggttgtttacgtcagtgacagcgggcgtatcacccacaacaatcgaaagctcactgaactcctgagaatgaaaaatgactctctcatcggtaaggacatcagttttatcattaccagcccgccagtagaggaactgaaaaaatatcccttcagttcccagtactccaagtgtgataataaggtcagcatcaataacaccttgggcgagagctgtcagtgtttttttaataagtaccagatagctgagcatgaagccgaccgaaatagcgaaatctgggtctttacgatctattccgatatcaaaaagctggccaaaaagctgtatacaggcaacaccagccggtacacctttcaggacatcaaaagccggtctgagtccatgagaatggtcattgaactggcgaaaaaggcttcgagctttcaagtcagcaccatcattgagggagagagcggaagcggcaaagagatgcttgcccaagcaattcacagtgagggaccccggaaggccggcccatttattgcggtggattgcggcgccctgcccagcggacttttggaaagtgagctctttggctacgaggagggggcctatactggggccagacggggcggaaaacagggcaaatttgaaatggcgaacaaaggcgttttgtttttggacgagattaccaatatgcctttagatatgcaggcaaagctcctgcgggtattgcaggaacggcaggctgtccggattggggggagtgatccgattgcatttgatgttcaggtcattgccgctacgaataaggatattatctcggagattgaacggaaaaatttccgtctggacctcttttacagactgaatatcattcatattaaaattccggcgctcaaagagcgaaaagatgatattgatctgtttatccggtattttatgaataagtttaatccaaagggggatatgcggattcatccggatgccattcagattctgaggaagtacgattggccagggaatgtgcgccagctggagaacgtcatagagcgcatggtaatcattgcggataccaggatcatcggcagggaatgcattccggatgaaattctgaaatctgtaggagaacctgtgggaatttctgtggacctgaaccgtgatgaaacgctggaggatctgtgcaggctttatgtgtacaagacggtggaacggtatggcggcaatattcggcgggcggcggatgctttggggatcagccgcgctacggtatacaagtacctgaagaccatgggcaaaccggattaa

SEQ ID NO: 911 - DNA, 1839 bp, Oscillibacter sp.
atggcggaatatcaagcgcaggataccgatctcgtgttcgctctggacattggcacacgcagcgtggtgggcgttgtgggaaggaccgtgggagaccggctcaagattttgggcatcgaaatggaagaacataaaagccgtgccatgatggatgggcagattgacaacatccagcaggtggcggatttggcgcgcatcgtgacggaacggctggaaagacagctggaggtccatctggaaaaggtctgtgtggcagcagctggacgtgcgctgcggacccaaagcggaacctttgctctggaactgccggatgggcaggccatcaccccggagcagatcagccggctggagactggcgcggtatccgcggcagaggcagcgctgcagatggacgaggagaatcgccgccagttttttctggtgggctatacggttgcgcaataccgcctggaccgatatcccttatccaccctgctggggcatggcggtaagaccatggaggcagatgtggtggcaacctttttgcccggagaggtggtggaaagcctgtatgcggccatgcatctggcagggctgcaagtggccagcatgacgctggagcctatcgccgcgatgaatgccgcgatcccagccgagctgcgtcttttgaatctggctctggtggatatcggcgccggcaccacggatatcgcggtttgccgggacgggagcgtggttggctacaccatggtgacgctggcgggagatgagatcacagaggcgctgatgcgggcgtttctggtggacttccggacggcggaggaaatcaaacgagacctgtggaacggggctgatctccactacaccgatattctgggggtggagaacaccagctcctatgcagccgtttatgaagtgattcaggagcctatgagacgtctcgcggaagcgattgccgcccaggtaagcggtgtgaatggcggcgcgccttcggcggtgttcctagccggcggcggcagcaggctgaaggggctgcgggaggaggtggcacagtgcctgggcatggaggaaaggcgtgtgtccacggcaggcaatcattacgccaagagcgccttttccgaggagcttgacctggatcatccggaatacgccacgccgcttggcattgccgtctctgctgggcttggcttgctgaatgacagctatttggtgatgctcaacgggcagccggcaaagctgtttcgcagtggtacactcacactgcgggacattctgctgatgaatggctatacgtacgaggacattcttggaaggtcagggaagagtctctccgtcacgctggacggtagacgtgtggttctgcggggagagccggcggcaccggctgttttgagactcaacgaagaagacgcgccggttactgcggtggttcacgcaggggaccagatcagcttcgttccggcgcgctctggtgcggatgcctccaggacgcttgcagagctgctgggaaggcccgtccgtgcgctggtgaacaatcgggaggtgccagcagacacgcagctagaacagggggatgtaattttgacattggaatcccccactcccgaaacggagatcccggcagagccggcggcacctccggtgagtccgaagcccctggatatcgtgctgaatgaaaagccgcttcatctggacgggaaagaggaggggacaccctattatctgatggatctgctgaaattttccggactggatttcgaccatttggagcgcccagtccgtctggaggtgaacggcgcggaatgcggcttccggcaggttctcaaggacggagactccgtcaccatcgcctgcgtatga

SEQ ID NO: 912 - DNA, 2193 bp, Oscillibacter sp.
atgtcacctcgcagaaaaaacttcgggcagttcttatcttttggcctgaccgcgccgataaatataaaaaaggcaaaaggtggtgctgctatgggcagtagtggaaacgaaatccttgatatgtatatttatgagaccaacacgctcctggagcaattggaaactattgttttggaggctgagaaggcagatacattttcacaggacgatgtaaatgagattttccgcattatgcataccatcaaaggctcttccgccatgatggagtatgactcactggcaaccgtttcccatcgaatcgaggacctgttttttattatccgtgaaaataccatggcggttgtctccgaggaaaacaggccctgcctctttgatctgatgtttcaatccattgactacttccgctcggaaatggaaaaggtagaggccggccaaccccttgataaaaatatcgacacctttcttgaaaatgttaatagcctgatttccaaaattaaaggggaaaaccctccagaagctgcggcatctgtccctactccggcgcctgcggtttcgtcttcggaatcgtccactcccacaaaaaccgccggcggcaacccggacttcccctatgagctgcatgtcttttttgacgagggatgcggcatggagaatctgagggcttatatgctggtggtgtccatccaggacttctgtgcagaggcggattttttgtttgaacccgctgcagtggaaaacgacgcctccaccgcggaacaggtgatcagggacggctttcttttgatgttcaagcacgcagaggaccgggaaaaggccattcccgttgtgcgtggggcgggttcggtgcgttcctaccagcctcacgattaccatcctgtgctggcgccgacttccgctcccgcgccagagaccagccctgccacggcaaaagcgccaaagacatccgtcccgctctccgcgccgggcgccgcaaccccagggcccgcggcgggcagcgctcccgcacaccagaaggaaagcctgatcagcgttaatctcagcaagttggatcagctgtcagctattgttggagagatcgtcattacagagtccatggtgactgcgtctcctgacctgaaggggctgcaccttgatatcttctctaaaaatgcgcgtcagctccgcaagctgacggatgaattgcaggatatctccatgtccctgcggatgattcccatgtccaataccttccaaaaaatgaaccgtattgtccgcgacatgagcaaaaagctgaataagcgtgctaagctgacgctcatcggtgagggcacagaggtggacaagaccattgtggacagcattggcgaccccatcatgcacatgatccgcaacgccatggaccacggaattgaggcaaccgaggaagagcgcattgctgccggaaaggacccggtaggagagatcgtcctctccgcgcaggacaccggcagcgaggtcatcatcatgatcaaagatgatggccagggcgtcaatgacgagagcgtgctgaaaaaggccattaaaaacggcattgccgcaccggacaccgagtattcccaccgggatattctgaactttttgctgatgccgggcttttcgaccaacacagaggtcacggaatactctgggcgcggcgtaggaatggatgtggtgaagaaaagtgtggaggagctgggaggcaatgtctcgattacaagcgagcttggtaagggaatgaccaccaccattcgcattcccctgaccatggcaatcatggacggcatggaggtatctgtaggagattccatttttaccatccccattaacaacatccgccagagcttcaaggtgtccagaaccgatatcctgcgcgattccatggatggtgaaatgatcaagctgactgaccgatactatcccgttattcgggccaaagatttttaccatcttcccggcggcacagatgcgatcgacgaaggcatcctcctatggctggagtccggggatctttcctattgtctctttgtggatgagcttttaggagagcagcagattgttgtaaagccgctcccctcctatatcaacaatttcaatgtaaaaaattatggaatcatgggctgcagcatcctgggtgatggcaatatcagcattattctggatgcgggcaacctatataccgctgcgcaaagcgcatag

SEQ ID NO: 913 - DNA, 1950 bp, Oscillibacter sp.
atggcagaaaatgaactgttgcattctactgcggtagacacgcaaaatgaatatgacgcctcggaaattcaggtgctggaggggttggaggctgtccggaaacggccgggtatgtatatcggctctacctccacatcgggtcttcatcatctggtctatgaaattgtggacaacgccattgacgaggcgcttgccggctattgtacggatatcctggtgcagatcaacgcggataataccatcacggtggtggacaacggccggggcattcctgtggatattcaggcccagacgggcaagcccgctctggaagtggtgtataccgtgctccacgccggcggaaaattcggcggcgggggctataaggtatccggcggactgcacggcgtgggcgcatcggtggtgaacgccttgagcgaatggctgaccgtgcaggtccaccgggatggaaagatctatgagatgaaattctctcggggccatgtcactcaggagatgactgtggtgggcaccaccgaccacaccggcaccaccgtgaccttcaagccggattcggagatgttcgaggacacagtctacaactacgagacgctgcacacccggatgcgggaggaggcattcttaaacgcgggactgcggattcggactgtggacctgcgtcccggtcaggagcaggaggatgccatgtgctacgccggcggcatccgggagtttgtcacctggctgaaccgcacgaaggacgcgcttcatgagagcgtcatctacatggccggacagcgggaggactccgtggcggaagtggccatgcagtataactccagctataacgagaccattctctcctttgccaacaacgtccataccccggagggcggcatgcatgaggagggcttcaagcgcgcgctgacgaatgtattgaacgcctatggccggaaaatcaagatgctcaaggacgaggacaaaatctccggcgaggactgccgggagggcctcacctgcgtgatctccgtgaagctgacagacgcccagtttgagggacagacaaaggcgaagcttggcaacagcgaaatccggacgttggtgaacacgattgtctcggaaaagctggagaccttcctggaggaaaatccccaggtggggcggatgattctggacaaggccctcaccgccagccgcgcccgggaggcggccaaaaaggcacgggaatccatccggcgcaaaaccgccctgggcggggccgccatgccggataagctccgggactgcaacgagaacaaccccgagcttaccgagctctatatcgtcgagggtgactccgccggcggctccgccacccaggggcgggactcccggtttcaggcgatcctccctctgtggggcaagatgctgaatgtggaaaaggcccgggcggacaaggtctatggcaacgacaagcttcagccggtgatcacggctctgggcgctggcatcggggaggagttcgacctctccaagctccgctaccacaaggttatcatcatggcggatgcggatgtggacggctcccacatccggacgctccttttgacgttcttcttccgctttatgcggcctctcattgagcacgggtatgtctactccgcggtgccacccctctataagctggtgcggggcaagaccacccgggtggcgttttccgacgaagagcgggacgcggtctccgccgagatgcggggggacaaccccaataccaaggtggtgatcagccgcttcaagggcctgggcgagatggactaccacgagctgtgggagaccaccatggacccggagcgccgcacgctgcggcgcattacgctggatgacgctgtggcggcggacgaggtgttcaccgttttaatgggcgaaaaggtggagccccggaaggaatttattgaaaagaacgcccagtacgccgtcaatctggactattaa

SEQ ID NO: 914 - DNA, 1047 bp, Oscillibacter sp.
atgatgccagaggaggttttggaggagattgcagccgagatgatgaactaccgtggcagcgggatgtgcgtgatggagatgagtcaccggtccaaggtgttccagcagattcgagacgaggcggagtcggacctgcggaagctgatgggcatcccggacaactacaaggtgctgtttgtccagggcggcggcacagtccagttcgccatggtccccatgaacctgatgaaaaacggcgttgcgtgctatgtggagaccggcgcctggtcgaaaaaggccatcaaggaggcgcagaagtacggcgaggtgaagatcgtcgcctcctctgctgacaagaatttctcctatatccccgactgctctgacctggacattcctgagaacgcagactatgtctacatctgcgagaatgagaccatcaacggcaccacctactatcagctgcccgacacaaagggcaaaatcctggtctccgaccagtcctccatgttcctctcccggccctgcgacgtgagcaagtacggcctgatctgggcgggtgtgcagaagaacgtggggcccgccggcatggcggtggtgatcatccgggaggacctgctgcgggaagacctgtcgaagtttgtgcccacctacctcagctataaaacccacgcggacaacgactcgctgtataacacccccaactgctgggccatctactgctgcggcaaggtgttcaaatacctgctggccaagggagggctggaggctatgaaccggcgcaacgaggagaaggcggcggtgctgtatgacttcctggatcagagcaagttcttcaccggcgcggtggtgaaggagaatcgttccctcatgaacgtgccgttcgtctcccccagcaaggagcaggacgccgaggtggtagccgccagcaaggaggcgggcttcgataacctcaagggccacaagagcgtaggcggcctgcgggcgtctatctacaacgccatgcccaaggagggtgtggaggccttggtggagttcctgaggaaatacgaagcggagcatgcctga

SEQ ID NO: 915 - DNA, 1944 bp, Oscillibacter sp.
atgaaatatcagaaattgtttgaaaaaggctatattggtggcgttgaaattcgaaatcgtgttgcaatgacggctatgggcaacggtcttgccacctgggacggtgaggcgtccccagaattgatccgcttctatgaggaccgcgcccggggcggatgtggtctgattttcacggaatttacccgcgtagatgaaaacagcggcgcctgtaacccaaatcaactgtgtattgccagcagaaagcatgtacgcagtgtacagcgcatggcggaatgtgtgcatcgccacggcgcaaagatttttgttcagttgcatcatggcggacgggaagcgcctccagcgctgaacggcggaagacagcccatgggccccagtgccatcatcaatcaggtgaacggactggtatcggccgaaatgaccaaagcagagattgacgagatcgtaggtaaattcgtcaacggcgcggcgaactgtaaaaaagccggtattgacggtgtggaacttcatgcggcgcatggttatctgctggggtcttttatcagtccttacaccaataaacggacggacgattatggagggaatgcggaaaactgctgccgtattgtgacggatatcatccgcggaattcgggcggcttgcggaaattatccggtctgcgttcgaatcaacggaagtgattttgtggaaggcggtattacgctggattacgcggtgcaggtcgccagaattttggagtctgctggcgcagacgccatcaatgtcagctgtgcggtttatgagaccgtgccgaatatgattgagccgaactactacgatgagggctggaggaaggcgctggccaagacagtaaaggcgcggatttgtattccggtggtcgcggttaataccatcaaatttcccgctactgcggaaaagctgttggaggaaggtgtcagcgatttcgtgggcgtttcccgcggacagatggcagacccggagtgggtcaataagacccgggctggtcgggaagatctgatccgtaaatgcatgggatgtatgcagtgcaacaagtctgtggtgatggatggctatctttcctgcgcggcaaatcctgtcacaggacgcggcaccatgtacaacgatgaatatctgatccgaaacggtgatggacgcagggtcgtggttatcggcggcggtcccgcaggtatgcaggcagccatcgttttggcaaagcgcggcttccgggttgatctgctggagaaaaaggattaccttggcggaatggcatatctggctacggttccgccccacaagaccatggtggcggaatttatcaagaccttgactgccgagatgaaagaggttggcgtagcggttcatatgaacacttctgcggatgtaaaaatggtcaaaaaactggaaccatatgccgttgtggtggcgaatggcggcacagagattgtaccaaaggttgccggcctggaggcggcaaatgtccacaccatggaggaagcccttttaaagaaggtcactttttccggcaagcgggtcgccgtgatcggcggcggcatggttggcttggagaccgctcattacctctgtcaggataatcaggtgacaatcgtcgaaatgactgcgacgccgggagctacgatgtatccgactgtacggaacaaactgctgtctattttgaaagatgagggtgtggagttgctgctgaatcgggcattgtctgcggtggagggagattccattgtgatggactgcacagacagccgggaacccaggcaggaacggctgaccgtggatgaggtagtgattgccgccgggcgtaagccgaatctgagcctgtatcatgaaatggagaaggcatttggaaaggttgtcatggctggagactgtatgatgggtggatgtattctggaagctacacgaacgggaaacgataatgtttggttcctgtga

SEQ ID NO: 916 - DNA, 1356 bp, Oscillibacter sp.
atgaagatgccaaaggaagcaagggaattggccgattaccttgatcggcctctcacctgtgggtgcgggagggagcactacgcccccctgaaggccgtgagcatccggaaagatgccattgaggatctgcccgcctatgtaaaaaaactgggctttcagcacccctacctgatctgcgaccttgttacctatgagatcgccggaaagcgctgcgcagaggtgctctccgcagccggatgccatgcgcagacgcaagtcctcacccacgtcggctttgacgaggccaccgtcggtgagctcctcatccacatgcccgcagactgcgacctgtgtgtggctgttggaaccggcgccatcaacgatatgacccgctttttcagccaccgcatgggccggccctttttcaccgtggccaccgccgcgcccatggacggctttgcctcctccatcgcggccatcaatgtcaacagcctgaaaaccaccttccaggcccagactcccaccgtcatccttggagacaccgagattttgaagaacgctccctaccgcatgatcgccgccggcctgggggaccttctgggaaagttcacctgcctttgcgactggaagctgtcaaggctgatcaaccgcgagcattactgcgaaaacatcgcggggctggtggaaagctgcgtccaaaacgttctgaaagacgcgggaaaggccaaggaccgcgatccggaggtccttggcaagattatggaggggttggtattaacgggggttgccatgagcctgtatgggaactccaggccggcctccggctgcgagcaccatatgtcccattactgggagatgtggtttgagcaacggggtctgcggccagttccccacgggactcaggtgggcgtggccacggtgctggtattgaagctggcggaaaagctccgcggcacgaaggtggactttgacgccgccagggagtccgcccggtcctattccccggaggcatgggagcgggccatccaccgtgcatacggcccggcggcggagggtgtgattgccctggaggaggcgtcgcggaagaatgaatctgccgggcgcctggcccggatcgacgccatacagtcccactgggaggagatcacggctctgctggcggagctgcctggctccgccgaggtgatggagctgctgcggtccctgcagtccccctgtctgccggaggagattggggtggacgggcggcttctcagagatacccttctgtacgccaaggaggtccgcccgcgctatacccttcttcagatggcctgggatctgggtgtcctcgaacgtctgtcggacgacctcatttcaaatctccaacatttataa

SEQ ID NO: 917 - DNA, 1923 bp, Oscillibacter sp.
cggcgtgcggtggagctggcgcgaagaactgcggagggcggcggaaactgctggatgctgggagacctgatccataaccggtttgtggtggaggacctggcaaggcggggtatccggaaaacggcggacagcgccctgcttggaccggacgacatcgtgattatccgctctcacggggagctgaaaagcgtgctggatgccctggaacaacggggtgtccgttgcgtgaacgccacctgccccaatgtcatccggattcagcgattggttgcccaggcggaagcggagggacgccagccggtgattattggcgaggccgctcacccggaggtagcagggattgccagctggtgcctgtcaccgctggtttttgatgggccggagtcggtgcaggcatggctggacacccctgaaagcaagcgggaaattcccatgaccgtggtggctcagaccacctgtattcgtgaactttttgaaagttcatggaaaatcataaaaaaagagtgtacaaacgtcaaaatctttgatacaatatgtgatgctacgcataagcgtcaatctgaggcggcagaaattgcttctcaggtggatgtgatggttgtggtgggagaccgtaaaagcgccaacaccaaacatttgacggaaatttgtatgcagagctgttcccgcgttctacagattgaggcggcggacgagctctcggcggatgatttcaatggttgctctgttgcgggccttacggccggtgcctccacacctgcgggcatcattaaggaggtatatgcaacgatgagcgaagaaatcaaggcggccgagggcaaagaggagtccttcgaggaattactgaatcagtcttttaaaactttgaataatggagatagggtaacaggcattgtcactgcgatcacccccaccgaggtgcaggtggatgtaggtgctaagcaggcagcctacatcaagctcagcgagctgacggacgatcccactgtcaagcctgaggacgtggtccatgtgggcgatgagattgagacttgggttgtccgcgttaatgacgtggaaggctatgcagagttgagtaaaaagcgcctggatgccgccaaggtctgggaaaatattgaacaggccgttgaggaaaagactgtgctggacggtactgtcaccgaagagaataagggcggtatcgtggtatccgtcaagggcgtgcgggtatttgtgcctgcttcccagagcggccagccccgcggcgccgatctctccgctatgaaggggcagaaagttcagctgcgcattacagaggtgaaccgcgcccgccgccgtgtggtggggtccatccgctccgtgactgatgaggcccgtcgggctgctcaggaggagatttggagcaacatcgaggtgggcaagcactacacaggcacggtcaagtccatgaccagctatggcgtatttgtggacatcggcggtgtggacggcatggtacatatctccgagctgagctggagccgtatcaagacgccatccgaggtgtgcaaggtgggcgacacgatggaggtctatgtgatctcctttgatcctgagaagcgtaagatttccctgggtgtcaaggaccacagtgtagatccctggcaggtgttcatggatcggtacagtgtgggggacgttgcgaatgtccggattgtcaagctgatgaccttcggcgcctttgccgaggtggtccccggcgtggatggcctgattcacatttcccagattgccgaccgccgtatcgaaaagcctgaggatgttctttctgaggggcagatggtggacgcaaagatcactgccatcgatgaggagaagaagaaaatctccctgtctatccgtgctctgctgactcccgcagctgaggaagtccccgcagaggaagaggcttccgcggaggaataa

SEQ ID NO: 918 - DNA, 2025 bp, Oscillibacter sp.
atgagcttttggaaaaaagacacaaaagctgaagtgacggaagacatcagtgtcggcagcgcagccgacgtggaagccgtcatgaaaaaatacgaccgggaatccaacacccggttgtgggagggaactccgaaactggtgatccgcgttctgatggcgatgttctccctgtactgcatcatcgacacggtattcctcagcaccaagcaggaggtccggttgcccgtcttcgtggggctgatcctgctgtttggctttttgctgttccccgccaagaagggggacaaccgggtgaactacctgccctggtacgacgtggtgctgctgatcgccggccccggggcctacttcttctacgcagtcaacgctgacgaggtcattcggatgtctgcccgtgtcatgcagaatgacctctacatgatcgtggggttgatcggcgtgctggcgctgattgagctgtgccggcgatgtgtgggattgccgattctgtgtgttgccggcgtgctgctggtctacacgttcttcaacctgatgggaggcgcacccctcggcatagagcagattcggttggccttctatcaggtcatccggacgatgttctatacctttaatggtatttttggcggccccattaacgtgtgcgccaagttcatcgtggtgttcatcatcttcggcgcgtttttggagcgcaccggtattgcacagttcttcatcaacctggccaacgcgctggccggcgccgcccccggcggccccgctaaggtggcggtcatctcctccgccctgtgtggaatggtgtccggctcctctgtgggcaacacggtcactaccggctccgtcaccatccccatgatgaaaaagaccggctacaagggcgagtttgccggcgcggtggaggcggcagcctctactggcggccaaatcatgcctcccatcatgggcgccgctgccttcctgatggcggagttcaccggcgagccctatggcacgattgccatgcgtgctattctgccggcagtgctgtattttgccggcatctatatcgccgtacacctggaggccaagaaactgggcttaaagggcattccaaaggatcagctgccccggatgagccacctgctgcccagaatctatctgctgctgcctctggtcatcctggtggtcatggtttccaccaacatgtataccatggccttctctgcggcgattgcgattgtggcggctattggtgtgggcctcttggacaatgtgattacgattgccacaaagaacccggatcgcagcaatttcctcacgcctgtcaaaattgtagatgcactggagagcggtgcgaaaggctctatcacagtggctgtggcctgtggtgtggccggcattatttccggctgcattaccgtgacgggccttgcctccaagctgctcagcgcaattgtgaacctctctggaggccatatgatgattgcgctggtgctgacaatgctctgctgcattgtgctgggcatgggcgtgcccaccaccgccaactactgcatcatggcggccacctgcgccccgattctgatggacccctccatcggtgtcaccaaaatggcggcgcacttcttcgtgttctattttggcattgtggcggacatcacgcccccggtggccctggcggcctatgccggcagcgcaattgccaaggctgatcccatgcggacgggtatcaacgcaacaaagcttgcgattgcggcgttcattgtaccctatatctttgccatgaatcctcagatgctgtttgtcaatgtgagcagccccttccaagtggtgcagatctgcatcagtgccctgttgggaattttcggcgtggctgcggctctgaatggcttcctgtaccgccccctcaatccgctgatgcggattgtgctggtggcaggcggcttaggcatgctgatccctggcacgctgaccgatgtgacggggctggtgctggtagcggcggtgctgatgtatcagcgggccactgccaagcgcatggctgcttga

SEQ ID NO: 919 - DNA, 1755 bp, Oscillibacter sp.
agcgaaaaaagttctgagtccctgagaaaatcaaaactctccaccataggtgtggtggcactgattttctcctttgtggccgctggtgccttcggcattgaggaggccatcgccgccagtggaccgggtttgaccctgattatgctgctggtctttccctttgtctgggcttttccgctgtgtgaaatggtgggagagctggggtctattcttccctcggagggcggcatttactcctgggggcgtgaatccttcggagagttctggggttggcagatcggtttgtggtccgcgttgaccacctggatgtgccaggcacagtactgcgctttggtggttggctatgccgctaaattcattgacatgtctcccacagcggagtacatggcaaaaatcgtgatggtggtcattttcactgtggttaacatcattggtctggactggctggaaaagctggaaacagtctttaccattttggtgctgatcgcctttggagctgtgaccgtggtgggcttcctgaactggaattacaatccgttggagccgctttttaatcctgaagagggcctgtttcactcaattggcggcggtatcgccatcattatttggatgtacatgggctatgagtgtatgtccaacatggccggagaaatggataatccacagattattcccaaagccatgcggatttctcagccagtgatcgcatttacctacatcctgccgacgctggcagccctggcagcgattggaagctggagctcttggtccactgaatctggtggcggcgccgtgggctatgcagatgtactgattcagtatgtaggtaattgggcgggtctggcctttgtcattgtcgctgtcatttccaactgctccatcttctgctcgtatattgcccatggctccagagcatttttcgtcatggctgacgaccatatgttcccgctgcttatgaagaaggtggataagcgcggcattccaacggtctctattattctgctggcaatcttcacgattatcacctgccagtttgacttcaccacgctggtgatggccacaacgcccattcagctctacatgtacctggctatgattctctgcgtggttcagctgcgtaaatattaccccacggatgcccggaaggagctggggctaacggtcatgccaggaggcacggtgggcttggtggtgctctctgcctgcgtttttgtaatctgcatgtttgccatctatgccaacggcacggactactttattaccggcttcctggtgttgctgctgggacttgtaggctatgtggtgtgcaaatgggtgtacaagggcagagttttggataatgccgagacctatcccctaaatcccaagaccaagctgggcctgggcgacttgattgatattggtgtttatatcattctatcaggtgccatggcgctgggcggtgcagtgttcctgtatttctacgagggcagctatggcgaggagtactatctagaggagtatggttctggatttttcagtaatttttatggcatgatcaacgcgtgcaaatggctggggatcattctattggtgattggtattgtggtctggctgatcggcagaaagacagagggtgcccaggtcaaggcgctcaaagcagccagaaaagtggatctggataacatgattcgtgaaattcacggcgcagttcccggcgaaactcctaccagtgatacgcaagtttcatcaacaaccgaacaaaattcggtttga

SEQ ID NO: 920 - DNA, 1740 bp, Oscillibacter sp.
atgaagaaaaaacgcgggcttgtcagctgcgtgcaggagtttacaaaagacgcggtactgacacctattttcgtcgtgggagaggtggcctttgatgtgctgattcccatgatgatggctcaactcattgacaagggcattgacgcggggaacctgagcaatatcctgcggtatggagggctgctggttggcatggcgctggtggcgctggtgttcgggacgctatccggccgcttcgccgcacgggcctccactggcttttcccggaatctgcggcgggaaatgtaccgcaatgtccagaatttttccttttctaacattgataagttctcaacgggcggaatcatcccccgccttaccaccgatgtgaccaatgtacagatggcgttcatgatgatcatccgcgtggcggtccgctgccccatcatgctgatctgcgcctgggtgctcacctttaagatcaatccccagctggccatgatttttctggtggtgatccctgtcttggcggttggcatttttttgatcatgcggggagcgcatcccctgtttgagcgggtgttcaaaaaatacgacgtgctgaacaatgtggtacaggaaaatctgctgggtatccgggtggtcaaatcctttgttcgggaagagcatgagaaggagaaattcgggaaaatctctcaggagatttacgcggacttctccaaggcggagaagatcatcgcttttaatatgccgctgatgcaggtgtgcgtgtacagctgtatgctggtggtcagctggctgggcgctcatctggttgtgagcagtcagctgaccaccggggagctcaccagcatgttcagctatatcatgatgattctcatgagcctaatgatgctctccatggtgctggtcatgatcatcctatcccgcgcctctgccgagcggatcacggagcttctcaatgaggagagcgatctccaaaacggccccaaccctgtggaggtggtgagggatggctccgtgacctttgaaaacgtcagcttttcctatgcgggcgacccggagaaggagtgcctgaagaatgtgagcctggagatccgctccggcgagacggtggggattcttggcggcaccggcacctccaagagcactctggtacagctgatcccccggctgtatgacgccacagagggccgggtcctggtgggcggcgtggacgtccgagactacgacatggaggccttgcgggagcaagtggccatcgtgcttcaaaaaaatgtgatcttctccggcaccatcaaggaaaacctccgctggggcaaggaggatgccacggatgaggagttggtccgggtctgccagttggctcaggcagactccttcatccaggagttcccagacaagtacgacacgtatattgaacagggcggaacgaatgtatccggcggtcagaagcagcggctttgcattgccagggccctgctgaaaaaacccaggattttgattctggacgactccacctccgccgtggacaccaagactgacgcgctgatccgaaaggcattccgggaggagattccggacaccaccaagttcatcattgcccagcgggtctcctccatcgaggacgccgacaaaattttggtgatggagggcggaaggatcgctgcgatggggacccatgaggaactgctccaaagctgcgagatctaccgcgaaatctatgaatcccagacgaagggaggaaatgaccatgaataa

SEQ ID NO: 921 - DNA, 1674 bp, Oscillibacter sp.
atggaagagaagacgaaacgcaagatgatctcgccggacgtgctgcggcggctgaaaaaacacctcaagtggctgatccctgtgctcttagcagtatgtattggcgtcggattcctttttcgcctcccagccggtcaacaggcagcagcttctgcaacctatcaaaccgccgcgactgagacccgcgatatcacaaaatccctcacgggcagcgggacactggaaccggcagactcctatacggtcaatacgctggtgtccggagaggtcctcagtgatacctttgaagagggtgaccaagtagaggagggacaacttctctatacgctggattcctccaatgcttccagcagccagacccaggcccaaaattcttactcccaggcgcagtccaactaccagcaggcagtgaacgccaaatacccctctgcggatatgggcggcacagtctctgaggtatatgtgaaaaacggtgagagcgtcagcgcagggacagagcttgtgcggattgtaggggacaacaacatctatatgaccttcctgttcccctacgccagtccctctgacttttatgtagggcagacggctaccatttacatcggaaactttgacggcactacctccggcaccgttacagcggtctcctcttcctccatcaccaccaacaccggattgcaggcggtctctgtacaggtcaaagctcccaacccagggctggttactgaggactatactgctgtcgcttccatcggcagctataccagctatggccagaccgccatcaacctcagttcttccagcgtcattactgctgaggtctctggtaaaatcagcggcttgaactggctgccaggcgacgccatctccagcggtgagcggatctgcaccatcactggcagcaccgcagatagtcaagtggaaagcgctcgcatcagcctcagcaatgcctccacttccctggaaaacgcccaggacagtctggacgactatacgatcaccgctcccatctccggcactgttgtcaccaagaacgccaaggccggcgataacattgagggcggctctgacagtacgctgtgcgtcatctacgatatgagttatctggaaatgacgctgaacattgatgagctggacatctctgaggttgccgtggggcaggaggtccagattaccgctgacgcggcagagggccaggtatataccggcgtagttaccaatgtttccattgcaggtactacctccggcggcatcaccacctaccctgtcaccattcgtattgacgaaactgacggtctccgccccggcatgaatgtggatgcggagatcctcctggactccgcccaaggtgttctggctgtacccagcgctgcggtgaaccggggcgacaccgtcttaatcaccgctgattctcccagcgccgcaaacgccttggaccaggaggcccctgagggctatgtctatgtgtcggtggaacctggcatcagcgatgagagctataccgagattatctccggtctgcaggagggcgacacggtggcctatctgcagacatcctccagcagtgactctatggacttcatggctgtcggcatgattccctctggcggaggcgagatgcccagcggcgggatgcccagcggtgggatgcccagcggtgggccgggaggtttctga

SEQ ID NO: 922 - DNA, 1833 bp, Oscillibacter sp.
atgtctaactttgtgcaaaaggagaaaggagcacacaatatgccgttttcgtttaatttcggcggctttaatccgggcgatttcagcgggtttggaggatttcaggacgagggggccgcacccccgccaaaaaagccccgcaaaccccgcaaggccatcggcaacgccttcaccaggaccctgatcaacctgggagtaaccctggttttcgctctggtctatttttatgtggaactgccggcgctgaacttccatgcggaggagttctacgtattcgcatttttaatctgcgcggtatactgtatctgcgcggttgtgacctccggctttcagggggagggaatcaagggctatgtcggctttgtgaaaaaacagtgcgtcattcctttcctggccttcattgccctgatcgccgctattgccattggagcggtcacatcctgggtggtgctgcgggcgggcagctacagcgagctgctgagcattgagaccggggacttcgcctccgaggtggatgagatcagctacgatcagattcccatgctggacgaggactccgccgcgcggctgggcaaccggaagctgggtgagctggcggacatggtctcccagtttgagatattgccctcctacacgcagatcaactaccagggccgcccggtgcgggtgacatccttggcatacggagatattgttaagtggtttacaaaccgctccgagggcctgccggcctatctggtcatcgacatggtgactcaggaggcggaggtggtccgcctgaaggagggaatgaagtacacaacggcagagcatttcggccggaatctgtaccgccacctgcggttccactaccccacctatatgtttgatgagccggtctttgagatcgacgaagagggcactccctactggatctgctcgcggatggtcaagaccatcggacttttcggcggtacagacatccggggcgctgtgctggtgaatgctgtcaccggcgagagcgagtattatgaggaggttcccaattgggtggaccacgtgtatgacgcgcagctcattatggagcagtacgattactacggcatgtaccacaacggtttcctcaactccttgttcggccagcggggcgtgacactgacgacgcctctgcacaactatattgccatcggtgacgatgtctatatgtacacgggtgtgacctccgtcacctcggatcagtccaacatcggcttcatcctctccaaccagcggacgaaggagactcgcttctattccgtggccggcgccacggagacctccgcccaggccagcgcccagagccaggtccagcagatgcgctataccgccacggagcccctgctgctgaatatcgccgatcagcccacctactttatggccctgaagggcgaggacggcctggtgaagatgtatgccatggtcaatgtccagcagtataacattgtggagacaggcagtaccgtggcggagtgcgaggccaactaccgcaagaccctggcagacaacgggcttgtggacgaggacgatgcggatgtggctccctctgatcaggcggaggtatccggcgtcattgcggagattcgttccgccgtgctggagggcaactcctactacttcctgcgtttagaggacggggagacgttctatgctgtgaacgctgcggagaatcccttggctgtaattttgaatgtaggagatgaggtgagcattcagtaccacaccggggaggggagcagcatcctcagcggcaccacggtgaagaaggccgacgggagcggagagagtgcccccttggttgtcgctccgccggatgcg

SEQ ID NO: 923 - DNA, 1812 bp, Oscillibacter sp.
atgaatgaagtaaaaacacccaaaaagccccttatttattactacggaattgtgctgctggttttactgctgttcaacctgctggccatgccttggctgagccagcggcagatcaaggaggtggactatggcacgtttctgtccatggtagaaaacggagaggtcggacgggcggagcttcaggagcaggaaaaccgcattctcttcacggacaaggaggaaaccgtcgtctacaaaaccgctatggtgggagacccaaatctgacccagtccctgctggacgcgggagtttccttctacggtgaggaggtggagcagacctcccttctggcatcaattctggcctgggtcttgccgctggccatcttcattgccatcggccagttcctgtcccgaaagatgatggataagatgggcgggcccaatgccatgatgtttggaaaatccaacgccaaggtctatgtcaagtcctccgagggcatcaaattctccgatgtggctggagaggacgaggccaaggacaacttgaaggaaatcgtggagtacctccacgatccgcagaagtatcgggaaatcggggcctccatgcccaaggggattttgctggtgggccctccgggcaccggcaagacgatgctggccaaggcagtggccggtgaagccagcgtcccctttttctctatgtccggctcggaatttgtggagatgtttgtgggcatgggcgccagcaaggtccgggaccttttcaggcaggccaaggaaaagtccccttgtatcgtatttattgacgagattgacgccatcggcaaaaaacgggatgggcagatcggtggcaacgacgagcgggagcagactctgaaccagctgcttactgaaatggatggctttgagggcaacaacggtgtgatcattctggcagccaccaaccggcccgagtctttggacccggcgctgaccaggccgggacgctttgaccggcgggtgccggtggagctgccggatctgaaaggacgggaggaaattttaaaagttcacgccaaaaaaatcaaagtggcggaggacgtggacttcctgcaggtggcacggatggcctccggcgccagcggagcggagctggccaacatcgtcaacgaggcagccctgcgggctgtgcgggacggtcgacgctttgcgacccaggcggatctggaggagagcattgaggttgtgatcgccggctatcagaagaaaaatgccatcctgacagatcaggagaaatggacggtttcctatcacgagatcggccacgctttggtggccgccaagcagacccactccgctccagtacagaaaatcacaatcattccccgcacctccggcgccttgggctacaccatgcaggtggaggagggcaaccactatttaatgacccgggaagagctggaaaaccggatcgccactcttaccggcggccgggctgctgaggaagtggtctttggcaccagctccaccggcgcctccaacgacattgagcaggccaccaagctggcccgggccatgattacccgctatggcatgagcgagagctttgatatggtggctttggagacgttgaacaatcaatacctgggcggcgacacctccctgtcctgctctgcgcaaacccaggcagaggttgaccggcaggtgatggccctggtcaagcgacagcatgaaaaggctgcccagctcctgcaggaaaatcgcaaaaagctggatgagttggccaagtatctctatgaaaaggagacgatcacgggcgaggagttcatgtctatcctgaaccaggcgtga

SEQ ID NO: 924 - DNA, 2148 bp, Oscillibacter sp.
gcggagactatcaacatctctcccaaggaaattgcggaatttgtagagagccaggagaaagctattgaggaggctgcggccaaagccgctgagaaaggcgagagctatacggctccggagatacgggatcaggcatatatcgcccgtggcctcagccggattctggaaaaagaccaggctgatatagaaaaggccatggaggatttgggctccatgtattacaatgtccgcaagaaggtggaacaggaggtggctgacgaagtccgccgcttcatcaacggcgagattgacgaggagggcaacgcggttccggaggaccagcagaaaaagctgcagggcgtctggattcagccggataccaagcggtattatacttacagcaccctggcggccaatgtgctgggctttgtcaacgccgacaatgtgggcggggtgggcctggaggcgaaatacaacgacgtgctggaggggacggcaggtatgaccgtgaccgccaaaaacggcgtgggaacagacctgctgtaccagtatgagcagtactatgacgccgagaacggcaacagcctggtcctgaccatggatgtggaggtccagtcctatctggaaaagggactggacagcatgattgataaatttgatgccgccaacggtgctaccggcatcgtcatggacgtgaataccggtgcgattgtcgccatggcctcctaccccaactatgacctcaatgaacctggcgtggtacgagatgaggcgctgcagaaaaaactggataagaccctggcagacctggcgggaaagcagtccgaatatgagacggaagaggaatataacgaggctgtcagcaaggccaaaagcgaagccatgaatacccagtggcggaataagtgcattgattctacctatgagccgggctccacgtttaagcctatcacgctggccattgctctggaggagggcgtggtgagcaagagcagcacgtttagctgcagcggtgctgtgagtattgaggggtggacactgcggtgctcgaaaaagactggccacggaagccagagcctggttgaagcggttggaaattcctgtaacccggcttttatcaacatcggcctgcgggtgggaacggagaagtactacgaatatctgcaggcctttggcttgatggaaaagaccggtgtggatatggtgggagaggtcgccggcatttttacagatccggatacgttcaactcacaccagatctccctggcctcctattcctttggccaaacctttaatgtgacacctttggagctgatccgggcccaggcggcctgtatcaacggcggatatctgtacacaccctatgtggtagaacaggaactggacagcgacggcaacgtgatctaccagcacgaggccacacccgtccggcaggttatcagcgaggagacctccgctgttgttcgggaatgcctggaatacgtggtggcctccggtaccggtaagaacggacaggtggccggataccgcatcggcggcaagaccggcaccgcagataagacagagacccggaataccaccaaagaggtggtggtgtccttcatgtgctttgcgccagcggacgatccccagtatatcatgctgctcaccatggacacccccagccggaataccggcgtctatgtgtcaggcggcaacatggtggcgcctactgccagcagtatcatggcggacattctgcctgccctgggggtggagccggattacagcgccgacgagctctccagcgcggatgccgctgtacccaatgtagtgggcgagactgcggagaatgccaagagccgcttggaggcagccggcttttcttgccgcacggtgggaagcggagacaccgtcacggaccagactccggcaggcggcgcgattgtacccaataatgctacgatcattctctacctgggagcagaaaaaccaacggcgccttgtacggtacccaatgtggtggggaagacagcggcagaggccaaccggcttctcacagatgcgggcctcattatgaaggtcagcgggaccactgcctcgtcctccggcaatgtgaaagcgctctcccaaaaccgggaggcaggaacagaagcaccggctggcacagtggtgacggttcagtttgga

SEQ ID NO: 925 - DNA, 1341 bp, Oscillibacter sp.
ttgatcctcacgcttggctctgccggcagcgggaaaaagggtggccactcggaaaaagtaaataaaaagggaaaggaagcgatgtatctcatgtcacagactttagacgtccacagcatcaatagaaacggcatcctgatccgtggcttgatcattttgctttgcgccggtatcatcaacgccacatccgttttcatcacgcctcttgcaacctattacggatgggaggcttcggcaatcgcaaacgttggaactaccatgctgactttctggcccattggctctctgttgggcggtaagctgctgcagaagttcggcggaaaagcggtgacaattattggcgctatcgtatttggcgctggcctgattttaactggcttagtgcccgacacagctcctggcctgctgtatttcacatacagcttcctgatcggcatgggcaacggcattacctattgcggcgcgatgtactgtgtcatgggctggttccctgataagaagggcttggctgccggcctgtgcatggcgttcaacggcggttcctcggctttcctcgcgccgctgtgcgcttatatcacggctgcgtttaatgttaaggtcactctgttctcttgcggtatcgtctgcgcggttatctgcattctctgcggccttgggatgcgctctgctcccctgggctatgtgccagagggatacgtggctcccagcgatggcgctgctctgagctctcagtatgaaagctatcccatctccaaggcgtggaagacgaagcagttctggctgcagttgggcgcgatggcgtttttcccctctttctacctcattatgttctctcggttctctatgttcatgacggataagggaattgatctggcgtacgcaacccttggtgtttcactgtacaacatcggcaacgtggtaggccgcttgctgctgggcaaattgacggataatcttggattcaagaaagtgtacatgtgctgctggctcctgtgcatgatttgcggtctgctcctgctgacgggcagctcggtggcaatgattctgctggcttacatctgtctgggcgctggctttggcgctaccaacagcgtttacccggttatgtccactacgtccttcgggcctgtctacgccggcaatatctatggcttcgcactgctgggctatatgcttatgacgcaggttattcccagaataactgccgccacgattgagagcaccggcgggtataccgtggcgttcattatggccttcgtgctttgtacactgggcgttatctgcggtgtgctgattcccaagctggagcgtcctcgcttgaaggaaacagaaagcgtgtaa

SEQ ID NO: 926 - DNA, 2955 bp, Oscillibacter sp.
atgaaaacattttggaagaaaaagctcccggcgtgtctgctggcgctggcgctgctggccggaaccgttcccatggcgtctgcggcctcggcggatctgacgtacgatgtggacgaggacagcggcgtctggctggatgcggatgactttcaggaaatctatgaggacgacaacggcggataccttgaatacgtggaattcaccgattatgatgactttgacgattacggctatttcaccttcgaggactttgaccgttacgggttcgacgacgtggattccaaggcgctggagaactacgaattctactatgaccgtgctgatgcggacgattacgacatcgacctggacacgctgcggtttgagacctatgacaacatcgacagcgacacactggattttgatgtcaggctgtacggcgacgaagggtcattctatgcaacggtccgcattgatgtggagggtggctcccgctccggctccggcgacgtggagctgacctacaaggtggaccccggcgacgatgtgacggtggacgccgaggacttctgggatctctttgacgaggaagacggccgctatgacgagctggagtatgtggagttcaccagctacgatgatttcgatgacttcggatatttcggcgcagacggatacgacagcgatgactatatcctggactatgagctcaatgacagcgatctggacgatgccatgttctattacgacgagaacgacgtctggtacgactatgactttgaactggacacgctgacgttctacgccgaccggaacgccgacgcggacaccctggcctttgacttcaccatgcacggcgtggacggtgacaaggtatatggcactctgtacatcgaggtcggcaagggcagcggcaccagcagcaagggcgacctgacctatcaggtggacccggacgacgatgtgacgctggacgcggaggatttctacgatttcttctacgacgagtcggattacgacgaactggaatacgtggagttcaccgactatgacgactttgacgattacggctgtttctacgccgacggatacgattccgacgactacacccgggattacgagctgaacgacagtgacctggacgacgccgtgttttactatgatgaggacgatatctgggacgactatgacttcgagctggacacgctgacctttgcggcggaccggaatgccgatgaagacaccctgacctttgacgtcaccatgcgcggcgtgaaaggcgacaagatctccgctaccctcaccattgagatcggcaagggcagcagcaccggcaccaaggtgaagggcgacatcatttacgaggtggatcccgacgacagcgtgacctttgaccgggacgacttctgggatttcctggatgacgagaccggggacgatctggagtatgtacggttcaccgacgccgacggactggacgactggggcgagctgtacagctacgactacgatgatgaccggacgtactttgacgagagcgacctggacgacggttatttctactatgacagcaaggacctgttctacgacgaggacttcaccctggatgacctgacctttgtggcggacagggacgccgacggcaaggtggtggagctggacttcactgcctacggtgaggacggcgacaaggcctacggcaccgtggccatcgccatcggcgatgtggggggaaccggcgtggccgcagagggcggcgatatccgctattatacggattacagcggccgagtgcagatcaacgccaacgacatcgcccggttctttgaggagagctaccccggctataccctgcagtatgtcacctttaaagatgcgcccacttacggcagcctgtactacaactactacggtaccagcagctacggcagctccagcagcctgcgcatcaccgacgacaactgcgacgacatagatttctacttcagtccctccagcagccagcacgccctcagcgagctgacatacatacccagcggcgtcaactactgcgcccagatccccttcaccgcttacggctccggcagccgttctgtgtccggcaccatcctcatcagcgtgaacctcagcgaggtgcccgacgtttacggccccacgcccagaaacacggccgtcaccttccccgccgcctccatctacacggcggtggcccagtccagcggcctgggtctggccagcatccagctgctggaactgcccgccaccaacgagggtgtcatctacgtgggcagcggcacctccaagcgggcggacaccgagaccctgtacggctactccagcggcagcgagcggatcagccagctgcggttcgtgccggccagcggcttcaccggatctgtggaaatcccctatgtggcctgcaacagcagcggcgatcccattgccagcggcaagctttgcctgggcattgtcagcgctatggaggacttctctgatatcacctcctccacctggtgctataaatatgtactggagctcagcgacgccgacgtgatcgacggatacagcgacggcaccttcaagcccgacaaccaggtgacctacggcgcggcgctgaagctcatcatgctggccgctggctatgacgagcagaagccggtgaactccaacgtgttcagcggctatctggcccgggcgcaggcggacgggctggtgtccggcagcgtgaacctgaacgcccccatcacccggctggcggtcagccagatcgcggccaaggccatgggcctcagcatcagcaacctgtccagcgtccgtcccttcaccgacaccacggacccctatgtccaggcgctgaatgccgcaggcatcgtggagggctacttcagcaacggcaccagcaccttcaagccctacaacactctgacccggggccagatctccgccatcgtctggcggatggagcaagcccagtaa

SEQ ID NO: 927 - DNA, 4011 bp, Oscillibacter sp.
atgtcaagagatatacccttttttgaaatgtttactgagctgcagctctccggagagctgcggcttcgtttggccggcgcagtggtgaacggcgcttgcatcgaccaggccggcatgtcgctggcgctgcgcctcaccaccagggcggagctgggagatgcggagctggaggagctgaagcatctgctgatgggcgtatacggcttccgacaggtgacgacggaagtcacctgcaaggctccttcttcccaggccgcagccgcagggagccgcccggctgcttcggtcccggcggccccctccggcagtaagggcgagaagcaggccgcaggcaaggtcctgatgggcaagcccattcgcatccagccggtgcccatgaagatcctggacctgaagatggggaatgccaccgtggcggggaaggtgttcgccttcgagtgccgggagacccggcggcccggtatgtggcggctgagcttcgacatgacggactataccaactccgtcaccgttcagaagaacctgacggagaaggaggctcagggactggagagcgccatcaagcccggcatgtggctgtgcgtccagggcaagatggagcccacctgggacgggaaggacatccagctgaacccctaccacatccagctggcggagcacactgagcggcaggataccgccccggagaagcgtgtggagctgcacctccacacgaagatgagcaatatggatgccctgacggacacgaaagaggtggtccaacaggctatccggtggggacatcccgccatcgccatcacggaccacggcgtggcccagtccttcccggacgcttggcacgccgctggggacaagatcaagatcctctatggcgtggagggctactttgtcaacaacatcgatgaccgggtggtggtccacggccctcaggactgctccctggacggggagttcgtgtgcttcgacatcgagaccacgggcctcaaggtggaccgggaggccattacggagatcggcgccgtggtgctgaaaaacggtgagattacggatcggttccagaccttcgtcaaccccaaccggcggctgacgccggagatcatcggcctcaccggcatcaccgatgacatgctgaaggacgcccctcaactgaaggaggccctggcggaatttttgaagttcgtggacggccgccccctggcggcccacaacgcagagtttgacatcggcttcatccgggcgggctgccggaaggtggggctggacttccagcccacctatgtggactccctgattctggcacagaacctgctgccggatctgggaaagtacaagctggacatcgtggcggaccggctggagctgcccaacttcaaccaccaccgggccagcgacgacgccgccaccgtgggctatatgctgatccccttctggaagatgctccacgagcggggcatccacaccctccaggcggtaaaccgcgagatggagaagctgcggcccctgggcagcaagaccaaccgcttccccaagcacatcattctgatcgcccggaacaaggtggggctgaaaaacctgtaccagatgatctccgcctccaatctgaagtatttcaagcgggtgcccaccatccccaagagtctgctgctggagcaccgggagggcatcattgtgggttccgcctgtgaggcgggcgagctgttccgggccgtggcggaccacaaggactgggaagagctgaaacgcatcgcctctttctacgactatctggagatccagcccctgtgcaacaacgccttcatgttgcgaaacggcgacgtccagtcggaggaggagctgcgggagttcaaccgcaccatcgtccggctgggagaggagttgggcaagcctgtctgcgccaccggcgacgtccacttccgggagccggaggacgaggtgtaccgccacatcctgctggcctccaagaagttcccggacgccaacgccccgctgcccatctacttcaagaccaccgatgagatgctggaggagttcgcttacctggggaaggagaaggcctatgaggtggtggtgaccaatacccaggccatcgccgaccaggtggagactttccccttgctgccggaggagctgttcccgccccggctggagaactccgaggaggagctgaattccctggtgtggaacaaggtccatgagctgtacggcgaggacccgcccaagctgattgtggaccggctgaacgtggagctgggcggcattctgggcaagtacgacgtggtgtacatgtccgcccagaagctggtgcagcggtccctggaaaacggctacctggtgggctcccgaggctccgtaggctcgtccctggtggcctatatgtccgggatcacagaggtgaacagccttccgccccactaccgctgcccgaattgcaagcatgcggagttcattcaggacggctcctacggctgcggcgcggacatgccggacaagatctgcccggtgtgcggcacagaatacatcaaagacggcttcgacatcccctttgaaaccttcctgggcttcggcggcggcaaggtgccggatatcgacctgaacttctccggtgagtatcaggcccgggcccaccgccacgccatcgagatgttcggagagacccaggtgttccgggccggtaccatcggtacactggcggagaagaccgcttacggcttcgtgaaaaaatacctggaggagaacggcatgactgtgggccgggcagaggagaatcgcctgaccctgggctgcgtgggcacccgccggaccaccggtcagcaccccggcggcctggtggtcgttcccgacgatatggacatggaggacttctgcccggtccagcacccggcggacgccgacgactccgacaccatcaccactcattttgaataccactctatggaggcaaacctcctgaagctggacatgctgggacacgatgaccccaccatggtccgcatgatggaggatctgaccggtgtcaacgcccgccagattcccctggatgacccggacaccatgtccatcttcacctccagcaaagtgctgggatacgagaacgacgagattctgggccccaccggcgccgtggcgatcccggagttcaacacccgattcacccggcagatgctggtggatacccagcccaaggacttcaacacgttggtacggctctccggcttctcccacgggacagacgtgtggctgggcaacgcccgggagctgatcgtcagcggcaccgcctccgttctggagacggtgggctgccgggacgatatcatgctgtacctgatctccaagggcctggaccccaagatgagcttcaagatcatggagaaggtccgcaagggcaaggtgaagaagggcggctttgacgagggctgggtggaggccatgcgggaccacgacgtgccggagtggtacatcgactccctggccaagatcggctacctgttccccaaggcccacgcggtggcctacgtgatgatggccttccgcatcgcctggttcaaggtccatgagcccctggcattctatgcaacctttttctccgtccgggccaaggcctttgatgcggagtactgctgtgccggaaaggatgcggtgaagcggaagatccgggagatcgagaacaacaaggacgccacggcggtggagcagaacctgctgaccaccctggaggtgtgctatgagttctacctgcggggcttccacttcgacacgatcaacatttatgagtccgatgccaccaagttcaaagtgacggagaacggtctgctgccgcccttcacaacggtccacggcctgggagaggcggcggccatcgacacagtggagaagcggaatgggaaggagttcgtctccgttgaggagttcgccatgtgctgcaacaagctgtccaagacccatattgagcagctgaaggcgctgggagccttcgccgggatggcggagaccagccagctgacgctgttttga

SEQ ID NO: 928 - DNA, 3420 bp, Oscillibacter sp.
tatatgagccaagcattcaagaaggtcctggtcgccaaccggggcgagatcgccatgcggatcttccgggcctgtcacgacctgggcctccagaccattgccatctactccaatgaggacgtatacagcctcttccgcaccgccgcggacgagtcctatctgatcggagagaacgagagccccctgggtgcctatctggacatcccccggatcatcgagctggctaagaagcacggcgccgatgccattcaccccggttacggtttcctcagtgagaacgcggattttgcccgggcctgcgaggctgcgggcatcaagttcatcggaccctcctcccaggttctggacctgatgggcgacaagctgtccgccaagcagatcgccgtggcctgcggcgtacccaccacccccggcaccacagagcccctgaagagccgggaggctgctcagaagctggctatggagttcggcttccccgtcattctcaaggcggccgccggcggcggcggccgcggtatgcgccggtgtgacaccgtggaagaggtgggcaccaacttcgatctggtgaaggcggaggccaagaaggccttcggcaatgacgacatcttcatggagaagttcctggtggagcccaagcacatcgaggtgcaggtgctgggcgacgaagagggcaacgtggtccacctgttcgagcgggattgctctctccagcggcgctatcagaaggtggtggagttcagccccgccttctccgtggacaagaagatccgtcaggccctgtatgaagacgcggtgaagatcgcaaagcacgtgggctatgtgaacgccggcaccctggagttcctggtggacagggaagggcaccactacttcatcgagatgaacccccgtatccaggtggagcacaccgtcaccgagatggtgacgggcgtggacttggtgcgctctcagattctgatcgccgagggctgtcctctcagcgatccccgcatcggcatcaggaagcagagtgacctgcacctgaacggctacgccatccagtgccgcgtcaccaccgaggacccgtccaacaacttcgctcccgacaccggcaagatcacctcctaccggtctcccggcggcttcggcgtccggctggacgcggccaccgccggcgtgggcagcgagatctccccctactatgactccctgctgctgaaggtcaccacctgggataacacctttcagggcgtgtgcctgaaggccggacgggccatccgggagatccacatccggggcgtcaagaccaatatcgccttcatctccaacatcctgcagaaccccaccttcctggcgggaggctgccacaccaagttcatcgacgagacgccggagctgtttgagctgaacgagggccaggaccgggccaccaagatgctcaagtacatcgggaacatcgtggtgaaggagcgggacggacacaagatgtacgatccctgccggttcccgccggtcaccggcaaccggcccgatggcctgaagcagatgctggacgccaagggacccaaggccgtggcggactgggtgctggggcagaagaagctgctgatctgtgacaccacctgccgggacgcccaccagtccctgctggccacccgggtccgcacccgggacatcgtcaagggtatggagggcaccagcgagatcctggcggatgctttctctctggagtgctggggcggcgccacctttgacgtggcctaccgtttcctccacgagtccccctgggagcggctggacctgatccgggagaaggcccccaacctgctgctgcagatgctgctgcggggcgccaacgccgtgggctataccaactatcccgataacgtgatccgggagttcatcaaggaggccgcccgcagcggcatcgatgtgttccggatcttcgactctctgaactggatccccggcatggaggtggccatggatgaggtcctcaagcaggacaagatctgccaggccaccatctgctacaccggcgacattctggatcccaagcgggacaagtacaccttggactactatgtgaagatggcgaaagagctggagcaccggggtgcccacatgcttgccatcaaggatatgtccggcctgctgaagccttacgccgccaagaagctggtgtccaccctgaagcaggagatcggcattcccatccagctccacacccatgacaccaccggcaatcaggtggcggcgctgctgctggccgccgaggccggtgtggacgcggtggactgtgccatcagctccatggcaggcatgaccagccagccctctctgaacgccgtggtggcggccatgaaggacacagagcgggacaccgggctggatctggaccggctccagaccctcactgattactgggaggatgtgcgtaagcgttacgactcctttgagggcggcctggagtacaataccacggatatttaccgctacgagatccccggcggtcagtacaccaacctgaagccccaggtggagtctctgggcctgggcgaccggtttgtggaggtcaaggagaactaccgtaaggtcaatgagatggtgggcgacattgtgaaggtgacgccctccagcaagatggtgggtgacctggccatcttcatgacccagaacaacctgaccccggagaacatcgtggagaagggcgagagcctggccttcccggacagtgttgtcagctacttctccggtatgatgggccagcctgcaggcgggttccccaaggagctgcagcgggtggtcctgaagggcaagaagcccatcacctgccgtcccggtgagctgctgccccccgtggactttgaggagaagaagcgggagatgcagtcctttgatgcagatccctcctggcgggccatcctcagctactgcctgtatcccaaggtagtggaggattatgtcaagaaccagaaggagtacggctacatcatgcggctgggcagccatgtgttcttccacggtctggcggtgggcgagaccaacaaggtcaacatcgccgacggcaagaccctggtcatcaagtacttagggttgggcgaagtggacaaagagggcatgcgcaccgtcagctttgagctcaacggcatccgccgggatgtgcaggtgcccgacgaggaggcccagaagaacattgtcaaggtccccatggcggacccggaggacaagagccaggtgggctcctctatccccggcgcggtgagcaggctcaacgtcaaggtgggcgacaccgtggagaagaaccagaccctggtcaccatcgaggctatgaagatggagaccgccatcaccgcccggatgtccggcacggtgtcggagatcctggtgaaggagggcgagaccgtcaagggcggccagctcatcttggtcatcaaataa

SEQ ID NO: 929 - DNA, 4032 bp, Oscillibacter sp.
atgccgctggataagagcattcagaaagtgctggtcatcggctccggccccatcgtcatcggccaggcggcggagttcgactacgccggcgcccaggcctgccgggtgctgaaggatgccggcatcaacgtggtcctctgcaactccaaccccgccaccattatgacggatcaggccatggcggatgagatctacctggagcccctgaccgtggagaccgtcaagcgcatcatcaagaaggaacgccccgattccatcctggcgggcctgggcggccagaccggcctgaccctggccatgcagctggacaaggagggctttctccaggcccagggcgtccgccttctggggaccgacgcagcggccatctcccgggcggaggaccgggagctcttcaaggaggccatggcggagatcggccagccggtgattgcctccgacatcgcggagaccgtggaccaggccctggcggtggcggagaagatcggctaccccgtcatcgtgcggcccgcctttaccctgggcggcgcgggcggcggcgcggccaaggatcccgacgagctgaagatcatcgcgggcaccggcctggacgcctcgcccatcacgcagattttggtggagaaggccatcttcggctggaaggagatcgagttcgagaccatgcgggacagcgtgggcaacgtgatcgccgtctgctccatggagaacctggacccggtgggtgtccataccggcgactccatcgtggtggcccccacccagaccctggcggacaaggagttccagatgctccgcaaggcgtctctggacatcatcacccacctggggatcgtgggtggctgcaacgtgcagctggcattgaacccggagagctttgagtacgcggtcatcgaagtgaatccccgggtcagccggtcctcggccctggcctccaaggccaccggctaccccatcgccaagatcaccaccaagatcgctctgggctacaccctggacgagattaaaaacgacatcacgggcaagacctgtgcctgcttcgagcccaccctggactatatcgtggtgaagatgcccaagtggcccttcgacaagttcgccgatgccagccgggccctgggcacgcagatgaaggccacaggcgaggtgatggccatcgcccccagcttcgagatggccttgctcaaggctgtccggggcgcggagatcggcatggacaccctgaaccggaaaccggaccacggggacgacgcccccatccgggagcggctccgccgagtggacgatcacaggctcttcacggtgttcgaggcgctgaaatccggcgtcaccgtagaggagatccacgacatcaccagaatcgacccctggttcctctgcaagctgcggaagctggcggcgttcgaggcttccattgcagacggcctgtcggaggcgcagtaccgggagggcaagcggctgggctatcccgatgaggctctccgcaggctttccggcggcggagaactgccggagcaccgggatgcggtgtacaagatggtggacacctgcggcgcggagtttgacgcggagacgccctatttctactccacctatgaccggttctgcgagtcccgggccttcccccgcagcggcaagccggtcatcatggtgctgggctccggccccatccgcatcggccagggcatcgagtttgattactcctctgtccactgtgtctggacgctgaaggagctgggctacgacgtggtgattgtcaataacaacccggagactgtctccacggactacgacactgccgaccgcctgtattttgagccgctgtacccggaggacgtcatgcacatcatcgccgtggagaagccggtgggcgtggtggtggccttcggcggccagacggccatcaagctgacgaaattcctggacagccgcggcatccccattctgggcaccagcgccgagtccatcgacatggcggaggatcgggagcggttcgacgcgctgctggagcggttttccatcaagcgggccgccggccggggcgtgctgggtatgaatgaggcgctggaggcagcgaatgaattggggtatcctgttctgctgcggcccagctacgtcatcggcggccaaaacatggtcatcgcccacaacgatgaggaagtccgccgctacatggagatcatcctctccggcaagattgagaacccggtgctggtggaccagtacctgatgggcaaggagctggaggtggacgtcatctctgacggcaccgatgtactgatccccggcgtcatgcagcacatcgaacgtaccggcgtccactccggcgactccatcgccgtgtacccgcccttttccatcggggacaagatgctccagaccatcgtggactgctccgaaaagctggccctgtccctcaagacccgggggcttatcaacatccagtacctgatctatcagggagagctgtacgtcattgaggtgaacccccgggccagccggacggtgccctatatctccaaggtcaccggcgtacccatggtggacctggccacccgggtcatggtgggccagcccctgaaggccctgggctatggcacaggcctgtacaaacgtccgccctacgtggcggtgaaggtgccggtgttctccttcgagaagattaccgacgccaacgccgccctgtccccggagatgaaatctaccggcgaggtgctgggcctgggcgccaatatgcaggaggcgctgttcaagggcctggtctccgccgggtacaaggtggagaagagcggacacgcgggggtattgatctccgtgaaccgccgggatcagccggagattgtcaacatcgcccggaagctggatgaaatgggcttccgcctctacgccaccgacggcaccgcacgggagatctcccgcctgggcacggacgtggaggtggtgggcaagctgggccgggacaaccgggtcttccagctgctggagtccggcaggatcgactacgtgatcctcaccggctctacggagccggagtatatccgggacttcatccacctgaaccaccggtgcgtccagctgggcattccctgcctgacctcgctggatacggccggtgccctgacggacatcctggccagccgctacaaccaggagaacacggagctcgtcgatatctgccatctgcggacggagcggcagaagctgcccttcgccaaaatgcagacctgcggcaacgactacatcttcctggagaatttcagcggggagatcacctgcccggagtccctgtgcgtcaccctctgcgaccggcactacggcatcggcgccgacggcatcatcctcatggagggatcccggaaggcggatgccaagatgcggatgttcaacgccgacgggtctgagggctccatggccggcaacgccctgcggtgtatggcgaagtacctctatgacaacggtatcgtccgcaaggaggaaatgaccctggagacggacaagggcaccaagaccgtccgggtctacaccaccgacggcagggtgacctctgcctgcgtggacatgggctacgcgaccctggacaccacggccctccggctgaatatcccgaagcggcaggtggtgaactatccggtggagattgccgggcagccctgggagatcacctgcgtggacatgggcaatccccactgcgtggtgttctgttcccgggtggacggcgtggatgtggcccggatcgggccgcagtttgaacatgcgccttattttccggaccggatcaacacggagtttatccgggtggtaaatcccagcaccatcaagatgcgggtctgggagcggggcagcggtgagacgctggcctgcggcaccggcgcctgtgccgcggtggtggcggcggtggccaacggcctctgtgaaaagggacgggacatcacggtccgggtccagggcggcgacctggtggtgcattacaccgacgaagccgtcaccctcaccggcgatgccaagctggtctacaccggcgtagtggagtactga

SEQ ID NO: 930 - DNA, 4413 bp, Oscillibacter sp.
atggcacatatcaattcggatattctgcgcctcggcgtggatgtggggtccaccaccgtcaaagcagtggccctggacccggctgacaacagcgtactgttcacccgctatcagcggcataacgcccatcaggcggataccgtccggcagctgctggaggaggcggccggtcactttcccggcatgcggttccgtatcggcgtgtgcgggtccggcggacggcccattgccgccgccctgggggcctgctatgtccaggaggtggtggccaacgcggcggcagtccgggccttgtatccggaggtccgcaccgcggtggaactgggcggacaggatgccaaggtgatcttcttccgctatgacgaggccagcggaaagctccagacctccgacatgcggatgaacggcagctgcgccggaggcaccggcgcgtttatcgatgagatcgccgcgctgctgaacgtgccggcggacgagttcgagcaactggctgcccgcgggaagaccgtttacagcatctccggccgctgcggcgtgtttgccaagacagacatccagcccttgctgatccagggggcggagcgggcggatatcgcgctttccaccttccacgccatcgccaagcagaccatcggcggcctgtcccagggactggagctgacggcccccatcatctttgagggcggcccgctgaccttcaaccccacgctggtgcgggtgtttgcggagcggctgaatctggaggaaagggatatcgttcgaccggaccacccggagaccatcgtggcccggggcaccgccatcgccatcgacgagctgttccccggacaggaggacgccatgaccctggcagaggccatggagcggctggacaaggccccggcccagaccgaagggccctccggcaccggcaggcccttctttgccagcgacgaggagcgggaggtctttctccgccgccaccgggcggagctgcgccagccggtggatgccgcggagcggaaggtcctgcgggggtacatcggcatcgactccggctctaccacctccaagttcgtctttatagacgagaacgagcaggtgacggacactttctacgccaacaaccagggggagccgctgaaggtggtccgggagggcctgctggccctggcggagaagtatgagaagctgggcatccagctggaggtgctgggcctgggcaccaccggctacggcgagcagatgctctctgctgcctttcacgccgactaccacacagtagagaccgtggcccacgcccggggctgccgccgcttcttcccggacgccacgtttctgctggacatcggcggccaggacatgaaggccatctggctgaaggacggcgtggtcacgaacatcatgctgaacgaggcatgctcctccggctgcggctcctttttggagaacttcgccgccaccctggggatgccggtggaccaggtggcggacgccgccttccgatctcaggcccctgccgagctgggcagccggtgcactgtgttcatgaacagcaccatcatcaacgagcagcgcaacggcaagcagcctgacgacctgatggcggggctgtgccgctccatcatcgagaacgtgtttacaaaggtggtccgcatcgccaacgtggcggagctgggggatcgggtagtggtccaggggggcaccttccggaacttcgccgtcctgcgggccctggaggagtatctgggccgggacgtgaccctggccccctatcccggcgagatgggcgctctgggtgcggctctcgcggtgaagcaggaggtggaggcccacggctacgccaacggccgctgctccgccttcatcggctttgacgcggtgaaaaacttccaatacacccgggagagcggtgtactctgcccccactgcaccaaccactgcagccggacgatcctgcatttcccggacggtggctgctatgtcaccggcaaccggtgcgaccggggcgccgttgtgatggaggcggcacctgcccataaggcccaggaagtgccggacctgttccggctgcggcaggagctgctgttcaagacatatccggtatcccccgtgcgggaggagcagagccagaccgtgggcctgccccgggtgctggagttctgggacagcatgcccttctggagtaccttcttccgggctctgggatatcgggtgaagttctcccatcccagcagccgcagacagtatgagagcggactgcagtacgtggcgtcggacaccatctgttttccggccaagctggtccacggccatgtgctggacctgtccaaacagggcgtagaccggattttcctgccctatatcctccacatgcccacagagaacaaaggggagaagagcccctacgtctgcccggtcatcatgggctactccatggtggtgcggaacttccagtcccccggggagcacttctccgtgggctttgagacgccggtgttccactggttcagcaagcaggaccggaagcggcagatctgccggtatgccgtggaacactgcggcgccacaaagcggcaggcggaggccgcttaccgtcaggcggagacggccatcctctctttccgccatcagctggtggaggagggaaagcgggtcatcgcggacaccggaaaggcgggcggtttcgccgtggtgctggcgggacggccctatcacacagaccccctcatcaaccacgacctgtccgggatgttcacccgtcggggcatcccggtgctgacggtggatagcctgcccggactggagaaggcggacctgcgccggtcccgtgtggagatcaccaatgacttccacgcccggatgctctccggcgccatggtgacagcggagcagccctgcctggagtacgtgcagatcgtcagctttggctgcggccatgatgccattttgtccgatgagatcatccgcctgctgggggagggcagcggcaagccgcccctgatcctgaaggtggatgagagcgaggccgccgggtctctcggcatccgggtccagtcctttattgagacggtacagctgcgccgctctgcccaggcggagcaggcggcctgccgcctgccggagccctacgcggtgaagtaccgcaaggaggaccggaagctgcggactgtgctggtgccaaatatctccgccccggtgtccactcttctcacggccttgatggaccgggagggtattcgggcggtgagcctgccggtgggcggcgtggagcagatccgggtggggaagaagtacacccacaatgacatctgcttcccctgtcagatggtcatcggcgagctgatcgacgccctgcagaagggaaactatccggaggactccgtggccgtgggcatggccaagctcagctgcgactgccggatggccaattacaccgcgattctgcgcaaggcgctggacagcgccggatttgaaaacgtccccatcctcaccacagaccctggcgacaccaagggtatccaccccggcgtgtccatgctgggggcccggtctgtgctgctggcggcgtgggccttctccatgctggacattctggaggagctgtgccggaagatccgcccctatgagacggcggcaggcgagacgaaccgcgtgttcagcgaatgtgtggagtggattgccgccgcatccaagcaggggctgggcaagatgatcggtgccttccggcgggccatcgaggcattccgggggctccgctatgaccgctcccgccgcaagccccgggtgctggtcaccggcgagctgctggtgaactttcatcccggcaccaacttccacgtggaggagtacctggaacgcaacgacatggaggtcatcctgccccgcatcacctaccagttccgcaaggacttccaggcggccatcagcgagatccgggacttcggtgcccatctggcgccctatcccttcgccctggacggcgccgtggagttcatccagcggtttttggagcgcattgcccggtcccatcccctgtatcacccggcggcccggcctcaggacctgtacagtgacgtggagcacttcatccccaagaccctcacctgcggcgagggctggctgatggcgggcgagatcgcccactacgcccaccagggggtccggtccttcatcatcctccagccctttgggtgcctgcccaaccacgtgtgcggccggggcgtcaccaagcggctcaaggaggagttccccggcgtgcagatcctgcccctggacctggatccggacaccagctacgccaatgtggagaaccggctccagatgctcatcatgaatcagaccgcggaggcggagcattccgcagctagtgtggaaccggcaccccaaaagacccggggcggttcgccccgtccggcgctgtcctctacataa

SEQ ID NO: 931 - DNA, 4818 bp, Oscillibacter sp.
atggaacgacaactgggaaagcccctgcatattcaggcggcggaggcctttgaatcgcccgcgtttcttcagaagctgggaatggcccgcgccgacgcggagcgtatcttcggcggcgccgactggcaccagctgctccgggatctagtgcccatccggggccggatctcctgcgccgacgccctggcggccttccgccccctgctggaccaggtggcgccggatcccgctgagggatggctgtcctacgcctaccaggtggcccgggcgctgctgtatccggcgtcggaccccggacatacctccgcccagtgggatggagcgctgtgctttctgcagctgctccaggtcctgtttgacgcggagcggacctgcctgccctttgacttctggctggactttgaattctgcacggaggaggaactctcccacagcggtgtggcggaggagtaccgccgcttctgctaccggttccgggaggaatacatctatgagatgctccgcctgagccgggaggtcacatccttccgcaccctggagcacatcgccggcgtccactatgtgtccatgcgggtggcccgggccttctgcgcctccggcggactcatcgacctggggctgatctccggagccgccctgggccacgacctgggcaaattcggctgcaagcccggggaacgggtgccctacctgcactattactacaccgaccagtggttcacccgccggggactaacggccctgggccacatcgcggccaaccactccgtctgggatttggagatcgagaacctgtcctcggagtccctgacgctggtgtacgcggacttccgggtgaagcagacctatggggaagaccgccgggagatcccctgcctctactccctgcaggaggcctttgacgtcatcctcagcaagctggacaatgtggacgatgccaagcgcctgcgctaccgctatgtctacgccaagctgcgggactttgaggactatctcatctcctttggggtggacaccaccctccgcaccgccggcggccccgcccgcccggccaaaaatgctgccctgctgaacacggacgaggtggtgaccgctctgcggcgtaccgccgtggaccacaatatccgcctgatgcaccggctgggccatgagcagctcttcggcaacactctggaggccgcccggggcgaaaagaaccccgcccggctccaggcatacgtctccatttttgaggagtatttcacctactggaacgcctctcagaagcagcagaccctggactttctgtatgagctgctgctgatcccggacggagacatccgccgccgggccgccgccctcatcggacgcatcctggccgccttccgcctgggctatcagaaggagcccccggccgacgccccgccggacccggaggaagacctgcccttccagctgtgggcggagtacctggaaaagctcatcgacccggaccggcggctgacgccccggcagatcagcatgatccgctatcaggccaagactgcggcggacgcgctgctgatgaactgctccgacgccgacgccccccgctttgccggggagctgttccgccactaccgccgcccggaactggtggacgccgatgcggcctttgccctgctggacacggtgctgagcctgccgctggaccgggtatccgccgaggatctgcacgtgctgaccggcttttccgtctggtggctggaacggggcggcctgccccagaaggccgccgccctgcggctgttccaccacctgctgacggccctggaccccaatggccgggacgccgcggccatcactgccgccgtggaggcagcggattgccagggaagcacgccgctgctgtttctccaggcccgcctgggagagcggctgggcctggatgtctccatccagcggtccctgttggaccggcaggacgttgtgagcaatgtgtttctggacaacctgaagactgcgacccactgggttctgaaggccgtgggcgtggagtacctgctgggtcaggtggaacagggagaccgcgccaacgtgctccacatcgccacccacttctccaacctgatgaaggtcagtgagaatatcgtggtccgccggctggcgggcgcttccctgctggccattgctccggccctgacgccggaccgccggaacgaggtggccgtggagctttccaaggtgctggagaccgggcagacggagatctcccagtacatcccccagtacctgggccagtttgccctgtggctgacgcccagggaactggacgagatcgtggatcagatgcagatcctcctctcctccgccaacaccgtggtggtggccgccgccctggccactgtgggcgccatgctggagcattatgccatatacgcccagcggttccacgagtcccgggaggtactggaacgccgctggcggcggctggcaggcctgctgttgaagggcctggcctcttatcgtcagagcgtgcggcaggaggcgctgcagatcctgggcgagcggctcttcgcctcacagaccctctcctacgaggggaaggctgccctcttcaccctgatggccaagaagatcctcttcctgctgggagagcagccggaacaggagctgagcttcttctacaccgccgccgccctctcccacatctaccgcttcatcgtctcctatcagattgaaagcggagacttcccattctacatgccgggaagggccgccttctttcccggcaccttcgaccccttctccctgagccataagggcatcgtccaggagatccgggacctggggatggaggtgtatctggccatcgacgagttctcctggtccaagaaggcgcagccctccctggtgcggaggcagatcgtcagcatgtccgtggcggacgagttcgacgtgtacctcttcccccacgacatcccagtgaacctggccacgccggaggacctggaccggctgcgggaggtcttttccggccgggagctgtacctggcggtgggctcggacgtggtagccaacgcctcctcctacaaggcggcaccggtgccggggtccgtccactccatgaaccacatcgtcttccgccgctccagcgacgcggagggacgggagatcgacgcagatctgggctgcatctccggccgcatcatccagctgcagctgcccacccatctggaagacatcagctccacccgcatccgggagaacatcgacctgggacgggacatctccaccctcattgacccggtggtacaggacttcatctaccgcaacagcctctatctccgggagccccagtacaagcggatcctccgggcgggggatctggagttctcccacatctcccagccggaccggcacctgtgggaggagttgacggaggtaccgcttcaggggcgggagcagccgccggagatcgaccccagggacggcctctgcatcctgcgggacgcgggatcccgcccccgggtgctgggttttctgaccctgcggaccgtgaactccggcgggctgtatgaggccctgggggacacggagctggcggactatgtccgcaagcacacggcggggcgggttcagctgctcaccggactttacaccgcccgcggctccagcggcagctatgatgtgggccagctgctgatgacagaggccctctcccgctccctgggagcggactgcagctatgccgtgtggcacgccactgcgtcggaggagacgctggacctgctggagaggcaaggctttgtcccggcggagctgcccagcgcaaagcccctgctgctggtggatatgcgctctccctccgtactgctgcagaacatccccaccacgctgaaggagcctttctcctccgaccgtaccgtgctggcggcggtccgcgccgcccactgccggatgcagcgggctctcaccggcctgtatccgggttctctgatcctgtccctgaacgcggaggtcatttaccaccgtctggtgcggaagatcgtggacctgaacggcgtcccggcggagcccacagtgccccgggtactgggtcccaagatgtgcgtacccttcggcaagatcctgcggggcaatgccatccccaacaccgtcaccaagaccatccacaccgacaaggtctttgccagggacctcacctccttcgacatcgagaatttccccggctacgcgccgctggagagccagatccgcaccatccactccttccgccggccggtgatcctggtggacgacctgctccactccggcaaccggatccgggcgctggatcccctcttccggcaggagggtgtggtcatcgaccgggtgctggtgggcctgctgtccggccgcggacgggatctgatggccgccaagggccgcagtgtggacagcgtctatttcattccgaatatgcgttcttggtttgtggagtccaccatgtaccccttcatcggcggcgacactgtggggcatgaggagccctccgtccccggcctgaccccagcggtgaacctgatcctgccctacgccttcccccgcttctaccgggagtgcggacgggaggcggtgttccgtttctcctgtgcctgcctggagaacgcccgggacatcctgctggccctggagaccaccttccgggagcggtacgcccgcaacctcaccctctcccgcctcagtgaggcggtgatcctgcccctctccccggacaagggcagctgtatgcactatgaccccagtcttcctgcctccgtatttctgcagaacgacctggagatgctgttgcggatgcggaacgtcctccaatcctga

SEQ ID NO: 932 - DNA, 2673 bp, Oscillibacter sp.
atgggtgtaacaatcatgcattttaatggactgactgacaaacaagttgaggaatcccgaaaaaaatacgggtccaatgtgatccccgactccgaacccaccaccttctgggcggagttcaaggagacgttcaaggaccccatgatccggatcctgctggctattgcggccctgatgatcgtcatgtgtgtgctgggctatgcggagatctatgagcccatcggcactgtcgtggccgtgctgatcgtggcattcgtctccgccaagaccggcgtggccagcgacacgaagtaccgccagctgaaggacagcaccaaaaaagatcagtgcaaggtctaccgcaacggtctggtcaccgtcatcgacgtggatgacgtggtggtgggggacaaggtcctgctccagtccggcgacaaggtgccggcggacggcgtgctgatccacggaactttaagggtggacaactccgccctcaacggcgaggcggaggaatgccccaagaccgcggcggacgagtccttccccctgccggaggacatcaccggcgacaccttcgtggacgcccactccctgttccggggcgccgtgctgtttgacggcgagggcgtgctggatgtgcgcaaggtgggccttgccaccatgatgggcaagatggccgaggagatgcaggacgacgagccggactctcccctgaaggtgaagctcgggaagctggcggacatgatctcccgcttcggctacatcggcgccgtggttatcgccatcatgtactttggctactttatcctctccgccggcgggtttgcggcgtacttctcctccggagccccagtcatcatccaggacatcgtggaggctgtgtccctggcggtggtcatcatcgtgtgcgccgtgccggaggggctgcccctgatgatctctctggtgctgatgcagaacaccagcaagatgctggaccacaacgtgctggtccgcaaggcggagggcatcgagaccgccggctccctgaacatcctgttcagtgacaagacgggcaccattaccaagggccacctggaggtggtggagttcttcaccgcagacggcgtggctatccctctggatcaactggcccagcaaaccaagctcaagggcctgatcgatctggccatcggcaagaacagccagtccatgtatgacggcagcggccgcgtggtgggcggcaacgccacggaccaggcgctgatgcgctttctggggcaggagaccttccacaagctggatgaggtctcctcctatgccgtcaccaaatcccaaagcttcaactccgccaataagttcagccaggcctacatcgccggggcgggccgcaccttctacaagggcgcgccggagaagttcctagccgtggcccagaagtacctcagcctggacggggacgagcatcccctggacctggagtccctgaacgccaagatcgacgagctggcaggcaagtccatgcgggtgctggccttcggctactcccccagcgagatgacggagaacgccatcaacgccgacacggtgctgatcggcctggtgggcatccgggacgacgtgcgtcccgaggcccgggaggccatcgccgaggtgcagaaggccggcatccaggtggtcatgattaccggcgaccggctggagaccgccgtggccatcgcccgggaggccgggctgctgcggacccgggacgatgtggcgctgacctccacccagctcaacgagctgtccgacgacgaggtgaagaagatcatcccccgcatccgggtcatcgcccgcgccctgcccacggacaagtcccggatggtgcgcctgtgccaggagctgaacctggtggtgggcatgaccggcgacggcgtcaacgactccccggccctgaagcgggcggacgtgggcttcgccatgggcagcggcacggaggccgccaaggaggccggcaagatcgtcatcctggacgacaacttcaagtccatcaaggacgccatctggtacggccggaccatttaccacaatatcctgaaattctgcaggttccagctggtcatcaatgtggccgccgtggtggtcagcgctatcgctcccttcttcggcgtggaggagcccctgaaagtcacccacctgctgttcgtgaacctggtgatggacggcttgggcgccatcatgctgggcaatgagcccgcccaggagcggtatatgtccgagccgccccgccgccgggatgagagcattgtcagcaagtccatgatggcccagatcgtcaccatgggcctgtggctgacggcgttgagctttgtcttcctgaaagtgcctttctttgacagcttctttgccagcacggagcagaagctctccgcctatttcgtgctgttcatctggagcgccctgttcaacgccttcaacgtgcgcagcgacagctttgacatctttaaggatctgaagctgaaccccggtttcatgcgggtgttcgttatcatcgtcctggtgcaggcgttcatcgtcaacgctgccctgatccccgtgccggtattcggctggatcagcaatatgttcagctgtgtgcccttcccgcccgccgggtgggctgccgccattctgctggcgttcaccatgatccccgtggacatcctccgcaaggtgatcgtgggacggaagtaa

SEQ ID NO: 933 - DNA, 4533 bp, Oscillibacter sp.
atgagtggaccagcgcagaacatacacaatatctatgatcccctgtgggagcacgacgcctgcggcatcggcgccgtggtgaatttgaagggcacgccgtcccacgccacagtggacagtgccctgaagatcgtggaaaagctggagcaccgggcaggtaaagacgccaccggcgagaccggtgacggcgtggggctgatgattcaggtgccacacaagctgatggtgaaggcggcctccgccgagggcatcgccctgggcggcccccgggattatggcgtgggcatgttcttcttccccgcagacgcgctgaagcgggcccaggcccagaagatgctggagatcatcgcgtccaaggaggggctggacttcctgggctggcgggatgtgcccacccatccggaggtgctgggccggaaggccctggactgtatgccctgcatctgccagtgctttgtggcccggcctgtagactgcgcccgtggcctggactttgaccggaagctgtatgtggtccgccgggagttcgagcaatccaatgtgaacacctacatttgctccttctccagccggaccatcgtgtacaagggcatgttcctggtggggcagctgcggaagttctacacggacctgacggagccggattgtgagagcgccatcgccctggtccactcccggttctccaccaacaccacccccagctgggagcgggcccatcccaaccgctacatcctccataacggtgaaatcaacaccatccggggcaacgtggaccggatgctggccagggaggagactatgcactcggccgtactggaggcggacatggacaagatcctgccggtggtagaccagagcggctccgactccgccatgctggacaacaccctggaatttctgatgatgaacgacatcccactgccccaggcggtgatgatgtgcatcccggaaccctgggccaacgaccggaaaatgagccgggagaagcgggacttctaccactactatgccaccatgatggagccctgggacggcccggcggccatcgtgttctccgatggggacacggtgggcgcggtgctggaccggaacggcctgcgcccctgccggtggtatctcactaccgacaagcagctgattctctcctccgaggtgggggtgctggacatcccgccggagaagatcgtgaagaagtcccggctccagccggggcggatgctgctggcagacctgactgccggtcgactggtggacgacgccgaggtcaaggagcggtacgcccgccagcagccctacggcgagtggctcgatgcccacttggtatacctgcgggatcttcccatccccaaccggcgtgtggagcggtcctcccaggagcggcgggaccggctgtacaaggccttcggctacacctatgaggaggtgaaggacgctatcctccccatggcccggggtggggcggagcccacctccgccatgggcgtggacacaccgctggcggtgctgtcggaaaagcaccagcccctgttcagctacttcaagcagctcttcgcccaggtgaccaacccgcccatggacgccatccgcgaggagatcgtcaccgacaccacggtgtatgtgggctccggcggcaatctgctggaggaaagagcggagaactgcacagtcctccagatccacaaccccatcctcacctccgtggatctgatgaagatccgctacatggaccggcctggcttccatgtggagaccatctccctgctgtactacaagggctctcccttggccaatgccctggaccggctgttcgtcaacgtggaccgggcctacaagaatggcaccaacatcctgatcctgtcagaccgtggggtggacgagaaccatgtagccatcccctctctgctggcggtgtccgccctggagcagtatctggtgcggacgaaaaagcgcaccgcagtctccatgatcctggagagcgccgagccccgggacgtccaccacttcgccaccctcctgggctacggcgcccaggccatcaacccctatctggcccaggagtgcgtagaggagctggtgaccctggggatgctggataaggatcccactgcggccgtcaacgactacaacagcgccatcctccacggcatcgtgaagatcgcctccaaaatgggcatctccaccatccagtcctaccagtccgcccagatcttcgagtgcctgggcatcaaccgggacgtggtggacaagtacttcaccaacacagtcagccgggtggagggcatcggcctggcggagatcgaggagggcgtggagtggaaccacagccaggccttcgatcccctgggcctgggctacgactccacgctggactccaccggcattcacaagctgcggtccggcccggacaaggaggaccacatgtacaacccccggaccatcctgctgctgcagaaggccgtccgggagggcagctacgagaccttcaaggagtattccgccctggtggacgagcctgccaagccccataccctgcgggggctgctggacttccagttcgatgagagcggcgccatctccatcgacgaggtggagcctgtggcgtccattgtcaagcgattcaaaaccggcgccatgagctacggctccatctcccaggaggcccacgagtgcctggccatcgccatgaaccgcatcggcggcaagtccaactccggcgagggcggcgaggacgcggcgcgcctgcgcgatgagcggtgctccgccatcaagcaggtagcctccggccggttcggcgttaccagcgcctacctcaccagcgcccaggagatccagatcaagatggctcagggtgccaagcccggcgagggcggccatctgcccgggaaaaaggtctatccctggattgccaggacccggtgctccacccccggcgtgacactgatctctccgccgcctcaccacgacatctactctatcgaggacctggcccagctgatctatgacctgaaaaacgccaaccgccgggcccggatcagcgtgaagctggtcagcgaggcgggggttggcaccatcgccgccggcgtggccaaggccggtgcccaggtggtgctgatctccggccatgacggcggcaccggcgccgcgccccgcagctccatccacggggcgggcctgccctgggagctgggcgtggcggaggcccaccaagccctgatcgccaacggtctgcggagccaggtggccctggaggccgacggcaagctgatgaccgggcgggatgtggccatcgcctgtatgctgggggcggaggaattcggctttgccaccgcgcccctggtggccctaggctgctgcatgatgcgggtgtgcaacctggacacctgcccggcgggcattgccacccagaatccccagctccggtcccgcttctccggcaagccggagtacgtggtgaacttcatggaattcgtggcccaggagctgcgggagtatatggcggccctgggcatccgcaccgtggatgaactggtgggccgcagtgacctactgcgggtccgggagaagctggtgacccaccgggcggagaccctggacctccgcagcctgctggaaaatccctggagcggcgggccgtcccacttcaatcccggagatgtttacgacttccatctggagcggaccctggatgagagcgtgctgctggccaaactgggcaagacgctgaaggggaagcggaccggccggttggagctcaccgtctcctccacggaccgggccttcggcacgctgttcggcgccgagatcacccggcagtgcggggactccctgccggacgacagctatgtcatcacctgccatggcggcggaggccagtccttcggcgccttcatccccaaaggactgaccctggagctggagggcgactgcaacgatgggctgggcaagggcctctccggcggcaagctggtactctatccacccaaggacagcaccttcgaccccggcgagaacatcatcgtgggcaacgtggctctgtacggcgccacctccggccaggcgttcatcaacgggatggccggcgagcggttctgcgtccgcaactccggcgccatcgccgtggtggagggcgtgggggaccatggctgcgagtacatgaccggcggccgctgcgtgattcttggccccacgggaaagaacttcgcagccgggatgtccggcggcatcgcctatgtgctggacgaaaagcacgacctctatatgcgcctcaacaaggaccaggtgatgacggacaccctgacggagcctcacgacatcgccgagctccgctccctcattgaggcccatgtggccgccaccggctccccccgggggaagaagatcctggcggccttccactcctacgtcccctgcttcaagaaggtcatgccccgggactacgaccggatgctccggtccatcgcccagtacgaggagaaaggcatgacccgtcagcaggcggagatcgaggcgttctacgccaataccagagcttga

SEQ ID NO: 934 - DNA, 2808 bp, Oscillibacter sp.
atggactacaacaagaccatcaatctgcccaagaccgacttccccatgcgggcgggcctgcccaagcgggagccggagatgctcaagcgctggcaggagcaggacgtgtacaacgagctgctgaagaagaacgagggcaagcccctcttcaatctccacgacggcccgcccttttccaacggcggcatccacatgggcaccgccatgaacaaggccctcaaggatatcatcacccgatcctacgccatgcggggctactacaccccctatatccccggctgggacaaccacggtatgcccatcgagtccgccattatcaagcagaacaagctgaaccacaaggctatgagcattccggacttccgctccgcctgccatgactttgcccagcattatgtgggcgtgcagatggacgccttcaagcgcatgggcgtcatcggcgactgggagcacccctacctcaccatgaaccccggctttgaggctgaggaggtgaaggtgttcggtgccatgtacaagaagggctatatctacaaggatttcaagcccgtctactggtgcccccacgacgagaccgccctggcggaggcggagatcgagtatcaggacgacccttgcaccactgtgtatgtgaagttccccatgcacgacgattgcggaaagctttccggttatgacaagctgttcttcgtgatctggaccaccaccatctggaccctgccgggcaacctggccatcgccctgcatcccgacgagtcctacgctgtggtgaaggcccccaacggcgaggcctatatcatggccgaggctttggtggagaaggtcatgcacttgggcggcttcgacacctgggaggtggcggagacccatcccggcgccttctttgagaacatgctggcggaccaccccttcctgcccaagacctcccgcctgctgctggcggattacgtcaccatggactccggcaccggctgcgtccacacggcccccggcttcggcgcggatgactacgagacctgcaagcgctacggcgtggagatggtagttcccgtggacgaccagggccgccacacggagtacgccggcaagtacgccggtatgaagaccgatgagtccaaccccgtcatcctggcggacatgaaggagagcggcatgctcttcgccagcgaggacatcatccacagctatccccactgctggcgctgcaagggccccatcatcttccgggccacgccccagtggttctgctccgtggagtccttcaaggaacaggccgtcgccgcgtgcgacgatgtgcgctgggtgcccggctggggcattgaccggatgaagtccatgatccgagagcgcaacgattggtgcatctcccgccagcgcaagtggggcctgcccattcccgtgttctactgcaaggactgcggcaagcccatctgcaccgatgagaccatcgacgccatctccaagctcttcgccgccgaaggctccaacgcctggttcgccaaggaggcggaggagatcctgccggagggcttcgcctgcccccactgcggtgccaaagccggcttcaccaaggagaccgataccctggacggctggttcgactccggttcctcccacttcgccgccatgaagaaggaccagggcttctggcccgccaccatgtatctggagggcctggaccagtaccgcggctggttccagtcggcgctgctgaccgccgtgggcgccttcggccagggcgcgcccttcaaggagtgcgtcacccacggctggaccgtggacggcgagggcagagccatgcacaagtccctgggcaatggcatggacccggcagagatcatcaaccagtatggcgcggacctgctgcgcctgtgggccgccagcgccgactaccacgccgacgtccgctgctctcacgagatcttcaagcagctcagccagaactacctcaagttccgcaacaccgcccggtactgcctgggcaatctggacggctttgacgccgaccagctgacggcgcccgcggagatggaggaactggaccgctgggccgtcacccgcctgaacgccctgatggagaagtgcgccaaggcgtacaacgactatgagttcctggtggtcacccacgcggtgaacgacttctgcgtggtggacatgtccaacttctatctggacatcatcaaggaccgtctgtactgcgaggaaaaggacggcgccaagcgccgcagcgcccagaccgccctgttcctgattctggacaccatgaccaagctgatggcccccatcctgtgcttcacctgcgatgagatctggctctctatgccccaccgcagcggcgacgatggtcggaacgtggtgttcaacgacatgaacaagcccttcaccgactacgccctggatgagaccgccatggagaagtggtccgccgtggaaaagctgcgcgacgacgtgaacgccgtgctggaggccgcccgggccgagaagaaaatcggcaaggccctggaggcccacgtggccctccacgctggggacgacgcggcgtctgccgccctggtgcaggtgatgggcctgaacctggcagagctcttcatcgtctccgactgccaggtctccagtgcggagcccgatgccgcctccactgtgggccagggtgccaacttccccggcctcaccgtggaagtcagcgaggccagaggcgacaagtgcgagcggtgctggatgcacagccccactgtgggcgccgacgcggatcaccccaccctctgcgcccgctgcgccgccgtggtgcggaaactcccccagttctga

SEQ ID NO: 935 - DNA, 2529 bp, Oscillibacter sp.
atgggaccgggattgccggaaggagctgaaactgtgcgcaaagacactgaaaaaccatccttttttgtgcggctggccacggtgatcgtggataagcggaagctgatctttttcctgtacgcgtgtgcgctgctgttctgcctgttctcccggaactgggtcagcgtctgcaacgacatcacggagtacctgccggactccacagagacccgccaggggctgaccctgatggaggaggagttcaccaccttcggtaccgcccgggtgatggtgtcccacgtgacgcggggcatcgcggaggatctggcggaacagatcggggagatcgagggcgtctcctccgcgtccctgggagacagcatcggcgcagaggaggacggggaggccgagacaccggaggacatcgcatcgtatttcaagggcgcggacgcgctgatctccgtgacctttgcgggggaggaggatgacgaatccgccctggccgccatggaggccatccgggagctgctggccccctatgacttttatatagacagctctgtgggggactcccaggcggactccctggccgatgagatggggatcatcctggcggtagcggcggttatcatcgtgctggtgctgctgctgacttcccgctcctatgcggagattccggtgctgctgctgacctttatcgcggcggccttgctgaatctgggcacgaacttcatcttcggagagatctcctttgtctccaactctgtgacggtggtgctccagctggctctggccatcgactatgccatcatcatgctgcaccgcttcctggaggagcgggagcacgccggagaccgggaggcgtgcattgcggcggggagcgccgccattccctccatctccgccagcagcctcaccaccatctccggcctggcggccatgatgttcatgcagtttcagatcggcttcgacatgggcatcgtgctgatcaagtccattctgttcagtatgctgtcggtgttcaccctgatgccggggctgctgatgctcttttccaaggcgatggagaggacccgccaccgcagcttcatccccaggatcgaccgctggggcggatttgtcctgaagctgcgccatgtgggagtgccgctgttcattgtggccctggtggggggctttttcctctccaaccggtgcccctatgtgtacggctatacccagatcgagactgcgcggcagaacgagtcccaggtggcggagcagcgggtcagcgacaccttcggcacccagaacgtgatcgctctgctggtgccccggggagactatgacagtgagaaagccctgctggaacggctggaggcctgcgatcaggtggactacgccatgggcctctccaatatcgaggtgatggacggacacaccctcaccgatgccctgacgccccggcagttttccgaaatgacagacctggactacgagctcgtctgcctgctgtacactgcctacgcggcggaggaggaggcctacggccggatcgtgggcggtctggacgactatgcggtccctctgatggatatgtttttcttcgcctacgacaaggcggaggagggctatgtggatctggacgaggggcagcaggcggacctggacgatctctatgaacagctcgacaacgcccgggtccagatgctgggggaaaactacacccgtatgctcatcaatctgaacctgccggaggagggggcggagacctttgctttcctccagaccatccaccgggaggcggagcggtactacgacgcggacagcgtctatctggtgggggattccaccagcgactatgacctgtccgtctcctttgcccgggataacatcatgatcagtgtcctgtcggtggtgttcgtcatcatcgtgctgctgttcaccttccagtctgtgggactgccgatcctgctgattttggtgatccagggcagcatctggatcaatttttccttccccggcatggcccagaagcccattttcttcctgagctatctgatcgtgacagccatccagatgggcgccaatatcgactacgccatcgtgatctcctcctggtacaatgagctgaaggcggagatgtcccgacgggacgccatcgtccaggcgctgaatctgtccttccccacggtactgacctcggggagtatcctgtcctctgccggattcctcatcgcccaaatcaccacagagcctgccatcgtgggcatcggcgagtgcctgtgccgggggacgctgatctccatgttcctggtcatgttcatcctgccccagatcctgttcctgggcgacgggatcgtggagcggacccggttcgatctcaaggtgccggaggttgccaggagtgcccatggcaccgtctatgtcaacggccgggttcggggccgtatttccggcgtagtggatgcccagatccagggcgtgatttacggggacgtctccggaatgctggagacgggagcttatcagaaagaggaggagcccgcccatgagacggaagattcataa

SEQ ID NO: 936 - DNA, 2643 bp, Oscillibacter sp.
atgatcccccgccgggaacccagacagcagaaaagcaccaaacgaacgggacacaaggtcgtcttcatcctggggacggtcctgctggtgggcatctgcacagtggcgatgcttgccgggctttttatgatgtacgtccggaccacactggcccctacgctggaggtcaacgccgacgactacaccatgaatctcagctccatcatctattaccaggacagggacaccggagattgggtggaataccagaccgtctacggcacggaaaaccgcatctgggtggactatgaacagatcccggacgcgctgtggcaggcggccgtagccattgaggaccaccgattctttgagcacaacggcgtggactggacccgaaccgcctccgccacgctgaacttcttcaccggcagccgggccaccttcggcggctccaccctgacgcagcaggtgctgaagaacatgaccggcgacgacggcaacaccatcaaccgcaaggtgcgggagattttccgggccctggagttcgagaagaactacaccaagcaggagatcctggagatgtacctgaacaccatctatctgggacagggctgctacggcgtccagaccgcgtcggagttctacttcggcaaggatgtgtcggagctggatccggcggaatgcgcctgcctcatcgccatcaccaacaacccctccctgtatggtcccatgtccaccatcaccatcacccgggaggacggcagcaccgtcacgccccgggagctgaacaaggagcgccaggagatgatcctgacccggatggccggcggcaatgacgatgtgggcgtcaccgggctcacctatctgacagaggaggaggccgaggccgccaaggcggaggagctgcatttcacggacggcaccacttccgctcaggacattgtcacagaggctaccggcggcgccaatgtcaactcctggttcgtggaccaggtgctgcgggatgtctccgcggatctggcggacctgtacggcatcaccgaaaaagaggccctgaaccggatctacaacagcggctacaacatctacaccacgctggacccgaagattcaggagattgcggagtctgtctacgaggaccgggggagtctgaacaacctcacctccgccagcggacagctgatccactccggcattaccattatcgagccctccaccggcaacatcgtggccatggtgggcgatatgggacccaagtccggaaacctgctgtggaactatgcaacggatatccagcagccgggttcctccatcaagccgctgacggcttacgccccggcgctggatgcgggggcagtctccccggcaaccacctttgacaactatccggtccgcctgctgaatgggaatccatggcccaagaactcgcccaacacctacacgggctggacatccgtgcgcaacggtgtcaaggcatccatcaacaccatcgcggtgcagacactggaaaaggttggggtcacggcggcctaccaatttgccaccgaaaatctggggctgagtctggcaccggaggatatgaacgtcagcccgctggggctgggcggcctgacttacggcctcagcacggtagagatggcggcggcctacgctgctttcgccaacagcggtgtgtacaatgagcccaagacctacgtaaaggttctggccaacgacaactccaccgtggtgctggaaaaggagacggagcagcgggtggccatgaaggagaccaccgcctatctgatgacggacatgctgcgccgggcggtgaatgagtccggcggcaccggcggcggcgctcgattcagcgggatgcacattgcaggaaaaaccggcaccaccaacgacaactatgaccgttattttacaggctacacgccgtattactgcgcggcggtctgggtgggctacaagaacaacgagcggatcagctactccgtgaacccggcggcctccctgtggcgacaggtgatggagaaggtccatgcggatctgctggacaagtccttcaaccgtcccagcagcggcctgacaacggtcagtgtctgcgcggacagcggtatgctggcgacggatgcctgccgcgccgattccagaggggaccggacggtatcctatgaggtggctgtgggcacggagcccacgacggagtgcacgctccacaagatggtggacatctgcaccgagggtaactgcttggccggtgagttctgcccggcggagtccatcgtgcagaagggctatctggactatgtgcgggaggattacggcgagagcatcactgcctccgacgacgcctatctcatcagcaccctggaaaaggcggtggcccccacggagaccagccccggcggatgtcccgtccacacgtcggctgcagttacggaccccgatgacccgaatggggggctggatcccagcgatcccaactggcagccgcctgatcccaacgaccctgatgtgcccatagatccggatacgccgacagaggacccctccggcggcgattccggcggcggagaccagcctacggagccggatcccaacgatcccagcggcggctttggagacgccggcggcgattggtggagcggtttctggggagacaacacaggaacatga

SEQ ID NO: 937 - DNA, 2445 bp, Oscillibacter sp.
atgccacggacttctcaaaagacaattgcagcaaagcctaaaaccaatacacgcctgtctaaaaagccgccgttgacgccggcgcagctgaaacaggtcgacgcctggtggcgggcgtccaactacctctccgcctgccagctgtatctgttggacaatcccctgctgaagcgcccactggccgcctccgacctgaagcagaccatcgtgggccactggggcaccgtgccggggcagaacttcatctacacccacctgaaccgggtcattcagaaggacgatctggacatgatctacctctccggccccggccacggcggcaacgccatggtggcccaggactggctggacggcacctatacggaggtctatcccaacattacccaggatgaggacggcatgcggaaactgttcaagcagttctccttccccggcggcgtgcccagccacgtggcgccggagacacctggctccatcaacgagggcggcgagcttgggtattctctggcccacgccttcggcgctgtggcggataacccggatctcatcgccgcctgcgtggtgggcgatggtgaggcggagaccgggcccctggccacatcttggcactccaacaaattcctgaaccccatcactgacggcgcggtgctgcccatcctgcacttgaacggcttcaagatcgccaaccccaccatcttctcccggatctcccatgaggaggtggagcagttcttccgcggctgcggctgggaaccccgctttgtggagggcagtgagccggagaagatgcaccagcagatggctgccaccctggactgggccatccgggagatcaagcgcatccagcagcacgcccgcaccacgggagacaccacccgcccccgctggcccatgatcgtgttccgctcccccaagggctggaccggccccaaggaggtggacggaaaccccgtggaggactgcttccgggcccaccaggtacccatctccatgggccctgacacggaaaagcacctgcccatcctggagcagtggctccgcagctatcacccggaggagctgttcgacgaggagggacggccggtggatctgctgcgctccttcgcccccaagggggaccggcgcatgggtgccaaccctcacgccaacggcggcctgctgctgcgggacctgcggacgccggacttccgggactacggggtggaggttcccgcccccggcgaggtggaggcccaggacatgctggtgctgggcggctacgtccgggatgtgatgaagctgaacctggaatcccggaatttccgcatcttcgccccggacgagacggcctccaaccggctccatccggtgtttgaggtcaccggccgccgcttcctgggggagcggtacgagaatgaggacccggatgagcacctggacccggacggtcgggtgatggactccatgctgtccgagcacatgtgcgagggctggctggagggctacctgctcaccggccgccacggcttcttcaacagctacgaggcattcatccgcatcgtggactccatgttcgcccagcatgccaagtggctgaagacctgcaacgagctgccctggcggcaggatatcgcctctttgaactatatcctctcctccaatgtgtggcagcaggaccataacggcttcacccaccaggaccccggcttcctggaccacgtggcaaacaagaaggcggacgtggtgcgcatctatttgcccccggacgccaactgcctgctgagcgtgttcgaccactgcatcaagagccggaactatgtaaacgtcatggtggccagcaagcatccccgcccccagtggctcaccatggaccaggcggtgaagcactgcacccagggcatcggtatctgggactgggcctccaacgaccagggggaggagccggacgtggtcatggcctgctgcggcgacacgcccactctggagacgctggcggcggtgacgatcctgcggaaggagctgccagagctgaagatccgggtggtgaacgtggtggatctgatgaagctccagccccacacggagcatccccacggcctcacggacatggagtacgatatgctcttcacccaggacaggcccatcatcttcgcctaccacggataccccacgctgattcatgagctgacctaccgccggcacaacaagcatcttcacgtccgtggctacaaggaggagggcaccatcaccacgcccttcgacatgcgggtcctcaacgatatcgaccggttccatctggtgatcgacgtggtccagcggctgcactccctgggtaaccggggggcctatctggtccagcggatgaacgacaagctggtggagcaccgccagtatatcaaggatcacggcgtggacctgccggagatccgggagtggaagtggaacaacggcaagggaattgaatga

SEQ ID NO: 938 - DNA, 2397 bp, Oscillibacter sp.
atgtatcaggtcgtcaagcgggatggaaagatcgcctctttcgacatctccaagatcagcaccgccatcaccaaggcctttgaggccacccacatggagtacaatccggacatcattgatctcctggccctgagggtcacggcggattaccaggataagatccatgacggcaagatcaccgtggaagacattcaggacagcgtggaggacattctcagcaaggcaggctatgccgacgtggccaaggcctacattctctaccgcaagcagcgggagaagatccgcaacctgaactccaccatgctggactacaaggagctggtggacaactacctgcatatcaacgactggcgggtgaaggagaactccaccgtcacctactccgtgggcggcctgatcctctccaactccggcgccatcaccgccaactactggctctctgaaatctatgaccaggagattgccgacgcccacaagagcggcgccatccacctccacgacctctccatgctcaccggctactgcgccggctggagtttgaagcagctgatccagcagggcctgggtatcccgggcaagatcaactccaccccggccagccacctctccactctctgcaaccagatggtgaacttcctgggcatcatgcagaacgagtgggccggtgcccaggcgttcagctcctttgacacctatctggccccctttgtgaaagtggacaacctctcccagaaagaggttaaacagtgtatccagtcctttgtgttcggcgtgaacactccctcccgctggggtacccaggcgccgttctccaacatcaccctggactggaccgtgccccgtgacctggagaacctgccggccatcgtaggcggcaaggagcaggatttcacttacggcgactgcaagaaggaaatggatatggtgaacaaggcgttcatcgagatcatgaccgagggcgacgccgacggccggggcttccagtatcccatccccacctattccatcacgcgcgactttgactggtccgacacggagaacaaccgcctcctgttcgagatgaccgccaagtacggcaccccctatttctccaactacatcaactctgacatggagccttctgacgtgcgcagcatgtgctgccgcctgcggctggatctgcgggagctgcggaagaagtccggcggctacttcggctccggcgagtccaccgggtccgtgggcgtggtgactatcaatctgccccggatcgcctacctctcccagacgccggaggagttctatgagcggctggaccacatgatggacatcgccgcccggagcctgaaggtgaagcgcaccgtcatcaccaagctgatggatgcgggattgtacccctacaccaaatactacctgggcacctttgataaccacttctccaccatcggcctcatcggcatgaacgaggtgggcctgaacgccaagtggctgcggaaggacctgacccatccggagacccaggcctttgccaaggacgtgctgaaccacatgcgggagcggctgatggactatcaggagcagtacggcgacctctacaacctggaggccacccccgccgagtccaccacctaccggctggccaagcatgacgtggcactgtatcccgatatcatcaccgctgccaagaaccccggtgacacgccttattacaccaactcctcccacctgccggtgggctacaccaacgacatcttcgaggccctggccatccaggatgacctgcagaccctgtacacctccggcactgtgttccacgcctttttgggtgagaagctgccggactggaaggcggctgccaatttggtgcggaagatcgcggagaatttcaagctcccctactacaccatgtcccccacctactccatctgtccggaccacggctatctctcgggcgagcactttacctgccccaagtgtgggaagacctgcgaggtgtggagccgcatcaccggctattaccgccctgtccagaactggaacgacggcaaggtccaggagttcaaggaccggcaggagtaccaggtggaaaactcccggctggagggccgccgcctctgcgaccgggatgctgcgacggagcccgcagccggcaccgcgcccagcacaccggcggagcggggcgaggacggcctgttcctcttcaccaccaagacctgccccaactgcagcatcgccaagcgggagctggagaaggcgggcatcgcctatcaggtgatggacgtgaacgagcatcgggagctggtggcccggtacggtatccagcaggcccccaccctgatcgtccgccacggagagcaggtggagaagctggtgaacgcctccaccatcaaaaaattcgctacttcgcagagcgtgtaa

SEQ ID NO: 939 - DNA, 2541 bp, Oscillibacter sp.
atgcctttgcgggccggcgagggcgccggcccctacaaaaaggagatacgatacatgagcaaaaagccccaatacgatcctgaggagatccggtaccccgaacagaagatcgtggagtcaccgctggtccccgagatggagaaatcctacattgagtacgccatgagcgtcatcgtgggccgggctctccctgacgtgcgggatggcctgaagcccgtccatcgccggatcctctacgccatgtacgaggatggcctcacggtggacaaacccttcaaaaagtccgccacctgcgtgggcgacgtgctgggccggtaccatccccacggcgacgccagcgtctatgacgctctggtccgcctggctcaggatttctccatgcgctatcccctggtggacggccacggcaacttcgggtccgtggatggcgatcccccggcggcctaccggtacacggaggcccggatgtcccggctctccgacgagatgctgcgggatattgaaaaggacactgtggactgggaccccaacttcgacgagacccgcaaggagccccgtgtcctgccctcccggtttcccaatctgctggtgaacggctccagcggcatcgcggtgggcatggccaccaatatcccgccccacaacctgcgggaggtgatcggcgcctgcatctgcgtgctggacaatccggaggctcagctcagtgatctgatgcagtacgtcaaggggccggacttccccacccggggcatcatcatgggtcgcagcggcatccggcaggcctatgccaccggccggggccgggtggtgatccgggcccggcatgagtttgaggagttcggcaaggaccgcacgcgcattgtcatcaccgagatcccctaccaggtcaacaagcgtatgctcatcaagagcatggccgaccaggtggaagacaagcgtctggacggcatctccgacatccgggacgagtccgaccgggacggaatgcgcatcgtcatcgagctgaagcgggacgccaacccccaggtggtgctgaaccgcctgttcgcccagacccagctgcagaccagctttgccatcaacatgctggccctggtgaataaccagtctcagcccaagatcctctccctgcgccacatcattgacgagtatctggccttccaggaggaggtcattatccgccgaaccaagtacgacctgcgcaaggcccaggagcgggcccacctgctggagggtctgctggtggctcaggacaacatcgacgaggttatcaaaatcatccgcagcagctacgacaacgccaaggagaacctgatgtcccgcttcggtctggacgatgtccaggcccaggccattctggatatgcggctgaaagcccttcagggcctggaccgggagaagctggaggcggagtacaaggagctggaggaaaagatcgcctacttcaaccagctgctctcctccggcgagctgctgcgcaaggtgctgaaggaggaactccaggccatctccgacaaattcggcgatgaccgggtcacggagatccaggatgtggaggatgagatcgacatcgaggacctgatcgaggaggagcagtgtgtcttcaccctgacccaggcgggctacatcaagcggacacctgccagcgagtacaccgcccagtccaagggcggcatgggcaagaagggcatcaccacccgggaggaggactacgtggtggatgtgtttactgcctccacccacgactatatcctcttcttcaccgacaccggcaaggtctaccggaagaaggggtatcaaatccccgagtccggcaaggctgccaaggggaccaacatcgtcaacatccttcaggtggagcagggcgagcggatccaagccatgatccatacccggtccattgaggacgacggccgcttcctcttcatggttacccggaacggcacggtgaagcgcctgccggccaatactctgaagaatctgcggaacaacggcatccgtgccctgcggatggaggagggtgaccagctgatcgctgtccgggagactgacggcagccagaagatcctcatcgccacccatgacggtatggcagtctgctttgacgagaacgatgtgcggcccatgggccgggacgccgtgggtgtgcggggtatccgcctgcgccagggcgactacgtggtgggcgccgcccgtgccaaggccaatcatgcggtgctggccatcacggaaaacggctacggcaagcagacgccggtggaggactatcggatcaccaaccggggcggcctcggcatcaagaactacatggtgacggacaagaccggccccgtggtgggcatcaaggtggtggacggcacggaggacctgttgctggtgacccaggcaggcattctgatccgcaccccggtggacagcatccgcaccgcgggccgggccactcagggcgtcatcgtcatgcggttcaaggaggagggggatcacgtgatctccctggcgctcacagaccatgaggagggcagcgccgaggccgaggaataa

SEQ ID NO: 940 - DNA, 1848 bp, Oscillibacter sp.
atgccattttcatttgacttcggaggctttgaccccagtgctttcggcggtttcagcggcggggacgcctcccagccccagcgtcccaagcgggagcggaagccccgcaaggccattggcaacgccttcacgcggacgctcatcaatctgggcgtgacgctgctgttcggcctggggtacttttacttcgagctgcccgccctgaacttccacgcggaggagttctatgtcttcgtgttcctgctgtgcgcggtgtactgcgtgtgcgccgtgctcacctccggctttcagggggagggcgtgaaggggtacttcggctttgtgaaaaagcagtgcaccatccccttcctggtcctggtggctctgatcgccgccatcatcatcggcggccttacctcttgggtggtaatccgggccggaagctacagcaagctgctttccatcaaagatggtgattttgcttccgaggtggaggagatctcctacaatcagatccccatgctggacgaagactccgccgcgcgcctgggcagccgcaaactgggcgaactggcggatatggtctcccagtttgagatcctgccctcctacacccagatcaactaccagggtcgcccggtgcgcgtgacttccctggcctatggagatctggtcaagtggttcaccaaccgctccgcgggcctgcccgcttatctgattatcgacatggtgacccaggaggcggaagtggtccgcctggacgaggggatgaaatataccaccgccgagcatttcgggcggtatctgccccgccacctgcggttccactatcccacatatatgtttgccgatccggtgtttgagatcaatgaagagggcgagccctactgggtctgcccccgcatggtgaagaccatcggcctcttcggcggcgcggacatccagggggccgttctggtgaacgccgttaccggggagagccagtattatgaggaggtccccaactgggtggaccacgtctatgacgcgaatctgattatggagcagtacgattattacggaatgtaccacaacggctttatcaactccattttcggccagcgggatgtgacgcacaccacagaaggctacaattatattgccatcggggatgacgtgtatatgtataccggtgtcacctctgtgacatccgaccagtccaacatcggattcatcctctccaaccagcggaccaaggagacgcacttctattctgtcgccggtgccacagaggcgtccgcgcaggccagcgccatgagtcaggtccagcagatgcgttacgtggccaccttcccgttgctgctgaacatcgccgaccagcccacctacttcatgtccctcaagggtgaagacggtctggtgaagatgtacgccatggtgaacgtccagcagtacaacattgtagagaccggcagcaccgtagcggagtgcgaggccaattaccgccgggcactggccgacagcggcctcatctccgacggggatgcggaggctgttccctctgaccaggaggagatcagcggcgccatcgctgagatccgcaccgctgtgctggacggcaattcctactacttcctgcggctggagggacaggacaccttctacgccgtcaacgccgcggagaaccccctggcggtgatcctgaatgccggggatcaggtgactatcgcctacaccgcaggggagggcggcggcattctctccggcacctccgtcgcccgggccggagagacccccgtgaccttcaccccggaggaggcgccagctgatgcccccgccgaaacgggccagccggcagaagatgctgcctcttccaatcagcccacctga

SEQ ID NO: 941 - DNA, 2631 bp, Oscillibacter sp.
atgagcaaaaaatatgtctatttgttcagcgagggcaacgccaacatgcgggagctgcttggcggcaagggtgccaatctggccgaaatgaccaacattggcctgccggtgccccagggcttcactatcaccaccgaggcctgcacccagtactatgaggacggccagaagatcaacgacgggatccaggcggagatcatggagtatatcaccaagttggagggcatcaccggcaagaagttcggcgatctggagaaccccctgctggtctccgtgcgttccggcgcccgggcctccatgcccggcatgatggacaccatcctgaatctgggtctgaacgaggacgtggtggacgtgctggccaagaagtccggcaacccccgctgggcctgggactgctaccgccgctttatccagatgtactccgacgtggtgatggaagtgggcaagaagtactttgagcagctcatcgaccagatgaaggaggcccgcggcgtcacccaggacgtggagctgactgccgacgacctgaaggagctggccggccagttcaaggccgagtacaagtccaagatcggcgcagacttccccaccgaccccaaggagcagctgatgggcgccatcaaggccgtgttccgctcctgggacaacccccgcgccaacgtgtaccgccgggacaacgacatcccctactcctggggtaccgccgtcaacgtccagtccatggccttcggcaacatgggcgacgactgcggcaccggcgtggccttcacccgcaaccccgccaccggcgagaagaagctgttcggtgagttcctgaccaatgcccagggcgaggacgtggtggccggcatccggactcccatgcccatcagcgaaatgagcgaaaagttccccgaggccttcgcccagtttgagaaggtctgcaagattctagaggatcactatcacgatatgcaggatatggagttcaccgtggagaacggcaagctctacatgctgcagacccgcaacggcaagcgcacccctgccgctgcgctcaagatcgcctgcgacctggtggacgaggggatgatcgacgaaaagcaggccgtggccatgatcgatccccgcaccctggacaccctgctgcatccccagtttgacggcgaggtgctgaagaagacccccgtgatcggcagcgccctggccgcctctcccggcgccgcctgcggcaaggtcgtcttctccgctgaggacgccaaggcctgggccgagcgcggcgagaaggtggtcctggtccggctggagacctctcctgaggatatcgagggcatgaaagctgctcagggcatcctgactgtgcggggcggcatgacctcccacgcggccgtggtggcccgcggcatgggcaagtgctgcgtctccggctgcggcgccatcaagatggacgaggagaataagcagtttgagctctccggcaagaccttccacgaaggcgactggctgtccatcgacggttccaccggcaagatctacgacggcgccatccccacggtggacgcctctatcggcggcgagttcggccgggtcatgggctgggccgaccagtaccgccgcctgaaggtccgcaccaatgcggacaccccccacgacgccgcccaggcccggaagttcggcgctgagggcatcggcctgtgccggaccgagcacatgttctttgacgcagaccgcattcccgccatccgccgaatgatctgctccgacaccgtggagcagcgtgaggccgctctggctgttctggagcctatgcagcagtccgacttcgagggcatctatgaggccatggagggcctgcctgtcaccatccgtttcctggatcccccgctgcacgagttcgtgcccactgaggaggccgacatcgagctgctggccaaggacatgggcaagagcgttgcggagatcaaggccatcatcgccggcctgcacgagttcaaccccatgatgggtcaccggggctgccgtctggcggtcacctatccggagatcgccgccatgcagacccgcgccgtcatcaaggctgcgctgaacgtccaggccaagcatcccgagtggaccatggtgcctgagatcatgatccccctggtgggcgaggtcaaggagctggcatacgtgaagaaggtcgtggtggagaccgccgatgccatcatcaaggaggccggctccaacatgaagtacctggtgggcaccatgatcgagatcccccgggccgcgctgaccgccgatgagatcgccaagcaggcggacttcttctccttcggcaccaacgacctgactcagatgaccttcggcttcagccgtgatgacgcgggcaagttcctggacgcctattacgacaagaagatctacgagaacgatcccttcgccaagctggaccagaccggcgtgggcaagctggtggatatggcctgcaagatgggccgcgccaccaaccccgagctgcatctgggcgtgtgcggcgagcacggcggcgacccctccagtgtggagttcttccaccggacgggcctggattatgtgtcctgctctcccttccgggtgcccatcgcccggctggctgcggcacaggctgccatcaaggacgagaagtaa

SEQ ID NO: 942 - DNA, 2133 bp, Oscillibacter sp.
gggagactttcttcaaaatcagatgaaattttagagaagaaaaagaaaaaagttcgcaaaaaattcatggaattgcagagggaaaggcgctataataaaaaatctatgaaaagaaagaaggtcattccgatgcaacagacattgccgccggcggccgcggatgccgaacggcatcgacaggaacgctctgcgttcctgtatcttccgctgctggctttagcggtcaccgtcgtggtggagctgttcaatcacaagagcttcacagatgggcccgccggcttttggcgctttatgacggaggaaccgctggcatttctggtgaatttcctgattgtactgctgacgctctgccccgccttttttctgcggcggcgggcgttctggtgcgcattggtgtccttcttgtggctgatctgcggcggcgtgaacgggttcatcctcctcaaccgtatgacgcccttcaccgtggcggatctgacggtgtttgaaacggggctggacacggtccccaactatctctccaccggctacatcattctgctgatcgcggcgctggtgctggtggccgcagggctggtgctgctgttctggaaggggccccgcagcagctgtccgctgcggacccggattctcaccggcatcggagcgatggcggtctccggcgccctgatgggcggcggatgcgccctggcctttttcacaggcaacctgtcagaccagtttgccaacctggcctttgcctacgaggactacggcttttcctactgcttcctgcagacctggctgaaccgggggatccgccgcccggccaattacagccagaaggcggtggcggatattgtccggtcggtggaggagaagacggcggcgctctccgccgatccgcagacggatgtgaatgtgatcttcatccagctggagtcctatattgatccatccatgatccagggcctggagctgtcggaggatccggtgcccaactggacggcgctgaaggaagcgtattcctccggctatctgacggtgccggtggtgggcgcgggcacagccaatacagagttcgaggtgcttaccggtatgagcagccggttcttcggacccggggagtaccccttccagacctgcctgaaggatcagaccgtggagtctgtggcctacgacctgaaggaaaacggctacgcgacccatgccatccacaatcaccgggcggccttttacagccggaacgaggtctatcccaatctgggctttgatgattttaccgccctggagtatatgcctgcggtggagaagacgcccaccaactgggctaaggacggcgtgctgaaggaccagatcctccaggcgctggatgtgacggaggaccaggcggatctggtgttcacggtctctgtgcagggccacggcaaataccccatggagccggagctggaggacccggccgtcacggtggaagcgtgccccgatgaggcgtaccgctgggctttggagtattatgtgaaccagattcatgagatggacgcctttgtgggggatctgatccaggagctggaggcccgggacgagcggacggtgctggtgctctacggcgaccacctgccggcgctggggctggaggccgagaacatggagagcagcagcctctaccgcacagagtacatcatctgggacaactttgggctggaacagcaggacgagcccctggcggcctatcagctctccgccactgtgctgggccgcctgggcatcaccaccgggctgatgaccgccttccagcagacctgccgggaggagcctacataccgggcggacctgcggatgctgcaatatgacgccctctatggaaaaggatactgctatgagggcgaggcccgctacagacccacggagatggagatgggcatggtgcccatcgagatcaccggtatggagcagcgggcgggggactggttcatcctgggagagaattttacaccttactgtgtggtgacacagaatgggcagctgctggatacggagtatgaggccccctggctgctgcgggtgacggaggagccgaacaccgcggattaccgggacttggagatcagcgtggtggataagcacaatgaggttttaagcaatacggaataa

SEQ ID NO: 943 - DNA, 1839 bp, Oscillibacter sp.
atgtgcggaatcatcggatttgtaggaaacgagcccgcggcccctattctgctggacggcctggagcggatggagtaccgggggtatgactccgccggcgtggcggtgcggtccgagacggcgggactccaggtgcgcaagaccaaggggcggcttcaggtcttatccgacctgatccacggcggcgcggacctggaggggaacctgggcatcgggcatacccgctgggccacccacggggagcccaatgacatcaacgcccatccccacgtcagcgagaacgggcggatcgccctcgtccacaacggcatcatcgaaaactatctggaaatcaaggagcacctcatgcgccagggcgtccacttcacctccgacacggacacggaggtggtggcccagctgctggagttccactacaacgaatgccacaacatgctggaggctgtgggccgctgcctgcggcggatcgaggggtcctacgccttcggcatcatctgtgcggattaccccaacgccctcattgccgcccggaaggacagccccctcatcatcggctacggtcagaacggcaacttcatcgcctccgacgtgacggctgtcatcaagtacacccgggacgtggtgtacatggacgatggggagatcgctgtcctcaccgccgacagcgtggacgtgtttgacgacgagctgctgccggtggagaagacccacagtctggtggactgggatgtgtccgcagcggagaagggcggctacgcccacttcatggccaaggagatcatggagcagccggaggcggtccgcaagaccatctccccccgcatccgggacggccgtgtggtgctggacaatctgcatctgacggcggagtacgtccgcgacctctcccggatttacgtcatcgcctgcggctccagctaccatgtgggcgtggtgagcaagtacagctgggaaaagctgctgcgccgcccggtggaggtggtgctggcctccgagttccggtactgtgatcctctggtggacgaaaagactctggtcatcgtcatcagccagtctggagaaaccctggacactatggccgccatgcgggaggccaagcgccggggcggccggaccctggccatcgtcaatgtggtgggcagctccatcgcccgggaggcggatgacgtgctgtacacttgggccgggccggagatcgccgtggccaccaccaaggcatacaccacccagctggtgctgatggatctggtgggcctctatctggcggacctgctgggtacggtggaacagagcgagtatgacaccattctctccgagatgcagctgctgccggagaagatgcgccagttcctctcccacacggaggacatccagtattacgcctcccggtacttcaaccacgactccatcttcttcatcggccggaacctggactacgccatgggcctggagggttccctgaagctgaaagagatcagctatatccactcggaggcctacgcctccggcgagctgaaacacggcaccatctccctgatcgagccggggaccctggtggtggccctgggaacctacgcgcctctctttgacaaagccatgagcaacgtggtggaggtgaaggcccggggggccgaggtgctggccctgaccaccgaggacttccgggaaaagatggagaagactgccgacgccactgtctctgtgccggtgacccatcccatgctccagccctctctgggcgtggtgcccctgcagctgttcgcctactatgtggcgctccagcggggctgtgacatcgacaagccccggaacctcgccaagagcgtgactgtggaataa

SEQ ID NO: 944 - DNA, 3270 bp, Oscillibacter sp.
gtgttctttcagcgagcccaatctccgcacccgtcccgcctgggtggcatccagattttttccgattcagaggggagattccttttgtttccggtgatccgcagccggagcgggccttcgcacattcttgcagcggtaaagaccctgtccccgccgctgacggctccggagctggggacggcactgctggctctgtgggatcgatgggagggcactccctgctgggaggaactgccgccggagctgacggcggttcccttctggaagggaaccgcccggtcttatcgggctttctttcgggcgcaccggttgattgtcgcggcgttcggacatccgaacccgggagacatctccttggcttactggccccggcatctggagaacaacatctggggcgtggtcaagggacaggtggagctgcaggtacggctggacagggaactgccggatctgccccggaagatcggcatggcggcccggcagctgctggccgcggcggagctgacggatcccaccatgccggcgactggaaataacaggcggtattgcttttatttatcatatattattgagaataaaaagatatttttaggaggaagaacatttatggcacatcccacatacggactgaacgagctgcgggagatgtttctcaaattctttgagacaaaagaacacctgcggctgcccagcttttccctgattccccagaacgacgccagcctgctgctgatcaactccggcatggcgcccatgaagccctggttcaccggggaggaggagcccccccgccaccgggtctgcacctgccagaagtgcatccgcaccggcgacatcgagaacatcggcaagaccgcccgccacggcacctacttcgagatgctgggcaacttctccttcggagactacttcaagcgggacgcgatccactgggcctgggagttcctgacctctcccgaatgggtgggtctggagccggaccggctgtatccctccgtgttcgccggcaacgagaccacccccgccgacgatgaggccttcgccatctggcgggacgaaatcggcatccccgaggatcggatcttcaagttcggcaaggaggacaacttctgggagcacggctccggcccctgcggcccctgctccgagatctactatgaccggggccctgagtggggctgcggaaagcccggctgcaccgtgggctgcgactgcgaccggtatatcgaggtctggaacgtggtgttctcccagttcgacaacgacggagagggccactacaccgagctgaagcagaagaacatcgacactggcatgggcctggagcgtttggcctgcgtcagccagaacgtggccagtctgttcgacgtggacaccgtcatgaacatcaccaacaaggtcagcgagatcaccggcgccaagtacgagcagagcgacaagatcgacgtctccctgcgggtcatcaccgaccatatccgctccgccaccttcatgatctgtgacggtgttctgcccagcaacgagggccggggctatgtgctgcgccgcctgctgcgccgggccgcccggcacggcaagctgctgggagtgaaccatcccttcttatatgaggtgtgcgacaccgtggtccatgagaacgagggccactatcccgagctgcgggagcggcaagcctatatcaccaaggtcatccgcacggaggaggagaacttcgccaagaccctggacgccggcatgaagatctatgacgatatgctctccgcccacaaggcccagggggagaccgtgttctccggcgctgacgccttcaagctgtacgacacctacggcttccccatcgacctgaccgtggagatggcggaggaggccggcatgaccgtggaccaggagggcttcaaggctctgatggaagagcagaaggtccgcgcccgcaaggcccgggaggccctgggcgacctgggctgggcaggcatcgagttcggcaaggacatgcccgccacggagttcgtaggctatgatcgctccagcgagcagggcagagtcctggccctggtggccgacggggaactgcgggacgagctggctcagggcgtggagggcatcctggtgctggaccagacgccgttctatgccgagatgggcggccaggtgggagaccacggcaccattcagggacccaacggcaccttccaggtgacggatgttcagaagaacaagggcggcaagttcatgcactccggcaaggtggtctccggcaccctcagcgtgggggagaccgtcaccgcatccatcgacatggagcgccggaaggccatcatgcgggctcacagcgccacgcatctgctggacgctgccctgaagaaggtcctgggcgaccatgtgcatcaggcgggctccctggtggagccggaccggctgcgctttgactttacgcactttgaggctatcaccccggagcagctggctcagatcgacaagctggtgaacgacgccatcctggagggctaccccgtagcgacggaggtgctgcccatcgaggaggccaaaaagaagggcgccgtggccatgttcggtgagaagtacggcgatatcgtccgcgtggtggagatgggcgacttctccatggagttctgcggcggcacccatctggacaacaccgccaaggccggtcccttccgcatcaagtccgagggctccgtcgcctcgggcgtccgccggatcgaggccacggtgggccgactgagcctggacaccatgaaccggaatcaggagctgctgttccacgccgctcaagtgctgaagacaacacctggtgagctggccgccaaggcggagcagcaggcagcggagatgaaggagctgcgccatgagctggagaagttcaagtccgaggcgtccctgggcgaggcccggcaattcctgaccgccgccaagaacgtgggcggcctgaaggtcctgaccgctatccgtaacggcatggatgcgaacgccctgcggcagatgggcgatttcctgcgggacaaggccccggatgttgtggcagtgctggcttctgccaatggggagaagatcaccttcctggcagtctgcggtcccgaggcggtgaagcgcggcatcaaggccggcgacctggtgaagagtgtctgcgccatctgcggcggcaagggcggcggcaagcctgatagcgccatgggcggcggcagtgacctgctgaagctggatgatgcactggccaccgtggatgattttgtggcggaaaagctgaagtaa

SEQ ID NO: 945 - DNA, 1938 bp, Oscillibacter sp.
atgagagacggttttatctccgtggccgcaggcacccccaaaatccgggtggcggactgccgctataacgcggaacaaatttttaccctgatgcgggaggcggacaagcagggggtgaaggtgctggctcttccggaactgtgcctcaccggctacacctgcggagatctgttcctgcaggacacgctgctccggggcgccgaggagggccttcagaccatcctggaggctacaagaaatctggagatcgtgacggcccttggcctgcccgtgtgggacaaatgggacaacaaattgtataactgtgcggctattatacaaaaaggagagattttggggctgattcccaaggtctatctgcccaattatggggagttttatgagcagcggtggtttgcatccggcagcggcgtggagcacgggattgagctgtgcgggcagcatgtgagtctctgtacgaaccagacctttgcctgcgacaccatgcccaacttggtgatcggcgtggagatctgcgaggatctgtgggccccggcgccgccctccgtggagctggcccggaagggcgccaccgtgattctgaacctctccgcatccaatgagctggtgggcaaggcggactaccgccgctccctagtgacaggccagtccgcccggctgatgtgcggttatgtgtacgcggatgccggagagggagagtccaccaccgatgtggtgttcaccggccacaatatgatcgcggaaaacggtaccctgctggcggagcggcggttcgccaccggactcaccgtcagcgagatcgatgtggaccggctgatccatgaccgccgccggaccaacaccttcaccttcggcaaggagccgccggagatctggcggtgcggcttcacgctgccggtggaggagacccggctcacccggtacgtctccccatctcctttcgtgccggaggatgccgcgggccgggcggagcggtgtgaggagatcctgcggatcgcctccctgggtctgaagaagcggctggagcacaccggcgccaagacggcggtggtgggcctctccggcgggctggactccaccctggccctgctgatcacggccctggccatggggatgctgaaccggcccgccagcgacatcgtggccgtcaccatgccctgcttcggcaccactgcccggacgaagtccaacgcggagctgctggcggagcggatgggtgccacgctgaagatcattgacatctcccaggcggtgcggcgacattttaccgacatcggacagaacatggagaaccatgacgtcacctttgaaaacggccaggcccgggagcggacccaggtcctgatggacattgcaaaccagaccggcggcctggtgatcggcacgggagatctcagtgagttggccctgggctggtgcacctacaatggcgaccacatgagcaactacgccgtcaactgctccatccccaagaccctggtgcggcatctggtggcctatctggcccgggacaacgcggagaaggacgaggccctccatgacgtgctggaggatattctggacacccctgtctccccggagctgctgcccgctgtccaaggggagatcagccagcggaccgaggatctggtggggccctatgagctacacgacttcttcctgtactacatgctccgctggggcttcccgccccggaagatctaccgtctggcgctgtatgccctggggaagacctacaccccggatgtgatcctgaagtggctgaagaccttctaccgccgcttcttctctcagcagttcaagcgcagctgtctgccggacggccccaaggtaggctctgcggcactctccccccgcggcgactggcggatgccgagcgatgcttccgcggcactgtggcaggcagaactggagacactggagtcagtgcatttttaa

SEQ ID NO: 946 - DNA, 2271 bp, Oscillibacter sp.
atgtttcaacaggcgggaacggcacaactgaatgattatttccgcccgctctcggaacggggcgggtcccgcgtgtttttctgccggatcgccgggtacggggagacggtggccgcttttctgcgccgctactatgaggcggcccgccggtccggcgtcatcatcgacgggcgcatccccaaccccacgcccgacaacctgtcctatttcaatgagatgatggggtccggtttccagatggaccgggattttctctcccagcggctgaaaaaatggctgccccggatgacggacgggcagcgggacgctgtggtgacggccatgtatgccaccctggacgatatgcgccgggcgggcaaaaacgacaatatgctccgcaatgcctacatgaaatacatgtgctggctctactacaagttcgagcggatcgtcaacgtgctgggcggcgagacgctgcccaagatcctctatgccggggacgtgagccattatgagctgcagctgctgacggtcctctcccgggcgggggcggatatcgtcctgctggagtgcggcggcgaccaggcatatctcaccgtggacccccagtcggccctgtcgcacctgtatcaggcccctggcctggggtccttcccggcgggcttcggtgtcaagcagcttcaggcggagctggagcgggaggtgcgccgccagcggctctacggcacgccgccctccctctctccctgcaccaacgcctgggtgcagaaggcagagctgaacgcggcgctgacggctgtgcaggcccgcggaaacgatccccgctttttctgcaacctcttcctctgccagtacggcgtggaggacaatctcacctataccaacgacctcttcgcgttttatcagtccctccagggcggcggccgccggatctgcgtggtcaacggagaccccgcgccccccgggccggaggagatcgccgcggtcaagcggggcaactacgcctccgcagagcagctggcggcgggtctcgccgccaacatccggtatccggccaatgtggagctccagcgcctgatgacccgagctttcatcgatctggtgctggaggagggggagcggtgcggcggcagcgtctccaagctcaccagccgggcggtgtacctcctgtgctggctgaaccggtatcagaaggacctctttccggactggaaggcgccggaggtggcggtctttctccagtttggcagatgcgcgtcggacaccggagccctgttcctgcggctgctggcccgcctgccggtggatgtcctgttgctgctccccaatctgaatgagggcagcgccctccacaccccggatctgctggaggtccactgtccccaatccgtctctctggaccgcttcccggtggaccagaaccaggcccgggtcaccaccgccgcctatcaggcggagcgggatctggaccggctgatgtaccaggatacgggactgtatcggaaccagcagtacgccaaggcctccacggtcctgctgcagaccatgtacgaggaaatcccgattctgtgggaccaggagatgaaataccgtcccagcttttccgccgcgggggacaccgtcaccctgccggtgatctgccagaagatctgcggcgtgaaggacggcaacgcctcccagtactggctggacatcaagaagctcatcacgccggacacggaggtggtccggtctgtcccctgggtccagggcacggatcccaaccccgtgaagccgtacgccacgcagtttttgaagaacggcaagctgctgcgcggcaagatcaagtcccacagcgcctatctctacggcatcctgcgggcggagatgcaggagcacctgttggacaaattgcagctgctgctggaccagaagctgatccgcggcacctttgagaacggcacggagtacacggtgatcgccaccgccctgaatctccccaaggacctgctgcggaagatccagaagttcgacttcaccaagaagaaccccaagctcatctacatcaaccccacagaggagaggatctctctggaggacagcatcctcaccgcgtttctaagcctggttggcttcgacgtgctattcttcgtccccaccggctaccagtgcatcgagcagcacttcacgcgcccctttgccagcgagacgcagatcggggactatctttacgacctgcggattcctgatttcaacaccgtgcaggaaagcggactgcactccatcagaaaactatttggaaggagtatatga

SEQ ID NO: 947 - DNA, 3396 bp, Oscillibacter sp.
atgagacggaagattcataaatgcctgagcttccttctggcggcggtgctgctggcgtccctggcggcgcctgctgccctggccgccgaaggcggggacacggttttcgtccgcacggcggaggacctggtccaactggcagagaactgcaccctggacagctggtcccagggaagaattgtccgcctgcaggcggatatcgacctgtccggcacggacttcacccccatccccacctttggggggacctttgaggggcagggccacaccatttccggtctgtccatcacgggcagcggcaatgtccggggactgttccggtacatacagccctccggcgtagtgcgggatctgtcggtggagggacgggtcgatccctctgaccggaagaataccctgggcggcattgccggcagcaaccggggccttcttgccggctgcaccttccacgggacggtgcggggagcggacagcataggcggtcttgtggggatcaacgagagctcgggacagatcgtcaactgcactttctccggagccgtcacgggagagcattatgccgggggcatcgccgggcagaactacggcgccgttatccagtgccggaacagcggcagcatcaacaccacggaggtggatgcggagctggatctggacgccatcaaccgggaacagctgaacgcggcggaaaacgtgccggtatgcaccgatatcggcggcgtcgccgggtattcctctggtatcatccagagctgcaccaattccggcagcgtgggctatgaccacgtgggctacaacatcggcggcatcgtggggcggcagtccggatatctggacggctgtgccaactccggcgacattctgggccggaaggacgtgggcggcgtcgccggtcagctggagccggaagtgcggctgctctatgaccaggggcagatgggggagttgctggatgccctggacggtctgggggatctgctggaccagacgcagcaggatctgcggggcacttccgacgctctgtcggaccggatggacgccatctccgcccggacggacgaggcccgggaggcagtgggcgatctggcggactccgccgcggactggaccaatgagaatatcgaggagctcaacagcctcacggcccggatctcctggctcatcgaccagctggcgccgatcctggatgacgccgtcgatgtgatggacctggtggaggacctggccgacgagcttgggaatgcgctggatgaagtcggcgcggcatcagggctgggagatcaggcggaacaggagctgcgggcggcagtccagtccctccgccgggcggcctccagtggaaaagaggccgttgcccgcctgctgtcggcgctggagcatctgggcgcggccctgggcagcgccctccagagccaggaggccatggaagaggttcgggctgccgccggggacctggcagccgccctcggggacatgtccgacacgctggcagagatcgcccgcattctgtggaacggcggcgacgaagcggcgctgggagaggcggctcaagccctggcggatacactggccagggcgggggatgcgctggaacaggcggcgaacgccgtcgcggcccacatggacagcggcgagctggaagaggccgggaaggacgcggcggccgcatggcaggcactgggagaggcggctcaggccctgcgggccgccgccggacacgccaccgacgcggcagcgctgctggcaaagcttctggcacagggcggagacctggcggaagcgtttcgggacccgggcaggacgttggagaaagtggcttcccgggcatcccgtctcggcgaggacctggccgacgtcttttgggagctggccgaggagcccaccatcaccatccgtcccattgacagtgccattcgggagcagggggacgccctgggggacgtctttgccggtctgctggaggacggcgacgccctgcgggagaccatgtccgcggccacggatacactattggacgatctggaagccatcggagaccagttccgggttatcacggatctgctgcgggatctgctggagcaaactggagaggaattgtcggaccgtttcgaggacatctcggaccaggagaccagtggaccggataccggatgtgtcgccaattcccggaacacagggaccgtggagggagacatcaacgtggccggcatcgtagggtccatggccattgaatacgacttcgaccccgaggatgacctgatcgaagagggagaccgctccctggacttccgctatcagacgaaggccgtggtccgcgcctgcatgaaccggggcggcgtcaccggaaaacgggactatgccggcggcgtggtgggtctcatggacctggggcgggtgagcgcctgcgagaactatggggacatcgccagcacggacggcggttatgtaggcggtatcgccggcgcctcctgggggaccatccgggacagctgggtcaagtgtcatctctccggcggcgattatatcggcggcgtggccggactgggagccaccctggaaaactgccatacgctggtggaaatcgaagagggctccgcctatctgggcgccgtggcgggagatgtggacgccgatgccgccgtatccgacaacacctttaccagtgaacgactgggggctctggatgggatcagctacgccggccatgctgaaccggtggattttgacaccctgtgcaccacgcccggcgtaccggaatccttctcccggctggagctgacctttgtggcggacggcgtggtggtagaggtcgtccccttccagtacggagaggggattgacgccctgccggagattccggcgaaaaagggctgctctgcctcctggccggatctggactacacctgcctcaccgccagccagaccctggaggcggagtataccccctacacctccgccctgacggatggcggggagctgccggagatcctggtggacggcagcttcagcagccgggcacaggtctcccacaccacggaagaggtggcctggacggacggcggcgcggagtatgcgggcaccgcctataccgtgacggtggaggacccggacctggaacaggcggcctacacggtccactgccgcctgccggaccccggcaagcggtacgacctctgggtgctgagtgaggatggctggaccaagacggatgcccggttggacggccagtatctgctgctggagagccagaccgggacggtcaccttctgcctgacggagcgggccggtcctctggcggtcgttattctggccgtcggctttgccgggctgttgatcggcttttgctggctcatccgctggcggcggaaaggcactgcggcaggacgcaaacactga

SEQ ID NO: 948 - DNA, 1977 bp, Oscillibacter sp.
atgcagtcaaagacatcgtactttaacgccacgctgttccgcaagaacctgacccggttctggccgctgtggggcctggcgtcctttgtcggcgctctgttccctctggcggtgctgctggatatggtgcaccggggctggaacgtcctctccgcaccggacttcaccggtatgtactatgatgcggtgagcgccgtgcccgtcatcaatctggtctacgccgccctctgtgccatggcggtgtggagctatctatacaacgcccgcagcgtggggctgatgcacaccctgcctatccggcgggaagggctgttcctcaccaacttcctctccggcctctccatgaccctgattccctacgcggtcaccggggtcctgtgcgtcgtggtctccctgtgcggcggggcctttgacgccaaggggctggccgtcaccgtcctggcagtgctgggtgagagcttcttctacttctccagcgccaccttcgtggccttcatcaccggcaacgcctttaccatgccgccgctgtacgccctgctccacttcctggcggtgctgctggactggctgatctcctccttcgcccaagggttcatcttcggcttttccacttattacaccggggtggtggaatggctctcccccaccgtgtatctggtcaacaacgtccggtgcgcccggcagtatgtggaggtccagcagacgttccccgatggaacgccttacacctcccgccttttgacctccgcagacctggagagcttctggctgatcggcgtctacgccctggtaggactggcgctggctgccctggccctcatcctctaccgcaggcgccgcagtgagaccgccggcgacgtggtggccgtgggctggctgcggccggtgttccggtacggtgtggcagggctctgtgccctgctgggcggccagttcctctactccctgttctggtatggcttccagcagggggaatactacgacacgctgcccatggtggtctgcctgctggcggcaggggccatcgggtattacggcgcctccatgctgctggccaaggccttcaaggtgttccggggcagctggaagggcctgggcattgtgctggcgggctgtgcgctggtctgctgtgtgctgcatttcgacctgctgggtgtggcggaccgggtgccggaggcctcccagatccagaccctggagatccggattgccgacaacacctacacgctcacgccggagaaggacgcggacctgctggagcaggtcagggccctccatcaaacggtggttgccgacgaatcctatgttcgggagatggaggcccgcagatcttccacctggtctgaggatgagacccccaacacggcatacaccggcctgaatctcacctatactctgaaaagcggcacccggatagaccgctggtactccctgctcattacccaggaccgactggcccagccagagacctatgattatctgctggaccagttcgtgaacagcgatactgtaaaagcccggcgcctccatctggatgacgatttctggacggtgagcggcggcagcctgtacattgacactcgtggcgagggctacgaactgggcagccgggagggtgacgccattctcaaggcagtgggccgggatctgaccgccgggaactggggggattacgactggttctccggcgacagcggcagcagctatgccatggacctggggctggactttgaaagtgcagacagggagcgttacgactggatctctgtccatgtgacccctgccatgacggagacggtggactgcctggagcgcctcggcctggtgacgagggcagatctcgtcacctaccggcagctgtatccggaggactatggggcggacggctcctccatctggcaggaggttccgcacacgggtgagaatgcggtggtctacacggaggacaccacttccgccatggtctccccggcatga

SEQ ID NO: 949 - DNA, 2031 bp, Oscillibacter sp.
atggcactgttcaagaaacacaagacggagcctgtgccgccggaggataccggcgcccacgatacctccgtggggaccgccgccgatgtggaggcggtcatgaaaaaatacgaccgggagtccaacacccgggtctgggagggtctgccgaagctggtgatccgctggctgatggtagcgttctccgcctactgcatcatcgacactgtgttcctttccacccggcaggaggttcggctgcccatgttcgtggggctgatcctgctgttcggcttcctgaccttcccggccaaaaaaggggacgagcgggtcaaccacatgccctggtatgacatcgtgctgctgattgccgggcccggcgcctactttttctacgccgtcaatgcccagaacgtggtccagatgtccgcccgggtcatgcagaacgacctgtacatgattatcggcctcatcggtatcctggccctggtggagctgtgccgccggtgcgtgggcctgccgatcctgtgcgtggccggtgtgctgctggtgtacaccttcttcaacctgggcggcagtgcagatttcaagatgaccctctatcaggtcatccgcaccatgttctacaccttcaacggcatcttcggcggccccatcagcgtgtgcgccaagttcatcgtggtgttcatcatcttcggcgccttcctggagaggaccggcatcgcccagttcttcatcaacctggccaatgccgtggccggggccgcccccggcggccccgccaaggtggccgtcatctcctccgccctgtgcggcatggtgtccggctcctccgtgggcaacaccgtcaccaccggctccgtcaccatccccatgatgaagaagacgggctacaagccggagttcgccggcgccgtggaggcggctgcctccaccggcggccagatcatgccccccatcatgggcgccgcagccttcctgatggcagagttcaccggcgagccctacggcaccatcgccatgcgggccatcctgccggcggtgctgtacttcaccggcatctacatcgccgtccatctggaggccaagaagctgggcctgaagggcattcccagagagcagctgccccgcgtgcgccagctgctgcccaagatctaccttctggcgcccctggtgctgttggtggtcatggtctccaccaacatgtacaccatggccttctccgctgccatcgcaatcgtggcggccgtggccgtaggcctggtcaacaacgtggtggagatcgccagcaagagcagcaaccgggaggacttcctcaccttcggcaagatcatcgacgccctggagggcggcgccaagggctccatcactgtggcggtggcctgcggcgtggccggcattatctccggctgcatcacggtgacgggcctggcctccaagctgttgagcacaatcgtcagcctctccggcggccacatgattatcgccctggcgctgaccatgctctgctgcatcgtgctgggcatgggcgtgccgaccaccgccaactactgcatcatggcggccacctgcgctcccatcctgatggatccctccatcggtgtcaccaagatggcggcccacttcttcgtgttctacttcggcattgtggcggacatcacgccgccggtggccctggcggcctatgccggcagcgccattgccaaggcggatcccatgaagacagggttcaacgccacgaaactggccatagcggcctttatcgtgccgtacatcttcgctttcagcccccagatgctctttgtggatgtgaccggtgccttccaggtggtgcagatctgcatcagcgccctgctgggcatcttcggcgtggcggcggccctcaacggattcctgtaccggcccatccccgcgctgctgcgggtggccatggccgtgggcggcctgggtatgatgatccccggcacggccaccgacatcgccggctttgtgttggtggttggcatcgtcctctatcagcgcttcagcgcccggcgcgccgccatggtctga

SEQ ID NO: 950 - DNA, 3567 bp, Oscillibacter sp.
ttgtatctgcgcgcattggaaatccaggggtttaagtcctttccagacaagacggtcctgaatttcggcgaggacatcaccgccatcgtgggtcccaacggctccggcaagtccaacatctccgacgctatccggtgggtgatgggggaacagagcgtcaagggcctccgtggcgccaagatggaggacgtgattttcggcggcacggagaagcgcagccaggtgggctttgcccaggtgacgctggtgctggacaacacggagcacatcttccccaccatggaggagagcgaagtgtccgtcacccgccgctattaccgcagcggcgaaagcgaatactacatcaaccgccagtctgtccggctgaaggacttgacggagctgttcctggacaccggcatgggccgggagggctactccatcatcggccagggcaagattgatgagatcctctccgccaagagcggggagcggcgggagatcttcgaggaggccgccggcatttccaaattccgccaccggaaggaggaggcggagcggaagctggagcggacggaggagaatctggtccgcatcaatgacaagatcgccgagctggagcttcaggtggagcccctgcgggagcaggcggagaaggccaggaagtatctggtgctccgggatgagctgcgccttctggagatctccgtctggctggagaacctggacaccctgaaggcgggcgcccggaagctggaggcggactttcacgccgcagagtcccagcgggacgaggcccgcgccgctctggacgccctctatgccgagggggagcggtacagcgagcggatgcgggagaaggacatggaggctgagcgtgtccggacagagtccgccgttctggaggagcagatcaaggagaaggagtccgccgccgccgtgctggagagcaccgtcacccacaaccgggagaacatccagcgggcggaggcggagctggcagaggcggagagccgttccggcggccttgcgaagcaggcggaggagcaggaagcccgggtggcggagatcgaccgccggatcggggagctgaacggtgcgctggccgccctgctggagaccgcccagaccatggcggaacaggccggcggcgcccagaacgaggcggagcgcctgcgggcacaggaggccctcgccatggccgccgccgcggacgcgcgggcggaactggccgccgccgccgcggagaagaagcagatccaggagcggcgggaggccgcagagcgagacagggccgccgcggaggagcagcttcagtccgcccggcaggaggcgcgggagaaccgccgcgccctggaggatgccagggacgaggcggaggccgccgccaacatcatcgccggccacagcctgcggatggaggaacggaagaagaaggccgctgccgccgcggagcggcgggtccagctgaccatggacacgggggcgctggaaaaccgccgccgcctgctgacagagatggagaaggagtacgagggcttctccaaggcggtcaagttcgtgtgccgcgcacagagcggcctgcagggcatccatggcccggtggccaatctggtgaagaccgatggcaggtactccttggccatcgagatcgccctgggggcgggactgcagaacattgtggtggaccgggaggaggatgccaaggccgccatcagctacctgaagcagcgggacgccggacgggccacgttcctgcccctcaccgccatccggggtgacgagctccatgaaaaaggcgtggagaaggaatttggttttgtgggcctggggtcccggctggtgacatttgacccggcgtaccggaatattgtttacaacctgctgggccgcactgtggtggtggaggacctggactgcggcatcgccatggcccggaagtaccgcaacgccttccggatcgtgacgctggacggccaagtcattaaccggggcggctccatgaccggcggcagcaccagccggtccgccggtgtactgagccggtccgcggagttggagcagctcaccgcccggaccgctgccatgcaggcaaagctggcggaggcaaagcaggcggaggaggataccgcccgggaactggccgccgcccaatacgagctggagaccgcggaggcccagcgccgccacgcagaggacgaggtcctgcggctggagggcatcaggggacaatatgatctcctgctgcgctccctggaggagagcgtggagaacctcgtcggcgagctggagagtctggccggacggctgacggacaacgacgcccggtctgccgccgcccaggtggagatcaaccgacaggaatccgccgccgcggacgcgcgggcccaggcggaggcggctctttccggccaatcggagctgctggagaaatccggtgccctggccgaggagatcagcggcagaaagagcgatctggctgccctggcggccgagcgggaggccacagtccgcagcgccgcggacctgcgggcgctgtgcgcggatctctctggtgaccgggagcagaaggaacagatggcggagacctaccgccgaaacatcgccgccgcggaggaagagatcgccggattgcagacggcgctggaggagctggcgggccggggcgcggccttccggcagcggctggccgccatcacagaggagaagaacgccctggaggcggagcggactgccaagaaccgggcgggccaggagatgaacgagaacctgctgaacctggagcgggcggtggccaagctggaccagaagcgggccacctccgccatggaggaaaagcagatcctggaccggctgtgggaacactacgaactctcccactccgacgcccaggcacagcggatcgagctggagagcgtgcccaaggccaaccggcggatcggggagctgaagcgggacatcaccgccctgggcaccccaaacatcggggccatcgacgagttccagcgggtgaacacccgctacacctacctgacggaccagcgcaacgatgtggagaaggccaagggcgagctgcagaacatcatcggcgagatcacggaggagatgaccaagattttcgccgagcagttcaagctgctgtccgagagcttccagaccaccttccaggagctcttcgggggagggacggccagattggaactggaggacgaggaggacatcctgggctgcggcatcgagatcaaggcccagccgccgggaaagaccctcaagaccatctccctgctgtccggcggcgagaaggcctttgtggccatcgcgctgtatttctccattctgaaagtccatccaacgcccttctgcgtgatggacgagatcgaggcggctctggatgacgccaacgtcacccgctacgcccgctatatgcggacgctggcaggccggactcagttcatcgtcatcacccaccgccggggaaccatggaggaggccgacgtcctctatggcgtcaccatgcaggagcagggcgtgagcaagatcctgaccatcaatctgaatgacatggcgaaagagctgaagatcaaataa

SEQ ID NO: 951 - DNA, 1188 bp, Bifidobacterium adolescentis
ttgaccgataatctgaacgattttttctccgataacgcgcagtgggtcgatgatacgtcagcgggctcgtcattcgatgccgcgttgccgccgcaaccgccgaaatcgcgacgcgacatgcgtaaacgacgtgagcaacaacgtcgtcgtcgctatgtcacaatcatcgcggctgccgtcgttgtcattcttgtcgtcgtcggcggctttttcggtgtgcgcatggttaaacatctcaggcaaatgaacgccaacggctcgcaaatccagattgaggattacaccggttcgggagacaaagacacgacgttcaccgtggaaaccggacaaggcgcagccgaaatcgcacgaaatctggtcaaggcggacatcgtcaaatccgaatcggcgttcacctccgcagtcgcggccgccggcgcgacgctttacccgggttcgtacgcgttgaagacgcatatgaaagcggccgatgtcgtcaagatcctgtccgaccaaagcaaggccggcggtttcgccgaagtcaaggccggcgaacgggtgtccgatgtcatcgccaacgcggccaagatgtcaggcaaggacgtgtccgaattccaagcggtcatcgacggtggcggcgcgggcattctgccagatgaagcgggtggcaaattcgaaggatggcttgagcccggatcctacagcgtccaggacaagtccgccaaggacatcctcaaggaaatggtcacggcacgcgtcaacaaactggacacattgggcgtgccagatggaagcgaacgcgaacgtatcatgaacatcgcgtccatcgccgaatccgaggcatgcaatcctgacgattacggtaaggtggcgagggtcatcctgaacagaatcgaccaggacatgccgttgggcatggacagcaccgttgcctacgggttcaacaccacaggcagcaagctgacagacgagcagcttgaggatggaagcaacccgtacaacactcgcgtgaacaaaggacttcctccgacgccgatcagcaatcccggcgattccgctatccaagccgcgatgaatcctccggaaggcaaatggctgtacttcgtcaccaccaacctcaagaccggcgagacgaagttcgtggaaaccgaagacgaattctggaagattcgcgacgaatacaaaagcaacaacgcgaatgccaactga

SEQ ID NO: 952 - DNA, 1140 bp, Bifidobacterium adolescentis
ctgagcattagccttgaaaccatgtctcaggaaattgaaatcggtttgggcaagaagggccgtctggcctattcgctggacgatgtctccatcgttccctcccgtcgtacccgtgatcctcaggatgtgtccacctcttggcaggtcgacgcctatgaattcgacgtgccggtcatcggcgccccgatggattccgtgaccagcccggccacggccatcgccatgggcaagatgggcgcgcttggcgtgcttgacctagaaggattgtggacccgctatgacgatccccagccgctgctggacgaaatcgcgcagctgtctgcggacaaggccaccgaacgcatccagcagatttacgctgagccgatcaagccggaactcatcgtcgaacgtctgcatgagattcgtgatgccggcgtcaccgtagccggcgcgctgtctccgcagcgtacgcaggattattattccaccgtgcttgaggccggtgtcgatctgtttgtcattcgtggcaccgtggtgtcggcggagcatgtctccaaggaccatgagcccctgaaccttaagaaattcatctatgacctggatgtccccgtcattgttggcggcgcggccaactacacggctgcgttgcatttgatgcgcacgggagccgctggcgtgcttgtcggcttcggtggcggtgcggtatccgccaaccgcaacacgattggagtgcacgcgccgatggccacagccatcgccgatgtcgccgaggcccgccgcgattacatggacgaatcgggcggacgctatgtgcaggtgattgccgacggcggtatgggtgattccggcagcttcgtcaaggcattcgcgctgggcgccgatgcggtgatgctgggctcgcctctggcacgcgcctccgaggctcctggcaaaggcatgcattggggcgccgaggcccgccaccagacgttgccgcgcggattccgcactaacgtgggcaccgtaggttccttgcaggaggtcatgttcggcccgagccataacgccgacggaaccaccaattttgttggggcgcttcgcagagccatggccacgaccggttatgtcgatttgaagagcttccaacgttgtccggttacggtcgcttcgagccactga

SEQ ID NO: 953 - DNA, 978 bp, Bifidobacterium adolescentis
ggcaattggcggcccactgatccgttcccgtcggataatcgaaggctgattaaaaaagaaagaaggaagattgtggcaacgctgaagcaggtcgtggatgtgcttgaaacgctgtatccgctgcgatacgcggaacaatgggatgagccgggactcatcgtgggagaccttcgccacgacgtgcgcaacatcgcgttcgcggcggacccatccatggcggtgatcgaccaggctatcgccggaggcatcgacctgctgatctgccaccatccgctgttcttccgttccgtgcatgcggtctccggactaggattccgtggtgagatcgtccggaagctcaacctcgccggttgcgcgctgtgggttgggcacaccaatgccgatgcctcctaccgaggagtcagcatggccgccgccgacgcgttcggcctgatcgaacagcgtccgctggtacccatcgaagatccgaacgccgaacatccggtcggattgggccgtgtcggccggttgcaggagccgatcgcattgcgtgatttcgcccgtcgtgtggccgacgcgctgccatacaccgaacttggcgtgcaggtgtgcggcgaccttgacgcgacgatcggcacggtggcggtattgccgggctcgggcgattccctgttcgatgaagtgcgtgccgcaggcgtcgatgtgtatgtgaccagcgatctgcgccatcatccggtgaccgatgccatcgagcaggcgcgctatgaggcgtccatgcgtgccgcggacatcgaactcggccgaggcgacgccactgttcgtccgatgttcatcaacacgccacacagcgccatcgaatccatatggttccaatacgccatgggcgatgtgcctcgtgccgtatctgaggcgaccggagacatccccaccgtccgctggatttccatgaacaccgatccctggaatctggtactgccgtcctgcgggcaggaacgctga

SEQ ID NO: 954 - DNA, 1068 bp, Bifidobacterium adolescentis
atggctttattccctccaaagaatccggcgccagcaccggcacccatccccatgcccgcagccgcaagaccaaccacgctgtcggccgaagacatcgcacgcgccaggaacatcggttcgcagattcgcggacgtttcgcgcagaccctggtcggacaggacaatcttcgtgaatcgctgatcaccactttggtggccggcggtcatatcctcatcgaatccgtcccgggtctggcaaaaaccactgccgcgcagaccttggccacttcggtgtccggctcgttcaaacgtgtgcaatgcactcccgatctgatgccttcggacctggtcggcactcaggtcttcgatttcgccacgcagaaattctccacgcagatcggcccgatccacgccaatttcgtgctgctcgacgaaatcaatcgttccaacgcgaaaacccagtccgccatgcttgaagccatggcggagggcgcgaccaccatcggaggccaacgcatcgcgctgccgaaaccattcatggtcatcgcaacgcagaatccaatcgaggaagagggcaccttcaatcttcccgaggcgcagatggaccgtttcatgatgaaggccgtactgacctatccgacagagcaggaagagcaacgcatgctcgccatgctgacccgccgcggctccgataccgtagaccagcacgcgctcaccggtgacaccgtttccatcagcgacgtcgaattcctgcgttccgcggcacgtcgtgtgcacgtgtccgatgcgatcatgcagtatgcggtcgatatcgcggccacctcccgtggcgctggaaccaagcccgtccaaggactttcctcgctcgtcaggctgggcgcctcgccgcgcgcgtccatcgcgctggtgcgcataggacaggccaacgcgctcctgcagggacgagattacgtcattcctgaggatgtgaaggcgttcgcccacgaagtgttgcgtcatcgtattctgatgacgttcgaagcacttgccgatggcgtcaccagcgaccaggtggtggattcgatcgtgcaggcggtccccgttccatga

SEQ ID NO: 955 - DNA, 999 bp, Bifidobacterium adolescentis
atgaggaagcgtagtcaggcgattatcgcggccatgctcgcgctgggaatggccgtcggcatgtgcggttgcgaaggccagctgccgaccccgaaagccaccacccggcaggatgcgccgaacttgagcgccaagcaggagcaaaaggtccgcacgaggattctcaaaacgctcgaccagtgcaatcagaaccgtgacactgatacgttgccgacgattctcgaaggtccggaactggacatccgcaccagcgagctgaacgtagcgaaagccacgggcaatcttgaccgtaagaccaccatccccacggatctggcccaggccgtgatctccacggatgccggctggccacggtccgtgttctccatcacgtccacaaccaaggaccagcagtccaagcgtctgctggtgttcaggcaggattccgcacgccagaactacaagctgtggggtgtggcgcgactgttctccggcgtgaagatgccgagtttcgaaatctccaaaaccggcagcgcgcagggaacgcctacggacaccggtctggtcatgacgccgaaagcggcggtggacgcgtatgcggacctgctgcagaacggggcgaacagcaagtacgccagcaaattcgcggatgatgatctgcgatcgaagcttgccgatctgactgcccaggtgcagaaggccatggagcttaacgaaggcacgcagcagcagaccttcgaaccggtcaatggagccatcagcgtcatgcgttccgcggacggcggcgatctggtggtggcgcagatcaactccgaatggacgcgttccgccggcgctggccgtgaatcgcagccggcctctgacgcggaaaaggcgctgttcggcaatggcaaggccaccagcaccatgaagacgagctatgtgaacgtcatcgcgctgtatgttccgccggcgaattccgggcagaaaatcaccgcggtcggttccgaacgccagccggtgaaggtcgaagcgctgtaa

SEQ ID NO: 956 - DNA, 1005 bp, Bifidobacterium adolescentis
gacatggcggataaaaccaaggatgcgaaaaaagacgacgccagaatgtcttcgatcgcgaaaacgctgaacaaagtggaagatcggctggaaaaaagcgagaattgcgattccgtcgccgaaggattggcgaacgccgcaaaagcgagcgaactactgagctcggtatggacgttgccgccgacccagctattgcgattccatcacgacacgaaggtatcggacatagatggcgattccactcctggttttgacggcaacaaggatgatgccgaacgattcatatccatcagctcgtcggagatcgcccgttaccagcggcttatgtacgccaatggcgtgaaaggctcgcatcggcgattgctgatcgtgctgcaaggcatggacgcgtcaggcaaaggcggcatcgtacgacatgtgttcagccaaggcgacccgatgggcatgcactatcacggtttcggcgcgccgaaaggcgaagaactggaccatgactatctgtggcgcatcaaacgcgagctgccgaacaacggatggatctccatcttcgaccggtcccattacgaggacatcgtcatgccgcgcatctacaaaacgcagccggaagaagtgtggcaggcacggtacgacgaaatcaaccgattcgaatcgcaattgacggccgacggatgcgccatcatcaaaatcttcctcgtggtcagcaaagacgagcagaaacgccacttcctgagccgtctcgatgatccgaccaaatgctggaagttcgatccgagcgaccttgaggcgcgcgcccgctgggacgactacatggctgcatggcaggatgtgttcctgcgcaccagcaccgagcaggcgccgtggtatctggtgcctgccgacaatcgttggtattcgagggccgtcgtctccgagctgctgcgcaacacgctcaagaacatgaacatgatctggccgccgctcgaagtcgacgccgacgagatgcgccgtcagttggacacgctgtag

SEQ ID NO: 957 - DNA, 1296 bp, Bifidobacterium adolescentis
ttgactgacgatccgaagctgctggcggaaccgcgcgaaggcgtgcccaacgtgatcgacacgttgccggcattccgtgactattgcagtgagctggcttcctcacatggctcccttgccgcggacgcggaacgcgcatccggcttccggtatgggcatgaggactggctggtgcagttcaaacgcgacggagccggcatcggcctgctcgatccgcaggcgctcgccgcggccggggcggattggaacgatttcaaccgtgccgtcggagatgcggtatggattctgcatgattccctgcaggatcttccgggattcgccgaactcggcatggaaccgcaacggctgttcgacacggaaatcgccgcgcgtctgctgggattgaaacgattcggactcgccgctgtcaccgagcattttcttggactgacccttgccaaagaacattctgcggctgactggtcgtatcgtccgttgccccgcgactggcgaaattacgcggcgttggacgtcgaactgctcatcgagcttgaaacgaagatgcgcgccgaactcaaacgccaaggcaagatggaatgggctcaggaagagttcgattacgcgctcaaagaaggtctgggaccacgcaaggagcatctgattccctggatgcatgtctcgcacatcactgaagtcatgcgtgaccggcaggcgctggccatcgtccgcgcgctatggacccgacgcgacgaactcgcgcgcgaatacgacatcgcgccgaccctgctattgtccgacagctccatcatcgaagtggcgaaacgcaaaccacacaacgctgcgcaattccgttcgattcgctccatcaacgaacgtgtgcgcatccataccgattccgaacaggacaagatgttcgaacggtacgcgccgattcaacgcaaaatcaaaccgagcatgtggaagaacatcatccaggacgcgctcgccctgccgccaagcgaatggccggacgtggacggcggcgccgcgcggcgtcatgaatcgcagtcagcctcggctcccaaatcgattcgcgtgtggaaggaacggtatccggaacgtctgcaagtgctcaacagggtgcgcaaggcggtctcccagatagcggaggacacgcgcacgcctgtggaaatcgtcatcaaaccgcagtatttgcgtaacctgtgctggacggacgaacctcgtaagcgtgacgtcgcgcgattcctcagtgaacaaggcgcacgcgactggcaggtctccctagttgcagagtccgtaagtcgcgctattatatag

SEQ ID NO: 958 - DNA, 1428 bp, Bifidobacterium adolescentis
atggccgacgagaatgtcaccgcgtccgagaacaccactgaaaccaacgagcaggcagcgacgcccgcaacccaggccagcaaaccggccgtcccgagcccagcggccatgaagccgcatgcgccgagccccgcggccttcgccaagaaggctccgcagcgtcctgcaacctccaccggattctccgaagccgatatcaaggccgccgaagcgttcggccgtgtcgccgatgacggcaccgtgttcgtgaaggaaggcgagggagaacgcgaggtcggacagttcccggacgcttccaaggaagaggccctggcactgtatgcccgtcgctatctcgatctgacggcaaagctcgacctgttcgccaacaggctcaagtccagcaatgtgaagaaccgtgagatcgacgagtccatcaagacgctttccgccgaaatcgagcagccggccgtcgtcggagatattgaggcgctcaagtcccagttcgaagcactgaaggaggccggagcggccaagaaggccgagctgagcgaggcccacaaggccgccgtcgccaaggcgctggccgaacgtaccgcgattgtggagaaggccgaggctctggccaattccctgggcgacaacaccaactggcgttccaccgcggacaagttccgttcgctgttccagcagtggcaggatcaccagcacaatagcgtccgtctcgacaaggccgacgccgacgccctgtggtcgcgtttctcctccgcccgcactacgttcaacagcgcccgccgcaagtgggcccagggccgcgatgaggagcgcagcaacgccaaggccgcgaaggaggccatcatcgccgaagccgaggagatcaaggattccaccgcttgggtggaaacctcccgcaagttcaacgagctgatggatcgttggaagaaggccggtcgtgcgggccgtcgtgatgatgacgcgctgtgggcacgtttccgtgctgcggcggacacgttcttcaacgcccgtcaggccgatcgcgagcagattagctcgtccgaaaaggaaaatctcgccaagaaggaagaactgctgaccaaggctgaggctttggtgccggtcaaggatgagaaggccgccaagcaggctcgccaggcattggccgccattcaggaggaatgggatcagatcggctacgttccgcgcgatgatatgcaccgcatcgaaagccgtcttgatgctgtcgacaagcagatcaaggctgttgaggatgccgcctggaagcagtccgatccggaagccgacgcccgtaagtcctccttcgaggagcagctcaacgcccagctcgccgaacttgacgcccagatcgccgctgagtccgatccgaagaagaaggccaagcttgaggcggagaaggccaccaaggagcagtggctgaacgccatcaagtaa

SEQ ID NO: 959 - DNA, 990 bp, Bifidobacterium adolescentis
atggctcgacgggtcatcagttccggcaaggatgtgcaggagacggaccagtcgggcggacgacgttccggacggtccatctcatcggagcatgccgaaggacggtcgattgaagggtacgcggaccgttcaaaagccgaaggcttcgtagacgcgcgacgtttgcaaagcgaggacctggtttccaaaaccctgcaggagaccaccggcacgatcggcatcatgacacgtccgaaagtggttgatttcggcgaacggctcaaggaacgccgtcaggccggcgcgcgagccatagtcctgcgcgtgctcatcggtcttgtcgtagccgtggttttgggagctgtcgtctggctgttcctcttctcgtcggtgttccgtttggagccaggcaacatcagcgtggtcggcgccaacgaatgggtgagcgaatcgcaggtgcttgacatcgcgaggcagcagtccggaaaatcgttgttcctggtttcggatggagccgtggagaagcagatcaaggcgattccgggagtcacgtcagccaagtcgaagaaacagctgccgaactcgcttgaagtgacgatcaaggcgcagaaacccgcggccatgctcaaaaccagcgaggaccatatgacggcggtcgacagcaagggccgcgtgctcaattccgtcagcggcgtttccgtggaaggcattcccgtcatcgaagtgcagaacgtcgatgcgagcctgtctaggcgtcctatcaaggaagcgttgaagattctcagctcactgccggaatcgatgcgcaattccatcaccaaggtcaccgcggcgacccaggattccatcaccacggaactcaatgggggagaccgcgtgatcgtatggggtgattcctcggacctgaagctcaagaaagcggtggtggacaagatcgtcaatgatccgaacgtgattggagacaagcataacgtggacgtgtccgcgccgttgagaccgatcatcaaatag

SEQ ID NO: 960 - DNA, 1245 bp, Bifidobacterium adolescentis
atgggaaccatgagtgttgaagtgcccgaaatcgaccagctgctagccatgaccagtccggcacgatatggcgacgaactgccggatgagggcggccgcggcggtgctctccacctatcctcggtacttcccgccatttccagcgccatcgggcatccgattccaacggccatccatgccgatccgaaacgactccaagaggcacttggcctgccggacgcgcgttcggcagtcgtggtcctggtggacggtctcggatattggaacatcaatatgagattggggcattcaccctatctacggtcgctgatggcggatggcgttaaccagcggccaatcgccacatgcatgcccagcaccaccgtggccgcaatgtccacgttcggcaccggcacatgccccggattaaccggcatgacgggatatacgcagctcaatcccgacaatggcgaaatctgccagctcatctctttcaaaaacgcgcccgcaccgctgaaactgcaacagcagccgaccatattcgaacgattggcggaacaggacgttcgcgtcaccagttcgggactgccgaaattcgcgttctccgcgttgactcaggcggcgttacgtggcagcgactacatctccaatgacgatccacgccgacgtatcatgaccgcggcgaaagcggcgaacacgcccggactgacatacgtgtacctgcgcgacgcggacaagatcggacacaattacggctgggactccgacaagtggatcggcacatatgagcgtatcgacgcccagttgtctttgctgcgtcgaagtgtgccgaagaacacgctgatcgtcatcgtggcggatcatggcatgataaccgccgacccggaagcctgcatcgacatagcgtccgaaccccagctgatgtggggcgtcgcgaatgtcggcggcgaaccacgctgtgtcatgctttatggcgaggatggcgaggatggcgagaatccggaggacatcgccgctcgttggcgtgacgtgctgggggagcgcgcccaggtgcgcacccgccggcaggcaatcgaggaaggcgtctacggaccagtcgatgaacgcgtcaagtcgatgatcggcgatgtggtcgtctccgctgcgggctctaccaccattgtcgattcccgcacacaggcggagaaggcgatgcatctgcccagcgtgcacgggtcgctgacctacatggaatctgatattccatgcctgattgacgtggcttga

SEQ ID NO: 961 - DNA, 1635 bp, Bifidobacterium adolescentis
atgtcattcgaacatcccaatcgcaacaacgaaagcatgatcgacgtcgaacgcgacatcatgagccgtccatcggaacgcaacaccaccaatctcgacctgcaacgcatgaagatgatcctcgacatcatgggccatccggagcagtcgttccgcgtcatccacatcaccggcaccaacggcaagggctccacggcacgcatggccgaagccatctgccgcgcctacggcatgcgtacgggcctatacacctcgccccatctggaacacgtcaacgagcgcatcgctatcgacggccagcagctgtccgacgacgatttcgtcgacacctgggaccaggtcaaggaccttgtcgccatcgtggacatgaaaatggacgagctgggcaagccgaagatgagcttcttcgaagtgctcaccgccatggccatctggaaattcgccgacgcgccggtcgacgtcgccatcgtggaagtcggcatgggcggccgatgggacgccaccaacgtgctcgacgcggacgcggccatcatcggcccggtcgacatggaccacatggcatggctcggcgacaccgtggaggaaatcgccacggaaaaggtcggcatcatcaagccgaactgcaccgccatcatcggccgccagccacacgaggacgaggtcatgccgattatcgaggccgcggccaaggagaaccacgccagcttggtgcgcgacggcgtcgaatcggaagtcgttacccgagtgccggccgtcggcggccaggtggccaccctgcgcactccgaacggcacttacacggaagtgccgatcgccaaattcggcgagcatcaggcacacaacgcgctcgccgcactgtgcgcggcggaagtggtgattcccgtcaatggcgcgttggacggcgatttggtggccgaagcgttgagcagcgtacgcattccgggacgtatcgaacaaattcgtacctcgcctaccatcatccttgatggcgggcacaacgtgaacgcggccgaatcgctgcgtgccgccattgaagagaactatgatttccagcagctcgtcggcgtggtcgccatgatgggggacaagcaggtcgaggagtatctgggcgtgctcgaaccgttgctgagccatgtgatcgtcaccgagaactcgtggcgtgaccgagtgatgccggctgaggatctgaagaagatcgcggaccgtgttttcgggccggaacgcgtcacctgcattcccgaattgccggacgccatccaggaagccgtcaacatggttgatgccgatgacgaactgggcgtcggctacggtcatggcgtgctcgtctgtggcagcttcaccaccgccggtgatgcgcgactcatgctggaggagaagatcaaccccgacctgaagaagccaaaggccgaacgtgtgttccaggaagccgtcgatccggaaccgcgcaaaaagcaggacgaggctgacgtggatttcgaatccgacgccaaccctgatttcaacatcaacgatttcggcagcgtcggtccggacgattccgttttagcagacgccgatgcggatgaaatggatgaggcggcggatgccaacgaaccggcggatgcggaaacggcttcggaaaacgaaacgaagtga

SEQ ID NO: 962 - DNA, 1245 bp, Bifidobacterium adolescentis
atggcgaagaacccaaagattctttccatcgtgctggcaggcggtgagggcacccgtctgatgccattgaccagggacagggccaagcctgccgtcccattcggcggcgtgttccgtctgattgattttccgctgagcaatctggtgaattccggctacatgcagacggtcgtgcttacccagtacaagtcccattcgcttgaccgccatatctccactgtatggcgtttctcgccgctgttgggcaactacgtctcccctgtgccggcgcagcagcgtctcggcaagcattggtatctcggctcggccgacgccatctaccagaccatcaacatcattgaggacgtgcagcccgacatcgtggtgattgtcggcgccgaccatgtctatcgcatggatttccagcagatggtgcagcagcacatcgaatccggcgcggaattcaccgttgccggcatccgtcagcccatcagccagtccaaccagttcggtgtgatcgaggtcgatcccgatcatccgaatatgatcaagagcttccaggagaagccgcagaccaccacgggactgccggacgacccgaattccatcctggcctccatgggcaactatgtggccaacaccgatgccttgttcgcggcgctttcgttggatgagaaggccgaggatacgaagcatgatatgggcggcgacatcgcgccgtatttcgcggcacgcaacgaggccggcgtctacgatttcaattccaacgagattccgggagccacaccgaccgaccacgcctactggcgtgacgtgggcacgctgaagcagttctacgatgcgcatatggatctgatctcctatgtgccggagttcaacctgtacaacaccgaatggcctatctacacgctgtccggcaacctgccgccggcgaagttcgtgcatgccggccgcgaccgcctgggccatgccaccgattcgatcgtctcccccggcgtcatcgtttccggcggcgaggtgcaccattccgtcctgtcgccgaacgtgcgcatccattcgtggtctcaggtcgtcgattcgattctgttcgacggtgtggtcgtcaaccgtcgcgcgcgggtctacaaggcgattctcgacaagaacgtcgtgttgacggagaattcgaccgttggcatcgataccgagcatgatttggcgcgtggcttcaccgtcacgccggaaggcatcaccgtggtgccgaagggtaccgtggtcgacgactga

SEQ ID NO: 963 - DNA, 2115 bp, Bifidobacterium adolescentis
atggcggtcgatatggcgatcagcgcgacggaaaaacccctgggcaaagtgttcacttccgattaccaactcaccatcccttcgttccaacgcgcgtacacgtggcaggcggagaacatcgaacagctcgtcaacgaccttcaggacgcctgcgccgacccggacacgccttacttcctcggctcgctcatcctcgtcaaggacggccccacccaataccaggtcatcgacggccaacagcgcctcatctccctgtcaatcatcgtctccgtgctgcgcgaactggaagacgaccccgacctcatcgacagcctcaacgacctcattttggaaccaggcgacaaactccgcggcatcaaagccgagccacgactcaccctgcgagaacgcgacaccgacttcttccgcatgtacgtgcaggaaggcgatttggaaggcctgttcgatctgagggacaacgacatcgcctcgcacgcgcaacgcaacatcgccgtcaacacccgccgcacattcgacctgctcgccgccatggacgccaaagaccgccgccgattcgcctcatacctggtcaacggcgtcaccctcgtcatcgtcaccaccgacgacctcgccggcgcgcaccgcatcttcgacgtgatgaacatgcgcggcgtgccactgaccgcatccgacgtgttcaaagcgaaaaccatcgcggaaatatcccccgccgcgcgtaacgcctacgccacacgatgggacgacatcatggacccgctcggcgatgactcgcacacgctcgaagagttcttctccgacctgcacctgatcgtctcgcacaaggccgtctgcacacagctgcttgaggaattccgcaaagacgtgctcaaaccatacgtgaagaaacagaacgtcatctccttcatcgacgatctgctcgccccttatgccaacgcgtggctcatcctcaaccgtccgaccgacgccaacctgccagacgacatcgtggccatgctcgtctcactcgccgactaccagaccaccgactgggaacccgtggccatgtgggcgctcgtcaactccatccgcaacctcggcagcgccaacgcacaagtgttctccacacccggaaatatcggaaacgaaaccacgaacgcgcacgacgaacgcctccaattacacgacatcgacagactccacgacgttctcgccgcactcgaacacgtcaccggcgtcgacagcctcaaccggcaaagcccactcgcccgacgcacacgcgccgcaagcgccatccgagacctcaacaaaggccataccctccaacagatccgtggattcctcatcaccgacgaggaccgacgttccgcactcgcgcatctacgtggcgagttgcagaccagtcccgccatgaagaaacttctgctcatccgcgccaacgagcagaaggccggctaccgcatcacccgaccgcgcagtctcaaagcgttgccgatcatgcccgaacaggtcagcgcgaaatccgatttcgccgcttggccggagtcggtgcgtgaccattgggcaaaccgcatcggcaatttggtgcttagtcaggccaacgaaacccaagtcgcgccactcgccacgtatgcgcagcggcgcgaccgcatgctgttgtcggcaagctccagacgttttccgctgacagccgaactcgccaatatcgccgaatgcacgccgcagacgctgcaataccggcaggatgagatggttcggctcatcgccgaccattggaatattcgttacgatgccgacgatacggatttgtcgacgttgaacgaggagacgctcaatgtgaaagctacggtctcctctcccacgtccaaacgcgtcagcattgcccaagtgctggaagccgggctgcttatcgccggagagaccttggtatgggagcgtccccgcaagggcgaacgttgggtagcgaccgtcacttccgaaggcaagctgcgcatggatgacggcagggagtatgccacgcctactgccgcggcgcgtgccgttggcggctcatcagcgggtcttaccgtgtggaaacgcacgtcgaatggccagaaactgagtgacgtttggaaggcgtatcgtctgcgcaagcactga

SEQ ID NO: 964 - DNA, 840 bp, Bifidobacterium adolescentis
acgacctttcgctttgacgagcacggacgggagacgacgaatattatggggccgaaacggattcctttggtggccggaaactggaagatgaatttcgatcatcttgaagcgacgtatttcgtacagcagcttgcatggaatcttcgggccgtccatttcgactacaaacgttgcgaaatcgcattgatgccgtcattcacctcactccgcagcgtgcaggtcgccgtcgaatcggacaatctgaaaatccgctacggagcccaagccgtctcagtcacctcgcagggagcgttcaccggcgacgtctccgccgatatgatcgcccatctcggctgctcgtacgtgatcgtcggccattcggaacgacgcaaataccatcccgaagacgacgcgaacatcgtcgaccaggtgagggccgtgcttgctgccggcatgcagccgatactttgcgtcggagaaagctacgaggaacggcgcaaaggcatagagctcgatttcgcggtcggccaggtgcacgacgtgacgcgggacctgtccgatgaggaggccgcgaagctgattgtggcgtacgagccggtatgggcgatcggcaccggcatggtggctacgcctcagtcggcacaggacgcggccagggcgatccgaaacgacctgtccgatacgttcggaacacgggtcggcgaaacggtgcgaatcctgtacggcggttcggtgtcctcgaaaaacgcggtggaactgatcaacgagccggatgtggacggcttcctgatcggcggctccgcgttgaaggtcgatgaactcacacgcatctgcaagctgacattggaaacaaccgcctga

SEQ ID NO: 965 - DNA, 1422 bp, Bifidobacterium adolescentis
ctgagcctgcggtggaatgatatcttcacaaatgcaatacccctgccgggtcgcggcaggggtattgtgttttctaaacggcagatatgtgaaacgaagaggttgcgaatgggacgcgtggtcagctacaacgatgcggtgccgagatgcacgttctgcggcaagtccgagagccaggtgcgcaaactggtcaccggttcgggcgcggccatctgcgacgaatgcatcgaattgtgcgtggacatcatttccgaggaacgggacaaggacgcccagctcaatatcctgcaactgcccaagccggcacagatcagcgcctacctcgacaatcacgtcataggccaggagtccgccaaaaagacactttcagtggcggtgtacaaccattacaagcgcgtcaacatggaaatgcgcgagtcgtcgcgaatcggcaaggaacggatgcatggacatgacgattcgttcgagggcgtgcaagtggcgaaatcgaacatcctgctactcgggccgaccggcgtgggtaaaacatatctcgcgcagacgctggcccatgtgatgaacgtgccgttcgtcatagcggacgccaccacgctcaccgaggcaggatatgtgggcgatgacgtcgaaaccgtgctgcagcgcctcatccaggctgctgacggggatgtggcgcgtgcgcagcagggcatcgtatatatcgacgaaatcgacaagatcgcccgtaaaagcggcgaaaacacctccatcacgcgtgacgtgtccggcgagggcgtgcagcaggcgctgctcaagatccttgaaggcaccgtcgcctccgtgccggtggaagggacccgcaagcatcgtgaaatggaaaccgtgcagatcgacacccgcgacatactgttcatctgcggtggcgcgttcgtgggactcgccgacatcgtggcgcaacggttgggcgccagggaaagcggtttcggtgcggtctggcatgaccatgaggttcccaagcgtgagctgcttgcgcaggtctccgccgatgatctggctgatttcggattattgccggagttcatcggacgtctgccggtagtcagcgtgcttgaggaacttaccgaagacgatttggcccgaatcctcgtcgaaccggaaaacgcgctggtcaagcagtaccagaagctattcgccgtcgatggggtgacattgacctttaccgaaggggcgatacggcagattgcggcgacgtcgattcggcggggtacgggcgcacgtggattgcgttcgattattgagaagacgctggaggacaccatgttccgtcttcccagcatggaaggcgtcgaagaggtggtcgtagacgaagccgcagtcaccggatcgggcactccgaaactactcaaggtgtcgacgcagaaaattcctcgtctacgtgaggcgtaa

SEQ ID NO: 966 - DNA, 1422 bp, Bifidobacterium adolescentis
ggcgtgaacttcgaagtgtggccagaggccattgaattaggacgtatgtttgctgcggaaggctatgaactggcactggtcgggggtcctgtccgcgacctgctgctgcatcgcaaatcgcatgatttggatttctgcacatcggcgcgtcccgagcagtttgagcatattctgcgccgttttgggcatgatggcttctgggatatgggccgcaaattcggcacgctcggcgcgatgcgcaggcgtgaggacggcaccgaggtgaaagtggaggtgaccacctaccgttccgacacgtacgaccccgactcgcgcaagccggaagtcaattacggcgacacgctggaaggcgatctttcccgccgcgatttcaccgtcaacgcgatggcgttgcgtgttccggaactcgaattcgtcgatccgttcggcggtgcgaacgatttggccaaaggcgtgctgcgtacccccgtcgatccgcggcagtcgttcgacgacgatccgttgcgcatgatgcgcgccgtgcgtttcgtggcgcagctcggcttccgcatcgagccggaaaccgccgaagcgctgtccgacatggtcgatcgcatcgaaatcgtctccgccgaacgtgtgcgcgacgaactggtcaagctgctgctgtccgatcgcccgcgcgccggcatcgaagcgttggtcgattctggtcttgccgacatcgtgctgccggaaattcccgcgctgcagctggaaatcgacgagcaccatcgccataaggacgtgttcgaacacaccatgatcgtcatcgaacgcgccgtcgccctcgaaaccggtcccgacggtccggtgccggccccggacctgacgctgcgtctggcggctctgctgcacgacatcggcaagccgaagacccgtcgtttcgaagcgggcggcaaggtgagcttccaccgtcatgacgccgtcggcgcgaagatgacacgcaagcgtttgaaggcactgcatttcgaccaccacatggtcgaggacgtcagcgagctggtcaacctgcatctgcgcttccacggctacgtggaggagccgtggacggattccgcggtccgccgctacgtcaaggacgctggcccgctgtacgagcgtctgaaccgccttacgcgcgccgacacgaccacgcagaacaagcgcaaggccatgatgttctcggcggccatggacgagatggaacagcgtgtacgcgacctgaaagaaaaggaagactttgacgcgatccgtcctgacctcaacggcgacgagatcatgcagctgctcagcatcgaaccaggcccgatggtcggcaaggcgtacaagcacatgctggaataccgcctcgataacggtccggtggagcgtgacgtggccgttgccgagctggaacgctggtacaaggagcagagcgaatag

SEQ ID NO: 967 - DNA, 969 bp, Bifidobacterium adolescentis
atggttggccctatgcgtaaatcacttctttccaaggccgtcacggcagtctgcgcaacggtcatgtgcctgggcgtcactgcgtgcggcggtaattccagcgcgaaatccgacaagtcgaactcggattcctcctcatcttccgaaaaaatcggcatgcaccagatcgccggcgtgaccgccaagggcgagctcggcaagaagccgaccgtctcgttcaaaacgccgatgacggttgaggacaacagctacgtggtgctgcagaagggcgacggagcccagatcgaggacggcgaccgcgtctgctcgcagggcatcgccatcagcgtcaaggatggttccgaactggccagcacgtgggagaagaacacccccgactgctccaccgtagtcacctcggataccagccagatgaccgagaactactacaagatcttcaagagcctcaagctcaattccaccgtggcgttcggcgtgaacgactcgaattcctccggcacctcgtatctcatggtactcacgctggtgtccaagtcgaaggacctgaagaaggccaccggcgagaaggtcgccgacattccggccgacctgccgaaggtgacgctcgccaaggacggcaagccgtcgatcgacatgaatggctataagggctccgattccttgatttcccaggacctcatcaagggcaagggcgctgtggtcaaggatacgcagtccgtggtggcgcactacaccggctggctgcttgacggcacgcagttcgattcctcgtgggaccgcggacagtcctccgccttctcgcttgacagcgtgatcaagggctggaagcagggtctggcaggccacacggtcggttcccaggtgctgctggtggtgccgccgagcctcggctacggaaacaaggatcaggagaagattccggcgaattccacgctggtcttcgtggtcgacattctcgccgcctactga

SEQ ID NO: 968 - DNA, 2502 bp, Bifidobacterium adolescentis
atgcgctacggtcatttcgatgatgccgcaaaggaatacgtgcttgaaaccccggcgactcccctgccgtggatcaactaccttggcaacgaggacttcttctcgctgatttccaacaccggcggcggctacagcttctacaaggacgccaaactacgccgcatcacccgctaccggtataacaacgtgccggcagacaacggctcccgctgctattacctgagcctgatggactccgattccgccgatgccaagccggtcgaaacctggtcgccgaccttccttccatgcaagaccccgcttgattcctacaagtgccgtcaaggcatcggctacaccgtgttcgaagcttccaagcgaggcatcgaatccaagctcaccgccttcgtgccgctgcacaccaatgcggaaatcaatcggctcgacgtgacgaacaccaccgacgagccggccgtcatcgacgtgaccggctccgtggaatggtgcctgtggaatgccgtggacgactcgtccaacttccagcgcaacctgtccaccggcgaggtggagatcgaacgcgaaaccgatgccacgctgctgtaccacaagaccgaattcaaggaacgccgcaaccattacgcgttctacggcgtcaacgcgcccgtcgtcggcttcgacaccagccgcgacgagttcctcggccagttcaacggctgggacaccccgcaggtcatcgccgaaggcaaggctcacgattccgtggcgcacggctggttcccgatcgccgccaaccgcgtgcgtctggaactccagccggacgaaaccgcatcgctcgtgttcatgctgggctatatcgaagtggccaaggaccagaaatgggaggatccgaacgatccggccaaggtcggcatcataaacaagaagccggcccatgagctgttccgccgtttcgccaccgtcgaacaggtcgaagccgccttgaaggagctcaactcctactggtccgaactgctgaccacctacagcgtcgattccggcgacgaaaagctcgaccgcatggtcaacatctggcaccagtaccagtgcatggtcacgttcaatatgtcccgttccgcctcctactacgagtcgggcatgggacgcggcatgggcttccgcgattccaaccaggacctgcttggcttcgtgcatctcattccggaacgcgcacgcgagcgcatcatcgacatcgcctccacccaaatggaggacggttccgcatggcaccagtaccagccgctcaccaagaagggcaatgcggacatcggtggcggcttcaatgatgatccgctgtggctcgtggccggcgtgtacgcgtatctcgccgaaaccggcgacgtgagcattctgaccgaaccggtgccgttcaacaacgtcgagggctccgaacagccgctacttgagcacttgcgccgttcagtgaacttcaccattacgcataagggcccccatggcattccgctcatcggccgcgccgactggaatgattgtctgaacctcaactgtttctccgatactccgggcgaaagcttccagaccgtggagaacaacgacaccggcgtcgccgaatccgtgttcatcggcggcatgttcgtgctgtacggcagccaatatgccgacatcctcgagcattatggacgtctggccggcatgtccgacgccgaaatcgcgtccgaggcggccagcgtgcgcgccgaaatcggccaggtttccaaggccgtcaaaaccgccggctgggacggcgaatggttcgtgcgcgcctacgacgcctactcgcgcaaggtcggcacgcatgaggacaccgaaggccagatctacatcgaaccgcagggcatgtgcgtgatggccggcatcggcctcgatgacggcaaggcgcagcaggcgctgaagtccgtcaaggaacgcctgacctgcgattggggcaccgccatcctcgcacccgcctactccacctaccgcatcgaattgggcgaaatctcctcctatccgcgcggatacaaggaaaacggcggcatcttctgccacaacaacccgtggatctccatcgccaacgccatcgccggcaatgacgacgaggcattcgccgtctaccagcgcaactgcccggcgtatgtcgaggacaagtccgacgtgcgcaaggtggaaccgtacgtctactgccagatggtggccggtcccgaggcagcgaccccgggcgagggcaagaactcctggctgaccggcaccgccgcgtggacgttcgtggacgtgtcgcagtatctgctgggcgtgcgaccgacgctcgacggcctggccatcgaaccgcatctgccggaacggttcgaccagctgaccgtgacgcgcgtgttccgcggcgtgacctaccgcatcgccatgaagcgcaccggcgagcgcacggtgagcgtcgacggagcgaagattggcggtaatgtggttcccgctttgagcgatgccaaatccgtcgatgtcgaggtcacgttctga

SEQ ID NO: 969 - DNA, 1053 bp, Bifidobacterium adolescentis
atgagcgagaaagacgtgaaagacaacgaaaccgaagcattgaacaacgctgccgctgaaaacgcggaaaacgcggacatcgaggcgggcgaaaccgatatggccacgtcgatcgaatcggtcgatttcgcggtggtgtatgacgatggaggcgattccatcgcaaccgaatcggcagaaaacgcggaaaatacggaaggcatcgccacggaagacagcgttgccagcgacaacgcgaatcgcgtgaacgaaacgctcgcattgggcgcgaccgacgacgaacagtcgctcgaccagcacgaaaccgtacaggcggactccgcaaccagcgtgtcatcgcagatcgaccgcgaaatcaaacatcatcgcaagaaggacgcattcttcttcaaggcgaacccgacattcgcgctcgaccatgtgacggtgcacaaccgcaaaaccggtcgcaacgtgctcgacgacgtttccctggcgttccatgccggcgcgacccacgcggtgctggtggatgccgaagatgtcgaacagcatcaggcgctggtggccaccatggtcggcatgatgcggacgaccagcggcaacgtgatgcacaaaagcacgaacctcgccgacgcgacaccggtcgacgtgcttggacaccgcatcggtttcattccgcagcggttcgccgtgcgcggcgaccttgacgcggaaggcaacgtgctgtacgccatggacgcgtcgaaccgcaatttcctgcagcccaagccggtgattgcgcgcgagctgctcaagcgcgtgggattcgaggaagtgacttccggtctgccggtgggcaagatgagtgcgttggaccagcgtcgtgtggcaatcgcgcgtgcgctgagctgcgaggcggaggtgattattgccgacgagccgaccgctggattgaaccgtgacgacgccgccgtggtgctggggctgctgaagaaggccaagcgcgatgaggatcgtaagcgtgcgattattgtggtgaccgataatccggaggtcgccgatcagatggaacattgcgcggagcttgagtag

SEQ ID NO: 970 - DNA, 1212 bp, Bifidobacterium adolescentis
atggtaggaaccatgcctaaagcattgttacttgaaaacatccatcccgacgcggcgcagtcgctgcgcgaccatggcttcgaggtcgagtgcctcaagggagccctgagcgaggacgagctgattgatgcgttggaaggtgtcgacctgctcggcatccgttccaagaccagtgtgacccgcaaggtcatcgacgcgcgtccgacgctcaccgcggtcggctgcttctgcattggcaccaaccaggtggatctcgaatacgcgggcaagaacggcatcgccgtcttcaacgcgccgtattcgaatacccgttccgtggtggagctggtgatcggcgacatcatctgcctgatgcgccgcattcccgcgcacacccatcatatgaagcacggcatgtgggataagtccgcctccggctcccatgaggtccgaggcaagacgctcggcatcatcggctacggcaacatcggctcccagctttccgtcgtcgccgaggcgcttggcatgcgcgtgctgttctacgacattgaagagaagctcgccatgggcaacgcccaccgttgcgacacgctcaacgaattgctggaacagtccgatgtggtcacgcttcatgtggatggacgcaagtcgaacacgggattcttcggcgaagaccagttcgagcatatgaagcaggatgccatcttcatcaacctgtcccgtggtttcgtggcggatttggatgcgttgaagaagcatctggattccggccatctgtccggcgcggcggtggacgtgttcccaatcgaaccgaagaagaccggcgacgagttcctgaccgaccttgcggacgaggacaacatgatcctcaccccgcatatcggcggctccacgcttgaggcgcagaagtccatcggacagttcgtctcccagcgtcttgaggattattggttcaagggttccaccatgttgtcggtgaatctgccgcagatcaccctgtccgacatcaagtcgaatttccgcatcgcccacctgcatgcgaatcttccgggtgtgctggcacgcgtcaaccgtgtgctgggcgaggacggcatcaacatcgccgcccaggccttgggcacggaaggcgagatcggctatgtggtcaccgatgtggcgcagcgcccggaccagagggctctcgaccagctcgcctccatcgagggtacgatccgcatgcgcgtgatcagctga

SEQ ID NO: 971 - DNA, 2133 bp, Bifidobacterium adolescentis
cgccgcgtagccataacctatggcatcgctggtaggctggaccgtatgccgggaatgatcaagaaggaagacatagaaaaggtccgcgccaccgccgacctgtatgacatcgtatccgcgaccgtcacgctcaaaccctccggaaccggcacatacgtaggcctatgccccttccatgacgagaaaacgccaagtttttccgtgcgcccggcgcttggcgtatggcattgcttcggctgcggtctcggcggcgacgtgttcggctacgtcgaacatcaggagaacatcgactttcgtgacgcggtggagctgctcgccgacaaataccatatcgaactgcattacgacaaagccgacaacgtgcccgcgcacaccggttcgaaacgcgcacgcctgctcgaagccaacgaggcggcgcaggaatacttcgtctcccagctgatgaccaaggaggcgctcgccgcgcgcaagctgttggacggccgcaatttcagccaggccgactgccagcgattcggctgcggctatgcccctcaaggatgggataacctggtgcggcaccttgccggcaaaggcttcacccagcaggagatgctcgacgcgggactcgcccgtcagggccagcgtggcgtatacgactatttccgtggccgcgtgacatggccgattcgtgattcgaccggtcgtacgcttggcttcggcgcgcgcaagctgtacgaggatgacacgatcaacgcgaaatacatcaacacgcccgacacgcagctgtaccgcaaaacacaggtgctgtacggcatcgaccttgccaaatcggcgattgtgaagaaacgccaggcggtgatcgtcgaaggctataccgatgtgatggccatgcatctggccggcatcgacacggcggtcgccacgtgcggcaccgcattcggcgtcgagcatgcgaagatcatccgccgattgatcgcggacgattcgttgggcgccgtgcagctggttggccccctgaaggtggaggggcaggcgttgagctcgcgtgtcgtgttcacattcgacggcgatgcggctgggcagaaggccgcgatccacgcgttcggtttggacgccgcgttttcgacgcaggcgttcgtcgcggtcgccgaagacaacctcgacccgtgcgatctgcgcatcaaacgcggcaacgaggcggtgcgcgcgctgatcgccaatgcgcggccgctgtacgatttcgtgatcgattcggcaatcgaccgtttcgacaccacgtacgcgacaggtcagatgggcgcggtcaaggcggtcgccccgctgatcgcgcaaatccgagaccgttcgctgctcgacctgtactcacgcaaggcggtacgtcgcatcggcgtcgatctggacatcatgcaacgcgaagtggcgtaccagcgtcgcaaactgaacatgcgtgacgaggacgcgtacgcgccgaaacgtcgattccaaaacaatgcggggccgtcggctgaaccagcatatgcggaacgtggcgcgaatccgtatgcgaatcccgccgcacgcaaggcgttggagcatcgcgacgcggccgaccaaagctactatcgcatcgacgacgccgtgttcatctgcgaacagcagttcatggccacgctgatccaggtgccgttggccgtcgatccgacgatgttcgccagcctgaccttgtcgagtttcatgacgccggtgttccgcacgctgttccaagcggtcgccgcggcgggcgggcttccaggggaagacgtgccgcagggactgtggatgcacaatctgacgaaggcgggcggtccgatgctcgaatcggtcatcaacgagctggccgtcatgccgctgccattgccgccgagcgaagcggacgcgaaccgcaatacaggcgagtcgcaggaacaatcggcgcaattgcgcaagccaacgcaggaggagcggcggtacgcgtccgaactgatcgtcagactgcttgataccggcatcatgcgcaaaatcggcgcggcccagcgccgcatggcgcaactgccggacggtgcagagaaaatcgaactgctcggacagatcaccaaactggaaacgctgcgcaaggacctgcagtcgcgtgttttcggcaacaacgttgcgtga

SEQ ID NO: 972 - DNA, 822 bp, Bifidobacterium adolescentis
atgtccggcatgggagaaaggctcatcggcatgggcaaataccgcaaaagcagggcattcagccccgaaggtttctttgaatgcgagggacgcggcctcaaatggctcggcgaggcgcaatcgcagggcggcccacgcgtggtcgacgtatacgactggggcaaggattatctcgacattgaacgcgtgaacgcctgcggtccgaccatccaagccgcgcgcgatttcggtgttgcgctagctcatatgcatgatgccggtgccgaacattttggctccgctccaactggatacgacggcacctgctatttcgggccgttgcaggatcccgtcccgatggataccggtgcctgggatgatgtggccacctatctggcggacggcagattgcgtccgatggtacgactcggcatgaaacgtcgcgaactgaccgactatgacatggaactgactgaagccgttatcgacgccttgcccgacatcctaggcaaggccgccaacgacaagcccgcacgcgtgcatggcgacctgtggagcggcaacgtcatgtggactgctgattccggtgacgtcgaagccgtgcttattgaccctgcggctcacggtgggcaccgtgaggaagaccttgccatgctcgacctgttcggcatgtcatatcttacggacatcctcgaaggctatcagtcggcgcatccgcttaaggccggatggcaggaccgcatcacattgtggcagctctaccccattgcaggacattgcgtgttcttcggtggaggatatgtgagccagtatcgcgccatgtgcaggtcgctgctcaaatag

SEQ ID NO: 973 - DNA, 1902 bp, Bifidobacterium adolescentis
atatttcaggaggaggatggcgtgggccagcagcataaccagcccggtttcaccgatcagtcgttgattcgcaatttctgcatcatcgcgcatatcgatcacggcaagtctacggtagcagaccgtattctgcagctcagcggcatcgtgcccgaacgtgagatgcgtgatcgttttctggaccgcatggatattgagcaggagcgtggcatcaccatcaaatcgcaggccgtgcgcgtgccgtggacggttgacggcaccgaatacacactcggcatgattgatacccccggccatgtggacttcacatacgaggtgtcccgagcgttggccgcatgcgagggtgcggtgctgcttgtcgacgccacgcagggcattgaagcgcagacgctgtccaacctgtatatggccatcgaccatgatctggccattatccccgtgctcaacaaaatcgacctgcccagcgccgaacccgacaagcatgccgaggaaatcgccggcctgattggttgtgacccgtccgacgtgttgcgcgtctccggcaaaaccggagaaggcgtcgccgaactgctcgaccgtatcgtcgccgaagtgcccgcgccggcgggcaacccggacgcgcctgcccgcgcgctcattttcgactccgtatacgactcctatcgtggcatcgtcacttacattcgtatggtcgacggtgaactgaaatcgcgcgagaaactgcacatgatgggtatcggcatgacgcatgaccccatcgaaatcggcgtgatcagccccgacatgatgcccaccaaggcgcttggcgcaggagaggtcggctatgtgatcaccggagcgaaggacgtcagccagtccaaggtgggcgacaccatcacctccgccataaatccggctaccgagccgctcgaaggctaccgtgatccgcaaccaatggtctacgccggcctgttcccaatcgacaacgcgcaatatccggaactgcgcgaggcgcttgacaagctcaagctcaacgacgcggccctcatctacgaaccggaaacctccgtggcgttgggcttcggcttccgttgcggcttcctgggcttactgcacatggagatcgtcaccgaacgtttgagccgcgaattcgaccttgacctgatctccaccgcgccgaacgtgccgtacgaggtcaccgcggaagacaattccgtgcatcgcgtcaccaatccgagcgaattccccgaaggcaagatcaagaagatcgtcgaaccgatggttgccgccgacatcatcacgccgaaggatttcatcggtgcggtgatggacctgtgccaagaccaccgtggccagatgggcaccatggaatacatttccgccgaccgtgtggaaatgcattaccgtattccactcgccgaaatcgtcttcgacttcttcgaccagctgaagagccgtaccaaggggtatgcgtcgctcgactaccacgaggatggcgaacagtccgccgatctggtgaaggtcgacatccttattcaaggcgagaaagtcgatgcgttcagcgccatcgtgcaccgtgacaaggcgtacagctatggcgtgatgatgaccaagaagctgcgtgagctcattccgcgccagcagttcgagattcccatccaggctgccatcggttctcgaatcatcgcacgcgaaaccatccgcgccctgcgtaaggacgtgctcgccaagtgttacggcggcgacatctcccgtaagcgtaagctgctcgaaaagcagaaggccggcaagaagcgtatgaagatgctcggccatgtggaagtgccgcaggaggcgttcatcgcagccctgtccaccggcggagcgggcaacgaccgcgacaccaaggacaagattcgcgccgcgcagaagtccgaaggttga

SEQ ID NO: 974 - DNA, 1998 bp, Bifidobacterium adolescentis
tcggtaacgtttgtggagccttacaaaaagattgcgaatcttttgtgggaaacgagttcgtcgaatcacgcctcgaccgccaaacttgacattatgcctaagaatgtcaacaaactactggtggcgaatcgcggcgaaatcgcgcttcgagtcgtgcgcaccgcacgtgagatggggattcccacggtcgcggtctacgccgaacaggaccgtcacgcacagtacgtgcagatggccgatgatgcgtatctgctgtctggcgacacctacaaggacacgtatctcaacgaggatctgctcatcgacatcctgcagcgcagcggtgccgacgcggtgcaccccggctatggcttcctttccgaagtcgcaagcttcgcgcagaaggtcctcgacgccggcgccacgtgggtcggcccgaatccgaaggcgctcgtcgacctgggcgacaagatcacggcccgccgcgtggccactttcgcgaaggtgccgccggttcccggcatttcccagtcgatttccgacatgcgactgctgctcgacttcgcgcacacgcacggctatccgctgatgctcaagcgcaccgacggcggtggcggccgcggcatcacgctcgtgcacaacgacgacgagctgcgtggcttctacatgaaccacgatgcgctgcagggcggcgatttggacgagtatttcgtcgaacggttcatcgacaagggccgtcacgtcgaaacgcagtgcggacgcgattcgcacggcaatttcaccgtgtattccacccgcgactgctccgtgcagcgccgcaaccagaagcttgttgaggaagctccggcgccgttccttcccgacggcgtgctcgaacagctggaaacctattcccgccgcctgttcgacgcggtcgattacgtaggacttggcacctgcgaattcatggtgaccgaacagggcaaggtgtatttcctggaggtcaatccccgtctgcaggtggagcacaccgtcagcgaagaggtctgcggcctcgatctggtgcgtgagcagctcaccatcgccaacggcggcgagctgaccgtcgaccacccgctgcgcggacacagcttcgaactgcgtctgacctgcgaggatccagccaagaacctcgcgccgagctccggcacgctgaccaagctcgcatggccgtccggcccgggcatccgcgtcgattccggcgtggtggaaggcgacaccgtctccccgaagttcgattcgatgatgggcaagctcgtggtcaccgcctccgaccgtgcgacagccgtggcacgtgtgcgccgcgcgttggaagagctcaaggtggaaggcgtgccgaccccggcaagcctgttcgagcagatcttcaacgacgacgagttcaccgccgagcatggcgtggcctacgacgtgagcacgaaatggctggaacgcaagtacctgaacaaggaagcatcctccaccaagggcggccagccggcatccatggccggcgcttcgggtgcgaaggaagccgagcagaaggaatccagcgaaaccttcgtcatcgaagtcaacaaccatcgtgtgtcgctgaccgtgccgaacgacatcgtggccaacctgaccggcggcgccaaggcgcgtgacgccaagcgcgccatccagccgctgcgcggacagggcctgcaccacgtcgaaaagaagcagcagggcaacgacggccagtccggtgtgatcgccagcccgatgcaggcggtcgtcacacgcatcaacgtcgccgaaggccaggacgtggccaagggcgacctgctcgtcgtgctcgaatccatgaagatggagaactacgtgtacgcgccggtcaagggcaccgtcaccaagatcttcgtcggcccggccgcaggcatcgaagcgggcgagacgttgatgaccatcgacgtcaacggcgcttccaaggcggctgacggcaagccggcaacggacggtaatacggaaaccaagacggaaggcggcgcgaaatga

SEQ ID NO: 975 - DNA, 1137 bp, Bifidobacterium adolescentis
atggcacagccggcggcatcaacgaaggtgacatttgtcatgttcgaaagtgacatcattccggcaattgtgactacgcgcaccatgtcgggggcatccggcggcacgacaatggaatcagaggcatggagcacgagaaaggagctcgtcatgggtggacgcatgaatgacgctgccgatgcggtcagcgcggtcaaggtctcgaaactggtgaaacgttacggagacatgctggcgctcgactatttcgatctcgacgtgcatcagggggaaatcttcggcctgctggggcctaacggctcaggcaagaccacggcgatcaactgcatacttgcgttgctcacgttcgatgagggcactgtgcgcgtgttcggcgagccgatcagccctaccagctatgcgttgaagcgacgtatcggcattgtgccgcagaacgtggccgtgttcaacgaattgaccgttgaggagaacatcgattatttctgctcgctgtatgtttccgacaaggcaaaacgtcgcatgctcgtggacgaggcgttggatttcgtaggattgcgcgattaccgtacctatcgtccggcgaaactgtccggcggtctgctgcgtcgtcttaatatcgcctgcggcatcgcccacaagccggatctgatctttttcgacgagccgaccgtggccgtcgatccacaaagccgcaatgcgattctcgaaggtatccaacgacttaaccgcgaaggcgcgacggtgatctacaccagccattacatggaggaggtcgagcagatctgcgaccgcatcctcatcatggatcatggccggcatctggctcttggcaccgcggaggaacttaaggcgatgatcagcaccggcgaacgcatcagcatcgaaaccgatgatctgggagggcgctcagattcggccgatacgacgcttgcgcgattgcgcgcattgccgttcgtgaccaacgccgactatgacggccatgagctgacggtgaactgccgccagggcgatcacaatctcatcgacgtactgcagctgttggagcacgagggcacgaatatcgggcatctctccagtcgccagccgacgctcaatgatgtgttcctggaactgaccggcaccgcgttacgcgactga

SEQ ID NO: 976 - DNA, 5223 bp, Anaerotruncus colihominis
atgagtgagcaggagaaagcaagagaaaagcaggtcccggaggaggaaaacacacacgcaggacaggaaacgccgcaggaaacagcgtccgtgccaaaagacgccaaaccggagcagccggtcgcaaattcaggcggggatgccggtgctgtgcggccgtcgggcggaaaaaagttccgctggcagaagcggtattcggcgctgctggccgcggcgctgtttgttgtgatcggcgttgcggcgctgatacggcaaagcgcgccggccgagccggccggcgcgcctgcttcaagcatggcgccgtcctccgcgcagccgggcgatgactttgaatatccagagaacgaggcgattgatgcggctgttttctcgtcaattcatctgcttgacgagggctttgtcgagatcgtaccgcagtcatggtttgggaataacaacgacgacatccccctgacgcttgaatatctgcaaaactgcctggagctttcgccttcgcatccattcactgtgacggaggagcaggggacgtttcgcgtttatattgagggcatggagaaaaacagttgggtcgatttgatcctgccgtacagggatggcggggaggaggacgcgcgccggtatacggccaacacaggactgtgcggatggcttgatctgaagtccggatacggcggcgcggcgatcgacgcgccggtccgtgtggaattcaatgctccggtatctccggagtccgcgcgcggccgcgtgctcctgcggcagggcgaggccggtcccgatcagattgcgccggccataccgtgcgatgtgtcgtatgaggagcgcgccgtactgcttacgccgcatgagatgctcgactatggcgcatattatacagttgagctggccagtacgcttgtatcggtggacggcgcgcggatgggaaagctggacagtctgccgttttcaaccgagcagcgcgcattttccatttcagttgtggacggcaatacaaacttattccggccgggcgcggatatcgagctgacatttgaggtgaaaacggaatggagccagggcgtcgacgccaaaaccgagctgttcaggctgacgggagtcgaggcgtatcaggcggtattgacaggcgcggacacacagcctgacgaggccggggataccgggacggtacatctggacgacggctttgcatccgtgacctatgacaatcccggcgtgggatactatctgttccgatgctcggtgatggaccagaaaaccggcgaaccggtggtgatcgagaaaccgtttatggtttccacaacggccgtctatttgcaggctgccggtgaaagcgatttgatctggcttaacgactgcgcatccggcgaggcgctcggcggttataccgttgtattcacgcaggcaggcgaacaggtcgcgcgcttcgtgacagaagcggacgggacggctctgttcagccatacggtcgttgcaaaaacgccaacctggggaggactggacgctgacagcgactgcatcttcacaatttatgacccggatggaaaagcggtttacaccgaccggaccgcgtgtcttgggtgggacagccagaccgaggaaaggtattattcatttttctacctcgaccgcgcgctgtaccggccgacggatacggtgaatttctggggctatgtcaagccgtaccgtatgaaccggggcgctatgcccacccaggtagaggtggtatttgacgaaggcggccttgacgaacgcgtgacggtttcgctgaacgcggacgggacgttttccggttcgctctcatatgaacaggtggccagctcgcagtatggcatatcggcccgtatgctcctgccgccgccatacctggaggatagcagcggcaatccggttacgacgcatcatatcgataccatatgggtcgacattaaggattttgtgacgccggcgtatacgatttcatcgtcggtcgacaagccgatttaccgttcgggcgatactgtttcaatcaccatcacacccacgttttatgacggtacgccgctgccggattatccgatcgaattcagcgtgtttaaccccacgagcggcaattttgaggcgattcagaagctgacgaccgacgaaaagggcgttgcatatgcggcgatcaaggccggcgagaatatgacggcctattcctggaggccgacttatggctattattacatcaagatcgcaaatgacggcgaaaccgtttcccaccagggaagctacatttacacgccgggcaatgtgattctgcgcccggaggttacgtttgacgcgcatggagcgcggctgcaggtgcttgccaacagcgtcacgctcgaaggcgtcagggacgccgaacaggcgcagcggttggccgatgcatatgatgatgacgcttacgacgttctgatcggcgatccggtcgacatgcagttgtccgtggagacggatttgcgctactttatgccgcgtgagcagggggaggatgatacgtccgaccggcacatatgggacgaagaaaacatcgtcgccgtcgaggtgaaggacggcgctggcacggcagagctgctcgccgccggcgcgttcgacccgtcagaatatgggtgggtttccgtcacagcatcgtatgtgcatgacggtaatacgctctcaagcagcgccagcgcctcctacagcggcggccgtcggcgtgcttatagaggaacggatgaaaccgcgccgaagggatatacgttcaatgtttaccgcggcgacgagccggagccggtccagacgtatgaggaatatcttggacgcagctttgttgagacggatgtgggcgtgccgctccagttcgagctgctgcgcgacggcgtcccggtacagggcggccgtatgatctatacgcttgtgcaggacgatatcatcgggcgcggcagcgcggacacggcgcttacgctgacgccggaccaaaaacacgcgaacagtgtcctgctcgtggcggcatattttgacggacacgatgtatacgcggtcgccaactgttatatccgcatcaaccaggagagccttgcgctggagattgaaacggcgcttgacaaagaagcgtatatgcccggcgacacggtgacgctgtcagcgaaggtgcgcgacaaaaacggcaatccggtatcagcgcagatgtgtgtcagcatcgtcgacgaggctgtgttcgctctgcgcgagcaatactttgatattctggcgtcgctttacggggagatgaatttttataattattatatttataagtatacgtccctgactggcgacatcaacccgtttaacaacagcggcgacggcggaaagggcgcgggcgacaatctggaggcatatgatatcttccgcgacgacttccgtgatacagccttctttaaaccgctgcaaagcgatcaggacggcagcgcgtccctgtcgttcacactgccggacaatatcacctcctggcggatcacaacgctggctgtgggcaataacctatatgccggagcgtcaaaatcaaatctggttacgacgctgccgttctttaccaagccggttctcagcccgaaatatattgagggcgacgaggtcacaatgcttattcaaggacacggcacagcggttaaaacaggcgatgtgatcagctatgaggtacgcgtcaccggcgacggcgtagataaaacttatacgcgcagcggtacggcatatgagccggttgagatcaatctcggcaagctggccgaaggagactataccgtcacgtcgaccggacagttcggacagatgcgcgatacagttgaactgccgctgtccgtcatcagcagcaatctggaactgattgtcaaccgtgaaatcgacctgcaaaagccggtcgatatcgaggcgctgcgctatccagtcgtcatcacgctgtatgacgacgcatacagggcgtataacgacagcatcagttcactgctgcgccattactgtttccgtatcgatcagcgcatggcgcgctttgcggccaaacgcgcgctgatgcagtttggcgactcggaggatctgccgcgccatatccgcgtcagcgacagcgacgtgttgggctatcagaactttgacggcggtatcggctggtatacctacagcgatcagtccgatccggtcgtcacgatgaaggtgttgatgttcgcgggcgacatgtatgatctggagcgcatgaaaggttatttcgaggcggttaaggacgatcagacacgcggcgggactgagcgggcggctgcatatgccgggctggcggcaatcgatccggcttatacggcggatatccgggagatactcgcctcacagccggatatgaagctgaaggaacagctctattatgtcgccggcctggcctatggaggcgacgaagcgggcgcgctggcgtattacgaaaagtttgtcacgccgcgcctgcgccatgatatggagggcgcaaaatggcttgaatattcaaacgcggtacaggaatatgaacgcttgaaggaaaacgacgatgtgacggccgccgcatggatcacggcctcaatgctcaaccttccggatgcggacggctttgcggcgcattttgcacgcaacagatggcgtatcgattccatttttgaatgcatgatctacgtggtcaattacgggacgcctgcgacaaaagcggcgaaattcagctacacatccggcggcgagctgcacgaggtggatctggcgggttatggacgcaaatcgatcaccctcaatcgaagcgaaatgcaggatttggcgtttcacgacgtgccggactcggtgcgggcggctgcgtactatattggcgaaccggaggaggcaggctttgaaggttccggaaatatcagtatgcaaaaggattttcaggagatggaggacgggaaatacaaggtgacgctcacagttacatttgaggatgacgcgccatatgggttttacaatatcagcgattgggttccgtcaaacatgcgcctgcacacgatcgccaagcagccgcaaagctccagggtggaggtgcacagtgaacaggaaaaccagaagctgtattttgatttttaccgcacagcttatacgccgaaaaccgtctatatcaactattacacacagcgcaccttcgatacgcaggcagtggccgaccgcgcgtacctgatctgcgcggaaaccggagacagtgcctttacagagcgcggccggatttga

SEQ ID NO: 977 - DNA, 5124 bp, Anaerotruncus colihominis
atgagggaccgccaagggagggaaaccagtatgacaaaaaaacgatggctgattccggtgctggtgctgctggtgattataagcgcggccagcgcggcattttttctttcgcggccggagggcgatatgatctatgcatccgtcaatatccagccgcaggagcaggagagcacagagccgctcgcgcctgaaagtacgtttgccattacgcttgattacagcgtgtcgcaggagcagttgcgtgcaatgctgtccattgaacctgatatcggggaatatacgattgaaggaagcgggaaaaaatggacgctgcgtccggcagtcccgctggaggaaaatacggtttacaccgtccgcgtgatcaatccggataccggtgcggcggtgcagtcgtttgcctttcagacacgcagcgatctgctggtgaacacggtttatcccggcgacggcgaaacctttgtgccgctggaaacgggaatcgaaatgactttcaacgcgcaggatgttgatctgcaaaactattttgaaatcaagccggctgttgccggaagcttcgagacaaacggctatacagttatctttaaacccacggagccgctgacggccaacagcatttaccgggtgacgctcaaagccggattgacggcgccgggcggtatggcgcttaaagaggattatacgttttcgtttgagacggtgcaggcagaggatgcgcagcgcgattatgagaagctgcggcttgacggcccgtatgcggagacctttttgccgggcgatccgctgacagtcaagctgcaaagcggcggcgaggtatccgggctgccctttgaggtcaaaatccatcgttatggcgacatcagcggatatatgaaagagctgcgcgcatatgacgcgttctatcgggagcggtacggcgaaaagacagaatatgtcgccaatacgaccggtctggaagaagttgcgtcttataccggcgagctgttttccaaagatgacggatggggcgaattgtatgcgatcctgccggatgatctgggggaaggctggtatgtcgtcacaatctccggggaggacgcttccggcgccgaccagtttgtacaaaagctgatccaggtctgtaatttaagcgtttatacacagtcggccgacggcgacacattgttttggctcaatgatcccgcaaccggcgagccggttgcaaaagccacgctccagcttgaggacgtgaacggtgaaggcgagttcccagcggttacaatggccgatggaacggcgcgcgtgatgacaggggaaagcgaagccgcttatttgacggtgctgcgcgatggaaagagcgtctatttcgcgcgcgcgcccctgtcgcaggcggtcgagacgccgccgttgtccgaacggtattatacggcgctttatactgaccgcgaagcttaccagccgtcggataccatccatttttggggcgttgtcaagccgcgctccggcgacggcacgctgccgcagagcgtatgggtgtcgctttccacctcatggccgcgtgcggaggtttaccgcgtgaaagcggctgtcaatgaggcggacggcacgtttgaaggcgcgattgccgtaaccggcatcgccaaggattattatgagctttccgttaacgatggagagcagggcgtttacacctccaaggggctttcgctcgaaaagtacataaagccgccgtatgaaatcagtgtggctttggataaggaccactattattttgatgaagcggttggcgtttccattacggtgcgttattttgacggtacgcctgtttcaaatgaaacgcttacgctgacaggcgcttacattaccgagcaatccgtgacgcttgacgcatccggccgcgcgaactgcacagtcaggctgaaagcgccgaacgatgaaaacgatccgatgggctggtcgccgcgcagcctctggattgaggcgcacaatgcgagcgcccaggacgtctatgtttccggcagcgccaatgcggcggtcctgccttcgcgcgtcgcgctcaagctggagggcgattccctggagaagctgacggtgcgcacggcgcagctcgatgatacgaaattaaacgacggtcattccgtcagcccgctgaaaatttatgacagcgaatatgaccggctggcgggcgcgcctgtcgatgtgccggtgacggtgctgatccacagcgtcacacgccgtcaggtggaaaccggaagttattatgattatgtcaataaacgcacggtgacagaatatgaaacgcagcttgacgaggcggtcgccgaaacgatcgagacaaagacaagcggcggggttgttgcaattgaggggctggattacaaaaatacggacgatacaacctattgggccgaggcgcgcgttgacggcggcgcggccggcacggtttctgaaacaaaccggttcggcacgcggccttacggattcagaggcgacacgccggtttatacctttgtcaatccggacgatgaagccgcgaacgcaccggtcgatgtgggcgatgcgatcacgcttgggctgtaccgcaacggtgtaaaaaccgaaaataccggccgtgtgctttacagcgtattgcagcgccggtcgctcaaaaatggaatctttgaaggggattcgcagacgttaacaatggaggaaagcttcctgccgaacgttgtcattgcgggcgcctattttgacgggcggcatatctatgccgtggaggaatatgcggttgattatgattacacggacaagggattgaatgtgacggccgagacggacaaagaaacgtaccggcccggcgaaacggcgacggtgacgctcaagctgacggacgcggcgggaaatcctgtgtccggctccgtctgtgtgggcgtggccgacgaggcggtgttcgacgtcgcggagcagcacgcagagctgcttgaccagctttacagggcggtctattatccgcgcctgcggcgcagcctgtcgtatgcggaatatgataccggcgctgatgaaaaggcaggtgccgaatcaggggacggggcggtcccgatgagcgccaataccggcggcaacgcgggcggcgtattgctgcgcgaggactttgcagacacggcgctgtttaaaacggcgaaggccgatgaaaacgggcaggcaaccgtaacctttgagctgccggacaatgtaacctcatggcgcatcacggcgctggctgtgacaaacgatctgaaggccggcgacacggccgaacttgcggccgcaacgctgccgttttacctgtcgccgctctatacggatacgtatctggagggcgacgacgttgtgatcgcggcaggtgccgttgggaccggtgcgcataccggcgacgcggtttcgtatacagtgacgatcgccgacgccgcgggcagggagcttgacaaacagaccgccgaaggaaccatcggcgtgcgcgtgccgtttaccttcggcaagctggaggcgggcgcttatacgctgacgatagaaggcgtgtgcggtgaaaacagcgacgctgtgcgttatccgttttctgttgtaaagcaggcgctgacaacgccggtttatgaaaatatgccgctcaaggacgccgttaacattgaatcggtgcgttatccggtaaagctgatggtgtacgaccggcggatgcagccttatatggaaggtttgcagtatctttccatgcaggcgggcgaacgcacggagatcatcgcggctgcgtaccgcgcgcagcttgcatacaatgagctgttggacgaagcggaccgcgagccggtgcgccgggacagccgtctggatgatatccagaatgacgacggcggcgtgcggctgctgcctgtgtctgaaagcgacgccgctgtgacggccaagatgctggttgcggctccggaactgatcaacaagggcgcggcgcgcgattatctcaagggcgtgctccaggacccggccgctacgcaggacgaccgcgtcatggcctatctggggctggcggcggcaaaggaaccgattttgcttgatctgctgcgcatcatctctgaggagggcgcgtccatgacagacgcgcagcgcctctatctggggaccgggcttgcgctgcttggagactttacatcggctgatcttgtttataattcgcttggcggccgcctggttaaggacggagatatgctctatgccgaaggcgcggacggcacgctcgacgcgcgcattcaaacgtcggctgcggcgctgatgcttgcgtcggttacatccaatccggacgccgacgcgctgatgcgctatatgaataaccttgaccaggaccgtgcaaagagctacagcacaattgccaatttggagatgctttgctatatcaattcgtttataccatcacagaaaggagcggaaagtttcagctacacggatacgcagggtgaaacccagaaacgaaccctggaaaacggcggtgtggagccgctttccatgagctatgaggcgctggcggccgcggatttccaggcaaacgatcatgtatatgcctgtgcgctttacacaggttatgcagacgcagcgcagatcccggacgacgagcgcgtacagatcatcaagacgtacacgccggtcgccggcgatgggatcggcgtttccgacagggtacgcgtcgatttgacggtgcgcttttcagatgacgcgcctgacggctgctatatcgtctccgattacatcccgtccggtatgcgttatatggaagacgccggtatttccgggatcaatccatactttgattggatgtggggccggatcgacaatgaaggccaggccgtttttgggcgtatctaccgcaatattgccgtttggcgcgagacacaggcggcgcgcgccggacagcaggccggtgaaagggcggccccgctgactgacagcgcggcggccgaagaaaagaggatcccttcaacaagcggtatggtggtgcaggaggacacgaatgtatataccctgacatattatgtcagcgcggcgcttccgggcgaatttgtttcggaaagcgcatatgtaaccccgtatatcgagggcgcggccgctaagagcgagcgcggcacggtaacgattgaggcggagagctga

SEQ ID NO: 978 - DNA, 2742 bp, Anaerotruncus colihominis
atgggtctgattaaaaaactgttcggaagctattccgagcgagagttaaagcgcgtttatccgatccagcaaaaggttcttgcgctggaagaaacatataaggccaaaagcgacgccgagctgaaggctgtgacgccggcgcttaaagaacgcctggcaaacggcgagacgctcgacgatattctgccggacgcgttcgctgtctgccgcgaggcgagcgaccgcgtgcttgggatgcgccatttcccagtgcaggtcatcggcggcatcatccttcatcaggggcgtatctccgagatgcgcaccggcgaaggaaagacgcttgtcgccacgctgcccgcttatctcaacgccctgaccggcaagggcgtgcacatcgtcaccgtcaacgattatctggccaagcgcgactccgagtggatgggcaaggtctaccgtttcctcggcctgtcggtcggtctgattatccacggccttgatacgcagcagcggcgcgacgcctacgcctgcgatatcacctatgggaccaacaacgagttcggctttgattacctgcgcgacaacatggtcatctacaagcgcgacaaggtgcagcgcggccacaactacgccatcgttgacgaggtggactccatcctgatcgacgaggcgcgcacgccgctgattatctccggccagggcgacaagtcgaccgacctttatgagcgcgccgaccgctttgcacgcacgctcaaatgctaccgcgtcgccgagacggactcgaaagaggagcatgacgacgtcgacggcgattatatcgtcgatgaaaaagccaaaacagtcacgctgaccgcctccggcgtcacaaaggcggaggaatatttcggtgtggaaaacctgaccgacggcgacaatatgcagctccagcaccacatcaaccaggccatccgcgcccacggcatcatgcagcgcgacgtggactatgtcgttaaggacggcgaagtcattatcgtcgacgaatacaccggccgcctgatgctcggccgccgctataacgaggggctgcaccaggccatcgaggccaaggagggcgtcaaggtcgagcgcgagagcaaaacgctcgcgaccgtcactttccaaaactttttccgtatgtacgacaagctcgccggtatgaccggtacggcgatgaccgaggccgacgagtttatggagatctataagctcgacgtcatcgaaatcccgacgaacaagcccgtccagcgcgtcgaccaccacgacgttgtttacaagactgaaaaagcgaaattcaacgcggtcattgaaaacattgtcgaatgtcacgaaaagggacagcctgttctggtcggtacgatttcaatcgaaaagtcggagctgctctccgggatgctcaagcgccgcggcatcaggcacgaggtgctcaacgccaaataccacgagaaggaagccgagatcgtcgcacaggccggccagtacggcgcggtcacaatcgcaacgaacatggccggacgcggtaccgatatcatgctcggcggcaacgcggaatatatggccaaggcacagttgcgcaaggccggttatgacgacgaggtgatcagcgaggcgacgggctttgccgacacggacgacgagcaggtaagcgaggcgcgccagatgttccgcgagctgatggatcagtaccgcgctgaaatttccgttgaagcggagaaggtgcgcgcggctggcggcctgtttatcatcggtacggagcgccacgaatcccgccgcatcgacaaccagctccgcggccgcgcaggccgccagggagatccgggcgagacgcgctttttcatgtcgctggaggacgacctgatgcgtctgttcggcggcgagcgcatccagaatatgatgaacatgattggcgccgacgacgatatgccgatcgaagcgaagattctgaccaactcgattgaatcggcgcaggcaaaggttgaggcgcgtaacttcggcatccgtaaaaacgtcctccagttcgacgacgttatgaaccgccagcgcgaaattatctattcacagcgcgacaaggtgcttgacggcgaggatatcagcggcatcatcaagaacatgatcaaggagacgatcgattccaccgttgaccgttatcttgttgataaagaggtccatgacaactggaatctcgagggcttgcgcgactacttcctcggctggctgacaacgcaggaggatctgcgctacacgaccgaacagctcggcgaggtgacagaccagcagatcaaggatatgctgggcgaccgcgctgaaaagatctatgcagcgcgcgaggcgcagttcaccccgccgatcacgcgcgagatcgagcgcgtcgtgctgctgcgcaatgtcgatatgaagtggatgcagcacatcgacgacatggaggaactcaaacgcggcatgcacctgcgcggctacgcgcagaaggacccggttgtcgaataccgtatcgagggctttgacatgttcgacgcaatgatcgaatcgatccgcgaggacacggtcaagatgatgtttacaatccgcctgcgcactaacgaggagccaaagcgcgagcaggttgccaagcccgctcaggagagccgcggcgaaagcgacggcacgcttgaaaaccgtccccgcaccgtcaaaaaggtcgggcgaaacgatccctgtccctgcggaagcggcaagaagtacaagaagtgctgcggccgcgacgccgaataa

SEQ ID NO: 979 - DNA, 4704 bp, Anaerotruncus colihominis
atgcatatggtctggaaaagattcacggcgttttgtttggcggctgcgatgatggcggcaaatgtcgccgatgtggcgctgctggccgcgccgtttacaacgaatgcgcgcgcttcaagcgatgttgaggctgcgacgcttggttttataaagaaatcatgggacgatgataaggaccatccagaacgcacaacggttgtttcaggcggttcggtcgatctgtcggtttccattaaatctgggtatgaggaaaacaaggaaaccagcttcaattatgattcgacagacggaacagcgcctcagggcgatgatatagtgatcacgggaactggaaatacacgccgcctggatgtatcggatagttttccaacgattgagaagcagacggtaatgataacgggcaactattatgcgatcaagggacagggcaaggcgcttgagaaaatcaatggcgctgaccgtaccaagattgacgcaacggtcgacccggaacggattatgcagtacggcgaattgaccataaaagcaacccagggtgaaattgtcgcaaatggaaagtcccagggcggagctacatttactgttacagcgccggagtttctttcaaacggcggcgcggaaaacggtctgtatggatataacggcggcacggtgggttccagaagggcagataatggcgatttgatcgttgaaatccatccgccggcaagtacggcaggcaggctggatgatttgacctttacaattacgccatccaaggtatatgagtatttcgttacaccggataaacagaattcggccggtacaaataacttttatttaaaagaggacggtacgccatatgcggacgacgaattgctcgacaatggactgccgcctgtcaagacgatgaacgacgttattcagaaggatgaggaaatcacattttatctggatttgccaaaatcgaatacactgctgttgacggtcatcaaggcaacggcggcagtggaggaaattgccaacgatatcaaaatcagcgccaaccgcaacgatgaaaaatttatcaagctcgatccgggtgatgcgttgaattggatcacgactgatttttcgctgcgcaattatcaaaatcaatataacgacaaatttacaatttcatgggactggaaggccgacgattccgcctatcaggataatgtccatattggcgagagcaacaatgagtggatcggcgcgaccattgagcgcgaaataaccgatgtaaagggtaagcttctttatacagtaaccttcaaggatcgaaacggcaaggaaacgaaatccgctcagcaggagattgatattgtcatccgcggcactggagatccgccagtagcgacgttgacagcccaatggctcaataaagatgatctgagcagcggcgtcaacgatgacgccaataagatccccatgaatacggagcttaacaacaacggcacgcagctcaagatggacgtctacaagggcggcgtcatcgggtacaagaacccgcagagtccgtaccgttatgaaatcaccgccagcatgggtgcgcgccaaagctgggcaaagtatatgatcattgatgcgtctggcagcacggatgcggtcacagtacaattgaatacaaccagcggtattcaggattatacgtttggcagcgaatttaataacccgtcaatcagcaacaaggatacagcggttaatatccccgttcagattaatgcggcaaaaccgggaactgtaacgctgacatttcgcttttttgtagaggattcaaagggtaatcctgtggaattggattacaagccccgtgtgacaattacggtcgtcgatacctccccaagcgaggatgcgacgctttcgtcgcttgttatgaaggatccgaagggtcagtcgatcgatttcggcttcactccggaggcgacacagccgtttgaaattaaggtgccgttcaagacggaatcgattacgttggaagcgttccgcaacgacgacgcggccaacaagatgatcgcctattacgcctatcaccgggatggcggattgacgccggtttatggtacggaggacaatccggaaaaggtggaggccggcaagccgacagataagattccgttaaccgagaatgtcccggtttacattgaagtgacggtgacggcgcagaatccaaattttacaaagacatatacgctccaggtgacgcggactccggccagcaccgatgcaacgctctccaacatcgagatttacgatgagagcgacaccgatatgaaaaacaactatctgaaggactttaaccctctccagatggacggctatatgatcgaagtgccgtataagacggactggctgcgtgtgaaggtaccgacaactgacccaaatgccgccgttcagtgcgatccaaagctggaaaataaggttttgtttggcgatccggaatggatcaggctcagtaaaatgacgccgaacgaccagggcgtgtatgtgctgaaggtcaaggttgtttctgagcagagcattgaccgttcggcaaataagcagcccgattttacgaaacccgaccgcgaatacaccgtgcagatacgccggcgcgatccaagcgatgtatcgacgctgacagagttgaaggtatatgatactgacgataaacagttgacgctttcaccggcctttacagcggctcagagcgattacaccctgcgcgttccgttttcaacgtcaaaaatcagggcgtcggtcaaaccgcaggaggattctgtcagccgtatctttgcagtttatggacgccgcggccagagcgattacaagaagtggaaaactgttgatatcaatccggacggttcgatctccaaggatattccggtagacttcattacggcggcttacgaccacgatgaaatctggattgttgtcggatccgaaatggcatatggttatacggagcaggaattgatcaagatggtgattgacggcgacaagtcggaatatgtttcggtttaccgtatacgtgtggagcgcgccgaaccgagcgacgatgcgacgctgaaatcactcgtaatcaatgaccaggacggcgttgatacaaagaagatttcgttcaatccggatgttgagacgtatgaaatcagcgtgccttatgagacaagagaggttagctttgtgccgacagcgaaccacgagggcgcgcgcattaaaatccagagcaatcgagacagtattttgccaggcgttataccgcccagatggtacactgtgaatagtggaacagcgtcaaagaactttgacttgccctatgcggtcggcgatgcgacaacgacctttacaatccgtgttgaggcggaaaattacgattatgttgacccgccttcttataaagagtacatcgtcaagatcacacgtgaggagccgagccatgatgcatatctgaaagcgctttcggcgaccaacaccgagaattggcagccggacccgtttatcaggacaacgcttgattatgaggcgacggtcaaggaggggtcgtcaaccgtaaccattacggcgacaaccaatcatccgggtgcaacgcttacaatcaatggaatggcggctcagagcggcgtcgcaagtgatccgatcgatctggtcgatatttatacaacgattgagattgtggtaacggcgcaggacggcaccacaaagatgacgtacacgatcgagttttacaatcagaacctggttgaaaaaacaaacaatgctgatctgcgcagcctcaaggtcaattatgggttgatgacgccgaagttcaagccggcagtcactgaatatgaggtgacggccacggaggatacatattcggtcgatatcatcccgcgcacggacgaccggcttgcgacttatgaggttttcgccgggaccaggaagataggcgattacaataataattacgccttggcgcttgaggatggagaaaatgaggtgcgcattgtcgttacatcgccggataagactgtgacgaaggaatataccgtcatgatctaccgcaatgaggaggataagctgaaaaatctgaccccgcttgaatcagaggatgtcgattatgagggcagcggcgacacaatcatcattatgattgaccagtatccgcgcattggagcaagcgtttttgaggaattgaaaaattatccggacaagacaatcattttccagggcaacgattattcattggaatttaaggcatccgatcttgcaggccgcgtgattccctcgacagagatttacgatttccgcatgtcgttcagtccgccggatgaacaggaggatgcgatctgggacatcatcgagtcacgcagcggcaatgatgatctcacctccagccgggttgtaatggcgtacttcccgcatcacggatcactgcctgcgaccgcgatcctgcatatgtccattggaaagcggtacggtaatgaaaccatctactggcattattacaacgaggaacgtgatagaatcgactattacggaccggttcagacaaacgcacagggcaccttcgcggttaagatcgaccatttttcgacctatgtgatgacggagcgtcactccatcgtcggcgctgaactgcgtgtgggtgaaaccacattggctccggacggcggatttttgaatgacgcggcggatatcgtcaaggtcaatccttcgacgggtgccgcaaaggagtgtaaatga

SEQ ID NO: 980 - DNA, 3546 bp, Anaerotruncus colihominis
atggcaagaaaaatgaaaaccatggatggaaacaacgccgcggcgcacgtatcgtatgcgttcaccgatctggccgcgatctatccgatcacgccgtcgtctgtgatggctgaggttacggacgagtggtcctcgcagggccgcaaaaatatcttcggcaatgaagtcaaggttgtcgaaatgcagtccgaagccggcgcggccggtacggttcacggctcgctggccgccggcgcgctgaccaccacgtttaccgcttcccagggcttgctgctcatgatcccgaatatgtacaaaatggctggcgagctgctgccgggcgtcatcgatgtttccgcgcgctgcgtcgcttcccatgctctgaacatcttcggcgaccactccgacgtttacgcctgccgccagaccggttttgccatgctctgcgaaggcagcgtccaggaggtcatggacctgacggccgtcgcccactgcgccgccatcaagggccgcgtgccgttcctcaacttcttcgacggcttccgcacctcccatgaaatccagaaggtcgaggtctgggattacgaggacctcaacgagatggtcgaccacgacgcgatcgacgcgttccgccgccgcgccctcaatccggagcatcctgtcctgcgcggctccgcccagaatcctgatatcttcttcaccgcgcgcgagagctgcaacaaattctacgacgccgtcccgggcatcgttgaagaatatatggacaaggtcaacgccaaaattggcactgactacaagctctttaactactacggcgcgcccgacgccgacaacgtcatcattgcgatgggttccgtctgcgagacgatcgatgagacgatcgattatctcaacgcgcacggcaaaaaggtcggcctgatcaaggtccgcctgtaccgtccgtttgcggccgaccgtctgatcgccgcgatcccgtccacggtcaaatccatttccgtgctcgaccgcaccaaggagcccggcgctttcggcgagccgctgttcctcgatgttgtcgccgcgctcaagggcacgcagtttgccaacgtccctgtatacggcggccgctatggccttggttcccgcgacacgacgccggcgcagatcatcgccgtgtacaagaacggcgaaaccggcgcgaaggaacgcttcaccatcggcatcgaggacgatgtcacgttcctgtccctgccgattgatgagaacccgaacaccgctccggacggcacaaccgcctgcaaattctggggcctcggctccgacggcaccgtcggcgcgaacaaaaactccatcaagatcatcggcgaccataccgatatgtatgcgcaggcctatttcgcttatgactccaagaagtcaggcggcgtcaccgtttcgcatctgcgtttcggccataccccgatccactccacctatctgatcagcaaggcgaatttcgtcgcgtgccacaacccgtcatatatcaccaagtacgacatggttgaggatctcgtcgacggcggcaccttcctgctcaactgcccgtggagcgcagaggagcttgaggagcgcctgcccggcaaggtcaaacgcttcatcgcacagcataacatccagttctacacaatcgacggcatcgacatcggccgcaagctcggcctgggcacccgcatcaacaccgtgcttcagtccgcgttcttcaagctggccaagatcattgacgaagccgacgcaatcaaatatatgaaggacgccgcgaccaaatcctacggcgccaagggcgacaaggtcgtcaagatgaaccacgatgccatcgacgagggcgcaaaggctgtcgtcaaggtcgacgtcccggcttcctgggcaaacgccgccgatgacgcgaccgacgcgaaggctgtcggcgagcgcaaggatctcgttgattttgtcaacaacatcctcatcccggccaacgcacagcgcggcgaaaagcttcctgtttccacgttcgtcggcgccgaggacggcacgttcccgcagggttccgccgcttatgagaagcgcggcatcgccgtcgacacgccgtgctggattccggacaactgcatccagtgcaacttctgctcgtatgtttgcccacacgctgtcatccgcccggccgtcatgaccgccgaggaagccgaaaaggcccccgagggtatgaagatggtcgatatgaccggtatgcccggctacaagttcggcatgacgatttccgtgctcgactgcaccggctgcggctcgtgtgcgaatgtctgcccgggcaagcgcggcaacaaggcgctcgagatgaagaagctcgacacgcagcttgcacagcaggaaatcttcgcttacggccagtccctgccggtcaagccggaagtgaacgagaagttcaaggagacaacggtcaagggcagccagttcaaacagccgctgcttgaattctccggcgcgtgcgcgggctgcggcgaaaccccgtatgccaagctgatcacacagctctacggcgaccggatgtatatcgccaacgccaccggctgttcctccatctggggcggttccgcgccgtcgacgccgtacaccgtcaacaaggacggccatggtccggcttgggctaactccctgtttgaagacaacgccgaatacggctatggtatgttcctggctcagaacaccctgcgccagcagctcgtttccaaggttctcgagctttccaagagcactgacaaggctgatgtgaaggctgcctgcgaggcgtacctctccacggttgacgacggcagcgccaacaagctggcgacgatcaagctgattgaggcgctcgaagcctgcggctgtgacgcggctaaggcgattctcaaagataaggagttcttggccaagaagtccaactgggtcttcggcggtgacggatgggcgttcgatatcggttacggcggccttgaccatgtcatcgcttccggcgaggatatcaacatcttctgcttcaacaccgaggtttactccaatacgggcggtcagtcctccaaggcgaccccgaccggtgctgtcgcgcagttcgccgcggccggcaagaccatcaagcagaaagacctggccgctatggcgatgagctacggctatgtctatgttgcgcaggtcgcgatgggcgctgactacaatcagtgcatcaaggcgatcaccgaggcggaaagctatcacggtccgtcgctcatcatcgcttacgcgccgtgcatcaaccacggcatcaagggcggcatgggcattgcgcagaccgagatcaagcgcgctgtcgaggccggttactggcatatgttccgctacgatccgcgcctcgagcttgagggcaagaatccgttccagctcgattccaaggcgccgtccgcggactataaggccttcatctccaacgaggtccgttacagctcgctggcccgctccttcccggatcgcgccgaggagctgtccgagaaggctgccaagaccgctgccgaccgttaccagcacctgctcaagctctccaagctctacgcggttgagtaa

SEQ ID NO: 981 - DNA, 4686 bp, Anaerotruncus colihominis
atgggacagaggctggtgtttcagcctggggatgggctggagctggaaattaaggaggaaaacaagatggaactgctggaacaatgccaaatttggaatgaaaacgacgaataccaaaagatcattgatgcgctggaggctgtccctgccggggagcgtaccccggagatggacagcgaactggcacgggcctacaacaatctggcggaacttggggatcgggagctgtttaaaaaagcgattgctctgctggccccccatgaggaatattttgaaggcgaccattgctggaatttccgcatgggttattcctattactatctcgaccaagagggccgggcactgccttatttccgcaaggcgctggaggcccgtcccggcgacgaggattcgcagatgctcataaatgactgtgaaaagcgtatcaccctcccacgatttgaaaaatgcttccgggagcggacagaggcggcatgggaagcctttgcccaacaggaggccgggctgcgccgatttatggacgaggataaaaaccgtgaacgcggcgaggaattgatcgggcagtgcgaaaaaatcctgaactttgcttttgacgaaatctgttttgagatgggcttcaatggaaaaaagcatgagctgatcctcaccccggagggaaatcgggtgaagctgttccagcttgtttactttcagaagcacgcgcccaaagaggtgctggagcactggaacatcctggtgggccgccagtccaatccgaacatcggcctgcgctctggcggctgggagatttccggagatgatgtgcagctctggttggaacagcagggcgaaaacagctttgctctctcagcctactgtgaaaaactgctgcccctgctccgggaggatgagaaccgggtatggtggattctcaccaacctcaccgaccaggtgctgggcgaaatcccccatatgagatacatagactcttttgatatgctggagactcccagagaggagccttgcgttctcctctcgaagctgccggacgagttaaaagggatggggcttgacctttccatcgacccggaggttcttttggagagctatactgggtatgagatgaaaccggatgaaaatcccgatgctgattggcggctggatattatcgccggcatcacctgctgcccgccttttatcaacgactacatgagtgcggagagtggctgcatggacgattttcacgctgacggcgctgtggcgggctttttctgttatcctctggataccctgcgcgatgagaacggcagtcagaaaatctttgacttccgggagaagctggaatcggcgctgctggcggacgctggggaggatgctgttaccctgaccggcggggccaccggtctctactgcggctatgtggacttcatcgcctgggatttgagagccgtcctgaatgcggctcaggagttctttgacgaaaccgatctgccctgggcaagcttccatgtgttccgccgggatgtggggacagtgactctgaaggaaccggaaggggataagcctgaagatgacgggtttgatgacgaagaatccctggacaatctggagtacatcccctacaccccggagaatgcagaggcattttaccggcagttggaacggtggaacgacgaggacgaatacacccgctgcatcgcggcgctggggacgatccacaaggaccagtgggactatcgcgccgcctatgccatggcacgggcgctggaaaactacgccatcattggggaccatgaggagggtacccccaactacaagggggataaggcgctcctgcaggctattgagatgctggagtccgtccgggaggagggccaggacaaggcggagtggaatatgcggatggcctacggctatcagtatctccacggccaggaggaaaaagccattccctacgcccagcggtgggcggagctggacccggaggatgaggacgccccggcagtgatccgggagtgccggcaggagatccggaaccggcagcgcagccggaaaaagaaaaccaggtttgcgcccggcgacactccctttgaaggctttgattttacagacttttgggatgatgatgagtacgctctgaaagagtatgtcagtgagccaccctccgatgaactgatcgccagtgtggaggaggagttgggctacaagctgcctgcctcttatatctgcctgatgaaacagcacaacggcgggataccggccaatacctgctatcccagcgacgaaccaaccagttgggcggatgaccatatagccatcaccggcatctttggcattggccgggagaaggactattctctctgcggaaagctgggcagccggtttatgatcgacgagtgggaatatccggccatcggcatagccatctgcgactgtcccagtgcaggacacgatatgatctttctggactaccgggactgcggcccccaaggagagcctgcggtggtccatgtggatcaggagaacgactataaaatcacccgtcttgccgacagttttgaggagtttatctgcggtctggagaacgagtctgtctatgatatggatgaagatgatgacaacgaggatgatgacactgacgaagaagccgatcaggatagcagaggcgccttcgccggctttgtcctgatgtccaaaggaagctgggacaaggcccagttcattcaggatatgaaagcaaagtgggacatcaccgtggaggaggatgaggacgggggcaaccgcgacgacgctgtggtctttgaagtgggcggcatgatcgccgctgtaagcctgatgccctatcctatccctgacggcgaggccgaactgaacgcagaaaacaactatatgtggccggaggcggtcaaggccgccaaggagcactgcgcccatatcatggtggcggtcctgggcaaggaggaaaatctgctggagcgtggcaagttctacgccaagctggtggccgcctgttgccgccagaaatacgccgccggcgtctacaccagcggcgtggtgttcgagcctcggttctatgagggctttgccgatatgatgcaggaggatgaactgcccattttcaactggatctggttcggcctgtatcggaacgagggcggcatgagcgcctacacctatggtatggaggtgttcggcaaggacgaaatggaggtgctgaacaccggcgccgagccgggagaactgcgagacttcctggccagccttgtgtcctatgtgctggaaaatgatgtggaacttcacgacggggaaaccatcggcttttcggcagaagataagcacaccatcacccgcagcaagggcgtggctctgccggatcagatgaccttgaaaatctcctatgtgcctgccggggacgatccagagcaggatgatgacgacagcataggcatggacgatgcctcctggcacatggaaagcattgaggagaaagaactggaaatcgaccccatcaatgcctgcagccacatggcaatctacctgcgctggtgcatagagcatgacctgatggaagaaaacttcctgtcagagcatagcgaagttgtaaaacaggtcaaagccgatcctgccaacgtggatttgcgggcgttcatccgtgagaagctgttcggctgcttgtactccgccctgttcaatcaacaaggccgcgcctttgccgggtactactacggagagggcgacagcccttactttcccagtgatgtggatgactacgctctgcaatatttcggcccaaagcggtatcactccaatgaatttcagcaggaagcctatctgttcattccctttgacgaggactattatcaggccatggcaaaggtgattgataaacgttttgtcaactggcagggacagggctttgatgaggatactttggagccttccgatgtggctcaggctatcatggagtatctggactgcgagtgcacctatttcccttccatgaaggacgacgaccccatcatgtcggcgtacagctacgcccggcggctgggcgtgcgggagggctttattcccgtgcttgtcaagccggacgaaacgctgctggagtgcctggtaatgaacgccgacccggagaacgaggcggactgctatgaatttgacctcaaaactgtgacggggtaccggaagaagattctggatgctcccatcaaagacggaaaggctgtcttggagcaattggccggacaacgcagggaagaagccgaggatgacgatctggactgggcggaagaagtcctgggcgaaatggaaggcggctatgataactgccgtttctcctgttactgggattctgacactaacatgacttatccgcttattctggcgaaaattccggtgaagaatccgtgggatattttcgcatacctgccctttggcaactggaacgagtgtcccgacacaccggagctgatggcggcggcaaaatactggtttgagcagtatggcgcggtccctgcggctatgacccatgatgaattggaatttgaactcccggcccccatttccaaagagaaagccatggaggcagccacggagcagtatggtttttgcccggatattgttgaccaggagcaggatgatcccacagtgggtaacttggcggatgtcctgtggcagtccactgtctggtatttctggtgggattga

SEQ ID NO: 982 - DNA, 7305 bp, Anaerotruncus colihominis
atgaacagcgagttatttccgatcatagaagaacgtgtgcgtgcagcggcacagacaaaaccatcgggtatccggagactgaaaaaagccgtgcgcagatggctgcgtgatctgcgcacagcatatgacagcctgcccgctgcgccggaagaagcctgggcgcgatggctgtccgataacttctatacattagagggacatgccaaacagattctgcgcgatctgcccggttttaaaggctgtggaacagcatgtatgcggctgtatgcagcagttgagcgcgtgtttatggatgggcgcgtggtgcccgatcaggcgcatgtggggcagacgcttctctttgccggcttgttgggtgagctgggagaacgtcaattcgattttttatacacggcgctgcgctgcgcgcttctacgtgcggcggcagacgcatgcgcagagcagacagcgaagcaggaacgggaacggttgatctcctatgcggttgtggaactgaaccgcatttgtgaacttgatttcgacgcgctggtcagcgaatgcagcgcggtcgaagcaattctggcaaaggacccgtccggcgtctatccgcgcatggcggagcagtcgcgcagccattaccgccatgttgccgcacgcattgccaaacggtgcggcatggcggagagcgcggtcgctcaggatgtgctcaactgcgccgagattgcaaaaggcgaacgtgaacgccatgttgggttctatcttttaaaccacgatccgcgttcgatccacgcgcgccgccgtgcaatcgcggcgctgacgctgacctggctggcgccggtgctgctgtgcgtgttgatctggggcgtctttcacagcctgacagcggcgcttgtatcctatctgcctctggtggaaattgtacgcgttatcacgtgtgggctggcggcgcggcacgcgtctccggcacatatcccgcggatggagcttcgcggcgatgcgccggagacaatcgtagctgtctccacacttttgccagctgcggcaaaggcggacgagctgcgggaacggctggaacagttatatttttcaaacagaggagatcatttaaaattttgtgtgcttgcagattttaaggaggaccgccggccttataacccgcaggacgaactgaatatggcggctgccaagcgtgtggtggagcagctcaatgaaaagtatggttcgcgatttgcgctgctggtacgccgccgcgttttcagcagtacgcagaacgcgtatatcggatgggaacgcaagcgcggtgcaatcatagagctgatccgcttcctgcgcggcggcgatcccgcgatcgcatgctttgccggcgatcgggagcaattatcacgggcgcggtatttgcttgcgcttgacgccgatacgcttctggcgtttgattcagccgaccgcttgctgtctgccgcggtccatcccttaaaccgtccggttattggaaagcacaatattgtaacagccggttacggaatattggtcccgcggattggcacggatttgaattctgcaaaggcagctgactttacacgaattatggccggggcaggcggcgtttccacatatgagcaggaatgcagcgatttttatcaggaccattttggagagtcgatttttacaggaaagggcctaatcgatattgaaacgtttcatacagtcgtcggccggcgttttccggaaaaccgggttctcagccacgatatactggagggcgcatacctgcgcgccgggctgctctctgatgtggaaatgaccgatggaatgcccgcaaacgcgctttcatggcttgcgcgcctgcatcgatggattcgcggcgactggcaaaacctatgcttttttggcagaacgattcagctcaatggatcgtcccggccaaatcccatcagcgcgctgtcacgttatcagcttttcgataatttacgtcgctcctttgtacccgtggcggcgcttatttgcgtgctggtttctgcctttacaggatggagggcggcaattttgctctgtctgcttgctttcctttcgacggcattggcgcctctgctcgccgcttttcgcgcgctgctttacggtgggcgattcgcattgtcgcgccgtttttttgcacgcacgttgccgcgtgtatttgagctttgcggccaggcgctcctgtcggttgtcatgacggcacagcaggctgttgttgcgtttgatgcgattgtacggacgctttggagaatatttgtatcccacaaaagattgctgcagtggacgaccgcggcacagtcggagacgcgcgataccggcttttttgcagtgctgaaaaaaagctggctttcagagctggtcgggctttgcctgttgatttttgcgccggcaagccacggtctggtaaaactttatgggcttctgtttctgctttacacgccggcggccgctgcgactgcacggccggctgtccagaggctgcaagcgcccgatcagtcaggccgggaacgccttttgtcgctgtgtgcgcagatgttccgttattacgaggattatgcggacaaacacaatcgttggctgccgccggataacgtgcagttttcaccggtggaagcggtggcgcggcggacctcgccgacaaacatcggcatgatgctgctctcctatctggcagcgcgcgactttcactttattgacagccgcggcctgtatgtacgcttaaatcatgtatttgacacaattgagacgcttcagacctggcacggaaacctgtataactggtattccaccgaggatctgcatgtgctgccggagccgtttgtctcggcggttgacagcggcaattacctgtgcgcgctcgtcgcgcttaaagaaggcgtgcgtgagtatgcggctcaggagccgggcctggaaaccatcgcagggcgtattgaagccattttgaaaaacaccgacttttctgttttttataacccgaagcgccgccttctgtccatcggcgcgggagccgacggcaggctggtttcgtcccattatgatttcctgatgagcgaggcgcgcacggcaagctattttgccgtggcgacccgtcaggcgcagtaccggcactggcgcgcgctcaaccgcaccatgtcgcgctgcgggtcctatgcgggtcccgtttcctggacagggaccatgtttgaatattttatgccgcatctgcttttacccatatatgaggattctctgcttgatgaatcgcttcattacgcgctttactgccagaaacgccgcgcgcgtcgcgcaggcgtcccctgggggatcagtgaaagcggttattttgcattcgacgaacagctcaattatcagtacaaggcccatggcgtccagacgctcggcgtcaagcagggactggaccgcgaatgcgtcgtggcgccatacgcgacctttttaacgctcccgtttgattttgatggcgctatgaaaaatcttgaggctctcgagtcgcttggactaacgggacgctatggcttttacgaggccgtggatttcacacctgggcgcgccgcgccgtccgacggcggttatgcggtggtgcgttcctatatggcgcatcatgtcggtatgagtatggtcgcctgcgcaaacgcgctgcttggcgggattatgcaaaaacggtttatgcgtgaccacgctatgcgcgcggcacgcgaatttctgcaggaacaaatttctaaggatacggtggtgtatgatcgtatgaaggatgagacagagctttgcagggccgaaacgcctgtccgcgctgtttcggcgcgcgacggcgtttcgccgcttgcgccgcgctgcgcgcttttggcttctggggaactgacgcatatcttttcggatacaggcacaagttggctgcgctttggcgattgcgacgcaacgcggcgtccgtccgacccgctgctgaacgggcagggggtgcttgcagcggtaaagctctgtggacagacgctcacagccgcagccgcgccgttttatcaaaacggggttgaacggcgcagcgaatttggccccgattttgtggcctatcacgccgatcagggtgatattgggctgacgcagcggttttcaattgatcggacggcgcctgttgaacgctgcgaactgattgtacgaaaccgcaccgcgctcaaggccgtcgcgcaggtgttgatctattttgagccggtgctcgcacgtgacagcgattatgcggcgcacccggctttttccaagctgtttgtaacaggggaacgcgatccggccgcagacgcggttgtgtttgtgcggcggcacagggaaggcggcgagggtccgtgcctctgcgcgggatttgccgggcgggaagcctttgaatgcgggctgcggcgcgaggatatgacgccgtatccggacgggcttgaaaacctgctgcaattcgacgcactgccttttaacggcggcggcgcgacgcccgatggctgctgcgcgctgcgcgcaacgatgacggttccggcacatggcgaacagcgcatcacgcttttgatctcatgtgcggctgcacgtgaggatgcgcttgacgccttggccggcgcacgcgaaaaaaagcgtgccgccgcgccggcgccgctggcggacgacacgatggaagccagactggccgcgcggcttttgccgtgtctgttgctgcgtgcgtccggcggggacagccgtgcgcttttggaaaacacgcgcggacaggacgcgctgtggtcgatgggaatttcaggcgaccgcccgattgtcctgttcgattggaacgcataccccgatggcgcgcgtctagccgcctatacacgcctgtggaccttgatgcgcatgtatcggcttgatttcgacttgtgtgtgttgggcactcccgctgccaagacaccggatggcgtgcatgtactcctgccggaacggttcgatccgtccgcggttcttctgctgcgtgctgcggcatgccatatcgcaggccaaccagagccgccggcgccgcctgaatgggagcctgcgccggttctgcatacggatcccgcccccattttgcaggcaaaggaacgccttgacgtggtcggcggcgcatatgtaaacgggcgcttttatgtatcgcgtgtgacgccgctgccgttttcgcatattctcgcaaacagaacgttcggatgcctgctcaacgatgcgtcgctcggaaatacctggtggctcaacgcgcatgagtgcaggttaacgccgtggaaaaacgacattgccacaggctgcgacggagaaaagctttggctgtcggccagtggggcgctgtacgacctgatccgtggagcacgcgcctctttttcaccggaggacgctttatatgaagggtcagccggcaaaattttaacggcggtacgtgtctttgtaccggcgcaggggaatgctaaggtgattgatgtatcgcttgaaaatcaaacggacgaggaggcggaggttatctgtgcgtatggtttggaaccggtacttggcgtaacgcgcctgaacgcaaaatacacccagtttgatcaggaacagggctgcctgctgatgcataatccctatcacatggcgctgccgtgccatgcggctgtgtacgcgccgcacgaatatccgagctatacgaccgaccgcgcggcgtttttggcgggagactggtccgctcgcgaactgctgcccaataacgacccgatcgccggactgattatccgcaagaagctgccggcgcgccggcgcgccgatatccgcctgatcctggccgccggcgcaacgcgtgcagaagcggtcgccgaggcgctgcgccagcagtctgcgccggacgtcgggatggaacgaccggttgaaattgcgacgccctgcgcgccgcttgaccggtttatcaacacgttcgcggtgcaccagatccgttccggccggctgtttgggagatgcgcgttttatcagtgttccggcgcatacggcttccgcgaccagttacaggacgcgtgcgcgctgcgtttgacggaaccggcgcttttgcgggagcagattttgcgatgctgcgccgtacaatttgcggaaggagacgtgctgcactggtggcatccgctcccgacagagacacgcggtgtccgcacgcgtttttccgacgatctggtctggctgccgtatgcggtctgcgcgtatgtcgaggccaccggggacaagacgcttcttgacgagcaggttccattctgtacaggcggcgcgcttgcgtccggagagcaggagcagtatatgcaggtacaagcttcagagacacgcgcgccggtctttgaacattgtgtccgcgcgctggaaaaggcatataacctcggcgaccgcggcatcccaaagatcggctgcggcgactggaacgacggcttttccaaggtcggcgcgcgcggcgagggacaaagcgtctggcttgcgatgtttttatccattgtctgcgaccgtttcgcggcgctgtgtgacagccgcgacgcgcagcgggccgatgccctgcgcgcgcacgccgcgctgctgcgccgcaacgtcgacgtatcctgctgggacgggcagtggtatctgcgcgccttttatgacgacggcgcgccgctcggaggccatggaaacgacgaatgctcgatcgacctgctggcgcagagcttcgcagtttttgcagggatgccggaccaggcgcgcgtcagcagcgcgcttgatgcggcccttgcccatctggtggacgaccgctgtggaatcatccgcctgtttgatccgcctttcgccgacacaaaacagaatccgggatatatcaaggcgtatccgcgcggcatccgtgagaacggcggccagtatacgcatgcttccgtctggttcgcacaggcgatgcttgagtcaggacgaatccgcgatggatggaggctgatcgatctgctcaatccaacggcgcgctgcacggacgctgcacgcgcgcaggcatttaagacagagccgtattatatgcctgccgatatctatacaaataaagacgcctacggtcatggaggctggagtatttacacgggcgcggccgcatggtatttgcggaccgtcctggaaacgctgcttggactgcgccccaaagacggcgctctgacgtttgagccgcatgtgccggacgactggacacattttaccgttaagctgcggcgtgaaaacgcggttttatctattgaagtgaaccggaccggtatgcgttcgcttacagtggacggagcgccggcgcagagcgcgccgctcgacggaagggatcatacgattttgttaacgatctga

SEQ ID NO: 983 - DNA, 2664 bp, Anaerotruncus colihominis
atggatgatcacagacggacgccttggcattgtcagccagtacaggaagtatacgaagctttgcgaacctccagcgaggggctcagcgatgccgaggctgccgaacggctaaaaaaagatgggcacaatgagctgcgctcgaaaccgcccaaaaccattttgcagatgctttattcacagcttatcgatccgatggtgcttattctcgtcggcgcagccgtatgctccgctgtgctgcgggaatggacggaagcgggcgtcatctttgcgattgtggcgctcaatgcagtcatcggtattgtgcaggagaaaaaggcccagtcctcattggaggcgctgcgcaatatgagcgcacccaccgcccgcgtgctgcggcagggcgacgaaagcataatccccgccagcgaggtggttgccggcgatatcgtatttctaagcgatggggatatggtgcccgccgacatgcgtctgattgactcggcgaacttaaaggtgcaggaagcctccctgaccggagaatccgtcccctctgaaaaggacgccgacgatttgctcccgctggattgcccgttgggcgaccggagcaatatggtgtatacgtcctctattgtcacctacggccgtgcgaccggcattgtggtggcaaccggcatgaatacgcaggtcggcggcattgctgaaatgctggaggagcaggatgagcttgacacaccgcttaaacgcaagctgaatgcagttggtaaaacgctcaccattgtcggtctgattgtctgtgtaatgatctttttgatcggcgcgctctatcagcgtccactgatcccgcagtttctcgttgctatttccctggcaatttccatcattccggaaggtctgccagctacggcgaccattgtaatggccctgggcgtgcagcgcatggctaaacgcaatgcgcttgtacgcaatttgcccgctgtggaaacgcttggcagcgccactgtcatttgcagcgataagacagggacgctgacgctcaatcagatgactgtgactcacatcgcggtaaacggcgattttgaagcgggcgcgaccacccccatcgccgaagccaccggacagcaccccattgtttataaggagcttgtttacgcggcggcgctgtgcaatgatgcgagcgtcgacccggatcacgcaggcgcaatcatcggcgatccgacagagggcgcgctgattcacatggctcaggctttcggagtcgatcatgaggccctggaggacacatatccacgccggtttgagcagccgttcgattccgaccgcaaacgtatgacgacagtacatgtgatctctggaaactggatttcctatacaaaaggcgccgtagatgaaatgctgccgctgtgcacccatatattgacggctgatggagtccgccccatcacagaaggcgaccgtgcaaacattctgcgcctttgcctgtccatgtcggagcaggctttgcgcgtgctgggctttgccacgcgtaccctgaccggcgaacagattccggaggaggacggcgacaatgtggaatacgatatgaccttcctcggagtaacgggcatgatcgatccgcccaggaaagaggttgctgattctgtacgcacatgccgccaggccggtatccgcacgatcatgatcaccggcgatcacaaggttactgcgcttgccattgctcgggaattggacatttaccggcctggagacacggtgatctccggcgatgagctggatgaactggaggacgcagctttggacgcggctgtcaaaaacgcgactgtattcgcgcgcgtgtcccctgccgacaagctgcggatcatccaaagcctgcggcgcaccggcgaggtggcggccatgaccggcgacggcgtgaatgactcccctgcgctcaaggccgcggacatcggcgtagccatggggatcaccggcacggacgtggcaaaggacgccgccgatatgatcttactggacgacagctttacgacgatcgcctatgccatcaaggagggccggcgagtataccgcaacatccaaaaggttatccaatttttgctggcaggcaacatcgcggagatcacgaccctgtttgcagcgaccatattcaactgggaagcgcctctgcttgccgtccatattctatgggtcaaccttgctacggcgaccctgcctgcattggcgctcggcgtcgaccctgcaagtaaaaacatcatgaagcatccgccggtgaaatccggtacgctgtttgaaaaggatctggtatgccgtgtgatcacgcagggtattttcgtggcggccatgacaacgctcgcctattggatcggcgcgcgcatggacaatccaaccacaggccagacgatggccttctgcgttttggcgttctctcaaatgctgcgcgcttttaatcagcggtccaatacggaaccgatttgggtccgcgccgagggtatcaacccgtggctggttctttcctttttagtttctgcggctttgatggcctgtattttgctgttgccgtccccgcaaagcgccttcaagctgactggcttaagcagcgtccaatggatagctgtgctcatgctgtctctctcctctgttcttcagatagaggtcgtcaaatggtttaagcggcaaaagcagcatggctga

SEQ ID NO: 984 - DNA, 3084 bp, Anaerotruncus colihominis
atgacgcttccaaaactgtctgtcaagaggcccgttgcggtccttatgtgtgtgctgatgctggtggtattcggcatctcctccatctttggtatggagatggagtccacccctgagatgtccatgccggtgtttatggttatgacgcgttacgagggagcctccccggaggaggttgacaaccttgtcaccgatgttgtggaatcggccctatcctcgatcagcgacgttaaaactatgacgtcgcgttcctcagaaggctcgtccatgacgaccctggaatttgattacaacaccgatatggatgaaaaatacgacgaaatcaatgaagcgttgacgcgcctgcgtttgccggattccgccgatgatccgacgattatggaaatgagcatggattcttcatcgatcatggatctttccatccgtgccaacgccgacgacaatatttattcctatatcgaaaataccgttgtcccggaacttgaaaaaatctccggcgtctcatcggtcgatatgcgcggcggtacgcgcgaatatgtcaaggttgaattgcgcgaggaggagatggagcaatacggtctttcaatgaccgatatctccagcgccattgcctcggccgacttcacaacgaccgcgggggaaatcaaccgcggcaacatatccctgacgctcgagggcggcgtcagctacgacacctatgaaagcctggaaaccatcccgatttctctggcctccggcgatattatccatatctccgatgtggcgaccgtcagtatggccgaggagcagatgaacaatatcagccgttataacggcatggataacatcagcctgtccatttcgaagaaccaaagcgccaacacaattgagatctgcaatgagatttccgagaaagtagacgaattgaacgggcaggggcttggtcttgcaatcgaaatcacaaacaacagcggcgaaacgatctatgaaaacatcatgaacgtcgtttccaccttgcttcagggtcttgtgctttccatgctcgtcctggtcgtattcctgggcgactggcgcgccgcgctgatcgttgccacctcaatgcccttgtctgttttcgcggcgcttgtgctgatggccgcgtttggcatgaccatcaacattctctcgctcggcggcctggtagtcggcatcggaatgatggtcgacaactctatcgttgtcatcgacagctgctttaaaatgcaggatggtatacgcacctatgacgacgccgccatcgccggagcgaacctcgtcaatggggccgtcatcgcgtcaacgatcacaaccatcgtcgttttcctgccgattgctttgatggacggcatgtccggtcagctctttaaggacgtcggctttacgatcgtcttttcgctgacagcctcgctgatttctgcgctgacgctcgttcccctgctttttgcaaagttccggcccgtggaaaaacaaacttcggctgtcaaccgcggactgcacaagctcgaacgcctgtacggcgccttgcttgacaaggctctctgtcataagctgattgttgtggccattgccattgtcatgcttgcaggcacgttcgttatgttcactcagatcgattccgagctgatgccgatgtccgacgaaggctccatcagcatttctgtcacgacaaaaaccggtcttaatattgatgaaacggatcagatcatgacacagctcgaggcgctggtggccgaacagcccgacgtagaaagctattccatgcgcggcggcggcggttccgcaagcattaccgttacgctcaaagacgaccgttccatgcagacggacgaattcatcgctttgatgcgtcaggaaacagcttatgttgaaaatgccagcgttgaagtggaggaacgcagcagtatgtcgtttggcagccggggtgtacagatcaatctgtccggcagcaacctcgatgtgcttgaacaaacggccaacgaggtcaaagaggttatgcaggaatttgacggtattgattccgtttcaacaagcctgtccgacggcgacccccgtgctcaaatcgttgtggactctgtgcaggcggccgcaatcggtaccaccccatcggcggtgctgtctaccgttcggaacatgatttccggtattgaggcgactacgcttcaggagagcgatcaggaatattccgtcaaggtcatgtatccggaagaccgcttctatgatgtcagcgatctttccggcctgatgatctccacgcgttccggcggccaggttccgctgaccgatgtagcgaccatcgtatacaataacagcccctctcagattcagcgcgaggacggcgattaccaggtttccattacaggccagaccgcgattggccagtcggacagcagtctttccggccagattctcgcgcgggttttacagatgaatctgcccgaaggagtcacggtcgaggaaggcggcagcatgcgcaccatgaacgaggaattcaacgctatttacggcgcgctggccacagcaattttcctggtgtttgtcgttatggccatccagtttgaatcgctgcgcttctcccttgtcgtcatgttctctgtgccgtttgccatgacaggcgcatttctggcgctgctgctgacagacatgtccatcagcatgacttccctgatcggactgattatgctcgtcggcatcgtcgtcaacaacgcaatcgtcctggttgattataccaatattctgcggcgtgaacaggggctaaccgcccatgacgcgctcgtcaattccgggcgttcacgtctgcgcccgatcctgatgacaacgctgacaacggtcctcggcctgctgccttcggcctttggcttcggcggcaatgtcgaaatgatgcagtcgatgtccgtcgttgtgatcggcggtctgacgctttcgacgctcgtcacattgattctcgtcccgaccgtctatcttctgtttgacggcgaggaccgccgcaaaaagggacacaaaaccggcaagcgttctctgctgcgccgcaaccggcgcgaacagccgcaggtatccgatgcagcgccggttccgcctgaattcttttga

SEQ ID NO: 985 - DNA, 4338 bp, Anaerotruncus colihominis
ttggcgtccctgatcgaactgttcggcgaatacatagagctgccgcccggtgcgcttgcgcgcgggacggtacttggcatgcagattgaccagcagaagcggtcgatgtgcgtttcgctcggtttggacgagctgacgccgtatgctgcgctttctgagcttggccggcgtctggcggcggcgttctccttaaacgatgctgtggtccatccgcgctatgacggcggtatgctgtcaagcgagcatctgccggaattgattgcgcgtctgggcagcgaaggcgtgccggtcaacggtttttttaccggatgccgctgtgatttaattgatgaaacgctgcgcatctatctgacgcatggcgggcaggaattcctcgaaagcatccattgcccgcaaaagctttccgcggtcatacgtgaggaattcgggcgcgaggtgcggattgtattcgacggcgtgctcgaggtcgcgcctgacagcgcgctgtatcaggaaacagttgaaaaggtgcgacccaagccgatcaggtatacgccgcccacgccgcagcaggcggaaaagaagccggagaacggtgcagtcattccggcggcggcgcgcctttccttcgatgcgcacgatttgccgtttgagcctggttccatggttacgctttacggaaatcccccgaagggccgccccatagagatggcgcaggtaaatattgaaagcggcaatgtgacagtatggggcgatgtattcaaaattgaccgccgtaccagccgcgatgaaaagacgctcattttgtcgatttattttactgattacaccggctcttattgtgcgaaggtgatcggccggtttgacaagaagatgaaggcgctcgacgagctgcacgagggcgatacggtcgctatgcacggcctgattgaatatgaccggtttgaccgtgaaaatgtgatgcggcccgacagtatcgcgactgtaaagaaaatcccacggcgcgatctatgcgaggaaaagcgcgtcgagctgcacatgcattcgaacatgtcggcgatggatggcataacacccgcggccaaactgattaaacgtgcctacgaatttgggcacaaggcggtcgcgatcaccgatcatggcgtggtgcaggcatttccggactgcatgaacgccgttgccaaaatccgcaagagcggcggcgatatcaaagtgatctacggcgtcgaagcctatttcgtcgacgacgtggttcaggctgtcagcggtaatgcgcacggcaggtttgacagcgagatgattgtatttgacctggagacgaccggcctttccgctgcgactgaacgcatcacggagatcggcgcggtgaaactgcgcaacggtgagatcgtcgaccgctttaacacatttgtaaacccggagcgttcgatcccgccgaagattacagagctgaccggcatcaccgacgacgatgtgcgcggcgcgccgctcgaaggggaggcgctgcgccagttctatgcattctgtgggggcagcagcgcggtgctgatcgcacataacgcgccgtttgacacaagctttctgcggcagtgcgcccggcgctgcggcatggaatacaattttaccgcgattgatacagtcgtgctgtcgcgttccctgtttccggagctgaaaaagcataagctcgatatcgttgcaaagcatctcgggcttggcgagttcaatcaccaccgtgcatgtgacgacgctgaaatgctcgccaggatctacatacgtatgatggaactgatgcagtcggagcgcgcatgcagcgatattggacaaatcaatacatcgcttgctgcggtcgatgtcaaaaaatcgccgacgtatcatcagattatcctggtcaaaaatctgacagggttaaaaaacctttaccgtctgatttcgatttcccatctggattactatgccaaacgtccgcgtatccccaaaagcaagctgattgaacacagagagggccttttgatcggaagcgcctgtgaagccggacagctttaccgtgcgatcgtggaggggaaaagctggggcgacctgtgcgatatcgcgcgtttttacgattatctggaaatccaaccggtcgcaaacaacgaatatatggtgcgcagcaatatggttgcggacgagcaggccatccgggagtttaacgaaacggtcgtgcggcttggagagcggctgaacatcccggttgtcgcaacctgcgacgtccacttcatggacccgggcgacgcaaaattccgagcaatcctgatggcgggcatgggctttgccgacgccgaccagcaggcgccgctgtatttccgcacgacagacgagatgctcaaggaatttgaataccttggcgcgcagaaggcgcatgaagttgtcatagagaatccaaacctgattgcggatatggtggaaaatatcaagccgatcccggatgggacgtttacgccgaccatcccaggctccgacgaggatttgcagcgcatcacgcgcgccaaggctatggagctttacggttatcaggggcaggtgcctgaacttgtgtccaagcggttggagcgcgagcttggctcgatcatcaagcatggatttgccgtgctttacatgatcgcgcagaagctggtggccaaaagcgaggaagggggctatcatgtcggctcgcgcggttcggtcggttcgtcgtttgtcgcgacaatggccggcatttccgaggtcaatccgctgcctccgcactactactgcccggactgccattacagcgaattcatcactgacggttcggtcggctccggatttgacctgccggaaaaagcctgcccgatgtgcggcgccacctataagcaggacgggcatgatatcccgtttgaaacgttcctcggctttgacggcgataaggcgcccgatatcgacctgaacttttccggcgaatatcaggcgcagatccataaatatacggaggaattgttcggcccaacgcacgtgttcaaggccggtaccatttcgaccgttgcggaaaaaacagcctacggctttgtgaaaaagtatgcgcaggagcgcgggctgatcatgacgcgcgcagaggaggagcgtctcgcgattggatgcaccggcgtcaagcgcacgactggccagcatccgggcggtatggttgtagtgccgtccgaccatgaggtttttgatttttccgcggtgcagcgcccggcggacgatccaaattcagatatcacgacgacgcactttgacttccattctctgcacgatacgatcctcaagctggacgagcttggacacgatgttccgacgatgtataaatatctcaaggacatgaccggcatcgacgccaatgacgttcccatgaacgaccagaaggttatgagcttgttcctctcgccggaggcgcttggcgtcacggaagaggagatcgactgcaataccggtacgctcggcatcccggaattcggtacaaattttgtccgcggcatgctgattgaagcgcagccgaaaaatttttcagacctgctgcaaatttccggcctgtcgcacgggacggacgtctggctcggaaacgcccaggagctgattaaaaataaggtttgtacgatttcaaacgtcatcggtacgcgcgacagcatcatgacgtatctgctgcacaaggggctggagccgaagatggcgtttaagatcatggagattacccgtaagggcaacgcgccgaagctgcttacagaggaacacatgaccgccatgagggaacacggcgtaccgcagtggtatatcgatagctgtctgaaaattaagtacatgttcccgaaagcacacgctgcggcgtatgatattgcttcaatccgactgtgttggttcaaggtctatcaccctctggcattctacgcggttatctttacggtgcgcggcggcgactttgacgcggaagccgccgtgcagggcaaatcggccacgaaacgcaagatacaaaacctgctccagatgggcaacgagcgaacggccaaggacgagggtgttttgaccatgctccagatcattcacgaatgccaggcgcggggctattcctttttaccggtcgatctgtataaatcgcattacagcatttatgaggtggaggacggcaagatccgcctgccgtttatggcgctcaagggcgtgggggaggcggccgccaggagtctgtgggagacggccaaaaccgagcagtttatctcagcggacgatatttcaaaccgcgcgggtgtttccaagtcagtcattgaaatgctgcgtggagcaggcgcgctcggcgatttgccggaaacatcgcaggtgtcgtttttttaa

SEQ ID NO: 986 - DNA, 2796 bp, Anaerotruncus colihominis
atgaagcgtgtcctttcattgatacttgcctgtattttgctggcgggctgcatctcggcggtggtgctcgcggagggtgcagccgatccggttctcgacaccggcgtcgttgtcaccgtttcagttacaggcagcggtgaaatcaaactgagcgagagggatgactcgtctaaattttatccggttgtcaatggccaggcggctgtccccgcaaataccgcaatcaaaatcgaagctgttcccggcgagggccagcggcttttaagccttgccgcaaagggcatcgcattgacaccgccgtatacagtatctttccagtctgcggacatggacaaaaccattgccgccgtctttgaaccgatgcagtattctgttacatatactgctcccaccggtggtacgctgtccgtcacgaacagcggccagcccgtcgcgagcggtacaaagcttgattggggcacagtgctgactgtcgcggcgacgcctgacgagggccatgcactcaatacgctgacggccggcggcacgccggtcgcaagcggcgcgacttttacgctcaagcaggatacgacggtcgcggcgtcctttaaggcgctccagcattccgtcacttatgacgcgcccgttaacggaacactgtccgtcacaaacggcggccagcccgtcgcgagcggtacaaagctcgactggggcacggagctggtcgttacagcgacgcccagcgacggttatgttctcgatacattgacggccggcggcacgccgattgcaagcggcgcgccctatacgctcaagggtgatattctctttgcagcagctttcaagaccgcggacagcgtaccggttgagatccccgacacacagccagcggatggcaagcttacaatttattacaatggtcagccattgacggcagatacgaccctgcctgttggagcgcagctcgaattccggatcgtccccaatgatggcaaggagcttgtaacgcttactgtcaacggcgaaatcatctatgatctcaacagtccggcccgtgcggccgcccataccggcgatacaatcacggtcccctataccgtcaaggaagcggtcacaagcgttgcagccaccttccagacggctgcgaagcgtgatgtcaccgtcacgcttcccacgcttgttaccgagcagggaacgctgactatacgcaacctgacgcagaacaaggttgtcgcggccggaaccggcaccgttcagacaggcgaccggctgcaatttgagttaactccgaaaagcggttatcagatcaccgctttcaatgtaaccggggtcaacgagaatatgcccgctctgccaagtcccggacgcgcgctgacatttgccgccgccgtcaaaagcgacgcgacggctttgacagtcacagcctcgcttggggcctatgcgccgaacggtgacaagggcagcgtcgccatgccgaccggcgtgtttgacgatgacggcgacacgctcgaggataaggacggcgacgccttcgatatcgattctattgcaggcgacgggcgtattacgcttgacggtgtgcgtccaaaccgcaccttctatatccagcttggagacgacagattcaacccgacaaccatcctcgacgacggctgcatggcaactgcaagccaactggctgacgacagtctgttccgaatttcaattgacaaggagggcgacggcaaatctctgatccgttccatcacacaggtcaacgaaaaacggttaggcggttcgtccacacgcggcagctatctcaaggttgtactcaaagattcgacctcaaccgatgaaaaaaaagcgactgcaactgtcacctttaaggcgcgcaacaccctgaaaaccgctgacggcgacgagggtgactggcattccggcgattgtgcgacgcttgatatcactatgtggatcgccaacaccaaaacttccggttccgatcacaacattaatacaggcgataacgtctaccttgatcccgacgataacgactggaacgtttatgtatggggtgatgaccgcgcggcgcttgaattttatgcttctgacgacgccgacagcttctatgcgcgcctgtccacaaaggccgatgtcgatatctacagcgagtatggtgatccggtggatgcaaacctctggttttacgactttgtcggccatcccgaggttccctcctcttcccgtgcatatctgacgcttggcatcccatgggatgaggatgatgattacaccccctatcccaatgactgttatatctatgaggtcgattcgcgcggcaatctgaccgatgtcacaagtagtttctcttatagccgcagcgagcgggaaattcctggatggaccaccagaactcgcatcctgggtacatatattgtttcagacacggagttggatttggagcaagattacgacatcgatctcgacgataacgccaccgactcctatgaggagcagattaaagtgaatccttcaaccggcggcggcaacagcacgccgccggtcacacagacaatcctgccgccgcccacgaccagcggctcagatgggatttcctcggagcctgccgggagcgaacctgcggaatcttccgagcctgagcgcgaaacagcacagaccggacagatcgatgtgactgagccgacggttccacaggttacacagcccgcctccaaccagcgccgctccttcccattgttcggtgtgttagccgcggcggttgtcctcgcgtgtgcaggtggagccgcctatcttgtatatctgaaaatgcacgatgtctga

SEQ ID NO: 987 - DNA, 2181 bp, Anaerotruncus colihominis
atgggcctgtttgatgatcaattaaaaacgcgtctggaacaggaccgcgaatcctttgcggacgcgcttgaggcgcttggagagtctgtgacgggaaaagcagcagttacaggcaaaaatgggagcttggaggatgctgtgcacgaaatcctgacttggtttggagcgaaagcgccggagccgccgggcctgatggatgattttaacgaccggctcgattatatgctcaacccaactggaatccggcgccggacagtgaagctggatggaacatggtggagaaaggcggccggcccgatgctcgcctacacggcagaaggcagcgcggtggcgcttttgccgcgcaggtttggcggatatgcgtggcgtgaccctgcaaacaggcggacagtgcgcgccagtgtgaaaaccactgggatactgactggagaagctgtctgcttttaccggcctttaccgttgcaggcgcttaccctgcgggatttatttctctttgcggttcaatcggttgacagatgggatctaacgctgtttttattggctggtctgctggcgagcctgtttgggacggcggtcccgtttgtgacgcagatcctttttgcaacagtgatcccgatgggcggtatggagaatcttgcgcctgttgggatgttggcagttggagcgctgttttcactggctttggttggcctgacgaaatcgctggctgtcgaccgtatcgcgcagaaggtgcggctggtagtggaaaatgcggccatgagcaggttgttaagcttgcccgcgcagtttttccggactcacaatgcaggtgaactgcaaaaccgtgtggatgcgttgacgcaaatgtgcgcgttgctgggcgacacggtgctgacaggcgtcataaacggcgttttttccatcgtgtatctgtttttgatccgtgcgctggcccctgcgttgttcggtccgacaaccgttattctattggcgcagcttacggttatgattgccggcgtactggcaaaagctcatgtggcgcgtaagcgcctgcatattgcggcggatttgaacggattggtgttccggttgttttcgggtattcagaaaattaaactggccggggcggagcagcgcgccttttcaaaatgggcaaggtgttatgcagagaatgcggcgctgctttacaatccgccgcttctgctcaggatacagccagttttatcggcgctgattgccttgggaggatctatcctgctttattcctcggctgccaaatccggaatgcagacagccgattatatggcgttcgcatccgcatacggcttggtgaatggagccatgttgtcgttggcttcgatgacagagggcctggcggcgctgaggccgctggctgaactggccgagccgattatgaaggctgtaccggaaaccggcggcaataaaaaacagatccacagaatgagcggcggtgtggagctggcgaacctgtcgtttcgttatgcacacgacgcgccctggattcttgaccatatcaatttaaaaatccgtcctggccagtatgtggcgattgtgggcaaaaccggctgtggcaaaagcacgctgatgcgcctgctgctcggctttgaaacgcctgtctcaggcgcggtctattacgacaaccgcgacctgcaaacgctggatttgcctgctctgcggcgcaatatcggcgttgtgctccaacagagccgtctgtttgccggcgatatctattctaatatcgccatttccgccccgtggcttaccatggacgaggcgtgggaggcggcaaagctggccggcatggacgaggatatcaaaaaaatgccgatggggatgtatacgctcatcggcgaaggcggcggcgcactttccggcgggcagcggcaaaggctgatgatcgcacgggcgatcgcttcaaagcccaaaattttaatgtttgatgaagcaacctccgcgttggataatatcacacagcggatagtatccgattcgctcggtcaactgagatgcacccgcattgtgatagcccaccgtctttccacgatccgccaatgcgaccgcatcctggtgcttgacgggggaaagattgtggaggacggcgcttatgacgagttgatcaccgccaaaggcctttttgcggagctggtcaggcgccagacgcttgatatggcgccgctgtaa

SEQ ID NO: 988 - DNA, 3756 bp, Anaerotruncus colihominis
atggtgaacgtgaagccggtaacgcagggaaagacaacgcgtatgagtttttcccacatcgatgaggtcctgcagatgcccaacctcattgaggtgcagaagaattcctaccagtggttccttgacgaagggcttaaagaggtgttcaaggacgtatcgccgattaccgattatcaggacaacctggtgctcgatttcattgattatcaccttgacgacaagccgaaatacaccattgaggaatgcaaggaacgcgatgcgacctacgccgctccgctgcgcgtgcgtgccagcctgctcaacaaggagacgggcgaggtaaaagagcaggatattttcatgggggattttcctctgatgacggacagcggcacctttatcatcaacggtgcggagcgcgtcattgtttcgcagcttgtgcgctctccgggcgtctattatggatcgtcccacgacaagagcggcaaggagctttacaccacgacggtcatccccaaccgcggcgcatggctggaatatgagacggattcaaacgatgtattttatgtccgcatcgataaaaaccgcaagctgccggtgacgacctttgtgcgcgcgctcgggtttagttccaacgaatcgatcatcgactttttcggcgacgacgagcgcatcatggccacgctggaaaaggacggcacggccaatacggaggaggcgctgctcgaggtctaccgcaagctgcgccccggtgagccgccgacggtcgattccgcgcagagccacattgattcgctgtttttcgatccgcgccgttacgatctgtccaaggtcggacgttataaatacaataagaagctggccatcacgccgcgtattctcgggcgcaccacgtcgcgtcccgtcgccgatccgctgacgggcgagctgctcgccggcgccgataccgttttgacgcgtgaattggccgaacgcatcggcagggccggcgtcgacacggtttatatcaggatcggggacgaccgcgagatgcgcgtgctttccaacggcatggttgatatcaaggactttgtcggttttgactgcgccccgctcggcattaacgaaaaggtccgcttcgctgtcctgcgcgaaattcttgacgcctgcgatggcgaggacgcgctgcgcgaggccatcgcggcccgccgcgacgagctgatccccaagcatatcatcaaggacgatatcttctcgtcgatcaactacctgtgcggacttggccatggcatcggcactgtcgacgacatcgaccatctgggcaaccgccgcatccgttccgtcggcgagctgcttcagaaccagttccgcatcggcttttcgcgcatggagcgcgtgatccgcgaacgtatggcgacgcaggcgcaggacatggacgttgtgacgccgcaggcgctcatcaacatccgtccggtcgttgcgtcgatcaaggagtttttcggttcctctccgctgtcgcagttcatggatcagaccaacccgctggccgaactgacgcataagcgccgtctttccgcgctcggaccgggcggcctttcgcgtgaccgcgcgggcttcgaggttcgcgacgtgcattacagccattatggacgtatgtgcccgatcgagacgccggaaggtccgaatatcggcctgatctcgtatctggcgacgtttgcaaagatcaatgaatacggttttgtcgaggcgccgtaccgccgtgttgacaaggcgacgggcgttgtcctcgacgaggtcgagtatatgacggccgatatcgaggatatgtatatcgtggcgcaggccaacgagccgctgacggaggacggcaaatttgccaatgaaaaggtcagcgtccgttaccgcgacgcggtaatggtctgtgaacgcgaaaaggtcgactatatggacgtttcgccgaagatggttgtatctgtcgcgacggcgatgattccgtttttggagaacgacgacgccaaccgcgcgctgatgggcgcgaacatgcagcgccaggcggtgccgctgcttgtgccggaggcgccgattgtggcgaccggcatggagtataaatcagcggtcgactccggcgttgcggttgtttccaagcacgcgggcgtcgtggagtccgtctcggccaacgagattgtgatccgcgacagccgcggtgaaagtcattcataccacctgatcaagtttatgcgctccaaccagggaacctgcatcaatcagcgcccaattgtcaaaaagggcgaggaaatttccgtcgggcaggtgatcgccgacggcccgtcgacggcgggcggcgagatcagccttgggcgcaacatgctcgtcggcttcatgacatgggagggctacaactacgaggacgccgttttgatcaacgagcgccttgtaaaagatgatatttatacctcgatccatatcgaggaatacgaaattgaatcgcgcgacacaaagcttgggccggaggagatcacacgcgatatccccaacgtcggcgacgacgcgctgcgcgagcttgacgaacgcggtatcatccgcgtcggcgcggaggtgcgcgccggcgatatcctcgtcggaaaggtcacgccgaagggcgagacggaactgaacgccgaggagcgcctgctgcgcgccatcttcggcgagaaggcgcgcgaggtgcgcgacacctcgctgcgcgtgccgcacggcgaatatggaatcatcgtcgatgtaaaggtctttacgcgtgaaaactgcgacgagctttcgccgggcgtcaatatggttgtgcgctgttacattgcgcagaagcgcaaaatcagcgtcggcgacaagatggccggccgccatggcaacaagggcgtcgtctcgcgcgtgctgccgcaggaggatatgccgtatctgcccgacggccgtccgctcgatatcgtgctcaatcccctgggcgttccgtcgcgtatgaacatcggacaggtgcttgaggtccacctcgggcgcgcggcggcggagcttggctggaaggtcatgacgccggtctttgacggcgcggacgagacagatatcgccgactgcttggaacaggcgggcctttcccgcgacggcaagacgtggctgcacgacggccgtaccggcgagctctttgacaatccggttacggttggctatatgtattatctcaaactgcatcacctggtcgacgataagatccacgcgcgttcgacaggcccgtattcgcttgttacgcagcagccgctcggcggtaaggcgcagttcggcggccagcgtttcggtgagatggaggtctgggcgctcgaagcgtatggagcggcctatacgcttcaggagattctgacggtcaagtctgacgatgttgtcggacgcgtcaagacgtttgaatcgatcgtcaagggcaaaaacgtaccgcagccgggcatccctgaatcgtttaaggtcttgatcaaggagcttcaatcactcgggcttgatatgcgcgtgctagacaaggacaacaatgagatcgatctcaagcagacctttgacgacgacgacaatatggggttgaccccagttgacgatgcgctgatggacggcgtcgaagtcccgtccgagtttgaggatggctttgatatcgagcatcccgatccggacgccgacgccgacgcggatatcgatctgctcgacgtcgacctgacggacgatgacattgaggaaagcttcgacccaattgaggagcttggccttgacgggatcgccaatgacgacagcttctaa

SEQ ID NO: 989 - DNA, 2637 bp, Anaerotruncus colihominis
atgaagaaagtgctagcatccatccttgcgttgtgtatggttttcggaacagctatcacagcggcggcggacgatgcggcggccgacaacataaacaacgatgttgtttatgaagttgtaaccgttgatgtcgaagacctgatggtcgagatcgcccaacggcccgcgatgtacgcggcgaccggtaacttctacggcaataagctcactgggaacgccaagacgatctataatgatatgctcagttattttgagaatatcgacaatggcaccggcgattgtgtcagtaaatatactgtgaatggtacagccgccgaggttcaagaggctcttgcagcgaacctgatggaccacactgaactgcttaactggtttggaaaaggagcaggcaacaatatttcctatatttctggcggcggaatctgctatacctatttcccggttattgaggactatcgtgtccccggttcggaaaaaaaggatacatataatggactgtcgggttcctattcctattggaagattgactccaataagggcggagatcgcgccagcgcacttgcaaaagctgccgagattgtggcgaatgccagtggaagcgattttcagaaggtccgttatttcaacgaagccatctgcaatctgaccacctatgatttccccgcgcttgaggatggtatctatgatgatacctaccagatgatcaacgcctttaacggaaagcccgttgtctgtgaggggtatgccaaggcgtttaagtatctctgcgatgaaagcaatatcggctgcctgatcgtagagggccacattggttccggcacaggcgccggcaaccacatgtggaattacgtcgagttggatggcaactggtatcttgtcgacgtcaccaacaacgacggcagtgatgaaagcatggtcaatacgcccggcgattttacggaaaatctcttggctatcggttctggtaatccgtattacagccttcttggcttcgatccgctgtattacaccgacggcacaccggtcccgacgccgccggccgtcacgctcagtgtcgaggattatacggagcttaccggtgaaaaggtcaacgtcgcagttgaatcgagcacctcgaagcaggtcgttctcaaattgacgttggaaaatccgagcgcctctatgccggtcgttgcgcagactgatgtgtccgttgcgccggccgctgaaattgccggcttcaaacaggaaaccgacaagatcaccatcgactttgccaagcgccttgacgccggtacatatactgtcaccatcaagaacaacgaggattatcattacaattccgtttcgttcgaggtgcctgaggtcgacaagtatgccgctccggtgattgcggttgcttataacgaaaatcacaccagcgcggacattacaatttccaacccgaacaatgcgggcacaatcaagtatacggttaatggcggtgcagaaacggtttataccgattccttcacagtcgatacaaatacgcctgaccaccgtctcacaaagcagatttccgcttatgtcgagagcacagacgaggatttccaaagctccgataaggcaaaccaggttgtcacgctcgtggccgaccccgattcattccatgttgttgtcacccccgtggcgggcttgaccggcacgatcgctgcggatacagttgtcgcttcgatggaagcgaagaatgttccgtacagcctcgatgttatgtataaccttgaaagcggttcggagggcagcttcggcgttgatggcgataagattgttgccaatggcgacgtcgccccgggaagctatgtcgtttacgtttccgcacgtccgatcgttgacagcggcaatcttgacagcggtgatccgtccaatctcggaattggttacggagaggcggtcattgtgatcaacagccagccgacttccggaggcggctcctctggcggcggcggttcctcctccggcggcagcaagctgaacaacaagggcagcgtttcgaccggttcaaccggcggcgcgcgcgtcccggtatctccggccgctgcaggtaaggaagccggaaaatcggcagaaaatgcgatcaaggatgcgttggccaatggctccaacacggcagtcgccccggttgtcatccgcaatggctcgtccatcggcgcagacgccctcaaggcggtcaaagatgcggttgatcaggcagcggccggcactggcgtgaatgtcactccggtcgtttggtccgatgtcgtcaggaatggcgttgtgcagtcacgtatgtatatcgatcctgcaaagtacgcttcgcttacaggcgatatcaagcttggcgttgaactgtccgctccttcggtttccacgctgtttgacaagtatttctccaacaatatcaggattgtcaaatttgagcataccggcccgttcggcatggcgattgaagttgctgtgaagctcgatctgaccaacatgaatacggagaatctgtatttctattcgtatgacgctgcgacaaacgtctatacgccgattgccaatccgatgtactacatcgatacgaacggctatctgcactttactgtttccaatggcggacatgtcatcatttcagacggtccgctggcacgcaaataa

SEQ ID NO: 990 - DNA, 3225 bp, Anaerotruncus colihominis
atgaatcagcgggggctaaaagccgtcagtctcgtgctggccgcggctataacctgcgcgtccgtgctttccggctgcgcgaagtcaaacggcacgcagagcaccgccgcatccccggcttcgtccgaagctgctcaaacagaccaacaggtcgtctccgggccgttcacaggaccggacgccgccggcgtcaaaaaaagcgaaactgtctttatcaatcttgacccgaccggcaaaccatatgaaacgacggtcacagactggatccacagcgatacgcctgacgccgtattaaacgacctgtccgacctgacaggcattgaaaatatcaagggattgcagcagccccgccaggagggcgatcgcctgacatggaaaatggagggcagcgacctgtattacacaggtaaaactgacaaggaaccgcccgttgatgttgaaattacatatacacttgatggcaaatccatcgagccgcaggagctgccgggcaaatcaggacaattgtccatgacggttcggtttcgcaatacacaaaagcagcgcgtgaccatcgccggcaaggataccgatatgtatacgccaatgctggttgcggcaggcatgtcgctgccggacgataccttccaaaatgtcgaggtcagcgagggcagcgttatttcagacggcagcaaccagatcgtcgcctttgcgtgcgtaccggggcttaacgacagcctggctctcgggacctatcgtatacaggaaatcaatgatttggatttcccagaggaattcactgttaaagcggatgttcaaaattttgaaatgggtcctgttatggtcgccgtcacacctgagcttccggatcttgacgaactgacaaagagcgatgaatttgacgatatgcgccaagacctcactgatttgcaggatatgcaggacgatctgaatacaatcgatcctgaccgcgacattcgctcgcttctgactgatccaaatcgtaccgaagcggcgcgtgtgattacaaacgatgtattcgatttttatgatctcaataaggatctgcttgatatccttcccaaatatgtaactgatgaaaatattcgcctttatgaccgtatccggcatgatattaaggacggagcgttcgattccctgctggatgatgatgagcttgccgatctgatcgatctggtcgacgatttaagccccaatcgcttgcaggagcttgccgacgattacgccgagctgcaaaaaaacgataagctgcgcgcggcgcttaaacagcttatgggcgcagccaacccggacacagaaaagctgcttgatcttttgatgcaagtatatggcgcaatcaacagcgacaccgccgtcaaggaggctggactgaccgcgctcaacgggctgatccagcgcccggagctgttgaccgcgagcgcccaggcggccttgcggcagggcgtgcgcgacgcgctgatgaaatgcatcaatgtccaggagcagacggcagccggtatgcttcagatggtactagcacaatcaaagctgaattcacgtttgcaggcagaacttgtagccgccagctacgccgggctgattgttgatccgtccaggacgcgtgctattcgtcatgccgatgacgttgcggacgcctcctccatcctggacgaggacgtttcctccgcgcctgacgaggatgcttcctccacacctgacgaggatgctccctccacacctgacgaggatgctccctccacacctgacgaggatgctccctccacacctgacgaggatgctccctccacacctgacgaggatgctccctccacacctgacgaggatgctccctccacacctgacgaggatgctccctccacacctgacgaggatgctccctccacacctgacgaggatgctccctccacacctgacgaggatgcttcctccacacctgacgaggatgcttcctccgcgcctgacgaaaaggctccgactgtctttgaatcgataaccgaaaacacagttgtcaatagaacgcggacattggctgcattcacaaataatgcagacggcgacacgtcctctgcgccgaacgatggcacgtcctctgtaccgaacggcgacacgtcctctgcgccggacggcgacacgtcctctgcgccggacggcgacacgtcctctgcgccggacggcgacacgtcctctgcgccggacgacgatacgtcctctgcgccggacgacaatacgtcctctgcgccggacgacgatacgtcctctgcgccaaatgatgatacgtcctctgcgccatttgtcccctccgagccaatcaaaccgcttgcctccgaccgcgccgacctttacaaggaaattacaaccgatacaaatgccggttattatctgattgaaggtgcaatcgacgcatatgtgaacaatgccgatccagccgagctgcttacgctggcaaagcagttcgacccacaggctgccagccaggtagaaagtatgcaggccatacaggcgctgcttggtcaaattgggccggatcgtctcacttccctgctttcgcaggctcagacatgtgaaaagtacctctccgatctgttgacagcggttcagcagcctgagttgaaagaatatctggaaaagctgatgagggaccttcaggacaacgaagaaaacctgcataccctgatcctgcttctcagacagcttgatgacatgaatctgcttgacgaagtcgaaaacatcgacgacctgcgtgaggacctttccgatctgcgtccgattgtacaatcactgcggcgtgatctcgaccgggcagagatgaacaagagcctgcacgcttcccctgaaacggtcgataccctactgcgtatgaaggacgacctggaggaacaccgcgatatcatggaaacgatgcgcaacatgctccaggaagaaaaagtaaccctttctcgcagcatgatcgcaacgcttgaccgcctcgaggccaaagacgcggcaggcagcgccgtggaaaagcttgacgatcttgacgagctgcttgaacgcaaggatcgttataccgagctttcagacgcataccgtattttcacggccgcgccagacagcatggataccgatgttaaatttgtaatgaaaacggatgagatcaagctgcccgatgatgatgaacccgtccagacgcctgtgcaggagcaggaaggttttgtcgcctggttcaagggcctattccagtcctga

SEQ ID NO: 991 - DNA, 2640 bp, Anaerotruncus colihominis
atggacactggaggaaaagatatgccgaaacagctggacaaggtctacgaccccaagcaggtcgaggacaaaacgtaccggttctggcaggatggcggatattttcacgccgagccgaacccggacaaaaagccgtatacaattgtgattccgccgccgaatatcaccggacggctgcatatggggcatgcccttgacgagacgcttcaggatatcctgatccggtggcgcagaatgcagggttatgaggcgctctggctgccgggaaccgaccatgcgtcgattgcgacggaggcaaagattgttgaagcgatgcgccaggaaggcgtgaccaaggaacagctcggccgcgagggctttttagagcgcgcctgggcatggaaaagggaatacggtggccatatcctcgatcagcttaaaaagcttggttcctcctgcgattggcagcgcgagcggttcacgcttgacgaggggtgcagccgcgccgtgcgcgaggtattcgtgcgtttctttgagcaggggctgatttaccgcggcgagcgcattgtcaactggtgcccgcattgcctctccacaatctcggatattgaagtggagtatgaggagaaggacggctttttctggcacatcaattatccgatcgtcggcacggacgatgtgcttgaaatcgcaacgacacggccggaaacgctgcttggcgatacggctgtcgcggtgcatccggacgacgagcggtataagcatctgattggaaaaatggtgctgctgccgattgtcaacaaacaaattcccattgtcgccgacgaatatgtcgagatggattttggaacgggcgttgtgaagattacgcctgcacacgacccgaatgacttcgaagtcggcctgcgccacggcctgcccatcgtgaacgttatgaacgacgatgcgaccatcaacgaaaacggcgggaaatacaagggtttgacgcgcgaagaatgccgccggcagattgtaaaggatctggaggacggcggttttctcaaagctgtggagccatataagcacaatgttgggtcctgttaccgctgcggcagcgtcattgagccgcgcgtctccaagcagtggttcgttaagatggagccgctcgccaagccggcggtcgaggccgtgcgcagcggccggacgcgctttattccggagcggtttgataagatttatttcaactggatggaaaacatcaaagactggtgcatttcccgtcagctttggtggggccaccgcatccccgcatggtattgcaccggctgcggtgaaatgatcgtaagccgcgaaacgccgcaaacctgcccgaaatgcggctcgcatcggcttgagcaggaccccgacacgctcgacacatggttctcgtccgcgctgtggcctttctccacgctcggatggccggacgatacgccggagctgcgttatttctatccaacggacacgcttgtcaccggatacgacatcatcttcttctgggtggcgcgcatgatcttttcgggcttggcgcatatggacgaggcgccgtttaaaacggtgctgatccatgggcttgtacgcgacgcgcagggacgcaagatgtcaaagagtttgggcaacgggatcgatccgctggagatcatcgaccgctacggcgcggacgcgttgcgcttcacactggcgacgggcaattcgccaggcaacgatatgcgtttctcggatgaaaaagtgaacgcgtcgcgtaactttgcaaataagatctggaatgcgtcgcgctttatcctgatgaacctgtcggacgatgtagagccggggctgccggagacactcaatatcgaggataagtgggtcctttcgaaatacagaacgcttgtgcgcgaggttacggacaatcttgaaaaattcgaacttggtttggccgttcagaagctgtacgattttatttgggatattctgtgcgactggtatatcgagctgtgtaaatcacgcctgcaggcgggcggcgagacgtccgaggcggcgcagcgcgtgctggtgtacgtcatgaccggcacgcttaagcttctgcatccgtttatgccgtttatcaccgaggaaatctggcaggcgctgccgcacgacggggaaagcatcatggtcgcgacgtggccgcaggccgatgccgcgctcgatttctccgccgacgaatccgacttcgagatgattatgcaggtgatccgcgccatccgcgcccgccgtggagagatgaacgtgccgccgtcgaaaaagacgcgtctgtttatcatgacggcgcataaggctgtatttgagcagggacgcccattttttgcgcgccttgcgttcgcttccgatgtggagcttggcgacagctttgacgcagacggttccgttcaggtcgtgaccgacgccgcgcgcgtctttatccctatggacgagcttgtggatcgggagaaggagcttgcgcgccttggacgtgagaaagccgcctgtgaaaaggacatcgcggcgctgtcgtccaagctggacaaccccggctttgtcgccaaggcgccggcgcaggtggttgacggcgagcgtgccaagcttgcaaaagcgcgtgagcggcttgcaaagatcgaggagagtatcgctgcattttcttaa

SEQ ID NO: 992 - DNA, 3084 bp, Anaerotruncus colihominis
atgaatctgacaaagcttgtactaaaacgccccgtctcgatggttatgatcatcctggcgttgattgtatttggtttctcggcgatcacaggcgctccgcttgagctgatgcccgagatggaaatgccggttctgcttgttatgacgacatatcctggcgccggtccccaggaggtcgaggacctcgttaccagccagttggagtcctctgtatccacgcttaacggtatcaaaacgatccaatctgtgtcgcaggacagcgtctctttgatggttcttcagcttgaatacggcaccaatatggatgtcgcgcacatggatttgcaggaaaagctgaatatgtacagcggcgccctgccggacgatgcgcaggatccaatcatcattgagatggatctgaattcgatgagcgcaattacgctgtccgcgcgcgccactggagatatcgatctgctttcttatatcgatgaggagattaagccggagtttgaaaagcttggcggcgtcgcatcggtcgatgtttccggcggacaggaaaattatatcagcgttgagcttgatgagcagcgccttaaacaatatggcctggatatgagcacgattgtcagtttcatcggtgctgctgatttttcaatcccggtcggcgacattgaccgcggcgatcaaagcctgtcgttgcgcggcggcgtcagctatgataccgtcgagagtctcggaaatattccgatcacgctgcgttccggtcaggtaatccatctgtccgatgtcgcacatatctacgacgcaactgctgacgcagattctatcagccggtataatggcaatgaaaccgtcagtctcggcattaaaaagcgtcagagcgcaggtaccatcgaggttacagaagctgtcgtcaaaacaatggaacagatcaacgcgcgcaatatgggcgtcgaattgtccgttatcaatgatacgagcgacagtatccgcagttcggtcaacagtgttatcaaaacactgatttccgctatcatcctctgtatgatcgtactgtttatcttcttcggcgactggaaagcttctctaatcgttggcagttctatccctgtttccgtattgacaacgctgatcctgatgaacgcctttggattttctttcaatattgtttcattgggcggccttgtcatcggcgtcggtatgatggtagataactcaatcgtggttctggaaagctgcttccaaaggcgggaacgcaatttgactttccgtgacgcagccatcgaaggcgcgcggattgttacctcgtccgtcgcagcgtctacgcttacgaccgtcgtggtattcctgcccataagcattatggagggactttccggacagatgttccgtcagcttggctttacaattgtcttttccctgaccgcttcgctgatctcggcgcttaccattgttccactcctgttttaccggctcgcgccaaaggagaaggaggattcccatgtcaaccgtgtcctgaataagataacgattgcatacggaaatttcctgaaaaaaacgttcaggcataagctgcttgtagtgcttatctcagtcggactgcttgtcgggtcatttatgcttcttccgttcattcattttcagctcatgccggatattgaccagggtaccatttcgatttccgtagagacaaagccaggcctcaagctggaaaaagtggatgcgcttatgacgcaattggaatccatggttcaagagtccaccgacgttgaacgctattacttgactgccggcggcggcgcaatgaccagcactggaaacgaaagcggttctctgactgtttatctgaaagcagaccgtgaacgcagcacaaacgagtggatcgatgaatggcgcgaacagacaaaggatattcccaactgtgatatcagcatcagcgcacagagcatgatgagcttttcttccggaggatctgtcgatgttaacctccagggcaacgatctcgatttgctgcgtgaagcgtcaaaggacgttgaagcagtgatgggacagaatcccaatattgtccgcgtatcctcaaccctcacttcgggcaatccacaggctgagattgttgtcgaccccattaaggcgactgcggtcggcatgacgcctcagcaggtggttggaaccgtatacaacatggtatccggtacctctccggccactatggaccgcgatggacgtgaatatgacattcgcatcgagtttcccaaggaacgtttccaaacggtatctgatctctccgggttgattttgacttctccaagcggcaaacaggtcccgctgctagatatcgcatcaatcgaatattccaacgctccgcaaagcatccagcgtaaaaacaatcaatacattgtcacaatcagcggtcagcctacgacagcctcggctctgacagccggcgaagaaattaaacaggcggtcgcagagcttgaactgccagaaggcgtggctgtcacacagaatcaagccgatgaacagatgatggaggagtttggcgcattattcggtgcgattgcaacggctgtcttcctcgtttttatggtcatggccatgcaatttgaatcgtgcagattctcaatcatcgttatgatttgtattccattctctctgattggttcgtttggcttgatgctgttgtcgggtgttacaatgagtatgccgtccttgattggatttttgatgcttgttggtacagttatcaataacggtatcctgtttatcgatacggcaaaccaataccgatccagtatggacgccgaaacggctcttgtctatgccggccgcagccgtctgcgtccgattctgatgacgaccctgacaacggttttatcaatgattccgatgggccttggaatcggcgaaggttccgaggctatgcagggaatggcagttgtaatcatcggcggtttgacagcttccaccattctgacgcttctcctgctgccgaccttctatctgctgttccgcggacggccgcataaggaatataaaaaagaggaggacaccaagaacggaaatacccatcccgatctttcccaggaagaactgattacacaataa

SEQ ID NO: 993 - DNA, 2751 bp, Anaerotruncus colihominis
ttggctgtcggcaaaacgcctgagcttgccaacagcccgtgttttgaggaggttatcatggcagcaaaaccaaaatcaggttcgcgcggcaaaggcggcagcgccgctgcgcgcaagcgcaatgccgctcaaaagcgcgccaaacgccagatgcaggctgtaatcctgtttgcagtcggcgtgctggtcggcgcgctgacgctcgtttctggcgcaagcgcctggaattggcttcacaacgccctgtttggtctgttcggctggggcgcgatctttgtgtgcgtcctgctgatctacatagcggcattgcttacgatggacaagcctgtcaagggacgcgcctggatgggcggatttttaattctttttttctgcgcgtcgcttcaaatctttgtgatgggtatgccgcagtccgctgatgaaaacatccttgaaatgcttgttgaatgtattgtggcgggcatcgacgtcaaaagcggcggcctggtcggagcgctggttggcgtgccactgctcaagttctgcggcaagctcggcgcgggtattatcatcgtgcttctgatcttcgtgttcctgatgctgacgaccggcggcacgctgatcggcatcgtccaggcggcgcataagcccgtgcagaagatcggcgagacgtacgccgaccagatggagcgccaggagcagcggcgcgccgcccgcgcggccgcgccgccaaagcctgcgcgccagcgcaggccggcgcgcatcgatattccgcttgagggcgaagaccgcacgggcgccgcgctggctccggccacgccggagccgtccgccgaggcggactcggagccgcaggctccggcagcggcggcgcgtgcggatgctccgcaccatccaaagccgtcgattgatatcccgcttgacgagccgttcgacccggcacgggaatccggattctccctgatgccggccgacgaggcgatgcagtttgtcgccgctcctgagccgtcgatcgacgagcttgtgacaaaggctgcgaccgatacggggcgtttttccttctccgctgaagaaacgccctccttcgacagcttcaccatgccaaaggagccgcacagcggcgccgtgtccggtacggtcatcaatctgccgccgattctcgacgatccaccggataaacctgacgtcatgcctgaggagccggccccggatgctgctctatgggacgagccggggcaggaacaggcgcatgtcccggaccctcccgccgaaccggagccgcagcccgtaccgccggcctatcgcaagccgccgctctccctgcttcatgaggcgcgccgtacaagcgaatcggatgtcacagaggagatgaaggcgaatgcgcagcgtctcgtcgacacgctcgcgtcatttggcgtgcagacgcgcatcgtcgatatctcacgcggcccggcggtcacacggtatgagcttcagccgtcggccggagtcaaaatcagccggattaccgggcttgccgacgacatcgccctcaacctcgcctcggcgggcgtgcgcatcgaagcgccgattcccaataaggccgccgtcggcatcgaggtgcccaataaggtcgtgagcgccgtttccatccgtgaaatccttgaagcgcgcgaattttacgaagcgaaaagcaagctgtctgttgcactcggacgcgatatcgcaggcaatgtcacggttgccgacatcggaaaaatgccgcacctgctgatcgccggctcgaccggctccggaaaatcggtgtgcatcaattccatcattatttccctgctctttaattcgacgccggacgaggtccgttttctgatgatcgatccaaaagtcgtcgagcttggcgtttataacggcatcccgcaattgctcgttccggttgtgaccgatccgaaaaaagccgccggcgcgctgtcatgggctgttaccgagatgctcaagcgttataagctgtttgccgataactccgtgcgcgacttgaaatcgtttaaccaccttgccgaacgtactgaaggtatggaaaaaatgccgcaggtcgtcatcatcatcgacgagttggccgatttgatgatggctgcgccgaacgaaattgaggattatatctgccgtctggcgcagatggcgcgcgcagccggtatgcatctgattatcgcgacgcagcgcccctccgtcgacgtcatcaccggcgtcatcaaggcaaatatcccttcccgcatcgcctttgccgtgtcctcgcaggtcgactcgcgcaccattctcgatatgggcggcgcggaaaagctgcttggccggggcgatatgctgttcagcccggtcggcgctcccaaaccgatccgcgtgcagggctgctttgtcaccgacgaggagattgaaagcgtcgtatcgtttatcaagaacgattcgtccgccgcatatgacgaatcaatcgtgcaggaaatcgacagccatgttgtcgctggaaaaggctccaagggtggcggcgcggcctctgaaaacgcggatgccgacagcggcgaggatgaaatgctcatgcccgcgattgaatgcgtcgtggaagccggcatggcgtcgacttcgcttttgcagcggcgtctcaagctcggctatgcgcgcgccgcgcggattgtcgacgagatggaatcgcgcggcatcgtcggcccgttcgagggcagcaagccgcgtcaggtgcttatttctccggaacgctgggctgaaatgaagctgaaccgccaggaataa

SEQ ID NO: 994 - DNA, 2160 bp, Anaerotruncus colihominis
atgtcaatcaagatcgcgctcgcaggcaatccaaactgcggcaaaaccacgatgtttaacgatctgacaggatcgtcgcagtatgtcggcaactggcccggcgtcactgtcgagaagaaggaaggcaagctgcgcggacagaaggatgtcattatcacggatctgcccggcatttacagcttgtcgccctatacgcttgaggaggtcgtcacgcgcaactacatcatggatgagcggccggatgtcgtcgtcaatctggtcgacgcgtccaacatcgagcgcaacctgtatctgacgacgcagctcacagagatgggcatcccagtgctgatcgcgttgaacatgatggatatcgtcaagaaaaacggcgaccgcatcgatacgaaaaagctttccgaacagcttggctgcgagattatcgagacgtcggccgtcaagggcgaaggtttaaaagcgctggcggactgcgcggtcaagatggcgcggtccggtgtgaaaaccacgccgcagcacacgttcgaccagcgcgttgagcaggctctttccgaaatcgcatctctgatcagcgatgtggttccggccgaaagtctgcgctggtacagcgtcaagctgtttgagcgggacgaaaaggcgatggaacgcttttcattcgctgccgatacaaaggagcacctcgagcagatcatagccggctgtgaaaaacagttcgacgacgacagcgaaagcattattacaaacgaacgctaccagtatatcggcacactgatgcagagctgtgtacataaaaagaaatccggtatgacaacgtcggataagatcgatcagattgtgacaaaccgcatcctggcgctgccgatttttgcggtggtcatgtatattgtttatttcgtatcggtttcctggcttgggaccattgttacagactggacgaacgacacgttgttcgctgaaacgattcagcctgctgtcgcgggcgtgctcgagagcatcggcgcggccgcctggctggaaggtttaatcgtcgacggcatcatcggcggcgtgggcgcggtgctcggtttcgttccgcagatgtttatcctgttcttcttcctgtccatcctggaggactgcggctacatggcgcgcgtcgcgtttatcatggaccgtattttccgtcgtttcggactctccggcaagagcttcatcccgatgctgatctcctcgggctgcggcgtgccgggcgtcatggcgacgcgtaccatcgaaaatgaaaaggaccgccgcatgacgatcatgacgacgaccttcatcccctgcggcgcaaagttgccgatcatcgccctgatcgccggcgcaatgttccccaatgtcacctggatggctccggccacctatttcttcggcatctttatggtcatcatctccggcatcatcctcaagaaaacgaagatgttcgccggcgacccggctccgtttgtcatggagctgccgcagtaccacttcccggcgccaaagggcgtgctgatccacatgtgggagcgcggcaaggcgtttatcatcaaagccggtacggtcatctttgtggcctgcggcgtaatctggttcctccagagcttcggttttggtcctgatggattcggtatggtcgatgacgagaacatgagtatgctggccgctatcggcaatgtgctcgctccgatcttcgccccgctcggctttggaaactggcaggcggctgtcgcgagcgtctccggccttgtagcgaaggagaacgtcgtcggtacgttcggcgttctgtttggactgggcgaggtaggcgaggacgatccggccctgctggccgctctgcccacactgttcgccactcatgcaagcgcgcttgcgttcatggtctttaacctgacctgcgctccgtgcttcgcggccatcggcgcgattcgccgcgagatgaacagcgccaaatggacatggttcgccatcggctatatgacgggtatggcttatgtgatggccttcatcatcaatcagctcggcggcacgattttctatggcgttccctttggaatcggccaggtgattgcgctcgtgcttgtagccgctttgctgtggcttttgttccgcagctataaacccgccggaatgtccaagcgtccggccgctgccggcgcccgtgcgtaa

SEQ ID NO: 995 - DNA, 3621 bp, Anaerotruncus colihominis
ttgccgcttgcaaaagaaaagaggggttcgcttttggaatttaatgtatttgaatcgataaaaatcggactggcgtcgccggatcttgtccgcgaatggtcgtggggcgaggttaagaagccggaaaccatcaactaccgcaccctcaagccggagcgtgaagggctgttctgcgaaaagatctttggaccgacaaaggactgggaatgctattgcggccgctacaagcgcatccgctacaagggcaaggtctgcgaacgctgcggcgtcgaggtcacgcgttccaaggtgcgccgcgagcgcatgggccacatcgagctggccgcgccggtttcgcatatctggtacttcaagggaacgagcagccgcatggggctgctgctcaatatgtcgccgcgcctgctggagaaggtgctctatttcgcgtcgtatattgtcatcgatccgggcgttacgaatcttaaaaaatatacgctgctttccgaaaaggaataccgcgacctcaaggaggcgtatgaggacgatttccgcgccggcatgggggcggaggcggtcaaggagctgctggccgagctggatctcgacaagctttcggaggaactgaaaacggatcttgaaacagccgccggccagaagcgcgtcaaactgctcaagcgccttgaggtggtcgaggcgttccgccagagccacaaccggcccgagtggatgatcctggatgttgtgccggttattccgccggatatccgcccgatggttcagctcgacggcggccgttttgcaacgagcgacctcaacgacctgtaccgccgtgtcatcaaccgcaacaaccgtctgaagaagctgctggagcttggcgcgcccgacatcatcgtgcgcaacgaaaagcgtatgctccaggaggcggtcgacgcgctgatcgacaacggccgccgcggccgcccggtcacagggccgagcaaccgcccgctcaagtcgctgtccgatatgctcaagggcaaacagggacgtttccgtcaaaacctgctcggtaagcgtgtcgactattcgggccgttccgttatcgtcgtcgggccggagctgaagatgtatcagtgcggcctgcccaaggaaatggcgctcgagctgtttaagccgtttgttatgaagcgtctggtcgatctcaaggttgccaccaacattaaaaacgcgcgcaaaatggtcgagcgcgcgagcgtcaaggacgtgtgggacgcgctcgaggtcgtcatcaaggaccatcccgtgctgctcaaccgcgcgccgacgctgcacaggctcggcatccaggcgttcgagccggtcctcgtcgagggccgcgcgctcaagctccatccgcttgtctgcaccgcctacaacgccgacttcgacggcgaccagatggccgtgcacgtcccgctttccgcggaggcgcagtctgaagcgcgctttttgatgctcgccgcgaacaatctgctcaagccgtccgacggaaagcccgtcaccgtcccgacgcaggacatggtgctcggctcgtattatctgacgatgctgcgcgaggaggagccaggcgccggcaaggtattccgcgacttcaacgaggccaccatggcgtatcaggcgggcgcggtcggacttcatgcgccgatcaaggtgcgcgtcacacgccaggtcggcgacgagcgcgtctcgcatatcatcgacacaacggtcgggcgcatcatcttcaatgaccccatcccgcaggatttgggctatgtagaccgcaacgacccggagcatgtgttcgatcttgaaatcggatttttggtgcgcaagaaggaacttggaaagatcatcgaccgctgtatccgcacgtatgggaccgccaagacggccgaggtgctcgaccgcatcaaggcgcagggctttaaatattccacgcgcggggcgatcaccgtcgccgtttacgacgcggtcatcccgcccgaaaaggccgagttcatcgcggcggctgacaagcaggtcgatgcgatcaaacgccagtatgaccgcggctttatctccgaggatgtgcggtacgagcgcgtcgtctcaacgtggaacgactgcacggccaaggtcaaggacgcgctgcaaaagacacttgacgagcgcaacccaatctatatgatggccgattccggcgcccgcggttcgatggaccagattcgccagctcgccggcatgcgcggcctgattgcgaacacatccggccgtgcgatcgaaatcccgatcaaggccaactaccgcgagggccttaacattctggaatacttcaattcctcgcgaggcgcgcgcaagggcctggccgacacggcgctgcgcacggcggattctggttatctgacgcgccgtctcgtcgacgtctctcaggacgttattgtgcgcgagcatgactgcggcacgcatgagggcattgtcgtctgcgacatcgtcgacagcggccgtgtcattgaggactttgtcgagcgcatgatcggccgctacgcggccgacgacgtgatcgatccgaatacgggcgaggtgatcgtcagccgcgatcagatgatgaccgaggccgacgcgcagcgcatcaaggcggcgggcttcacagagctgaagatccgcacgccgctcaattgcgaatcaaaaatcggcgtttgtgccaaatgttacggcgcgaacctcgccaacgggcagcctgtgggcgtcggtgaagcggtcggcatcatcgccgcgcagtcgatcggcgagccgggcacgcagttgacaatgcgcacattccatacgggcggtattgcgtccgccgccgatatcacgcaaggtcttccgcgcgttgaggagctgtttgaggcgcgcaagccgaaaaacagcgcggtcatttcgcatctcgacggcatcgtttcgttcgagaaagatcagaagggcggcgactttgtcgtcgtcaccgccgatgacggcgagcgttttgagcggcaggtcgtctatggatcgacactgcgcgtctcagaaggggacgttgtgcgcaagggcgacatgattaccgaaggcgcggtcgagccgaatgagattctcatggtttccggccatctggccgttcaggactacctgattaaagaagtgcagagaacgtaccggacacagggtgttgacatcaacgataagcacatcgaggtcattgtccgccagatgatgcgcaaggtcaagattgacgacggcggagacaccgggctgattaccggcgcgaatgtcgacaagagcgagcttctgcgcgtcaacgctgaaattgagcgtaaaaacgccgaggacggcggtacgcgccgtcccgcttcggggctgccggttctgctcggcatcacaaaggcgtcgcttgcgacggagagcttcatgtcggccgcttccttccaggaaacgacacgtgtgctgactgaggccgcgatcaagggcaaggtcgacaagctccagggattaaaggaaaacgtcatcatcggcaagcttgtcccggctggcaccggcacggtttcctacgattcgctcgagcttgtgaacgcgggcggaccgtccgaccacggcgactacgagtttattgccaacatcagcggcgccgacgatatgcagcccgcctga

SEQ ID NO: 996 - DNA, 2838 bp, Anaerotruncus colihominis
atgacaatagacaaacaaggagagatctgtccaatgtccgaaatggattacagcaagacgcttaacctgccaaaaactgatttttcaatgcgcgctgggcttccccagaaggaacccgtcatggtgaaaaaatgggatgaagaacatctgtatgagcggatgcttgagaaaaacgaaggcaagccgctttacatgttccacgatggcccgccgtatgcaaacgccaatattcatcttggcacggcgctgaacaaggtgctcaaggatatcattgtccgccagaagaatctctccggctttaaagcgccatatacgccggggtgggatacgcatggccttccgattgagctcaaggcgctcaaggagatcggagtttccagcgacatcgccccgattgagctgcgccgggtctgccatgattttgcgctgcgcttcgtcgagaaccagaaggagcagttcaaacgcctcggcaccattgccgattatgagcacccttatctgacgctcaagccggaatacgaagcgcggcaggttgaaatttttggagcgatggccaacaagggttatatttataagggattaaagcctgtatactggtgcccgacctgcgaaacggcgctggccgaggcggaaatcgagtacaatgaggacaagtgcaattccatctatgtcaagttcaatgtgatcgacgacaaggatggtgttttggagcgcctcggcgcgaaggatctttctaaaacgtttgttgtcatctggacgacgacgacttggactttgccaggcaatatggctatctgtgtcgggccggcatttgaatattgtgtcgtcgctgcaaacagcgaatattatgtaatggccaaggagcttgtcggggcttcgatgaaggctgccggaattgcagattacgaaatcctgggcacttgtctcggggaggagctggaatacatcacctaccagcatccgttccttgaccggcagtcgcctgtcattcttggcgaccatgtcacgttggagagcggcaccggttgcgtccataccgcgcctggacacggtgttgaggactttgatgtctgcgcgcagcattatccagagattgaggtcgtcgtaccggtcgataaatttggcaatctgaccgaactggccggagaatttgccggtctttcgacggacgatgcgaatgctgcgatcgtcaagaagctggcttctaccgggaacctgtttgccattgagaaaatcgtccaccagtatccgcattgctggcgctgtaaggacccgatcatctaccgcgcgacagagcagtggttttgttccgtcgacgatatcaaggaacagactgtgtccgagatcgaaaaggttgcgtttgttcctgaatggggccgcggccgcatgatcaatatggtgcgtgaccgcagcgattggtgtatttcgcgtcagcgtacctggggcgtgccgattccgattttctactgtaagcaatgcggaaaatatcatgtaaatgaaacaagcattgaggctgtcgcggccctgttcagggaaaaaggttccgacgcctggtatacgaccgacgcggcggatattctgcccgccggcacaaaatgcgccgcctgcggctgtacggaatttgttaaggaaacagacattatggatgtttggttcgattccggaacatcctatgcgtccgttatccacgacaatcccgatttgaagtggccggccgacctctatcttgaaggcaccgaccaataccgcggatggttccagtcatccctgctgacttcggtcgcatggaagggcgtcgcgccatataagacggtctgcacgcatggatgggttgtcgacggcgaggggcgcaagatgtccaagagccttggcaacggaatggaaccttctgaaatcaccgatcagtatggcgcggatatcctgcgcctgtgggttgcttcagccgattatcatgcggatatccgtatttcgaaggacatcctcaagcagctttccgaggtgtatcgcaaaatccgcaataccgcgcgttatatcctggggaatatcgccggctttacgcccgataaagatgcggttgcctttgaccggctgaccgggcttgacagatgggcgctcacacgtttcaatgaacttgtcaagacggttacagaggcgtatgaccgctttgaattccacatcatttatcatgcgctccacaatttctgtacgattgatatgtccaacttctatcttgacgtgatcaaggaccgcctgtatgtcgaggcccctgattcagaggaccgccgtgcggcgcagagcacaatctacacaatcctgcgcggtatgacgctgctgtttgctccgatcatcccatttacggcggaggaaatttggagctttatgcctgacgacagccgctatgatggtgcatctgtgatgttcaatgagatgcccagggtcattgagggcatttcagatgaggcgtttatggagaagtgggatcgtattcacgctttgcgcgacgatgtgcttaaggcgcttgaggctgcccgtaatgccaaaacaatcggtaaatcgctcgaggcgaaggtagtgctgcactttgacggcagccttgcggagcagatcggtctgacattggatgagctggcaaccgtgttcatcgtttcccaggtggaggttacagcggaaggggctggctcatatcaggggacggttccgttcctgcccggtcttacaattgagattgcgcatgctgacggagcgcattgcccgcgttgctgggtgtacagcgatacagtcggcaaggatgcgcggcatccgacgctttgcgcccgctgcgcacagatcatcggctaa

SEQ ID NO: 997 - DNA, 3579 bp, Anaerotruncus colihominis
atgtgtagtttgcggcttcgcggtttggagatacagggatttaaatcgttcccggacaaaacaaggctgacctttcacgatgggatcaccgctgtggtcggcccgaacggaagcggcaagagcaacattgccgacgcggtgcgatgggttctcggtgagcagtcgacgaaaacgctgcgcggcggcaaaatggaggatgtgatcttcggcggcacacaggcgcgcaagccccagggctacgcccatgtgcagcttacgattgaaaacgcggacggcgcgctgccctatgacagcgccgaggtgagcgtttcgcgccgtctgtaccggtcgggcgaaagcgaataccgtatcaacggcacgagcgtgcggcttcgggatgtacatgaactgtttatggacacagggcttggacgcgacggatattcgatcatcggacagggccgcattgcggagattgtgagcgccaaaagcacacagcgccgtgagatctttgaggaagccgccgggatttcaaaataccgttaccgccgtcaggaggcgcagcgccgcctggaggccgctgaggaaaaccttctgcgcctgcgcgacatcctggcggagcttgaagcgcgcgtcggccctttgcaggcgcaggcggaaaaggcgcgccggtttttaacgctggcagaggaaaaaaagacgctggagctgtcgctttggatcgcgacgctcgaccgctcgcgggcgcttctgcgggaacaggaggacaagctcctgttgtgcagggacgatcatgaccgcattcaggcggaaatggacgcggtggaacagcggatcaacgccctgtatgcagatatgcaggcgctcgccgttgagatcgacgaacggcgtgcgcaggcgcggacgcttgaggaggaaaatgcgaacagcagtgcggacatcgcggtgatgcagaacgatctggcgcataaccgcgcttcaatcgaacagatcggcgcggaactgcggcaggcggatgctgacggcggcgggcttgacgagcaaatccgtacatatgaaacggagattgcggacaaacaggcggcgctggagaaactgcaccgtaaacaggaggagacgcagcaggagattgtgaggctgacagccgcccgcgaggactgccggacacgcgcggacgcgcttaaagaacggcgcttcgggcttacgcagagcatccaggaggcgaagctgtcgtcggcgtcgagcggatcgctgattgacgagacgattgcgcggcttgaggcgcttcgggacgcggcggttgtcggcgatgaaaatgcggcgcggatcgaaaaggagcttgcggactgtaagggattgctcgccgaggtgcttgcggcgtcagaatcgctccaaaatacgcgccgcggttatctgctgcgcgccgaggggcgcggcgagaagctcgacgcgcttaaaaagcagcgcgccgcgctcgatgaacaggcgcgcggcttcttacagaaggcgcggctgctcaccgatatggaaaacagcctggagggctttcagagcagtgtcaaatatgttgtctcacaggcgcgccggggcgcgctgtccggcgtgtgcggccctgtctcgaagctgattgaagtcgatggggaccatgcgctggccattgaaattgcgctcggcgcggcgatgcagaatattgtcgttgaggatgaaacagccgccaagcgcgcgattgcgatgctgcgctcgagcaaaacagggcgcgcaacgtttttgccgctgacaacggtgcgcggcgcacggctctcggagggttggctttcctccgctgatgggtttgtgggtatcgcggccgacctggtgcggtgtgacagccgctatgaaggcgttgtggcgcagcttctcgggcgtatcgccattgtgcgcgacatcgactgcgctgttgcgctggcgcggcgcggtgggtataaattccgcgttgtgacgctcgacgggcaggtcgtcaacgcgggcggctcgatgaccggcggctggacggcgcgcagcgcgggaatcctcagccgcgcgcaggagattgaatcactgcgcgcgcaggcaaaggactgcgcggatcggatggagcgcctcgatggtgaaatcaagaccgttcaggaggagctttccgccgcgcaggcggcgatccttggcgtcgacggcgagcttgccacggcgcaggaggaccgcatccggtgtgaatcggagcagaagcgtttattggctgcgcaggcggatgctgcgcgcgtccgtgagcaggcggccagggagtatgaggcgctcgaagcccggctgcgcgaactacgcgccgccggcgtatcagccgacgggctgatacaggagctttccggccagcttgacgaggtagcgcggcagcttggagaagtgaacgagggacgcgacgcgtatgcgtcgcggcttgatcaggcgtcggaggcgctcgcgcaggttaacgtcgccgcagcggcgcttgaaaaggagatcgacggagcgcgtctgatgatggaacagctcgccggacagaaggagcaccgccgggagcaggagcgcgcgctgaaggaacgcgccgcgcgtcttgaggaggaaaacgaggccgtccggcagaggatcagcgatctggaggccgcgcgcagggaacggaccgcgcggattgaaaccattggaacggagattgcagagcgcacggcccggcgcaacgagtgcgagtccggtaccgccgcgctgcgcgcggacgaaaaagagatcgccgcgcggcgtgagacagccgcgcgggaactggcgcgcctggaagaaaaaaaggcgtcgatgcagggcgaatacgacgcgatcatcgcgcgcatgtgggacgaatatgaggtgacgcgttcgcaggccgccgaactggcgcagccggtggaggatacgccggctgcgcagaggcgcctgggggaactcaaaggtaagatcaaggcgcttggcagcgtgaatctgggcgcgattgaggaatacggcgaggtgtcggagcggtatacgtttcttaagacgcagacagaggacgccgagcggtcgcgcgccgagctgctgcggctgattgagcggcttacaagcgatatgcgcacaattttttcggagaacttcactaaaattgccgcgaatttttctgtagtttttacagagctgttcgatgggggcaaagcgtccctgtcgctggcagacccgacggacgtgctggaatcgggcattgatattttcgtacagccgcccggcaagatcattaagaacctgtcggcgctttcgggcggcgagcaggcgtttgtggcgattgcaatctattttgcgatcctcaaggtgcggccgtcgccgttctgcctgctcgacgagatcgaggcggcgctcgacgatgtcaacgtcgtcaaatacgcgcaatatttacgcacgctctgcgataaaacgcagtttatcacgatcacgcaccgccgcgggaccatggaggaggccgacgtgctctatggagtgacgatgcaggaggaaggcgtttccaagctgctggagctgaatgtcggggagatcgagggcaaactcggtatccaataa

SEQ ID NO: 998 - DNA, 2730 bp, Anaerotruncus colihominis
atgattggagtatcacgtatgctgaatcgacatgaaatcaatgctctcacggatgagcaggcggaacagagccgaaaacagttcggcagcaacgccctgacgcctccggagcagacatccttctggcgcgaactatgggacacgtttcgcggcgacgcgcttgtgcggattttaaccgtcgcgctcgtcatcacgatccttttcgccatctttggcgtcggggactggcttgaagcggtcggtatcgcaatcgccgtcgtgttggccacaacggtttccacgtacagcgaatattccaacaaccagcttttccaaaagctgcaggacgaatattcaaaaatcctctgcaaagcgttccgccgccgcgacggtttggtacaggtctgtgatctgcaaatcgacgacatcgtaaccggcgactttgtccttttgcaggccggcgacaaggtctgcgccgacggtgtcctagtcgacggcgacatcaaggtcaaccaggcgagcttaaacggcgaaagtgaggaagcgagcaagacggccgccgaagccgattacacctatgacgccgaacagatcgattttctggacaagcacaaggtctatcgcggctctgttgtgacaaacggcgaggccatcatgcaggtcaaatgcgtcggagacaaatcgcagttcggccgcctcgcgcaggagctcaaggaggacgaggagcgcgaatcgccgctgaaggtcaaactgggcaaggtagccgatacaatctccaaattcggatatatcggcggtacgctcatcgcaatcgcctttatgatcaactgtatcttctttaatccgacgctgctgccgggcgcgacggcgtatttttccgccgccaatgtaatgcagattctgcgcgatcttgtttcgtctgtaacgcttgccgtcgtcatcatcgtcgtggccgttccggagggcctgccaatgatgatcgcgcttgtatcgggacttaacatgaaaaagctcctcaaggacaacatcctgatccggaaaatcgacggcgcagagacggctggcagtctcaatatcctgttttcggataagaccggcaccatcaccaagggcgccttgcaggtagtcagctttacctctcccgaaggaaacgattaccagtcgttcgaatctataccggaacagctccgtgaaatgctgctcatcaacatctgcggcaatacgaacgcaatcgccttggttcaaaacggacatctccaggtgaccggtggtaacgccaccgagcgcgcgctgcatgaatttgtgggcgtagacggaacactcacctatgaaacctacaagctggagtgcagcgactcactgatgttcaacagctccaacaaatattccgcaagcgtactgcgcggcaagcttaaccgcgctattatcaagggtgccccggaaaagctgctcggcttctgcaccgcctattacggcgaggatttaaagccgcatccgatgacggatgaaatccgcgcccgccttgaagcgcgtatgtccgcgttgtcggaaaaagccatgcgcgtgcttgctttcgccacctctgaaaacggcatcggcgattcgcttttacaggatatgacgtttgtcggccttgtcggtatccgtgacgagctgcgtcctgaagcggtcgaagcgattcataccgctaaaaaagccggtattcaggtcgttatggttacaggcgataaaaaagaaaccgccgccgcaattgcgcgtgacgcgggtctgatcgattcgccagacgacgtagcgatgacaagtgacgatatggcaaagctttccgatgacgagctgaaaaatgtattgccccgcctgcgtgtggtggcgcgcgcccttccgacagataaaagccgccttgtgcgtatttcccaggaaaagaatctggtggtcggcatgaccggcgacggcgtcaacgacgcgcccgccctgaaaaaagcggacgtcggctttgcgatgggttccggcaccgaggtttccaaggaggccgcggaaatcacgattctggacgacaattttaattctcttgtcaaaacggtgctctatggccgcaccatttataacaatatccgtaaatttatagtgttccagcttacgatcaacatcagcgccgttttgattgcgctgatcggtccgttcattggaatgggcacgccgctttccgttacgcagatgctttgggtcaatattgtgatggatacgcttgccgcgctcgcgctcggcggagagccgcctctggcgcgttatatgaatgaaaaacccaagcgccgcgacgaatcgatcatcagtaaaaacatgtggtctgcgctgatcgttgttggaatttatctcacggcggcaagcctgatctttttgcaggttccattcttcaagacgctgttccgtgaggacggcccgatggtctataacggcagcgatatctatttcatgaccggtttcttctgtttctatgtattcagcgccatgctcaacggatttaacgcacgcacggataagctgaatgtattcgacaatatctccggcaataaaatgtttttgtatatcatggggctgatcgttgcaatccaagtccttatgacctttatcggtggttcgattctgcgaaccgcgccgctcacgctgaaggaatggagcgttgtgatcctgctctcactgatcgttctgccggtcggcaccatccgcaagctgatctttccggcaaaggcggaataa

SEQ ID NO: 999 - DNA, 2574 bp, Anaerotruncus colihominis
atgatacggatgaaacaggaacacgacgccaaggacgaggcgtttgatcccgttctgatagaacagcgcattcacaatgtcgatatcgagcatgaaatgaaacggtcgtttctcgattattcgatgtcggtgattgtcagccgtgcgctgccggatgtgcgcgacggattaaagcctgtacaccggcgtatcctgtatacgctgcatgaaaacggcctgacgcctgacaagccgtaccgcaaatgtgctgataccgttggatctgtgcttggccgttaccatccgcacggagacgcgtctgtttacgatgcaatggtgcggctggcgcaggatttttccatgcggtatccgctggtcgatggacacggcaactttggctcggtcgatggagatccgccggcagcctatcgatacacagaaagccgcatgagtaaaatgtcgctttctatgctgaccgatattgaaaaggaaacagttgattttaccggaaactatgacgaccgccttcaggagccgacggttttgccgtcgcgtttccctaacctgctgtgcaacggatcgacaggtatcgccgtcggtatggcgacaaacataccgccgcacaatctcggcgaggtgatcgatgcggttaatctgctcatcgataaccccgacgcgggccttgacgagatcatgcagcatatcaagggtcccgatttccccaccggcggcgtgatcatggggcgcgcaggaatacgcgccgcatatgcaacggggcgtgcgcggttgacgctgcgcgcgcgcacggaaattgaggagatggcaaacggccgggagcgtattgttgtaaccgaaattccatatatggtcaataaagcgcgtttgattgaatcgatcgccgacctggttaaggataaacgcattgaccagatttctgatctgcgcgacgaatccgaccgtgacggtatgcgcattgtgatcgaattaaagcgcgacgcaaatgcgcaggtggtgttgaaccgtctgtacagttacagccagcttcaggatacggttggagtcattatgctcgcgcttgtgggcggcgtgccgaaggtgatgccgctgaaggatgtactgacacattacatcgattttcagggtgaaattgttacacggcgcaccaagtacgacctgcgccgtgcgaaagagcgtgagcatatcctggaggggcttaagctcgtttgcgacaatacggacgaagtgatttcgatcatccgccattcaaaggatcgtcccgattcgaaagtcaatttgatcgcgcgctttggcattactgatattcaggcgaccgcaattgtggctatgcagcttggacagctttcaggtcttgaacggatcaggattgaggaggagcttgcaaaaatcctggagcgcgtaaaggaatatgaggcaatcctcggcgactatacgcgtgtgatgtcgatcgtcaaggaggaattgggagtcctgcgcgccaaatacgcagacgagcgacgcacagagattgtcgctgtcagcggggaggtcgatatcgaggatttgattccggttgaggactgtgtgattacgctgacacactttggatatctcaagcgccagccggtcgacgcatacaggacgcagcggcgaggcggtcgcggcgtcagcggaatgacgcggcgtgaggaggacttcgtcgaggagctgtttatctgttccacacatgacttcatcatgtttttcacaagcaagggacggtgcttccgccttaagggctatgaaatcagcgaagggtcgcgtacatcacgcggaacaaatattgtcaatctcctttcgatggacagcgacgaaaaggtaacggctcttattaaggtgacgcctgacgaatatgagcgtgaggatcgctgccttgttatggtgacgcgcaaggggattattaaacgaacgccgctgggcgcgtataaaaatgtgcggcgtatgggactgattgcaattggacttgacgatggcgacgagctggcgtgggtgcgtcagacggacggtacaagcgaactgattatcgcaacgaaaaacggtatggcgatccgtttcgatgagcaggacgcacggccgttgtcgcgtacagcgcgcggcgtcaaggcgatcacgctggaggacggcgacgaagtcgtcggaatggcgcgtgtcaggaaggaaagcggcgcgacgctgctgactgtctccgaaagcggactgggccggcgtacagaggtgtcgcagtaccgtctgcaaagccgcggcggcaagggaatccgcaactattatgtcgataagaacgggccggttgcaggtgtgcgcatggtcgacgaggatgacgatgtgattatcatcaccgacgatggcgttatcatccgtattcctgtgcgtgagatcactgtacagtcgcgctatggcggcggggtgcgcgcaatgcgcgtatccgaggagagccgggttgtgaccctggcgcgcgctcccaaggaggagacttccggggatgacgggcaggaggaatcacaaatcgccgcgggggacgaagcagccggcgaaactgacaaaacggcagaggatagataa

SEQ ID NO: 1000 - DNA, 2403 bp, Anaerotruncus colihominis
atgcgaaggggcaataccccgctatgcttcttgctttcctcgcattttggcccggattcgacggtaaacgccgcgtttcgtatcggtgtccatgcggcggacggcgcaacttttgcaaaggaacggtataaaagaatggcgaagtctccaacctaccatatgaaaagccgtatggtcgtcgtgcttgtcgcgatgatcgtgctcggtttctgtgtcgtgctgcatcagttgtttgtgctccagattgtggagggcgagtcgatgcaggcgcgcgcgctccaacatcagctgcgcacaacgcgcatcggcgccaaacgcggcgtcatctacgacacaaacggcgaaaagctcgctgtcagcgccgacgtttcgtcggtctgcattgcgccaaaattggctgatacgcccgaaaaagaggaggccgtcatcgatctgctggcggaatatatcggggcggataaggaaactgtcaaaaagaagctggagcgcaaaggttcctattacgaggttgtcaaggagaaggtcgaggacgaccaggcagacgcgttgatggcagcggtcggcgaaaacggactgacgggcgttattttcctcgaggaggacacccgccgttattatccatacgggaatttcgcttcggctgtgctgggttttgccaacaatgacaaccacggtgcgtatggacttgaggcgtattatgaaaagacgctcgccgggacgccgggacgcgttgtgtcgatgaaaaacggcgcgggcgttgatatggatatgcagtatgtccagcggtatgaagcgcaggatggcaattcgcttgtgctgacgatcgacgagacaattcagcattaccttgaaaagaaccttgagattgcgctgtccgagcatcgtgtgcgcaaccgtgtgaccggcatcgtgatggatccaaagacaggcgcggtgctggcgatggcctccaagccggatttcgatccaaacaacccgtatgacatcatcgacgaaaacgtcgctaaaaagcttgaggaggagttggccgctctgccgcaggacgactcggaggaatcgcagaaggcacgccagcaggcccggatggagacgctttactcgctgtggcgcaactatgcgatttccgatccatatgagcctggctcggtctttaagattgtgacggcggccggagctttggaatgcggcgctgtgacgacgcagtcgggctttaattgcctgggctatgtgaccgtcaacggcacacagtatcactgctggtactggaccgggcaccactccggccatggagcgcaggatttgacgcatgctgtgatgaattcctgcaatccggcgttcatcgatatcggacagcgaatgggcgcgcagaatttcgcggaaaactttgcaaattttggcctgacacagccgaccggaatcgatatgccgggcgaagctggaagtatttaccacggaacctattccgtcaacgatctggcgtcctcgtcgttcggccaaacattcaaggtcacgccgattcaaatgatcacagccgcctgtgcggctatcaacggcgggcagcttatgcagccgtatgtcgtcaagcagatcatcgacagcgagggcaacgttatttcaaatacggagccggttgtcaaacggcaggtcgtttccaaggaggtttccgaggaaatggcgctgatccttgaacaggttgtcggcggaggcggatccggtaagcaggcagctattcccggctaccgtgtcggcggaaaaacggggacgtccgaacagctcgacgaccgcaaggaggatggacgtatcccgaataccctgtcgtttttcggcttcgcaccagtcgacgatccgcaggtggcgtgccttgtgctgctcgacgaccccgatatttacaacgccttcggttcaaccgtcgcggcgccgattgtcggctccattttggcggagacgctgccgtatatgggcatcgagccgcagtacaccgaggaggagcttgaaaatatcgcgacacaggcgccttatctgctcaattatgatctgcacgaagcggagtatgaggtgcgccgccgtggtctgaagttccgtgtgatcggcaacggcgcgaaggtgctcaagcaggtcccgggtgcgggagagctgattccgcaggacggcgtcatcgtgctgtataccgaggaggaaggcgcgggagaattgattccggtgcctgatgtcgtcggaaagacgctccaggaagcaaaccagtcgatcgtcggctccgggctgcagatcagcgtccagggtgaacagatcgaaggcacgcacagcgttgtttcagcacagtcgcctgacgccggcgagatggtggaggcgggcgccgtggtgacagtcgaatgcgtggcggcagagccgcccgcgcagccatag

SEQ ID NO: 1001 - DNA, 1311 bp, Clostridium sp.
atgtctaagacaatacagcttttgacagcccgctgcggcaaaatccgtcctgactctgtggcggactatatcgcaaacggcggtttttcggctctgaaaaaagcaatgagcatggctccaatggagatcatcaatgaaatcattgatgcaaaacttttgggacgcggcggcgcttcctatccagcaggcaaaaagtggaaacagctttatgaaattgaaggagatccaaaatacattgtctgcaatgccgacgaaggcgaaccgggaacctttaaagataaggttttgctggaaaaagatccgcttagcatcatcgaaggtatggcaattgcaggttatgtttttaactcgcatgatggttatatttatatccgcggtgagtaccgtgagatccagaaactgttccaggctgcaattgataatgcagtaaaagcaaactatctgggcgacaacatcatgggttcctacttcagcttccgcgtacatattgtttcgggtgctggtgcttatatctgtggtgaaaactccggtctgctcaactccattgaagcaaaaaccggtcgtcctcgtgtaaaaccaccgcatctggcagaggttggtctctattctcagccaactctggtaaacaacgtagaatcctttgcaagcgtacctcaaattattaatatgggcggcaaagcattccaggaactgggcgtagaagattccggcggtaccaagttgatctgtctgtccggtaacgtaaatcgcagaggtacttttgaagtgccgattggcggtgttaccctgcgtgatattatttttgaccctgaatttggcggcggtattccggatggtaaagagcttaaatgctatcatctgggtggtcagtccggtccaatcggtttcccagaacagctggatacccgttatgaccacacttccctgaaaaaacagggactgagcatcggttccggtgcagtagttgtactggacgatactgtatgcatcattgattacctgaagaaggtatcggaattctttatccatgaaagctgtggtaaatgtgttccatgccgtgaaggtaaccgtcagatgtacatgatcctgcataaatttgcaacaggacttgcaacagaaaaagattttgagcgtctggaacgcctgtcctttactatggctaccgcatcttcctgcggtctgggtcagtcggcttccaccgcacttgactcctgtctgaaacacagacgtgaagaattccaggcacatatcaacggcatttgtccggtttgtttaaatagcagaaagtatggtgaccagtatgcatattga

SEQ ID NO: 1002 - DNA, 1149 bp, Clostridium sp.
atgtttttaatcaaacaggcgcaggtgtatgcaccggaatatctgggggtgaaggatattctgatatgcgggggaaagatagaggcaatcgaagatcatatcgatgaccagattccattttgccaggtaatcgatggcacagggaagaaactcacaccaggcatcatcgacccacatgtacacattaccggtggcggcggggaaggaagcttccatacccaggttccgccggtcaagctgtctgagctgattggcggcggtgtcaccaccgttgttggtcttctgggaaccgatggtatcagccgcaatgtggaaagtctgctggcaagagtaaaagcgctgcgggaggaaggactcaccgtttatgcactgaccggttcttatggttatccaagtgtgacactgaccggagatgtcaaaaaggacatcatgtttgtggaggaaattatcggtgtgaaactggcactgtccgatcaccgtgccccaaatgttacagtggatgaactggtacgccttgcaagtgatacccgcgtggcaggaatgctttcgggcaaatgtggaatggtgaccctgcatatgggaagcgatgacgctgcactgagcaaggttcgtgcagcattggaacagacagcaattccaatcaagatttttcatccgacccatattacccgcagtccaaaacttctgcaggaaagctttgattttgcaaatgatggcggctacatcgatatgacctgtggttccggtggagaaggcaaaccgtccaaatgtatcatgaaggcaaaagagcagggtgtagacctcaaacggattaccctcagctcagatggcatgggcagctggtccaactatgacaaggaaggaaatctgatcaagattggatactccgcggtggataccatctatcatgagatctgttctctggtgaaggaagagggcatggatttaagcgaagcacttacctttgcaaccagcaataccgcacattcgctggaactcttcccacgaaagggatgtgtgcgcgtaggagcagacgcagaccttctgctgatgcaggatgacctgtcgcttgatatggtgatggcgcagggacagatgatgatgcaggacggcgttctgctcaaaaagggaacctacgaaaaagattaa

SEQ ID NO: 1003 - DNA, 1359 bp, Clostridium sp.
atgaacgaaaaagatactcccgtttcctctctcgcgctcaagctggtggttggttttcttcttgtcctttccaccggacttgccatctgggcaagctataatcacatgaagatcaatacctatcgcactgctttgcagaacacctacctgcgcgccgccgatcttgcttcggacaatctggcaaatctctcgtccgatctggtcaagggcatgtatgtcggtacctcatcgcagctgtcgatgatctcctccaaaatgtggaaggaatcttcggaagcaaaatctgccctctccacccttccggtatcggacaaaacattggagaataccaaccgctttctctctcaggcgggcgactatgccatgtacctctccaaaaaatccgcctccggtcaggaactcagcgaagaggaacgcagccagtttgcttccttgcgcgaatatgccgaccgtttaagcggacaactggatgagatcgccaccggactgcaaaacggaaccctgacactggaacagctctccacacctaaaaccactgtggatgatccggaaaatccaggaaccacctctcacatgcagcagattgaagacagctttatgggttatccaaccttaatttatgatggtccattttccgaccacattctggacaagactcctctcatgaccgaaggcaaggcagaagtcccggtcgaccaggcaaagcagcttgctaatcaggttgccggcaaagatctgaccgaaatgcgggaagaaaactccactcttccttcttatgttttccatgacggaaccagcaattcagttgctatcaccaaaaatggcggctatctttgctacctcatcaccgataaaccggattctctcactgaaaaactctcttatgaggaggcagtagccaaagcacagcagttccttgagaaatatggctattcttccatgaaggatacctattacgagacccgcgacggtgtcatgaccctgaattttgcctactatgagcccaacacccagactatctgctacactgatctgatcaaggtggaggtttccctccaagacggttctatcgtaggactggatgcacgcggctatctggttaaccaccacgaccgcacgctgcaatccccatccatcaccgtcgaacaggcacagcaatccttaagtgatattctcaccgttgataacactcgcctcgccctgatcccaacctctggacaaaatgaggtctgcgtttatgagtttctctgcacatctcctaccggagatcgaattctttcctatattaatacacagaccggtgctgaagaacaaattttaattctaatgcaaaccccgaatggaactcttaccaaataa

SEQ ID NO: 1004 - DNA, 1278 bp, Clostridium sp.
atgtatgagattttacgatggatatttgataaattcacgaaaatccgctataataaaaaaatcaagaaaaaaggaagggaatgcgttttgtcaatttattttggaatggcagcctttttatgtgcaggttcgctgctctggaaacagacctctccgcttcagggagagtttttagaaaagaatcgaaaacagcttcaaaatctgtttttgatgacagcagcattgatttttatttttgttgcaacctttcgctatggaataggatacgattattttaattatgaaaatctctatgaacagttgggaccattatcgatccagcagcttgttacagatcatgtcgggcgtgagtttatcggctattcgatcttcacccacctgtgctgggaactggggctaagttatcggatgcttctgtttgtggtaaatatcattttaacagcgatcgtgttctggtttctcaagcgatattctcctctaccatggctgggtgcatatctttatctgacgctgcagttctttgcacatagcatgaatctgtttcgtcaatccatcgcagcgacaatctgcctgctggcatttccttttttaaagaaacgcaaattgattttctttgttctggtggttctgctggcttctgcttttcacatttcggcattgtttctgcttccattttactggattttaaactggaaggttgatggcagaatctacggtgtgattgcagcgatttctctcccgatttatctgttcagcacacaggcagcacagtttttgacccattatctgtttcaaaattatgccggctatatcggttcgcactactgggcaggtctgggaaaacgttatgtgatctttccagcaatttattttgctgcagtatggtttttccgaaagagattgcttaatcaggatgagaaaaatcgaatcctgattaattcctcgttttatgtgctgatcttgtatgtgttcagtacccatcacatgattctcgaacgcttttcgatctatctttttatgtatgcaatggtactgcttccaaagctggtctgcacattctgccaaaccagcgaagtagaaaaagcagataaaaagcgggcaaaatcagtatccaaacggacaaagaatacgcataaccagaaaaagaaagaaataattttcttggcatctgttctggtagttaccatcagttttggctatttgatctttgcttcccagcagggaacgaacggatttcataaagtttatccatatgtatcggtgtggacagagcaatga

SEQ ID NO: 1005 - DNA, 1440 bp, Clostridium sp.
atgaacgctgttgtttatctcttatccggtttttgttttataaaaatctttccgaacacaaaactactgaggagtggtatgatgtcaaaattacacgtacaggatctgacacaaggcagtattacccaaaagttactggtattcgcccttccttacctgtttgcaaacctgattcaagcactttatggcgcggtggatatgattgttgtaggctggtttgacagcgctgccggcatttctgctgtatccatcggcagtcaggtcatgcagattttaaccagtatggtagcgggacttactatgggaagtaccattttgattgcgcaatattccggtgcccgccgtcaggaagaaacagtccgaactatcagcacaacactgacactgtttgcattgcttgcggtattttttaccggactgctatttttctttgctccaaccgttctttctttgctgcaaacaccacctgaagcattttctgctgcactcagctatgtccgaatctgttcctgcggcactctttttatctttggttataatgccatcagtgctatcctgcgcggactgggagattccaaaaatccactcaaatttgttgccatcgcctgtgtatgcaatatcgtccttgacgttgcccttgttggaggagtcaaaatgggagctgccggggctgcattggcaaccattctgtctcagggaatcagtatgctgctcgcaatcttctttttgcagaaaaataacttcatctttaccttttcactcaaaaacttccacatctatccggatgaggcaaagcgtttaattcgtctgggacttcctgtttctcttcaggaaaccatggtcagcctgtcgtttctggttatcaatgctatcgtcaattctctgggtgtggttgcttctgccgctgtcggtatctgtgcaaaatttgaaagttttgcgatgcttcctgccggagcattctccagtgcaattgcgtccatgtccgctcagaatatgggagcacaaaaaccgcagcgtgctaaaaaatgtatgtggacaggcattgcatttgcctttttatgctctctgtttttctttttctgggtgcagattctgccgcagagcgctcttgctcttttcaaggcagatgaacaggttacagctgctggcattgaatatctgcggacattcagcttcgactttatgtttgtttccttctacttctgcatgaatggcttcttaaacggatgcggctgcaccacatttaccatggcaaacggcgttgctgcaactttcctggtaagaatccctctggcatttctgctcacaagcttcctaccaaaggaattgtccctgtatggaattggcgcagctgctccggttgctactctgttttccattgcattgtgtctgttttacctcaaaagcggaaagtggaacacctgtgaaatttcctcctaa

SEQ ID NO: 1006 - DNA, 1068 bp, Clostridium sp.
atgcaagagcaaatttttaagcacagagagacacagcttttaactgtaaaggaaatgaaacaggacagggaagcgatcatccgtgcaggacagatcatccgtcagggcggactggttgcacttccgactgaaacagtttatggtctgggtgccaatgccctgaatcctgatgcggtaaaaaatatctttctggcaaagggacgtccgcaggataatccactgattattcatatcgaggatgcttcccaggcagaacgttatgccaaaaacatcccgccggtttattatgagctgtgcaggcgtttttgtccgggaccgctgacgatcattctgccgaaaaaggatattatcccactggaaacttcgggaggactggaaacggtggcaatccgtattccagctcacccggtagcaagagcgattatccatgaggcaggggtgccgattgcagcgccttcggcaaatctttccggttccccaagccccaccacagcgcagcattgtgtgcatgacctctggggtcgtgtggacgcgattgtggatgccggagagtgcagtgtgggcgtagagtcgaccgttatttcccttgcaggggaaaagccgatcctgctgcgcccgggtgctgtgactccgcagatgttaaaagaatttctgccggatctgatgattcatgaagcggtaaccgaaaagctcaaagagggagtccgcgcggattctccgggtatgaagtacaagcactatgcgccgaaggcaaaaatcaccattctggatgcagacagtagggagtttacagaatatgtcaattcccagaagaaagaaggtctgtttgcactctgctttgaggaggatgttccttttttacaggttccatatatcagcctgggcaaagatgaaaccgatcaggcaaagcacctgtttgcagcgcttagagaattggatgaaaggggcgcacaggaagtgtatgcgcgctgtccatccaaacaaggcgtgggtcttgcggtgtataatcgcctgattcgggctgcagcatatcaggagcatactctggatggggaaagtgaggcatag

SEQ ID NO: 1007 - DNA, 1386 bp, Clostridium sp.
gtgttgacacaaaaattgattttgaaaggatgggtattcttgttttccaaaaaagaccttcagcgcctgattatcccgctgatcatcgaacaatttcttgccatcaccatcggtatggccgatactgtcatggtttccagctgcggtgaggctgctgtttccggtgtatcgctggtcgatgcaatcaacattctgctgatcaacattttttccgctcttgctactggcggcgctatcatttcctcccagtatattggtcgtgaagaaccgcataaagcttgtgaagctgccaaacaactcgtactttccgtgtttgttctttccatggtaattggcggaatctgtgtttttggcggaccacagattctgggactgatctatcatgatgttgagcgtgcggttatggataacgctgagatttactttttcctgactgcgctttcctatcctttcatcgctctttataacgccggtgcagcattgttccgtgctatgggaaactccaaagtttccatgacaatctccatcatcatgaactgtatcaatgttggaggaaacgcaatttttatctttggctttaacatgggagctgctggtgcagcacttgcaaccctgatttcccgtattgtaggcgcaatcttcattttgattctcttaaaacgtcctgtcaacattatccatgttgactcttatctccacttggaatttcgtcctcagatggtcaaaaacatcctggaaatcggcattccaaatggtctggagaacggaatgttccagcttggaaagatcattgttcagggtatgatcgcctcctatggaaccgctgctattgcagcaaacgctgtctgcaactcgattgccggcttcccgattatccctggtactgcaattggacttgctatggtaaccgtagtaggacaatgtgtgggtgcacaaagatatgaagaagccaaaaaatacattgtccgtctgaccggacttgcctatatctttatgttaatcctcaatattctgattgctgttttctgcggaccgattgtcggattctttaatctgtcagcagaagcaacctccactgcagaacaaatcatgctctggcacagcctgttctgtgcggtcctttggccaacagcatttacgatgccaaatggtctgcgtgctgcaaacgatgtgaagtttaccatggccgtttctgttctctccatgtggatctgccgtatctgcatgagctacgtttttggaaccatgttaggaatgggcgtcctgggtacatggtttgcaatgttccttgactgggtattccgcatcattttctttgtcgttcgtctccaatccaacaaatggcagcaccgtgaactgcagcaaaaactttctgcacaaggataa

SEQ ID NO: 1008 - DNA, 1674 bp, Clostridium sp.
atgaaaaacaccgataaatatacccgaaattattttaatccacctgtcagcgagcatcgatggagctcacaggaatacatctccaaagctcctcgctggtgcagcgttgacctgcgggacggaaatcaggcgctgattgtcccaatgagtttggaaaaaaagttggaattttttcaatttctttgcaaactgggatttaaggagattgaagtcggttttccggcagcatccgaaacagaatttcaatttgtccgcacactgatcgagcaaaaactgattcctgaggatgttaccatacaggttatcacccctgcaagagaacatatcataagaaaaactttcgaggcattggatggatgccacaaagcaatcatccatctttacaattccacctctgtcgcacagcgggaacaggttttccagaaatcccgcagcgagattattgaaatcgcagtttccggcgcaaaatggctgaccgaatatgccgctaaaacgaacggtgaatttctgtttgagtacacaccggaaagctttactggaaccgagcttgattttgctgtggaaatctgcaatgcggtgctggatgtctggaaaccacagaaagaacaccccgtcatcatcaatcttgcttccaccgtttccctctcgatgccgcacgtttacgctaaccagattgaatacatgagcgatcacttaaactaccgtgaaaatgtggttctttccctgcacccacacaatgaccgcggcagcgctgtcgcagaagcggaactgggcattcttgcaggcggccagcgtgtggaaggaaccttattcggcaatggagagcgcaccggaaatgttgacctgattactcttgcactcaatctgttttctcatggagtggacccgatacttgacctttccaatataccacaggttgtcgaaatgtatgaggatgcaaccggaatgaaccttcctccccgtcagccttatggtggtcagctggtatttgccgctttttccggctctcatcaggatgcaatcgccaagggaatgcagtggcgccagagccattctggtgctcattggaatgttccttatctcccgatcgacccgcaggatatcggacgaagctatgaaaatgatgtgatccgcatcaattcccagtcgggcaagggtggtatcggctatctgctggaacacaagtacggcatcaatatgccaaaaccgatgcgggaagaatttggctacatcatcaagggaatttcggaccatcagcacaaggaactctctccagaagaagttcaccagatttttatggatacctacctcaatctgcaaacaccgattcgtctggacgacttctactttgtccacaaaaaggaatatcataccactgtttccctgaccgtcggaaaagaagaaatggaactgaccggacgaggaaacggtcgattcgacgcagtgagcaatgctttgcgtcgtggacttaatatccgctttcatgatattgtctaccaggagcatgcgctggaacgtggttccacctcccgagcaattgcttatgtcggcatcacctcggacagccagaaaacctactggggctgtggtgttcacaccgatattatcgccgcttccatctttgctctctttagcgcaattgaccgcatgctgacacaggaacaaaatgactaa

SEQ ID NO: 1009 - DNA, 1407 bp, Clostridium sp.
atgagtaacctggcagaaagaaaatccggggagaaaaggaaagagagtggttatatgaaagaaaacaagggactgatgaccgagggtgtgatctggaagcagctgttttggtttgcgcttcccttgctgcttggaaatttgtttcagcagttttacaacacggtagactcgatcgttgttggaaactatattggtgcaaacgcattggcatcagtaggtgcaagtacgccgatcattaaccttctggttggtctgttcaccggactgggaaccggtgccggtgttgtaattgcgcgattttttggtgcgcaggatgacaaaggggtacatgatggagttcataccaccattgcattgtgtctggtttccggtgttgtgatgggtgcgattggcgttttgttttcaccccagattctgcaatggatgaacacgccaagcgaagtcatggagggctcgattacctatttacaaatttattttatgggaatcatagcgctgatgatctacaacatgggatcgggaatcctgcgtgcagtgggagattccaaatcgccgctgtattttctgattgtatccagtgtggtcaacattattttggaccttgtttttgttatcaaagtacaaatgggtgttgcaggggtggcctgggcaactttaattgcacaggtgatctctgcctgccttgttttgattcgtctttcgatgagcagggaaagctatcggttggttttgaaagagattcgttttcataaggatgttctgctggaaaccatccggattggtctgccgggcggaatccaaaatgcggttatttcattttctaacattattgtgcagtacaatatcaacagctttggagccgcagcagtagcgggatgcagcgcctataccaagattgatgggtttgccatcctgccagttatgagcttttccatggcaattacaacctttaccggacaaaatgtcggtgcgaaaaactatgagcgtgtgaaaaaaggtgccaacacctgcctgaaaatgtcctgtgcagttaccatagtgatttcagttgtactgtttttgtttggcggaaatctgttaaaggtcttttcgtcggatacacaggtgctgcactatgcaacacagatgatgcattttctggttccgggatatctgtgccttgcaattgcacacacctattgcggtgttgtcagaggtgcaggtatctcaatggttccgatgcttgctctgatcggaaatatgtgtgttctgcgcatgatttggattacgcttgctatgccgtttgcacacagtatcatcatcgtttttctgggatattctctgacatggcttaccagcgcactgaccatgctggtatattatcataaatcgggctggcttgaaaaatatcagcttgcccattcataa

SEQ ID NO: 1010 - DNA, 963 bp, Clostridium sp.
ttgaacgatctcagtcttgaccgtcttgatgacgaaaagattctatggcaaaccttcactctcccatcttcctgtgatgggcagaacttgttctgccgcctggcagagcccacaacacctttgcgcggggtagtccagatttcccatggaatgtgcgaacatatcgatcgctacatcccattctttcgctttcttgctttggaaggctttgtagtttgcggaaacgaccatctcggacatggaaagacctgtcagaatcctgaccattttggattctttgcagaggaaaaaggataccagtatctaatcgaagatcttcaccaggtcagtcttttcttaaaaaagcgttatccccagcttccactctttctgtttggacacagcatgggctcgatgattacacgactgtacctttccaagtattcttccctgcttcagggcgtagtaatctgtggaacagccggaccaaatccagcatccaaagcaggcatgctgctttgcaaacaggtcattgccaaaaaaggtgaattttctcactcctctcagctgcaaaagttgatttttggttcttacaataaccgctgttcccatccaaaaaatgagtgggcatggcttagccgggatgatgaaatggtggatgcctacattcaggacccattgtgtggattcccgtttactgcatctgcttatctggatctgttgtccctgcaatatttctgcaacacccgggtatggtacaaaacactcgaccaaaatcttccaatgctgttgatttctggagcgatggacccggtcggcaactatggaaaaggaattcgtatgattgaaaaacagttgcttcgtgccggtgtcagcgatctgaccgtttggatttatcccggtgcccgccacgaactgctaaacgaaacaaaccgcgatgaagtcatgcgggatgttctttcctggtttgctcttcacgtataa

SEQ ID NO: 1011 - DNA, 972 bp, Clostridium sp.
atgccagaagtaaaagacagtgaagtggtgctgaaagtagagcatctgaaaaaatatttcccgatgggaaaacatgctgttttaaaagcagtggatgatgtttcttttgaaatgaagcgcggagaaacattaggaattgtaggagaatccggctgtggaaagacaacctgcggacgtaccgtaatcggtttatatgataaaacggatggaacagtgttgtacaagggaaaagatgttcatgcgatgaaggggaatgaacgaaaggcatttaccaaagaagtgcagatgatctttcaggacccttatgcatctttggacccgcgcttaaaggtaaaccagattgtcggagaaggaatgcgtatccacaagatgtattcgagcaacgcagaaattcaggaccgagtgtttgagcttctggatcaggttggactgaatcgggaacatgcaagcagatatgtccatgaattttccggtggacagcgtcagagaatcggcattgcaagggcactggcacttgatccggaatttattctctgcgatgaaccgatctctgcactggatgtttccattcaggcacagatcatcaacctcttgatccgcctgcagcaggaaagaggtttgacctatctttttatcgcgcatgacctttcgatggtaaaacatatttctgaccgtgtaggggttatgtatctcggtaccatggtagagatgaccacttcagaggaactttatactaatcccgcacatccgtataccaaagcgttgctttctgcaattccgattccggacccaaaggtagaacatgaaagacagcgcattatgctcagtggagacgttccaagcccaatcaatcctgctcctggctgccgctttaagggaagatgtccttatgcaagcgcaaaatgttcgcaggaaactcctgtactgcatgagattgcgccaaaacattatgtagcgtgccatctttattag

SEQ ID NO: 1012 - DNA, 636 bp, Clostridium sp.
atgaagctttttgttttttctggcagaaattggacaccgaggaggaggatgctcatggaagattgtcagaccccaacgtcaaaaaagtcgaacattgagatttgcgatatctatgacatctatggaaaccgcactggaaaaactttcattcgcggggaaccattgtcagatggacagtttgtcatggttgtcgatgtatggattgtcaacagcaaagatgaaattctgatccaaaagcgttctccatataaaaaagatcttccagatacctgggctacccacagtggctgtgtactggcaggggagacttcccagcaggcttgtatccgtgagccactggaagagatcggcatccacattcttccatcgcagattcacaaattgaatcgaaaactgagaggaaggcttctttcggaaaacttcgttgtggaacaggattttgatgttcgcgacgcagttttacaggaggaagaggtcagccagatcaaatgggtcactgtttcccaactcaaacagatggcaagcaaaaaagaattttaccgctatcccgagttttttgatgttgtccgctttttagaagaacgcaggcggcgtcaaagctctatgaacaaagttaaaaaacacaacaatgaatga

SEQ ID NO: 1013 - DNA, 885 bp, Clostridium sp.
atgaaacagcttttgattttaagcggcaagggcggcaccggtaaaaccaccattgcctcctcctttatttccctgctcaaaggacagcacaagacctgttttgccgactgtgacgtcgatgtgccaaacctgcatctgatcttttccgaaggacaaaccatgctttcgcaaaaaacctgctttggcaaacgtgctgtcattaaccaaagtctgtgtacccactgcggactgtgcgaacagcactgccgctttggtgcgatgaaaaacggcgtagttaacccttatctgtgcgaaggctgcggtgtttgcgaactggtctgtccgattggttccggctcggaaaaggcggttcatctggcagaaaccagcacaggaagctacagtgtttctgccaccgaatatggggttttctccaccgcttccttaaagccaggtgccggtgcaaccggaaaaaccatcaatatggttaagcagaatctttccacctacggagaaaatgctgaaattgcagtcatcgacggttctcccggcattggctgccccatcatttcttcggttgccggtgtggatctggtgcttttagtcctggagccttccctgtcagggctgagcgaccttacccgcatcctgaaaacagtccgtcagctgcgtgttcccgctgttgcctgcatcaaccgctcggacaccgctcctcaatttacacaggacatttatcgttactgtgccgagcatgagctgatggtactggaagaaattccgtttgatccgctggttatccgtgcagtcaaccacaatcggccaatcgtcgattatccaaactctcccgctgcccagcgtgtaacaagtctgttctccaagacactggaagttttgaacaccttatag

SEQ ID NO: 1014 - DNA, 2121 bp, Clostridium sp.
atgaaaccaatgaatatcaatatcttcgattatcttaaagagactgcgaacgtctcattgaccccgcagcagttgcaggccgctcaaaccattgaggggcctgttcttctgttggcggttcccggcgccggaaaaaccaccgttatggtcgcgcgcatcgccaatatgatcttccatcatcagatcgacccgggcgcgattctgaccatcaccttttccaaggcgggcgctgtggatatgcgccgcagatatgaagcgctcttttcttcgctttccgaaaaatatcatcgggagattccgtctttcagcaccatccatgcgttctgctatcgggtgctgggctcctactgcaggctcaccggcggtaccgctccaagccttatcgaatcccgcgaccgcaccctcatcctgcgcgagctttatgggcagattgccggcgagtttttgaccgaggatctggaagaggaactgctgtccaacttaagctttatcaaaaatgccatgctgcgggaggaggatgtgaaggaaggaaagtgcatcgagacccagatcaagcacctctgggagatctaccgccagtacagtcagatcaaacgccagaacggctggatggattttgatgatatgctcagttacaccctcaccatcttccgcaaatatcccgaaatcctaagccattaccagcagaccttccgctatctgtgcgtggatgaagcgcaggacacctccaaattacagtacgccatcctctatctgctgacccgccagacccagaacctttttctggtgggggacgaggaccagagcatctatcgcttccgcggcgcgtgcccggaaaatctgctggaatttccaaaacgctttcccaatgcgacggtgcttaagatggaagaaaacttccgcagcacaaaggagatcgtctcccacgcaaaccggtttatcgctctgaacaaacagcgctttgaaaagcagatgtttaccaaaaatgagcagggaaatccgattgagctaaaagtcctgcacgatttttccgaccagtatcacgcggcaatcgatgcctatctcaaagagcctggcaccaccgctatcctttatcgcaacaacctgtccgccatcccgatggtggatattctggagcgcaacgacgtcgatttttatattcgggaacacaaggcgcggtttaaacagaactatgtcgtgctggatgtcatcgccttttttgcgctgagctttgacccaagcgatttcgaggcattttcccgcatctgctataagacttccggacgcatccgccgttcgatgctcgagcagatttcccgggcaccgctgcttaatagggaaacctactttgaccgcgtcatcgacctgtgcgaggaaaatcagaacaccggacgcatccgctatgtcagcgccatgatcgcgcgccttcgtcagatgcatccggcaaaggcgatggacaccatcctgcaccagctgggatatctggattatctggaattttcaagcggcaacgcctattcgatgcaggcacagaaacttggtatcctgacaagcctcgcctcgcgggtcagcaccgtcgagcagtttctggaccgcatcgacgaactggacgaggtgattgcccaacacacccagcgcaccgattccagactgaccctgaccaccgttcactcggcaaagggactggaatttgatactgtcatcctgcttgactgcatcgatgacgtttttccctgtcacagtgcaatcgaaaagtacaagaccggacaggaggaagagatggaggaggaagcgcggcttttctatgttgcctgcacccgtgccaaaaaggtgctggttttgccgtacgcaaactattcgggcaacaatccggcgctgccgtcccgctttttctcccgtctgctggaagaccctcagaaggattcttccggggaagcagatgtcggcaacatccggctttatccgggactgatgatcgagcacaagaactttggtcggggacaggtagtcggtgttgaccgaaagaagggggtattcaccgtctttttcggcaaaaacggcacccgcacactcaccatggcgatcttaaagtcggacaccatcaaaaaggcgatgccatag

SEQ ID NO: 1015 - DNA, 945 bp, Clostridium sp.
atgacagcaatcattattatcgctattttgatcatcgctatcttggttttgcttgtttcctgtatcaaaattgttcctcagtcgatggtattcgttgtagaacgtctgggttcctattatcagacatgggaaaacggtttgcatttcaaggttccgtttttagaccatatcgcaaaaaaagtttccttaaaagagcaggttgttgattttaaaccacaaccagttattaccagagataacgtaaccatgcagatcgacagcgttgtattctatcaaattaccgacgcaaaactgttcacctatggtgtagaacgtccgatttccgcaatcgagaatctgaccgcaaccaccctgcgtaacatcatcggtgaactggaactggaccacaccttgacctctcgtgatgtgatcaacaccaagattaccacaacactggatactgctaccgataaatggggcatcaaggtaaaccgtgttgagctgaaaaacatcctgcctcctgcagaaattcaggatgcaatggaaaaacagatgaaggcagaacgtcagcgccgtgaatctatccttcgtgcagaaggccagaaacgcagccaggttctgattgcagaaggtgaaaaagaagcagcaatcctgaaagctgaggcagaaaaacagtctgcaatcctcaaagcagacgcagtgcgtgaagcaaaaatccgtgaagcagacggtgaagctaccgctattctcaaagttcagcaggcttatgcagacagcttgaagatgttaaacgaagcagcaccgagcgacaaggtgctcaccctcaagagcttcgaagcccttgcaaaagttgcagatggtcagtccaccaaactgattatcccaagcgacatgcagtctctcgctggtcttgcagcatcggtaaaagagattgttacagacaaaaagacagaagaaaccaaatag

SEQ ID NO: 1016 - DNA, 1383 bp, Clostridium sp.
ccggaatccgggtttttggatataaaaataaacaggaaaggagatcacccgatgtcaggagtgcagtcccgcggctcgtccaaaaggcgtatttttcggaaggtgcggcggtaccttctgcattatatcctgcttgcggcattttgtcttgcaatcgcttttatcatgtgttataccgtgtttttcaagctggacaagatcaaaatcagcggatgtacggtgtacagtgagacacagattgtggatgaaatcggcgcagagaagggtgagagcctgtttaaaattaacatttccaacgctgaaaagaagttggtcggaaaactgccctatatccgttcggtcaaaatcagccgacagtttccaacaacattaaaggttgagattgaagaggaagaagttttaggtgcagtttataccgacgaaggttttgcaattctttccactaccggtaaggttttggaaaccggtgtgctggctttgtctgaagggataccacaaatcgtgggaattaccggacagacatacagtaccggaagttatgtgcgggaatcgagcaacctgaattctgatttgattccgcagattcaggcgttgcagaccgtgcagcaagaactgaagaacaatgattttaacgacatcacctattatgatgttaccgatatgctgaacatcaaagtcatgattgaggacaggcttctgatgaagctgggaaccaacatcgatatggattataaaattcattttatcaaaggtgtactagatggcaaggagagcggggacgaggagtttgaaaatgttccagaagagggaacactcgatttcagcaatcctccggcactgcacaccatgtcgattgacattgataaggtgaagaatgaagatgcctaccatgactttggtgtggagaaaccgcctgttaccgataatatcgtgggtggtgaagagtctgaaccgatgcagacattaactccaagtacacaggaaggggaagaatccacggaacaaaccggtcaggagcaaacgcaggaacaaactggtgaagcgacccagccggaagagcagagtcaacaggagtcagcagagcaaacagacgcacagcctgaacaaacgcaagactccggagaaactcaggagacggaacaacagacagctccacaggcacaaactcagacggatattccaaaagcttccccacaggttaacgaggttaatggagttgtccaaaacactggaggacaaacgtccggtacccagtcttccgctgcacagccgtcaactggtagccagacgcagcaggcagggaatggacaggctcaggatcagacgcagtcccaaaatcaatcgggcagcacgcaaactggcggaaatgtattcaactcgcca

SEQ ID NO: 1017 - DNA, 939 bp, Clostridium sp.
atgaaagggatttcaaagccagttcgaatcggactgatcatctttttcctgatggtggcactgttttcatcactccatcttgtcaaatgggcgatcgaatcctataacagcagccagacacagaaggaattacagcagctgtatcatcagggttccctgacaggtgctggaaaagaggagcagtcagcacaggaaccagtgccgggagaaagcggcagccaacagaataatctgcctgcggctggagaagaaaatgcaacttcgaccggtccggtcatgctgcccgaatacaaggctttgtatgaagtaaattccgatattgtcggatggctcaacattggaaacggattgttgagtactccaatcatgcagcgggataatgaatattatctcacccataatttttatggggaggaagacaatcacggtcaggtttttctggatgagcgcaattcgccggatctaagcgacgacaacaccatcctttatggacacaacatcaccagtgataagtcgatgttcaatgtactgaccaactaccgcgaccctcagtttgtggcagataatccaatcattcaggtcaacactctgtaccagaagtatgagtatgtggtttcggcggtgtacatcgtgtccaccagaccggagcacggggagctgtttgactatatcaactacctgaaattcagtaccaaggcagccaaggaagcgtatattgcacagattgaccgccgttcactgatcgataccggtgtgacgatgaacgcagacgacaagattttaaccttttctacctgtacctatgagtttgcagatgcgcggcttgttgtagtggcaagacgtttacgggacggagaaaaggcagaagactttggtcacaatgtaacaatgcgtgaaaacccgctgatgccagaggtctggaccaaattgtttggataa

SEQ ID NO: 1018 - DNA, 810 bp, Clostridium sp.
atggggaaaacgaaaggagagagacgaatccaaatgggaaagattattgctgttgcaaaccagaaaggtggagttggaaaaacaacttcggtaattaatctgactgccggtcttggaaagtcgggaaaaaaatgtctgctggttgatattgactcgcagggaaattccaccagtggattaggaatcaataaacgtgaggtggaaatttccacctatcatcttttaacgggagacgaacgcgcagcggaagctattgtaaagacagagtttaaaaatgttgacctgattccgtccagtattgatctggcggcagcagagattgagctggtagaactgagcgaaagaaccctgagattaagacaggctttggctccgattcgggatcagtatgattatattttgatcgactgtccaccgtctatgggactggtgacactgaatgctttttctgcctgtgacagtgttattgttccaattcagtgtgaatactacgcgctggaaggtttgtcccagctgatggcaacgattaaacaggtgaaacgcctgtataatccggtaattgagctggaaggaattctgcttaccatgtatgacagcagactgaaactgaccgaacaggtggaagaggaagtaagaagccattttccagataaggtgtacaaaacagtgattccaagaaatgttcgtttgtccgaagcaccaagttttggtatgccggcaatctactttgaccagaattccagaggagcaaaagcatatctggaactgaccaaagagtttttgaaaaagtatcgtgtaaagaaaaagtag

SEQ ID NO: 1019 - DNA, 1524 bp, Clostridium sp.
atgaacgattccattacaataaaacaggtcgtggaaattctcaagcaggacggaattttgacagaagtttcctgtccggacgaaatgctcgaccatccatttgattatctctcatacagctcctccgatgtaaaggagaacactttctttatctgcaagggagctgctttcaaagaggagtatctgctggatgcagtgaaaaaaggagcaggggcatatcttgcagaaaaatactttaccaagacagttccttatatcctgaccagcgatattcgcaaagcaatgagcctggtggcaatcgctttttacagggaagcatacaagtctttccggttgattggtctgaccggaaccaagggaaagacaactaccacctattttatgaaaaatattttggatacattctgcgcaaaaaatcctcagctgtgcggtgctccaaagagtgcggttctttccaccgttgaagtggacaccggaatcgagcaccatgaagcgcatctgactaccccagagtccccggatcttcagcgctactttgcacagaccagagacagcggtatctccttcctgaccatggaggtttcttctcaggcatataagctcaaccgtgtttatggtgtagaatatgatctgggaatgttcctcaatatcggagaagaccacatcggtccgctggaacacaccgattttgaagattacttctcctgcaaactccagtttatggagcactgcaaaacagcggtaatcaatcgtgatatggatcatgcccagcgtgtactggagcgtgcacgtgcacacgcaaaaagagttatcacctttggcagactggacggtgcagatctggacgatgaggattgctggattctgcgtgatattcaaaaagaggatgttggatttacctttactaccagccacggaatgcagcaggacacttggcgtatccgcatggcgggaagattcaatgtagaaaacgctttggctgcgatcatctctgcaaaagcgatgggagtggacgatgagtccattcgagaaggtttgctcaaaaatgaggttcagggaagaatgaacctgtttgaaaaggacggcatcaccgttttggtagactacgcacacaactatctcagcttcaaaaaactgtatgagtcgctgaaagcagattatccaggaaaaaggattgttgtggtggtaggctgtccgggaggaaaagcatatctgcgccgcagagatattggaacactttccggtgaaaatgcggactacctctatctgactgcggaagatccgcagtttgaggatgttcgggaaatctgtgaggaaatcgcttcctttgtgaaaccatacaataaaccatacgaaatcatcgaagaccgtgcacaggcagtagaaaaagcaattttgaccgcacagtcgggcgatgtgattgttctggcagcaaaaggggaagaggtatatcagaaggtcaggggagaatatgtatattatgaatctgaccttgcaatcgcaaaacgtttgctttcggtatga

SEQ ID NO: 1020 - DNA, 1782 bp, Clostridium sp.
gtgaaaatattgagccaaggcaaaattgttaaggttgccggtccgctgatcgttgcagaaaacatgcgtgacgccaatatgggtgacgtagttcgtgttggtaagcagaagctcatcggcgaaatcatcgaaatgagagatgacaaggcatccattcaggtttacgaggaaactgccggtatcggtcctggcgacctggtagaaaccaccggtttccctatgtctgttgagctggctccaggtgtactgaccagtatctttgacggtatccagcgtcctctgaccaagatcagagaaatgaccggaagcaacatcaccagaggtatcgatgttacttctctggaccatgaaaagaaatgggattttgttgcaactgctaaagttggcgaccatgttgtaatgggcgatgtacttggtaccgtacaggaaacatccatcgttacccacaaaatcatggttccaaaagatgttgaaggtgagatcgttgagattacctccggcagctacaacatcaccgaaaccatcgcaaaagtaaaagataaagacggcaacatccatgatgtctgcatgcttcagagatggcctgttcgtgtacagcgtccatatgctgaaaagctttctccagatatcccgatgattaccggtcagcgtgttattgataccctgttcccaatcacaaaaggtggtactgctgcagttcctggaccattcggttccggtaaaactgttgtacagcatcagcttgcaaaatggtccgacgtagatatcgtagtttacatcggctgcggcgaacgtggtaacgagatgaccgacgtactgaacgagttcccagaactgaaagaccctaaatctggagaatccctgatgttccgtaccgttctgatcgcaaacacttcggatatgccagtagctgctcgtgaggcttccatctacaccggtattaccatcgctgagtactaccgcgacatgggttactccgttgctatcatggctgactccacttcccgttgggctgaggctctccgtgagatgtccggccgactcgaagagatgcctggtgaagaaggttaccctgcttacctgacatcccgtctggcacagttctatgaacgtgctggccgcgttatctgtaaaggttccgatggccgtgaaggttccctgaccgctatcggcgctgtatcccctgcaggcggcgataactccgaccctgttgtacaggctactctgcgtatcgttaaagtattctggggtctggattcctcgcttgcttacaaacgccacttccctgctatcaactggctgacttcctattctctgtatcaggatcagatcggcgagtggatggacaaaaatatttccgacgaatggtccagcctgcatcatgatgcaatgcttctgctgcagcaggaatccgaactggaagaaatcgttaaactggttggttacgattctctgtccgctcctgaccgtttgactctggaagctgctcgttccgttcgtgaggactacttacagcagaacgcattcgacgatgctgatacctatacctccaatgacaagcagtacaagatgctcaagatgattctgaccttctccaaagagtgcagaaatgccctcaacagcggcgtaaaagttgaaaaactgttctctctgccagtatccgagaagatcgctcgtgctaaatatgttccagaagatcagttcaatgcttacttcaacgacgtattagctgagattgaatcgtccgttgcaaaagtcgtttctgaggaggtatctgcataa

SEQ ID NO: 1021 - DNA, 1848 bp, Clostridium sp.
atgaacgatataaaaaatccaaaaacaaaaaagccgatgatttattattacgtcattgcgctgctggtttttatgctgctcaatactttcttgttcccaagtctgtttcgccgcaccgagcgtgaggtcgattacagtaccttcatgaatcagctcaatgaaggtcaaattcagcaggtagaggttcaggatcagaaaattgagtacattctgaaagaccaggaagactggaatatctatgttaccggaaacatgggtgacccgaatctggtggacaaactggaagctgcggacgtcatctatggcaaggaaatccaggagccaatgtcgccgctgctgtatctgctgatcagtgtcggcttcccgattctgctgtttgttggagtagggcagctgctttccagaaccttgcaaaagaaaatgggcggaggaaatgccatgacctttggcaagagcaatgcaaaggtctatgtggaagcacaaactggcaaaacctttgccgacgttgccggtgaggatgaagcgaaagaagcactgggagaaattgttgactttctgcacaatccgaagaaatatgaggcaattggcgcacagatgccaaaaggtgcactgctggtaggccctccaggaaccggtaaaaccttgcttgcaaaagcagttgccggtgaagcgagcgtaccattcttttctatttctggttcggaatttgtagagatgtttgttggtgccggtgcggcaagggtcagagatctgttccgccaggcacaggaaaaggcaccatgtatcgtgtttatcgatgagatcgatacaatcggtaaaaaacgtgacagtggtgtaatgggcggaaacgatgaacgcgaacagaccttgaaccagctgctgaccgagatggacggctttgatggtaaaaaaggtgttgtgattctggcagctaccaaccgtccggaaactctggataaggcgttgctccgtccaggaagatttgaccgaagaatcccggttgaattacctgaccttgcaggcagagaggccattttgagggttcatgcaaaagataaacagatggctccaaatattgactattctgttatcgcaagagcaactgcaggtgcttccggtgcagaacttgctaatatcgtcaacgaagctgcactgcgtgcggtacgaaataaccgtacacaggttgaacagggtgacctggaagaagcagtggaaacagttatcgcaggttaccagagaaaaagtgctgtggtatcagagaaggataaaaagattgtggcataccatgaaatcggacatgcgctggtggctgcaatgcagaaacattctgctccggtgcacaaaatcaccattgtaccaagaacttccggtgcactgggctacaccatgcaggtagaggaagaggataccttgctgatgagcaaggaggaagcgattgataaaatcacaacctataccggcggaagggtggcagaagaggttatcttcggttccatcacctcgggtgcatccaacgatatcgaacaggcaaccaagcttgcccgcgcgatggttacccgtcttggtatgagtgataatttcggtatgatggcattggaaacagtgaacaatcagtatctgggtggggatgcatcgcttgcctgctcagaagagaccgctgcaaaaatcgatcaggaggtttgcaccctgattgcacagtgtcatgatcatgcaaaagaaatcttgctgcaaaacatgccaaaacttcatgagctagcttcttatctgctggaaaaggaaaccattaccggcgaagagtttatggaaattttaaatgctccggtaaaatctcaggaagaacaagagtaa

SEQ ID NO: 1022 - DNA, 1233 bp, Clostridium sp.
atggttatgctggatgtattgcgattattgatagcggttattgttgcattttttgcaggaaaactgatttcacgtctgcgtctcccatccattttgggttggttgattacaggaatggttttagggccgcacgcgctggggctgctcaacaacaacgtgctggacagcggatggtttgatgtgctggagagtattttggaatgtaccgtcggtttgatgattggaaccgagcttatttggagcaagcttaaaaaagcaggcaaacagatcattgtgacaaccattaccgaatcggtgggaacctttctggtagtcagcattgtgtttggtatcattttctgggtttcccagattccggtatatcttgcgtttctatttggaggaattgcgcttgcgacagcacctgcgccgtccctctccattgttagtgatatgaagacttcaggaccggttacacgaaccttgattccaatggcagcgttggatgacctggttggagcgcttatctttttctgtgtcatcgcaatagtagcggcgaatatctcaaccaaagagatcccgatttttgctatgatgtttttggttttccttccggtactgattggaatggcgaccggatttgttacaggaaaaatgctgcaaaaagcgcagacacaaaaagcatctttgctcattctgatcgggatgattctggtttcgtcaggaatcgggctggttttaaatgagatggtactgccgacccctgttttaaacttcatgctcttgggaatgggattttccactatttttgccaatatgatttcgcaggaacagctgggcgaaatcatgaagataatgcatccaattatcggggtttcgctcattgtcgtgattttgaatctgggtgcaccgctggattaccacttgatttttaacgcaggaatttatacacttatttatatcgtatttcgtgcgattggaaaatattgcggtgcttattttggggcaagtatcacccatgcacccaagacagtcaaaaaatatctgggctttaccctgcttccacattccggtgtatctcttgtctttaccggaattgctgtttcagttctgagcacaccggcaccggaatgtgcgcagattattcagggaaccattgcagcagcggcggttatcaacgaaatcatcgctgtgtttatagcaaagaaaggctttgaatgggcaggggagctgaacaaggcagagaaggaataa

SEQ ID NO: 1023 - DNA, 1677 bp, Clostridium sp.
gtgataaagggaagtcagctcagagatgcgtttatctctggcgcaaacagcatttcaaattgcagacagcaggtagacgcgctcaatgtattccctgtaccggatggtgataccggtacaaatatgtcgatgaccatcaacgctgcaaaacgggaactggaaactctcaaggatgatccaaccgttgagcaggtatccaaaaaggcagcttcggctcttctgcgtggtgcgagaggaaactccggtgttattctttctttgctgttccgtggattctccaaaggtctggaaggcaaagaagaagcagacgcaaaggatattgcgcatgcactgtctctgggtgtttctgctgcttataaagcagttatgaagccgacagagggtactattctgaccgttgcaagacttgcttctgaacatgcgcagcaggttgcccagcaggaagaagtaaccgaagtgatgatgtggaaagagatcctttctgcagcagaggatgcgcttgcacagactccggagatgcttccggtactcaaaaaggcaggcgttgtcgatgcaggcggtcagggctttgttgaaatctggaaaggtatgctgtcggtaatcgaaaacgaacagatcattccttccgaggaagaagctcaggcagctccaaaagagaaaaaggcacacggtgttgcagcagagttcaatgaagaggatattcacttctgctattgcaccgagtttatcatcaacaaagagcatccggatgcagacccgctttctcttcgtgcatatctggagtctattggtgactgcgttgttgtagttgatgatgaagagatcatcaagtgtcatgtacataccaatgagccaggtaatgcaattcaggcagcactgaaactgggttatctgactaatatgaagatcgataacatgaaagaacagcacggcgataacaacaagctggtcgatctggaagcagaaggacagccagcattcccatataaggctgttgacccggataaagaatatggttttgttgcaattgcagcaggcgaaggtgtaaaacagctgtttgttgatttgggtgttgacaatgttgtcagcggtggccagaccatgaacccatctaccgatgatattctttccgcaatccatgcaactgcagcaaagagagtttttgttcttccaaataacaaaaacatcatcatggcagcagaacaggcagcaaatctggcagaccgtaaagtagacgttctccagaccagaaccatcccacagggactttctgcaatgctggcatttgatccggaagcagaccgcaaacagaatgttaccaacatggttcaggcttatgaaagagttggaaccggttcggttacctttgcagcacgtgacagtgactatgaaggtcacaagatcaagaagggcgaactgcttgcactggaaaacggcaagatgtcctttgttgataccgacctgaaaaagacagtagttaaactgacccacaacctcaccaagaaatcaccaaacaaggatgcaagctttgttactctgatttacggtgaagatgttgcagaagaccaggcagaagaaatccgtgaagcagtagcagaacgtcttggcgacagcgctgaggttgttctgattgcaggcaaacagccggtttactacttcattatttcagtagaataa

SEQ ID NO: 1024 - DNA, 885 bp, Clostridium sp.
atgaaaacatatttagtgcttttgggaacaggaaccccaaatgcctgtcccaatgcaagcggaccatcttccgcagtcgtggtgggagacagagcttatctggtggactttggcccgggtgtggttcgacaggcatccaaagcatattataaaggaatagatgcactgcgtcctgaccgcctgacaacagcgttttgtacccatctgcacaccgaccatacagctggatatgcagatttgatctttacaccatgggtgttggaaagagaaaccccgttgactgtctttggtccaaagggaattcgaaatatgaccgagcacattcaggcggcgtatgcggtggatattgactttcgcctgcatggatttgaacgtgccaatggggtcggttatcaggtaaaggtccacgagattggagaaggggttatctatcaggatgaccgtgtgagtgtggaagcatttttggtcagccacggaacactggaaagctacgcgtacaaatttaccaccatggatggaaaggtaattgtaatcagtggagatactgctccattggatgttgtagcgcagaaggccaagggatgcgatatcctcctgcatgaggtggagtacagcgcaggaattgcctgtcgagaaccgaagtggcagaagtaccaccgtgaggtacatactctgagtacagatcttgcaaaggtagcgcaacaggcacagccaaaacttctggtgacctatcaccggatttaccatatgaatattcaggacaacacacaagacctggaatatgaaatggcatggcgctgtgaggcaattttacaagaaatcaaagatgctggatatgacggtaaggtcgtcaatggacaggatttggacatttttgaagtgtag

SEQ ID NO: 1025 - DNA, 1149 bp, Clostridium sp.
gagagaaacgatgacgaaggaggatcttttatgagagaatttacacttaatatgttatcgcacgcagatcgggtaaaaggacagggcgtgctgtcagcttatctggaagaactccatttgattacaggaaatttggaccaaattgaaggcaaggacaccgattttcagatgaaagtggtggtaaattctgcacgtccggcagatattacccatattcataccgtaaacccacagttttttatgcagatcccgtacctgaaaaataaaggagtaaccgtagcttcggttcattttctgccggaaacagtcgaccagagtctgagtattccaaaagtattccgggaattcttttatgattatctgattcagttttataagagtgttgactatctggttacggtaaacccatgttttattccaaagctggcagcctatggaattgacgaaaacaaggtaacctacataccaaactatgtttcctcaaaacagttttatccggtggatgaacagagaaaaagagaattaagaaaagaatatcacctgaaagaggatgtatttactgtggtctgtgccggtcagctgcaaaccagaaaaggtgtgtttgaatatgcaaaactggcagagcagcttccgcagatgcagtttgtatgggcaggagattttgctttcggcaatatgagtgatggctacaaagatattgaaaagctgctcaaagagcacccacagaatctgcatttcaccggactggtcgagcgagataaaatgccgcaggtttatcagatgggcgatgtcatgctgcttccaagctttgatgagctgttcccaatgacggttctggaagcgatgagctgccatgttccgattcttctgcgtgatctggacttgtatccagttattttggatggatattatctgaaagcacaggataatgcaggatttgcagaggagctcaataagctgtcacagcagccacagtattatgaacaggcagttcagatgagccgaaaaggcaatgatttttacagcgaagagcatgtactctcgatgtggagagacttttatcacgggctgcttggggaaagtcaacgacgtcagaataaagcaattttgaaaaaagtattttcagtggctgcgggaggagtacgatga

SEQ ID NO: 1026 - DNA, 1749 bp, Unknown
  Description of Unknown: Clostridiales bacterium VE202-14 sequence
atgaagaataaaacctataataaaaggaagattctcattgtgtttatcggggcgtcgctaatgatactggggctgattgcaagactttgttatctgatgatttttgacgcggaatattatcagaagaaggccgaggctctccacgagcgggagcgggagatcaaggcggcaagaggagagattatcgaccggaacggtaaagtacttgctaccaataagacggtctgtaccgtttcggtgattcacagtcagatcgaggatgcggacgcagtgacgaaagctcttgccgggacactggagatggaggaagaaaccgtacggaaaaaggtggagaaagtttcctctatggaacgaatcaaaaccaacgtggaaaaagaagttggagaccggatccgggagatgaatctggcaggcgtcaaggtggatgaggatttcaaacggtattatccgtacgaagagcttgccagcaaggtgcttggcttcacagggggtgataatcaggggattatcggcctggaggtcaagtacgaagattatctgaaaggagaaaatggaatgattctctccactacggacgcaagaggcgtggagctggaggggatcgcagaggaccgggcagagccgactgccggcaataccttgcggatcagcatcgattataacattcagaagtacgcccagcagatggcgcagaaggtaatggaggaaaagcaggcggagaaggtggcgatcatcctgatgaatccgcagaacggagagatctatgctatggtgaactggccggagtttaatctgaacgaaccatttgaacttccggagggaacgacatatgattcggaggatgaaaagcaggaacttttaaaccagatgtggagaaacgggtgtatcaacgacacctatgagccgggttctacctttaaaatcatcacctccagcgcctgtctggaggagggggtcgttgatctggatgatacgtttgtctgtccgggatacaagatcgtggaggatcggaggatccggtgccacaaggtaggcgggcacggtgccgagacgtttgtggagggcgtccagaattcctgtaacccggttttcatggaaattggactacgccttggagcggaacggttctgtgactatttcgaacagttcgggctgatggaaaagaccggggtggatcttccgggggaggcttctactatcatgcaccggctggaagatatcggggaggtagagcttgctaccatgacattcggtcagtcgttccaggtgacgccggtacagatggccgccacagtcagttccttgatcaatggaggaaagagggtaacgcctcattttggggtagaagtgctggacagtgagagcgggaagacgcttaagacattttcggataaacagggcagaagggtcatatctgagaaaacgtcagagacgatgcggaaaatcctggagagcgtggtttcagtcggatccgggaaaaacgcctatatcgagggatacagtatcggaggaaagacggccacgtcccagactctgccaagaagcgccaacaaatatatttcttcctttattggctttgctccggccgaaaatccgcagattctgggaatgtgtgttatctatgaccctaagggaatctattatggcggaacgatcgcagccccggttgtgcgggagatttttgatgacgtactgccgtaccttggcatcgaaaaacaagagaacgcaaagtctgaaaaggaagagtga

SEQ ID NO: 1027 - DNA, 1260 bp, Unknown
  Description of Unknown: Clostridiales bacterium VE202-14 sequence
atgaaagagaaaggattttctaaagattttattatggtagtaattggacagattatctctctgttcggaaacgcagcactccggtttgcgctcccattatatctgctcaatcagaccgggtcgtcggcactctatggcactgtgactgcctgtgcgtttcttccgtccatcgcaatgtcacctattggaggaattgtggcagaccgggtaaataaacgaaatattatggtggcacttgattttttgacagcagcggttgttggaggacttgcggtttgccttcggtttggaaacgaggtgctgctgattgcgctgacactgatgattttatatggaattgcaggagcatatcagccgtctgtgcaggcagctatcccagtgcttgtcagacaggagaaggtgatgagtgcaacttctattattaatacagtaagttcactttcctccctgaccggtccggttctcggtggaattctatacagtatgtatggcctggttccggtgctcatattatgcaccacttgtttctttgcctctgcggtaatggagatatttatacatattccttaccagaaaccagaaaaacatgagcacattctgaggattctaaaaacagattttgcacagggaatccattttgcatggaaagaaaatcggaagatcggggaagttgtgctgattgtctgtggaatcaatctttttttatctgctatgatgattgtaggaatcccatatcttgtgacagaagtactggaactagaaacagaactggcaaatcagctttgtggttttgcggaaggcgcccttgcggccggtggacttgcaggaggaatttgcgcgggtatttttgcaaagagactgaaattcagtcaggccggaaatcagattatggctgcggcagcgagtgccttcccgatggcaatcattctttttttaccggtttcggcaatagtagtctatggagtaatgatggtatgctgttttgggattatgatgtttgctactattttcactgtacagatgatgtcctatgtacagatcgtaacgccccgcaatctgacggggaaggtcattgcccttgttctgatggtatccacctgttctcagcctcttggaaatgcgatgtatgggattctatttgaactgtgtaggggagcagaagcatttgtcgtactgttttcaggaattgtgtcatttgcgcttgcggctgtgacaagaaaaagctttcagagtatggagacagaatatagaaattcataa

SEQ ID NO: 1028 - DNA, 1041 bp, Unknown
  Description of Unknown: Clostridiales bacterium VE202-14 sequence
atgcgagcggtttattacctgaatcagttttttgggcagattggaggggaagaagcagcggatcatccgacggagatacaaagaggagcggttggagctgcgggtgctttccagaagagattcagcgaagaagaactggaggttgcctttacgatcatctgtggggacaattattttgcggagcatacagaagaagttttggaagaagtaagacaattcttagagaaggagaaaccggatctattgatcgcagggccggcttttaatgcgggacggtatggaatggcctgcggaaatatgcttaaactggcgcagcagcacctgggtattccggcggtatcggcgatgtatgaagagaacccgggaatggagatgtttcgattgtatggctacatatttccatccgggccaaatgccagagatatgagaaaaaccatgaaaaaaattggggattttgttgaaaagctggtaaaagactgtgaaattgggagcccaaaggaggagggatattttccaaggggaattcgaaaaatggtctggaaagagaaaagcggagcggtaagggcagtcgatatgatgttaaaaaaagtcagaaaagagccgtttgagacggagctgccaatgccaaagtttgaccgtattgtaccaagtccggcgatacggaatctttctaaagcacggatcgctgtgatgacttcggggggaattgttccgaaaggaaatccggatcatatggaagcgttggcgtgtacgaagtaccgagcttatacattggaggaatatggggacgccgggacattgccggctgacgtggctcatggaggatttgatccctcttttgcaatggaaaatgggaatcgtgttcttccggttgatgttttggaagattttgcgaaagatggaactataggagaactgtatccttacttttatgtcacggtcggaaattccatgccggttgacagggccgctatgttcggacaggagatcgcaaaggagattaagggaaaagttgatggcgtcattctcacttctacatga

SEQ ID NO: 1029 - DNA, 1158 bp, Unknown
  Description of Unknown: Clostridiales bacterium VE202-14 sequence
ccggatcaccattacactgacaggagaaagactttgaagatactgaatattacaaaatcatatcgtttaaaagattttaaattttcgttgttgatctttgtgcttgccttgacgtcccttgggattatggtcatcggaagtgccaaacattctgtccagggaaagcagatgatcggcttgctgatcgggcttgtggcgttggttatcgtctctttgatcgactatatgtggattctgaatctgcaatgggttttgtacggactgacgatagcaatgcttctggcagtacgctttttcggaaaagatgttaacggggcgaccaggtggattgactttggattcacgacgtttcagccctcagagcttgccaagattcttttagtactgttttttgcaaaatttattatgaatcatcaggatgagatgaagaaaccgcttaccatcattcaggcagtgatcttcctcgctattccgtgtcttttaatatacaagcagccagacctttcgacgaccatttccatagccatggtgttctgcattatgatgtatgtaggaggtttgagctataaattcattggagttgtacttctgattacagtcccgacggttgtcatccttctgagtattatcgttcactcggatgtggacgtgctgcaggggtatcaggaaactcggattctggcatggcttcagccggaaaaatacagcagcgacgaggcttatcagcagaataactccatcatggctatcggttctggtcgtctgactggaaagggactcaacaataacacgacaacttccgtgaagaatggaaactttattctcgaaccacagacagactttatttttgcgattgttggagaagaattggggtttgtgggttgctgtattgtgattggtctgttattattaattgtaatacaatgtctgaggatagggatgagagcaccggacatgggaggcaggattatctgctgcggagttgcttcgcagatcgggattcagagttttatcaacatcagtgttgcaacaggactctttccaaataccggaattccgctgccgtttgtcagctatggaatgtcatcccttgtcagtatgtttatcggtattggactcgtgttaaatgttggactacaacagaaaaaatataaataa

SEQ ID NO: 1030 - DNA, 1314 bp, Unknown
  Description of Unknown: Clostridiales bacterium VE202-14 sequence
atgccaactgttaaaaaaatatctatacttgaaatcatgaggaacagccagaaaggaagggattacgtggaagttgatgtaaagaaagtcatggaacatctgaacgaaatctaccagtgcggtgcaaaaccggatggcacttttacaaggatggcatactcccgggaggataaaaagggaagagaagtcttctgcggctattttgaaaagctgggtattccgacacgggtcgatcaggcagggaatctgatcgcacgcatggagggtacagacccgtctcttccggcgattatggtcggctcccatttggatacggtgccggatggcgggaagtacgacggagcggtcggatgcatgggaggacttgccgtgtgtgagacactgattcaggatggacgaaaattaaagcatcccctggaagttgttgtctttaccgatgaagaaggattccggtttggtagtggacttctgggaagcagcgccttgtgcggagaagagctggacatccatccggaggatctggatatcgaaggaaaaacgagaagagaagtgttcgagggttgcggcatgtctgtagagcatgttgccggagcaaagcgggatccggagtcgatccactgctttattgagcttcatgtggagcaggggggaacccttgataaaaagcagattccggtaggtattgtatcttccatcgcaggggtgagccggtttgaagtgacgatcactggcgaagcgaaccatgcgggaagtacaatgatggaagacagaaaggacgcgcttgtagcagcatcacattttatcggacaggttccggaaacagtgcggacacatggaaatccttatactgtgtcaactgtaggaacgatccgggtaacgccgaattctgtcaatgtggtgccaggtacctgtacattccagttagagatccgggatcaaaatgacgcggttatgaaagagattgagacaagacttcacacgacacttgaggaaatatgccagagagaagatgtcagctatacatgggatccaatttcctaccacgcaccggccccgatgaatgaggcagtgaaaaaagccatcgagacggcggtaaagaagactggaacagactatatggttcttccaagcggtgcgtttcacgattctctcctgatgacagggctcgtcccgacaggaatgatttttgtaccaagtgaaaatggaatcagccattcccggtatgaatttacaaaagaagaagatatcggactgggatgtgcagtattattagaaacaattttagaagtagataacatggaaatgtcatgttaa

SEQ ID NO: 1031 - DNA, 1347 bp, Unknown
  Description of Unknown: Clostridiales bacterium VE202-14 sequence
ttgaggtgtaaagaaaaagaaatggatataaaagcgattgcggtgacaggagtcgcctatttgattctattgattctatttataaagacaggaaagaagaggacaaaaagccgggaaaagcggcgcaaaatccggaaaggcatctgttttttcttctttgtcaataccctcagcgtggcggtgtttatctggacgggacaggaacgtccggtgaaagacggcaagcttggccgggacgaaaaaggaggtgggagcaggaacgagacagtacttgccacggtagacggtatttgtgagagagttcctgtccagatcagggtggacgaccaaggttacacagaagaggaggccacggcgatcctgaaggaagtgtccgaagaactggaagcaaagatattaggtagcaatgaaaaaaggagctatgtgacgacggatctggatcttatcacatccattccgggctatccggtctcgatccaatggacactggacaattatgatcacatgggactggatggaactctaagagaaggaataccggaggagggagccacagtacatctccgggcagtactgagctttgaatatggacagaagcagatggctcagaagacatgggagacaacagtgacgctctatccgccggatcttcaaaacccggagcaggtgatagaagcactggaacatctggtgaaggaggaaaacgaaaagagccgtgatgagacagcgctgtctcttccggatgagatcgccggccatgctgttacttgggggcgggatacagcaatcagcgggtaccaggtgcttggaatgggaggtctgatctttctccttctggccgcctgggggcgacagaaggcaagtgaagccttaaagattcggaaaaaccggcttttgcaggattacccagagattttggagcagttctccttgttgataggagcgggaatgactgtcaaaagcgcatggtataagattgtggacaactatcaggaaagaaaagaccggtgtggaaagcgtccggcttacgaggagatggtaaggacctgttttgaaatgcagggcggggtacccgaaggagagagctatgagaatttcgggaaaaggtgccagacacaggaatatatgcgcctggggcttctgctgtcccagaatcagagaaaggggacacggggaattacagagcttctaagtctggaggctattcatgcttttgaggatagaaaggcaagagcaaagaggaaaggagaagagactggaacaaagcttctggtacccatgattatgatgctggcggtagtactggtgatcgttattgtcccagctttctggagcacgggaatctga

SEQ ID NO: 1032 - DNA, 1185 bp, Unknown
  Description of Unknown: Clostridiales bacterium VE202-14 sequence
atgagtacagaattaatggaggctcttaccatactggaacaggaaaaagacatcagcaaggaaacgatgctggatgctattgagaattccctgatgaacgcctgcaagaaccattttaaaaaagcggacaatattaaaatcgtgatgaaccgggagacttgtgatttcgcagtttatgcggagaagaccgttgtggaggaagttgacgatccagaagagcagattagccttgtgaacgcaaaaatgatggactctaagtatgagctgggcgacattgtccaggtgccgattgattccaagtcctttggccggatcgcgacgcagaacgcaaagaacctgattcttcagaagatcagggaagaagagcgcaaagttgtttacgaccagtacttcgagaaggaaaaggatatcgtgaccggaatcgtgcagcgctatgtaggacgtaatatcagcatcgaccttggtaaggcggatgcaatgctcacagaaaatgagcaggtcaaaggtgaagtattcaagccgactgagcggatcaaactttatgtggtggaagtgaagaatacgacaaaaggaccgaagattctcgtatcccgtactcatccggagcttgtaaagcgtctttttgagtccgaggtgacagaggtaaaggatggcatcgtggagatcaagagcatcgcaagagaggctggatcccgtacaaagattgccgtatggtctaacgatccggacgttgatccggtaggagcgtgcgttgggatgaacggacagagagtcaatgcgattgttaatgagttaagaggagagaagattgatatcattaactggagcgacaatccggcgatacttattgagaatgcattaagtccggcgaaggtgatctccgtggcggcggatccggaggataagacggcaagcgtgattgtaccggattaccagctctctctggccatcggcaaagaaggacaaaatgcgagactggctgcgagactgaccggatacaagattgatatcaagagtgagactcaggcaatcgagtctggagaacttccggcaaactatatggatttgccgatggaagagggcgtatatgagtccgacgtctatgaggatgattacgaagacgattactatgaggacgacgctgtctacgaagaagaaagttacggggatgaaagtgatgaataa

SEQ ID NO: 1033 - DNA, 1416 bp, Unknown
  Description of Unknown: Clostridiales bacterium VE202-14 sequence
atgagaagttttacagaaaaaggaggtagtaacatggacggagaaattgcgtcaaaagagattgagcgaaaaaggggtgagctcgatgaaatcagccagtatatctggaggaatccagaagcaggttttaaagaagtcaaggcaagtgaaaaagtagctgactatctggaaagagaaggctttcgggtagagaggggagcaggaggtgtgccgacagcaatcaaggcttcctatggaaatgggcatccggtgattggatttatgggagaatttgacgcattgccgggactgagccagaaagtttcttccaagaaagaagaaattccggaacagacatacggtcacggatgtggacacaacctgctctgtacggcacatgtaggagctgtcattgggctgaaagaagagatgattcaaaaaaatcttccgggaacgattttgttttttgcctgtccgggtgaagaacttctgacagggaaaccgctgatggcaagaggcggagcgtttgaaggagttgatgttgcgataaactttcatccaaataaaatcaatgaagcaacaaccggagtttctacagcggtaaattcgatgaagttccgattccatggggtctcgtctcatgcggcaaatgccccggaaaacggaagaagcgcactggatgcagtggaactgacaaatgtaggagccaactatttaagagaacatgttccgtcagatgtcaggatccactatacgatcacggacggtggaattgttcctaatgttgtaccggatcaggcggaagtgtggtattatgtacgggcattttcaagggaagtggtagaagatgtgtacaatcgccttgtacgggtagcaaagggagctgcaatgatgacagatacttcagtcgaagtggaatttctcggagggtgctacaatacgatgaataacagaattcttgcggaagtggtcgcggaatctatgaatgagatcgcacaagaaccatggacgcaggaggaaatcgcatttgcggccgagctggatgcacagacgccggtggcggcagaagcgacaagaaaaaaatatggtttgccagcaggaacccatctgtatgaaggaccaggaaaagtaacctgttttaatagttatggatccacggatattggggatgtcatgcatttgatgccgaccgcttatttctttacagcatgtaccaatatgggagcaccggctcatagctggcagtttacggcctgtgcagggagcagtataggtgaaaaaggaatgatatatgccgcgaaagttatggcatgttatggcgtcaaactgatagaacagccggagattctaagaaaggcaaaggaagagtttgaccgtcagatggaaggaagaacctataaatgtccgataccggatgaaatcggagttccggaataa

SEQ ID NO: 1034 - DNA, 813 bp, Unknown
  Description of Unknown: Clostridiales bacterium VE202-14 sequence
atgggagagtacagaaaaagagacagaacggatcaaaacagaaaaacgaagaaaagaggcgggattctttccgccatcattttgattgtggcggccgttgtgttttgtttttccgggctccaactgtttcggattttttacggctatcataagggggagcaggaatacaagaaactcagggatatcggactaagtactgaagatgattccgcagatggaggcgggagatatctggtagacttcgaggaactttggaaggtcaatccggacattgtcgcatggatccgatttgatgagccgtcaatcatcagttatccggtcgcacaggggaaagacaatcaggaatatctggataagacgatttctggatatccgaatacatacggggcgatctttctgaatgtaggaaaccataaagagatgacggacaaaaacagtattatttacgggcatcggatgaatagtaaatccatgtttgggaagctggaagagtaccaggaggcatcctttttccatctctacccttatttttatatttatacgctggatggaaaagagctgaaatatcagatctttgcagtcggagaagtagaggacacatcgcaggcttataagacacaatttgaaagcgacgaggcgttcgaggcatttttggccttttcgagggaacattccttttatgacacgggggtggaggtcccgtccgacgctaaggttgtcacactgtcgacgtgtacgaaggcaaacaatgagaatcgtctgattgtacagggatatcaggtggaagtaaatgaaccggaagagagggaataa

SEQ ID NO: 1035 - DNA, 1116 bp, Unknown
  Description of Unknown: Clostridiales bacterium VE202-14 sequence
atgcatctgcttctggcatggattctcctggcgggctgcttttggttttatattgtcgtataccgcagcgtcaatgagccggttacatggctggaacgtacaaatacttcaccggctgttcacactgtctcggagatccggcagatacttaccggatataaggagtttttttcagaggacatggtgaagcatctttcggcggagcgaagctttggcacatatgtcattccggggctgaaagccgcaaaaaccgtagatagtaagacaggaatcacagatatctgcacatcgatgacaccgcaagggatggatgtaacggaggactcgatttttgtaagcgcatactgccatacgaagcggcataattctgtactttttgagattgataagaaaaccggacgcttcgtgaaagagattattatgccaaatcagacacatgcaggaggaattgcatacgataatctgaaacagatgctatgggtatcggactatgtagacggacaggcagcagtcagcctgtacacaatggaagcgctggaaaactatcagtatgataaaacgaaaaagccgctcccgtttttggaaacacatattctggaaggactcgccagaaattcctttatggcgttcaggggaggaaatctttatgcaggatatttttcgctttccggggacagtattattaaccggtattcggtagattttgagctgaacgagcagaataaagaagcatatgaagagatggatgaggacagagagttttttggaaatgtcgcaatcgatcaggagtgggcagatattctttcccaagtgcagggactggaagtgtttggaaattatctgtttttatctcagtcttacggatatgcggattccaagcttaggatttataaccggtctgttgtagagacagaaaagtacagtctgaaaaagaaagaagagattaaaagttttacgcttccgaaccgaatggaacagatctgtattcagggaggaaagctttatctgctctttgaatcaggagcctatgcctaccgtgggattcctgtcaactgtgtggaccggatcatttccgtcgatctttcggatgtattaagtcaacttgacgaggattag

SEQ ID NO: 1036 - DNA, 963 bp, Unknown
  Description of Unknown: Clostridiales bacterium VE202-14 sequence
atggaaaaaacatatggaatgatggttgccgcctcggtgatagaggaagtgaaaaaggcggtcattggaaaacaggattgtataaaaaaggtgatggctgcgattttagctggaggtcatatcctgatcgaggatattccgggcgttggcaagacgaccatggcagtggcgttttcaaaaagtatgggacttttgcggcaccgtgtccagtttaccccggatgtgcttcctgcggatattgtcggtttttccctctatgacaagaagacgcagcagtttgtctatcagccgggagctgcaatgtgtaacctgcttctggcggacgagatcaaccggacgtctccgaagacccagtcggcgcttctggaagtcatggaggaacggcaggtgacggtagatcagaggacgtacgaggttccggagccgtttattgtgattgctacggagaatccgttcggctctgcgggaactcagatgcttcctgagtcccagcttgatcggtttatgatctgtatctccatgggatatccggatattcagtcagagatcgagatcgttaagggaaatcagaaaggtagtccggcggatgcggtccgctctgtcatggacaaggaccttctgcttgcaatgcaaaaagaggtggaggaggtttatattcacgatgcagtctaccaatatattggaaatcttgtggaggcgaccagaaatcaccagatggtacggcttggcgtcagcccaagagggacgattgctcttgctaaagcagcaaaagcttatgcctatctggagggaagaacgttttgcatcccgcatgatgtggagagtgtcttcccggatgtgacggtgcaccgactgtttttgagcgccaaggcgcgggcggccagaatggattcgacccaggtgattgaggaaatcctgacagggacgaaaaagccgaaggcaggaaaagggagaatagaatga

SEQ ID NO: 1037 - DNA, 828 bp, Unknown
  Description of Unknown: Clostridiales bacterium VE202-14 sequence
atgaaattgggtgaaaaacaagtattgatgatggagaaggaagtggatttcggcgtatatctggggacggagtcagagcatgtcctcctaccgaaaaagcaggtgccaagggggctggagcccggagatccggtggaagtatttttatataaagattcccgggaccggctgatcgcgacaaccaacgaaccgaagctcactcttggcggactagcaatactggaagtcatcgacaccgggaagaatggagcattcctcgactggggactggagaaagatcttttcctcccgttccgtgagcagacgacaccagtgaaaaagggcgacagcatactcgtaagtctctacattgacaagagtgcgcgtctctgtgcgactatgaaagtgtatgagaaactttcctgcgattctccgtatcagaaagacgatatggtagagggaatcgtatatgaactcagcgaccgattcggtgtgtttgtggctgtggacggcaagtattccgcactgatcccgaaacgcgaagtctatcatacataccgggtgggcgagacgatccgggcgagagtagccgcagtcaaggacaatggaaaaattgatttaagcgtgcgggaaaaagcctttatccagatggatgtggatgcggcaaaactcgtggaatacatggaaaagaacggtggacgtattccatttacagacaaggcgtctccggagacaatccgcggcgaatttgagatgagcaaaaatgaattcaaacgtgcggtgggacggctcctcaaggagaaaaaaatcgaaatccgtgaaaaggatattgtaattgcaggaaaataa

SEQ ID NO: 1038 - DNA, 741 bp, Unknown
  Description of Unknown: Clostridiales bacterium VE202-14 sequence
atgaattatgtaaaagtttttgcgcacaggggagcaagcgcctatgcgccggaaaatacactagcagcgtttaggctggccgaggagcagggagcagatgggattgaacttgatgtacagcttacgaaggatgggcaggttgtcgtgatccatgacgagaatatagaccgcaccggaacagggacaggagcggtaagggactacacactggaggaactgagaaagctgtcgtttcacaatcacatggaagcttacgaaggagaaaagatcccaacactggaggaagtgctgacttttgtgaagcagggaagaatggaagtaaatattgaattgaaaacaggggtttactggtatccggaaattgagaaaaagaccatcgagattgtaaaaaaagcggggatggaagaacgtgttatttattcttctttcaaccattacagtgtccaaaagatactcagtatggatacgaaggcggagacggcatacttatatacagatgtcatgctggatgtagaaaagtatgctgaaaaaacaggggtacagggacttcatcctgctgtatttcacctatatatgtcagactttatgaaacgctaccaggaaagcggtttgaagattcgtgtctggacagtaaacagagaaaaagatatgaagaattttattgaggctggcctggaagctgtcattaccaactacccggatacggcgatagaggttcgcaggcaggtgaatcatgcttaa

SEQ ID NO: 1039 - DNA, 1161 bp, Unknown
  Description of Unknown: Clostridiales bacterium VE202-14 sequence
gtgagtttctatgataactaccagtttttctgcgtgctgatttttatcctcatgcccgcaatgctgctcggtattttggagcagccgctaaaatggtattccaccgccgcaacctttttgtttacggctctagccttcctttccaagccgcagcaagcggcttggctggctctcttttttgtaaccgagctgtttttggttgagggatatctgtccttccgggtgtctcgcgggagaagtcccgctgtttaccgacttgtgctgttcttgagtatcctgcccctgattctaagtaagctggccggtttctgggacggctccacctttgccttccttggtatttcctatctgacgtttagatgcgtacagatcattattgagacatacgacggtctcattacggaaatgcccgtcctggattttgcagcctttgtgctcttttttccgtccataagttccggtcccatcgaccggagcaggcggtttttacaggatctgaacaatattccttcccgtcaggattatttgactcttgccggggagggtgtgttcaaaatcctgctggggctgatttataagctgattctggcttctatcttcttcaaggggatgggaatggtacagggtgcacgggaatggtacttcgttatcttctacgcgtactgctatggattttacctgtttttcgactttgccggatacagccttatggccattggtaccagttatcttctgggaatccggacgcctgagaacttccgaaaaccatttttaagcgttgatattcaggaattttgggatcgttggcacatcaccttgtctcactggttccgggactttcttttttcccggtttatgattcagtctatccggaaaaagcggtttaaaacccggctgaatgcagcctgtgcaggatttcttgtcaatatgctcgtcatgggactctggcatggagtgaccccttcgtatattctctatggactttaccacggggtactacttgccatcacagaatggtataagaaaaaatcaagtttttataaaaaataccgtcaaaaacggtggtatcgtttcttatcctggctgattacactacagcttgtaatcttcgggttttatatcttttcgggacagttcttgtggcttctcggattatcataa

SEQ ID NO: 1040 - DNA, 891 bp, Unknown
  Description of Unknown: Clostridiales bacterium VE202-14 sequence
atgaacagagcaaaatcacagcggagatttgtttttgcatgtctcgcacctgcagtcatcctggtggcgctctttatgttctggccaaccgtcaatgtcttccggatgtcactgtaccgcatgggtggaattacaaaccggaaagagtttatcggtctgcagaactttaagacattgatggaagataaaaatttcctggaagcgatgcagaacacaattttgattattgtgatggttatgatttttactattgtatttgcaattctgtttgcggcgattctgcaaagagggaaattcaaggggaagaactttttccgcgttattttctacataccgaacattctcagtatcgttgtaatcggcggtatttttggcgcgatttatgatccgagcaacggacttctgaatacgtttcttgaagccgtccatctggattttctgactcataaatggatgggcgaaccgaagatcgtgatctattctattatctttgcgcttgtatggcaggcaataggatattatatggtaatgtacatgtctgggatgtcggcgattccggaagatctttatgaggcggcgtctctggacggctcttctgagatcaatacgttttttacggtaacgcttccgttaatctggacaaatatcaggacaacactgacattttacattatcagcacgattaacttaagtttcctgttcgtacagattatgacagacggaggaccgaacggaaagaccgaggtatttctgaactatatgtacaaacaggcatacggaaacggtgcgtacggatatggtatggcaatcggagttgttgtattcattttctcgtttgtgcttgcggcgattgtcaataagattacagacagagaagtttatgagatgtag

SEQ ID NO: 1041 - DNA, 1389 bp, Unknown
  Description of Unknown: Clostridiales bacterium VE202-14 sequence
atggataatagaaaagtttacatgaactaccataataatttattgcagctcgaagaacatatgtatccattggtggatgttgatacgccgaacgtattccggaatctttttccttatgatgaggttccgaagattgcgtttaacgaccgtattgtgccacattccatgccggatgagatctggatcaccgatacgacatttcgggatggacagcagtcccgtgcaccgtatacgacggagcagatcgtgacgatctataattatctgcacagacttggcggcccggaagggaagatccgccaaagcgagtttttcttatatagtaaaaaggacagagacgctgtctatcagtgtttagagaagggctatcaatttccggaagtgacaagctggatccgcgcaagcaaaaaggactttgagcttgtcaaagagatcggtctcaaggagacaggaattcttgtaagctgttctgattatcatattttctataagctgaaaatgacaagacgagaggcgttgcggcattatctttccattgtccgggactgcctggaaatcgggatcagtccacggtgccacctggaagatatcaccagatcggacatttatggatttgtgataccgttttgcctggagctgatgaatctgatgggagagtacaggattccgattaagatccgtgtctgcgatacgatgggatatggcgtcaactatcccggagcggtgatccctcggtctattccgggtatcatctacggtttgatggttcatgcaggggtgccgagcgaactcattgaatttcatggccacaatgacttctacaaggcagtcagcaatgccacgacagcatggctctatggtgcctgcggcgtgaactgttccctttttgggatcggagagcgtaccggcaatacaccgctggaagcaatggtctttgaatatgcacagctccgtggcagtcttgacggtatggacacgaccgtcattacggaacttgctgagtactatgaaaaggagatcggctatcatattccggagcacaccccgtttgtcggcaagaacttcaatgtgacgagggctggtatccatgcggacggacttctgaaaaatgaggagatttacaatatttttgatacgggtaagttcctgaaccgtccggctgtggtctctgtgtccaatacatcgggaattgcgggtattgcacactggatcaatacatattataaacttccggatgagcggaaagtaggaaaggattccgaacttgtcgcagcggttaaaatgtgggtggatgagcagtatgacgacggccgtgtgactgtaatgacagatgaagagatggtgcagaagatcactgaaatctgccgggaaaaggaaatcattttatga

SEQ ID NO: 1042 - DNA, 1239 bp, Unknown
  Description of Unknown: Clostridiales bacterium VE202-14 sequence
atgattgagacaggaaagaaacaggaaaaagtgattctcgtggcggcggctacggaggagatagagaaggtggagcgctccctcgatgaacttggcgagcttgttaagacggcgggggccgaggtgtgtggacgtatgattcaggcaagagacatgattcatacgggaacttatatcggaagcggaaagttggatgagctcaagtggctcgtgtgggaaaaagaggcagatggtattgtctgtgatgacgagttaagtcctgtccagctcaagaatctggaggaggcgctggactgtaagattatggatagaacacttgtaattcttgatatttttgcggcgagagcgtccacaaaagaggggaagatccaggtggagctggcacagctaaaataccggcagtcccgtctgaccggcctgggaaagagtctttccaggcttggaggcggtatcgggacgagagggccgggagaaaagaaactggagatggacagaagacttattaaaaaccggatcgcccagttaaaccgggagctggcagatgtaaggaggcaccgggaaataacaagagaaaagcgcagtcagaatcatattccggtctgtgcgttggtcggatatacgaacgccgggaaatcgacacttttgaataccttgaccggggcgtcggtgctggaggaggatcagttatttgctacgctggatccgaccacaaggatgttgattcttccggggaatcagaaaatccttctgacagataccgttggatttatcagtaaacttccccacaatctgatcgaggcttttcgcagtacattggaggaagcgaaatatgcggacatgatactccatgtggcggatctgtccaatcctcagatggaagagcagatgcatgtgacttacgaaacccttcgggagcttggcgttttgaataaaaccgtgatcaccgtgtttaataaatgtgacaaggcttcggaagagattttgatccgggattttcaagcagacgcgaaagtgattgtctccgcaaagaccggagaggggcttgacagactgcaagcgcttctggaggactgggtcagagagcaaagaatggaaattaagaggctgtatccatatacggaggcaggcaaaatacagttgatccgcgcctacggggaagtatgcaaggaagagtaccaggaggagggaatctacattgaagggttcgttcccagtgaattgtacacaaaagtgaattag

SEQ ID NO: 1043 - DNA, 873 bp, Unknown
  Description of Unknown: Clostridiales bacterium VE202-14 sequence
atggctgctggaaaagtacgttcagctaaaaagagacgtttcattcataatacgatcgtacatgtcgtacttgccattttggcgttgatctgggtattcccgattttatgggtaatactgacaagcttccgggcagagaaggggtcctatgtttccactttcttcccacagagctttacactggataattatgtgagactgtttacagacacctccattctgaactttccacagatgtttgcgaataccttgttcatcgcggtgtgttcctgtattctttccacattttatgtgctggcggtatcttattgcctttccaggctaaaattcaagttgcggaagccttatatgaacatggcgatgatcctgggactgtttcccggattcatgtccatggttgccgtttactttatcttaaaggcaatcggactgacagaagggaatctgatcaaagtggcgctgattttgtgttattcaggaggcgcggggcttggattccagatcgcgaaaggattctttgataccatcccgattgcggtggatgaggcggcgcttctggatggatgtacgagatggcagattttcagtaggatcacactgccgcttagcaaaccgattatcatctataccgtgctgacgtcgtttatggctccatggctcgacttcatttttgccaaagtgatctgccgtgccaactccgaccagtacacgattgcgattgggctctggaaaatgctggaaaaggaatatattgacagttggtataccagctttgcggcaggagccgtactgatttccattccgatcgcgatcctcttcctgtttatgcagaggtactatgtagatggtgtatccggagcagtgaaaggctaa

SEQ ID NO: 1044 - DNA, 924 bp, Unknown
  Description of Unknown: Clostridiales bacterium VE202-14 sequence
atgatactggataaaattacagaaaaagtacttcatatgatcgacggagaaggatttaaacaggagggagctttcaatctccgggaaaacggaatcgccgtctgccacggggacagtgagcatgtcaagatccgtaaaaaagaagacaagcagggaattgacatttatattgacaagaatacaaatggggagacggtacacattccggtggttgtctccgcctccggaatgaccgacgttgtctacaatgatttttatattgaagatggggcgaatgtgaatatcattgccggatgcggtatccataattcgggatgcaacgatgcaaggcacgacgggattcacacatttcatattggcaaggatgccattgtccattatgaggagaaacattacggggaaggagaaggtacgggagccaggattctgaatccggtaacagatatttatgtaggggagaattcggtgtttactatggatacggtgcagatcgaaggtgtagattccacgaagcgtgagaccgacattaccatggaggcaggaagccgtctcacagtgacagaaaagctgatgacccatgaccgccaggaggcagtttccaatatgaaagtgatcatggacggcgatggaagctcggcgcagatcatttcccggtctgtggcaaagggcgagtctatccagactttccacccacgggcgatcggaaagacagcctgccatgcgcacatccagtgtgattctatcattatgaatgatgcacaggtgcgttccattcctgagattgacgccagaaatgtggacgctcagatcattcacgaggcggccattggaaggatcaacagtgaacagcttttgaaacttgaaaccttcgggctgaatgaggaagaggcggagggagtcatcattgaaaacttcctgaattaa

SEQ ID NO: 1045 - DNA, 750 bp, Unknown
  Description of Unknown: Clostridiales bacterium VE202-14 sequence
atgaagaaagtgagccagacgattaccgtgacaggaatgattctgtcagcgcttccgattggagaatacgataaaagagtggtgatcctctcccgtgagcgggggaagatctccgcttttgcaaaaggcgcaaggcggccgaacagtatgcttgtcggaacgacaagcccgtttctgttcggcacgtttacgttgtacgagggacgctcctcctatacaatgcagcaggcggaaatccagaattattttggggagctaaggacagatattgaggctgtatcatatgggttttatttcctggaatttgcagaatatgttacgagagaaaacaacgacgagacggaaattttaaagcttctctaccagacgatgcggattgtcgtcaagagaagcatttctctttcgctgatccgatgcattttcgagctgaagatgatctgtcttgaaggggaggccccacaggtcttttcctgtgtcggatgtggaaagcagggtgagccgtactggttcagtgccgcgaaaggagggcttctttgccgggattgtgtgtcgaaagcgtccgatgcccggagagtggggcagtccacagtctatgcgcttgcttttattgtggccactccggtagagaagctctacacctttaccgtcactgagaaagtactggaggagttaaaacagtcggcgaagagatgcgtggatgtatacataggccatacgttccggtctctggagatgctggaattcctttaa

SEQ ID NO: 1046 - DNA, 1377 bp, Unknown
  Description of Unknown: Clostridiales bacterium VE202-14 sequence
atgaatttcaaacaatctattcaagctgaaaaagaaaacatcatcaaaagtatctgccaacttgtctccattccaagtacagaaggacgccctgcttgcggaatgcctttcggagaaggtcccgccaaagcacttcaatatgtgctggatctgggaagaaacatgggatttcatgttgaaaatttcgacaattacgctggacacattgaatttggtgaaggtgaaaagacattgggaatcctctgtcatgctgatgttgttccatgcggagaaggctggatccgcgatccttatgttcctgaaatcattgacggtatcctctacggaagaggcgtgctggatgacaagggtcctctcattgtctgtctctatgctatgaaaatcttgaaagatttacagatccctctgggcaaaaaagtccggctgatcgtaggaacgaatgaggaaaccaactggggatgtatggattactattttaaccaaaaacacgtaccattcccggatctcgccttcactcccgacgctgagtttccgctgaaatacgcagaaaaaggcgtcttacaatatgaacttaccatgccgcttaccggggaaatctctttttccggaggcaatgccgtcaattccgtaccggaaacagctactgtactcctgccatcttcctgcctttctgatttgctcgcaaatcagtctgctcttgaaaaagagtacggctgcaaacttgatatgctggcatctgaggacgggattcatctcactgtttcaggaacagcggcacatgctgcccgtccggaaatgggaatcaatgcaatcactggtgccatggctgcggttgattctctgcacctccagggtgatcttggagcagcggctgatttttatatgaaatatattggaaaagatctctccgggcaacacatcggagcaggattttcagacaatgaatccggttccctgacctttaatgtcggaaaagtgactgtgagagatcacagactgattctttccattgataatcgtgttcctgttacatactcctgccatgatgtcacactagctgtccagaaaacgattgcaaagaccccgttttctctggaacacgagtatgctacagattctatcctgattccacgtgacagttttcttgtcacgactctgatggatgtttacaaaaggatcaccggagatataaacgccaagccggaagtagacgggggatgtacctacgcacggacaatgccaaactgcgtcgcttttggagcacttcttcctggtcagccgaacactatgcacgaaaagaatgaggggcttcatgtccgtctgattgatacctggatggaactctatctggaagccatctaccagcttgcaaagtaa

SEQ ID NO: 1047 - DNA, 918 bp, Unknown
  Description of Unknown: Clostridiales bacterium VE202-14 sequence
atggcttacaaaggaattacgtttcgcaaggaactgcatatcgatcagatcttttctctgcactattttgagtatatgagtaccttctcttttcccggggaagcgcataatttctgggaatttgtctgtgtagacaaaggggaagtcaccatcggcgccggggatgcggttcacacactgaaaaagggagatatcgctttccatgagccgaatgagtttcactgggtcagagccaacggcagcatagccccgaacctgattgtcatttccttttcctccaaaagcccgatgatgaatttttttcgaaaaaagattctgaggactgatgattttgccagaaatattctggcccggattattacggaggccggaaattttctggaggggcgtctggacgatccataccagaccactctgcacacgaagtcttccctcccgccaggatctggacagctcattcagctttatcttgaggagctgatgatttatttttaccgaaagtactccgatctttcttccgttgccgaagaaaagccggacaaaccggacaagaccgtaagagagaatatcgacacggaagttttcaatcggatcgtctcttatctcggtcaaaatctgtcggggagggttacgatagaaaagatctgcaaagacaatctgatcggccgatcacaattacagaagctgttcagcaagaaatccggtcttggcatcatagaatatttctctcagatgaaaattgaggccgccaaggagctgattcgtacaggccagatgaattttacacagatttccgagaagctgggctatacctcgattcactacttttcgagacagtttaagaaagtaacaggcatgaccccctctgagtatgcctcctctatcaaagccatggccgaccgaagccaccgaaaataa

SEQ ID NO: 1048 - DNA, 675 bp, Unknown
  Description of Unknown: Clostridiales bacterium VE202-14 sequence
atgagagaacaggcaggctttgatatgattttgctggatcttgacgggacactgattgattcagagaaagggatcgtcaattccgtcatttacgccctggaaaagtttggaatagaaaaagagcgggaagaacttcttccgtttatcgggccgccgctggttcattctttccgggaatacacgggattaggcgaggaggaagctgttcaggctgtatcctactaccgggaaaatttcggtgtcaaaggagtttatgaataccgccttttcgatggcgtgaccgatttgctaaaacgtctgaaacaagcgggaaaaaccgtcgtgatggcgacgtcgaagccggaggtctatgcaaagatgattgcggaagatgcggggatcacatgctggtttgacgccatctgcggaagcgatatggaagggaaacgcctgacaaaggaagccgtcatcgaatatgcgcttgattcgtttcatcggaaagcaggggatccttcggtgattatggtgggggaccgtcactacgatattgacggggcaaaggcaaacggacttgcctccgcaggtgtactttatggctttggcagtagggaagagttggaagatgccggggcggatcagatctttgatacggcagaggaacttggtgaatatctggcaggatctaataaggaatag

SEQ ID NO: 1049 - DNA, 951 bp, Unknown
  Description of Unknown: Clostridiales bacterium VE202-14 sequence
atgaagaaaaaacttagatcttttgttattcttaccgccctgtctacggctacaatacatatcataaacagaggaattcattatttcgcaacaatgcataatcttcttcagcgtgatgatacagatgactacgaatggagatttggaagggtccactatcggaaatgtggtgagggtaagcccttgcttttacttcacgatctggcacccgcgagttcctctgttgaatggtcctatacaatctctttgcttgctaaaaatcataccgtctatgcaatagatcttctgggatgtggacagtcagacaaaccaaatctgacatatacgaattttttatatgtacagatgatatcagactttatcaaaaatgttgtgcataagcaggttgatgtcattgcaaccggttcttctgctccacttgttgccatggtttcgacaggaaatcaggagcttattgataaaatggtatttgtaaacccacaggatctctatgatcttgctaagattccatccaaacgaagcaaactgctttatcatttaattagtatgcctcttctaggcacttttctctataatattttattctgcaaaaagcagattgtctcgaatgcagagaaattattctatgatcagacacagattgatgagtggatgattaacgcctaccatgaggccgcacatattgataatatgcattcccgctatctatttgcaagtattaaaggaaattatacaaaggtaaatcttgttccgtttctaccaaatattacacacagtatctttgttatccgtggtatcaataatcccttattggaaaataatgcccgtcaatatcagaaatacttgccatctattgaggttattgaaattgatgagacaacatatttaccacaaatagaaaagccggaagaattctgcgaacaggtagaaatcctcctggatccgaaataa

SEQ ID NO: 1050 - DNA, 951 bp, Unknown
  Description of Unknown: Clostridiales bacterium VE202-14 sequence
atgaagtcatcaaatataggaggacaggcggttttggagggtgtgatgatgaagcacaaagaccgctatgccgtggcggtgcgaaagcctgacggggagattgagatcgaccgggaggactatcgaagtatagtcgggaattaccatagtctggtaaagattccgtttgtccgggggatttttcaatttattgattctatggttcttggaatgaggacgctcacctggtctgccgggtttgaagaggaggaagacattctgacagagcaggaagcaggaaaaaaggagagggcggatagaatcatgaatgggattgtgatggtagtgtcctttgtacttgccattgcgatttttatggttcttccatacgggatttccaatctgtttcgtaaggtgattccatcgtatctggtacgaattattctggaaggagtcatccggatagcgatttttgtggcgtatatccggctgatctccaggatggaggatatcagacggctctatcagtatcacggagcagagcataaatgtatcaactgcattgagcacgggctgccgcttacggtagagaatgtccgggtgagttcgaaggagcacaagcggtgcggaaccagcttcctgatgtttgttatgatcgtgggcattgtgttgttgttctttgtaaagaccgagtcccacattctgcgcgtggtgatccggatcgcgctcctaccgatcattgcagggatctcctatgagatcatccgtgtggcaggcagcagcgaccatccagtggtgaatttcctcagtaagccggggctgatgcttcagagactgacgacgaaagagccggacgactccatgattgaagtggccatcgcctctgtggaggcggtttttgactggcgggcttatctcatggagaatttcccgtccggaccggcagatcaggaagaaaaggagaaggtatga

SEQ ID NO: 1051 - DNA, 1251 bp, Eubacterium sp.
atgttaaagtggaaaaatgtgttgcatagattatctttgtatacacaggaatggagaattaatgttatgaaaaaagatttactacatacaccggaaggtgtacgggatatatacagcacagagtgtgttgagaagaagataatcgaaaacaggcttcataatgtatgtaagttatatggttataacgacatacagacaccttctatcgaatattttgatgtattcagcaaggagagaggtagtgttccatctaatgaaatgtttaagcttttcgacagatatggcaacacattagtattaagacctgatatgacaccatctatcgcaagagctgctgccaagtactttgaagaccatattcttcctataaagctctgttatgtaagcaacacatttattaatgtaagcaagtactatcagggaaggttaaaggagaatacggtcataggtgctgagttgatagatgatgactctattgatgcagattatgagataatatgtatggtaattgactgtatgaagagtgccggacttactgagtttcaagttgagataggcaatgttgctttctttaacggactgttggctgatgccggtattgctggtgatgcatatgaggagcttcttaaccttatcaacgaaaagaactatatcggagtggaggagcttcttaattcaatgaatattgataagaatactgcaaaggtattattagaactcccacagcttttcggtcaggcagacgtacttgagaaggcaaagagccttactaatattccagaatgtataggtgctgtagacagacttttatctttatatgaattattaaaggttaatggttatgacaagtatgtatcttttgacttaggcgaactcagtaaccatacatactatactggaattatattccatgcatttacatttggaacaggagaacctatagcaagcggcggacgttacgacaagcttcttggacagttcggctgtgataaggcttctattggtttctcacttatagtagacagacttatggcagctatcaacagacagaatataacagttcctgttgattacagcggcgtacttatagtatatactcctgacaagcttttagaggctataaagcaggctgatgaattaagaaaagacggcaataaagtctgtatgataagaaaaaatgaagcaaagacagaagctcagtatgaggaatatgctgcagcttcacagctttcagatattgtatacatttaa

SEQ ID NO: 1052 - DNA, 957 bp, Eubacterium sp.
atgaagtggaacagatattcaattaagacaacaactgcggcaatagaccttttaagcagcgcacttgatgatataggaattgaaggaatagaaatccaggataatgtacagcttacacaggaagaagccaagactatgtttgtggactttattcctgaacttccaccagatgatggaacagcagttgtcaacttctatatagactctgaggaggatgacggaacacttgtaaagaaggctgagcaggaaatagaagaccttcgtatgtttgttgatgtgggagatggaactatcacaaggtcagaaacagaggataaggactggattaacaactggaagcagtactggcatacatttactataggtaatctgtatattaagcctacatgggaagaggttacagaagaaatgaagggacatccggttcttagtatagacccgggaacagccttcggaacaggttctcatgaaacaacaagaatggttataaagcagcttgaaaagtatgtaaaagacggcgataatgttcttgatgtaggttgtggaagcggtatattatcagttgtagctttaaaatatggtgctgcacatgcatttggaacagatcttgaccctaatgcaattatagcttcacatgagaattcagagcagaataacatcacacctgaacagtttgaggtgatagaaggtaatatcatagatgataagaaagttcaggatgcgtgtggttatgagtgttatgacatagtatgtgctaatatccttgcagacgtgttagagccactttcagttaatatacacagacatatgaagcatggagcttactttatcacatcaggaataatcaacaccaaggaagaggaagttgtagaagctttcaaggaaaattcagagcttgagatagttgagataaatcatgatggtgagtgggttaatgtaactgcaagacgcagatag

SEQ ID NO: 1053 - DNA, 765 bp, Eubacterium sp.
atgtataaaagaataccggtttcggggaaatatcgtttccagaggggcataatagtgttagcggcagtgttgtggcttatagcagtggtgagaatattgtcaaaggatatagtaagggaggtatcggcaggcagcagcactgatatggtgagcgtgttctgtgataatgtatacacggatgtgacatctgagattacagcatacggtgtgcttacagagagctacttatcagaggatgcaaagaaaatgctgctttgtgatatggccgaggatatcgggcttaacgcttacaggcttgaaaagacggaggataacacagaatatgcgcttgtgcagaattcagtgtatggggatgtttcacttaagataatatatagtcaggagaagtattatctgattataaatatgcagcttgacaaaggtatagagagtacaatggcttacagaggcataatacaggatatatgcgacaggtacggtgttgactgtagtgtcaatgcagcacttagtggtacggtcgatggaaatatcggaatagaggaaagaaatgcattgtgtgaaaagctgctgacacagcttcgtgcaaaggaagttcagtcaagaaaaactatggatatgtctgtggtgtatgcatatgacagatatgaaagcagctatgtaatgtttggtaaaaataaggtgaatgttaatatatcaatggaatatgatgagaataatgatatgacagttgttcatatggcagttccagtatatatagaaaaataa

SEQ ID NO: 1054 - DNA, 1776 bp, Eubacterium sp.
atgaaacagaaagtaatgaaccatattaagaacaactggcaggagtatgccagctttattagtatgatagtgctgatagtgcttggattgatatatgcttttaatcttaataatttcgactttaattatccattggcatattatggcggtgatgatatgggcggacttcaggatgccaagctttttgcagagcagggctggatgctgtcaacagacagaatgggtgctccatatagttcagatatctatgatttttcttcatcactgcttcataacttcggacttatgattatgaagctgtgcgttcttataacaggtaattatatcgtaggttttaatatatactatctttcaatatttgtgttggcaggaatagtatcttatatagttatgagacagcttaagataaataactgggtaacagccgctatgtccgcagtatatggactttcaccatatatgatagcaagaggtgtcggacatatggtgcttgttgaggcgtactttattccattgtctttcttactctgcttctgggttatggaaagagaagatgtattccagtttaataagaatttctttaagacaccggctaactatgcagtgcttataatggcagcacttatagctaacaacggaatagcttattatccatactttacctgctttatacttcttgtaacaggtgtatcaaagtcacttaagacaaagaaggcaggcggatttttaaaatcacttgccatggcaggctgcgtatgtttcttcgttgtacttgcattacttccatccaaaatatatagtattatgaatggtcctaatgaatatgctatttcaagagcaggctttgttgagacagaaatgtatggcttgaagataattatgcttttcagacctttaagcacacacggaataagcttatttgaaaaggcaatagatatatacgacagcaatacaacatttcttaatgaaaatataactgaatatcttggtatagcagcgattgtcggattctttatacttatgtttgcgctctttatgaacagggagtcagctttaaagaaaagacttggactgttatcagaacttaatgtaatgctgcttcttcttggtacaacaagcggacttggcactattattgcatttcttataacagataagataagaggctacaatagaatatcaatatttatagaatactgctgtttattaggtcttacgcttattcttaacagtcttgtagaaaagtataagaagattaataaaaaggctgttatgtcagcagttatagcagctgtatacgtatttggcatcataagtatgtgggattcaagtgcaggccgtacatctgttgatacttataagtcaatacaggcagagtttgacagtgatgataagtttgtcaagactattgagtcagaggtaagcgagggggctatgatataccagcttccatatcacacctatccggagggtggcttccagaatgatatgtgggattatcatcttcttgttggatatcttcattcagacaagttaaagtggagttatggttctgttaagggaagagaaggcgacagctggaatgagaatatcggaagtatgtcatatgaaaatatggttacagagttaaagaaagagtcctttgaaggtatatatgttgacagaagagcatatacagaagagacacttacagagcttgagacaactcttgaaaagtctacaggcagcaagcctttagtaagtgataatggtaatctcagcttctttaagttttaa

SEQ ID NO: 1055 - DNA, 1143 bp, Eubacterium sp.
atgagaggtatatcagtactgggttcaacaggctctataggaacacagacactagatgttataagaagaaataatgatataaaggttgttgcacttgcagcaggtacaagggtggatgaccttgaaaagcaggtaagggagtttaagcctgagcttgtgtgcataggaagtgaaaagcttgcagatgagcttaagattaagctttctgatgttgatgtaaagatagtatatggcgatgaaggtcttgttgaggcagctactattgagagcgcagatatagtgcttacagctgttgtaggtatgatgggcattgttcctactatagaggcaataaaagcacataaggatattgcacttgccaacaaggagacacttgtaacagcgggtcatattattatgaagcttgcaaaagataacggagttaatatatatccggttgacagtgagcattcagccatattccagtcacttaacggtgaatataaaagagaggttgaaagaattctgctcacagcttcaggcggaccgttcaggggtaagaagagagctgaccttgccaatgtaacacttgaggatgcacttaaccatcctaactgggctatgggacgtaagataactatagattcttcaactatggtaaacaaaggacttgaagttatggaggcacagtggctttttgacgtgccatcatccaaggtatgtgtggttgtccagccacagagtataatacattccatggttgagtttgtggatggcggtattatggcacagcttggaagtcctgatatgagacttcctatccagtatgcgctttattatccacaccgtagagagcttaacactaagagagtagatttctttgagcttggacagataacatttgaaaagcctgatatggaaacctttaagggacttaagcttgcttatgaggcttctgataagggcggtaatataccaacagcttttaacgcagccaatgagcttgcagttgccaggttcttagacagaaagataaagtatcttgatataccggatattatagaatacgctatgaatgaggtaagctttatcgataatccgtcagtagatgagattcttgatacagagaagaatgtatatgagatgatcggaggaaagtggtaa

SEQ ID NO: 1056 - DNA, 1374 bp, Eubacterium sp.
gtggatattaagaggaaaaatattatgagtttatttagcaaaatcagaagaagactttcacatgcccagattatggcacttggttttcttacagtcataataataggtacggtgcttcttatgcttccggtgtcaagcaggacaggtcagtggacaccatttatcaaggcattgtttacttctgtaagttctacatgcgttacaggacttgtagtcgttgatacattttcatactggacattattcggacagatagtgatactgattatgattcagataggtggacttggatttatatcaatcggtgttgtgtttgcgctgttttttaacagaaatataggtcttgccaacagaacgcttatacaggaaagtatgaattccaacatgcttaggggcatagtcaggctaatgagaaatgttatcgttggaactgctatatttgaagcgataggtgcggcagttctttcgctaaggtttattccgcggatgggtgttgcaaggggtatatataacagtatatttcattcgataactgcattctgcaatgccggttttgaccttatgggacgatacgagccttattcatcgctcacaggttattacaatgattatgttgtaaatataacaattatggcacttatacttatcggtggtttaggctttacagtgtgggctgaccttaagcataataagctgtattttaagaagtatactctccatactaagattgttgttgtcagttctatagtgcttgttgttgtgccaacgatattgtttatgtattttgaaagagatggtgttgaggcaggcatgccttttgccgacagatttataacatcactttttgcggcggtaacgccacgaacagcaggatataacacggttgaccttggtgctatgactcaggcaagcaagctgcttactattatacttatgtttataggagggtgtccgggttcgaccgcaggtggcgtaaagactacatcaatcgtgattataatggtgtatatatggtctaatctgcgcaatgcttcaggttgtaatatatatggaagaaggcttgcagatgaggatataaagaaagccagtatggttataggtcttaatcttattatggctgttgcagcgctgcttattatcagtggtatgcagagttttgattttgaggacctatgtcttgaggtgttctcggcagtaggaactgtcggactttcaacgggtataacaagacagctcaatgtggcttcacagatagttattatattactgatgttttgcggaagaataggaacagttacatttgcatcaacatttgcttataacagaaagcaggttaagctgcttaatcctgaggagcatgttaatgtgggatga

SEQ ID NO: 1057 - DNA, 1620 bp, Eubacterium sp.
atgaggattaatatgaaattatcacagatggcagcagaagctgcggctaattatgagtatgatattattatggcaaaggtcaacggaaagctgacagaaatatcagacagggaaatacaggatgaaaaggtggaattcataacagtaggcgactctataggtaatgaaacttataagagaagtgtactgcttcttatgcttaatgccatacataagatagataaggaaaagaagataaaaaaagttacagtggaattctcattaagcaagggcttatactgtgaaatcaagggagatttcacgataacagaagaattcctcgcagaagtcaagagagttatgttagaggatgttaaagctaatattcctattaagaaggcaggaatgaagacctctgaggctattaagctttttgaggagcatggcatgagcgataagacacgtcttttcaagtacagaataagttcatatgtaaatgtatacaacatagaagattacagtgattatttctatggctatatggcatcacacacaggaatacttggtgtgtttgacctgtttaagtatgataaaggctttgtactccagctaccaagaaaagagtcaccaaagactgtgccagaattcgcaccacaggcaaagctttttaatgtgcttgaagaaacaagtgaatgggcagatatgcttggtgttgatactgttgcatcgcttaatgagcatataataagcggtgatattaattcacttattcttgttcaggaggcacttcaggaacagaagatagttgatattgtcaataagattaagaaaagagatggcattaagttcataatgatagctggtccatcatcttccggcaaaacaacattttcacacagattatcaatacagcttcgtgcaagcggttttaagccacatgccataggcgttgacaattattttgtggagagagagcagacacctgttgatgagaatggcaattataactttgaggatatccacgcaatagacataaagcttttcaatgaccatatgacttctcttcttaaaggtgagagagttgaacttccagagtttaactttgtgacaggaagaaaggaatataatggcgattatttacagttaggtgatgaggatattcttgtaatagagggtatccactgcctgaatgatgaactttcgtattcacttcctgttgaaagtaagtttaaaatatatatcagtgcgcttacacagcttaatgttgatgagcacaacagagtagcaacaactgatggacgtcttataagacgtatggcaagagattaccgtacaaggggtgcttctgccaagaagactctttctatgtgggagtctgtaagaaagggtgaggagaaaaatattttcccttatcaggaggaagcggatgctatgtttaactcagctatggcatatgaattatgcatattaaagccaatagtagagccattgcttttctcaataacagaggatgacccggaatatcaggaggctaagagattacttaagttcttagcatatttccttccttgtccagcagacaatgttccaattaactcaataatgagagagtttattggtgggggatgcttcagggtgtaa

SEQ ID NO: 1058 - DNA, 822 bp, Eubacterium sp.
atgagaaaattcagtgcatttaaaaagagtgcaggagttgtgttgagtatggcagtgctcttaggaatgtcctcgtgtggaggaagagttgaagctgtaataaccgatgagtcggaggatataacaagttatcaggaatatcctacagttgaagttagtaaggcagagaagtttaagtattctgaccttactgtgaattccctcaggtatatgatgaatgaaagtgatgtaaagaacatatatggcaatccggtttctgaatatgagtcgacagaaaaggaaagtaatgcagatgctttatatgtagaaaaggtatgctcatataatgaccttacactcatttttgttaagtttgatgatgaggggaaaacagcaggaaaaaatcaggcaggaacatataagctgacagcagcagcatctgtcagtgacaatgatgtatttgcaagaggacttaaggtcggaatgtcggtagattcgatactcagagtatactatagggataccaactacaagaataattattgtaagacacctgataagacggcagttctgggaaagtatctttatggtgattttactatagatgaccttgataaagtgaatacaaaagatgccatatcatatggaattattaattataatggatatgacagcgaggaaagtgctgagaattatatcattgagttcacatatttttcgcctgattatatgtcgggagtggccactgtgaacgatgactttgcacagattgcatttgatattgatgacagtggcattataactgccatcagatggtactattatccagaagaaggagaatga

SEQ ID NO: 1059 - DNA, 903 bp, Eubacterium sp.
atgaggagttatggtatgataagttacgattattatagaatattttattatgttgcccagtataagagctttacaaaggctgcgcagatgcttgataacaaccagcctaatataacacgctgtatgaataatcttgaaagtgagattggctgtaagctttttatacgttccaacagaggaatatctcttactcctgaaggacagaggctttatgaacacgttgctgccggatgtgaacagtttgctgctggtgagtgtgagcttgccaaggataaggggcttgaacgtggacttattaatatcggtgcaagtgaaaccgcgctgcgccttatacttcttgataagcttgaaacatttcacgaaacatatccacacgtaagattaaagatatccaaccattcatcacctgaggctattaccgcccttgaaaatggacttgctgatattgcagttgtcaccacgcctgtcactatacctaagaactaccattctgaacctttatattctttcagggaacttcttattggtggaaccaaatacgcagacctcgcatccagaatgcaaagcctgcgtgaccttaacaatattccatttatatgtcttggaagtgatacagctacaagaaacttatatatcgaattcttccttaagcaccatcttcagttttctcctgatatggaagcagctacaactgaccaggtacttcctatggttgaacacaaccttggcataggcttttatccggaagacctctgtgccggtgccattacaagcggttctgtccagcctataagacttgtagagcctatccctgagcgtgaagtctgccttgtgtgggataaaggcagggcactgagcatagctgcaaagaagctgattgatacattaaaaaaatcttattag

SEQ ID NO: 1060 - DNA, 1311 bp, Eubacterium sp.
gcagggctgcttttatgtattgcgattatgccgcttgtaaaggctgaatggtgggaaagccatcagttacatgcggtaatattctggtcgctgctttttattataccttttgccataacacagggtgtaggaactgccgctgaaactgtgcttgagtgtataataaatgattatttaggttttatagttttattatttggattgttctgcgttgcaggtaatatttctctggatggtgacttagtaggttcaccaagagtcaatactattacattgttaataggaacatttctttcaagtattataggaacaacaggtgcaagtatgcttcttgtacgtcctattataaagatgaattcgtggagacacagaagaagccatattatgatattcttcatattccttatatccaatatgggtggatgccttacaccaataggtgacccaccacttcttatgggatttatgagaggagtaccatttacatggagtcttcatctgttgccagtattatgctttaatcttgtagtgcttcttcctgtattctatatgatagacagaaagaactacagacttgatattgcagagggcagtgtgcctgatataagcaaagagtcaacagaggtaaagttccagggtggacacaatgtaatatttattattgcgattgtaatagctgttgtattaagcggtacactttctaatgttccagcatttatgcgcgcagatggtacgcttaagggcttgcatatcggagaggtgacattctcatttgttactatgatagagatagctattattcttgtagctgcatttttatcattcaagacaactaagaaggaaataagaacaaagaaccactttaactggggtgctattaaggaagttgccatacttttcatcggtatattcataacaatgcagccagcacttatgattcttaaggcagttggtccgacacttggaattacaaaggcatggcagatgttctggactactggtgcgctttcaagtttccttgataatacacctacatatctggtattctttacaactgccggaacacttggttttacaagcggcattacaacaagcgttggtgttattaccgcaaagatacttatggctatttcatgcggtgccgtatttatgggtgccggtacatatatcggtaatgcgcctaacttcatggttaagtcaatcgcggacgaaaacggtgtcagaatgcctggtttctttggttatatgatatggtcaatcggtatccttgtgcctgtatttattctggatacactagtattctttttatag

SEQ ID NO: 1061 - DNA, 1128 bp, Eubacterium sp.
atgaaaaataaaaagcctgataaaaaagagattgaaaataagcttaatcttgttattgataagcttatgaatcttggtaaaccagataatgacgaagaacttgaaaaaggtggagagtcgataggcttctttaaaagggactttggaattaaggagtgggactggccacagggagttggattatatggtctgttcaagataatgcagattaatggtaatgaagagtataaggaattcctctataaatggttcaaggagaatatagcagaaggtcttccatcaaagaatattaatacaacaacacctttacttactcttgttgaattaaataattattacaatgatacacagtttgaagagctgtgtatcaaatgggcagagtggcttatgaactgtcttccaagaacaaaggaacgtggtttccagcacgttacaagtgcgaatggtgacagacagggagtaagacttaatgaaaatgaaatgtggatagacacattatttatgacagttttattcctcaataaaatgggtcagaagtataaccgtcaggactggattgatgagtcaattcatcaggtacttatgcatataaagtatctgtgtgataacaaaacaggacttttctaccatggctggacatttaatgagatgaataactttggcggtatattctggtgcaggggaaatagctggttcacattaggaattcttgattatattgatatgtttaaaggaactcttaacagtggtgttaaagaaataataatagatgcttataaggcacagacagcagcacttaagaagttacagagtaaaagcggactgtggcatacagtacttaccgacccatccagctatgaagaagtatcaggaagtgcagcaattacagctggcatattaaaaggaatcagaatgggaatacttgacgactcttatatagaagttgccgacaaagcagtaaatgcaatacttaaaaatattgatacagacggaacggtacttaatgtatcaggtggaaccggcatgggatacgatgcagagcattataagaacattcttatagcacctatggcatatggacagtcacttacaatattagcacttgtggaggcattacagaatgattag

SEQ ID NO: 1062 - DNA, 942 bp, Eubacterium sp.
atgcgttttattgaaacatttaaagatggagatagaatatcagatgtatacttatgtaagtctaagtcaacagcacttacaaagacaggcaaggaatatgaaaatgtaatgcttgccgataagacaggacagatagactctaagatatgggatgtcaattcaggtggaataggcgactttgaggtgaacgattatgtatatgtcagcggtcaggtgacaagctacaacggcgcacttcagtttaagatagaaagagcacgtgtggcagcagaaaatgagtatacacagtcggattacataccatcatcaagatttgacatagaagatatgtacaaagagctgttaggctatgtgaatagtgtcgaaaatgtatacataaagaagcttcttacagcatttttcgtggaagatgaagcatttataaaaagatttaagaatacatcggcagcaaagactgtacatcacggcttcttaggcggacttcttgaacacagcttaagcgttacaagactttgcgacagaataagctctaactatgattttcttaacagagaccttcttataagctgtgcaatgcttcacgatgtcggcaaggtcaaggagctttcagagtttcctagaaatgattacactgacgagggtaacttccttggacatatcgtgatgggatatgagatggttatggaaaagattaggactataccggacttcccagctattcttgcaagtgagatgggacactgcatattatcacaccacggtgagcttgaatacggttcaccaaagaagccagccatagctgaggcagtggcgctttctatggcagataatcttgatgcaaagcttgaaacattgagagaatgttttgaagcaaaggattctaatgactggttaggctttaacagatggcttgattctaatataagaagaacaagtctgtaa

SEQ ID NO: 1063 - DNA, 1926 bp, Eubacterium sp.
atgttaattggaggttacaatgtaactgctgaaatattcagtcttatcacttgttcattcctgatttttcttatgatttattccaatccacgaaaaaccagctcatatagaattatatactgcggagcacttatatcgctggctgccataatatcacagcttgcacttatatactgtgtatcacatagcgaaacctattctgtacaattatgtataggtatttcgcttttgtttctggcattatactttataataataacatcactgtatatatatatcagttttctgtcatcgaaaatatataaccacagaaaagggcttcattatatgctcacagcatttactattgtctacgctgttggtgtcgtatggttttactcacagaaaactaattatattacggatgataatataatatcaatagatgcatttatcaacttttaccttatgtatggtattttgacatgctttttatgcctttttacagtactacacaaccagaatacaatacctactgtagtcaataagtatgctctcgtgttcatacctgtagattttcttatgcttacagtacagtttataacccaaaatgctatatttacaagtctgacttatgtactgccttttatgatttactatatattatttcatagtaacccatatgatgagctaataggctgtcagaaccagaattcatttgatgcacgttttagtgacagcgttgcgatgaagaggaattttcttgttgtatatcttaactttccgcagttaaaaaatgtgaattatgctgcgcacaatgaaaaaatagaagaaacagctgccaatgtctgccgtaagatagaacagcagcaccatatggtacacatttacagacttaataatattgactttgctatgattctttatataaaggatgaagataagataaagcagttccttaacaatgttgagaaatgcctgatagataatctgcattattcttcgtataatatcaactacaagatagttgccataccgaataatcccgtaatatctacagttcataagcttaactctatgtcagattatcttttggataagattaataacaagactggcaatcagtgttatcttgcaactgacaaggactatagggaattccatgagaattataaggtagaacagcttcttcttgatataagaaaccagaataatcttaatgacgagcgtgtcttatgttatgcacaacctatattcagtgttaatgaaaacagctttagaacagctgaagcacttatgagattatcacttgacggaactatcatatatccggataagttcatccctctggctgaaaagaataattgtatacacactcttactatgattatgattaacaaggtctgtcagactattaaggaatttgaatcaaagtacgacttcgatgcgattaccgtcaactgctcttcttccgaactgtcaaaccgtgacctttttgatgaacttatgaatataataaataccaatggcatcaagccacagcatataagacttgaacttactgaaagtgccatatttgacgattttaatatggtcatcaacaatatggaaaagttcaacaagtcaggtattaagttctatcttgatgactttggaacaggatattctaaccttgaaagaataataggatgtcccttctacacgattaagtttgacaagagcctgttatataagtcaattgacaattctgctgtatctgacatcgtttcgcacctcacaagcgtatttaagaaacagggctttgtccttcttatagagggggttgaaaatgatgaacaggctgactacagcataaacaaaggctttgattatatacaaggttacaagtacgccaagccacagcctgttatcaagcttagggaatactttaataaggctactgcgtaa

SEQ ID NO: 1064 - DNA, 1251 bp, Eubacterium sp.
atggacgaagttatggcaactattaaagcatttgaatgtataagaccggataaagctgtggctgacaaagtggcggctcttccttatgatgtatacaacagggaggaggcttgcagggaagtagcgcgtgagccgctttcatttcttgccatagacagagctgaaacacagtttgactcatcggtcgatacatatgcagatgaagtgtatgacaaggcaagacagcttcttgatgagaggatagcagatggaactttcattacagatacagataagtcatactatgtgtatgaacttactatgaatggaagagtccagacaggtatagttgcctgtgcttctatcgatgactatcagaataatgttattaaaaagcacgagaatacaagagcggataaggaagcagacagaattaaccatgttgacagatgttcagcgcagacaggacctatctttcttgcttacagagccaacgatgtcataagggaagaagtggcaaaagctaagaaggaagagccgctgtacagctttacatcaccagatggaataagacatcaggtatacaagattgctgataaagaagcagttgataacattaaaaatgcatttgcaggaataaatgatatatacatagcagacggacatcacagggctgcatctgctgtcaaggttggcttaaagagaagggcagaacatccggattatacaggagatgaggagtttaattactttttatcagtattatttccagacgaagagcttatgattatgccttacaacagagttgtaaaagacctgaatggatacagcagcgaagaatttatgaagataatatcagaaaagtttgatatagaagaaagcgcagaagctgtatcaccagcaaagaaagctgactttggaatgtatcttgatgataagtggtataagcttactgcaaagcaggatatactctcagatgaccctgttgacggacttgatgttgccatacttcaggataaccttttagagccagtgcttggaatacatgaccctaagacagacaagaggattgactttgttggcggaataaggggacttgaagaacttgaaaaaagatgtcatacagactgtgttcttgcattttcaatgtatgcgacatcaatagcagagctttttgcagtggcagatgcgaaaagacttatgccacctaagtcaacatggtttgagcctaagttaagaagtggattatttatccataagattgaagaatag

SEQ ID NO: 1065 - DNA, 1377 bp, Eubacterium sp.
atgggatactttccattttttattgatatcaaaggaaaaaagggacttataataggcggtggaagaatagctgaacataagcttaagaaaattcttgcatatgagccggatataactgttgttgcaacaaagataagtgacagtatcaaaagcattgaaggtattaagcttattgagagagaatttgtcaattcagaccttgatggctgttctttctgtatagctgccacagatgataagaagtttaatgcatatgtggctggtgtgtgccgtaaaaaacatatatttataaatgtggtggatgataaagacaactgccagttcctttttccatcagtatataaggcaggcaatctgtctataggaatatctacacagggtgcaagcccatatgtggctgctgatataaagaaccgcatagtgtcagagcttcctgttgatatagagcagatacttgattatctgtgttcaataagagaaaatattaaggaaaaggttgattcctcatctgacagggcggctatatttaaagctgctgcaagaagatgtatggtgcttgaaagaaagcttgaagaggatgagcttgatgagataatacgctcggttactgacagcagccatgaagaagtcaaaaagggcaaggttataatagccggtgccggatgtggttcatatgacctcataacagtaagggcacttaatgctataaaaagtgcgcaggtgcttgtatatgatgaccttatagatgaaagaattcttgagtatgcattagagagctgtgaaaagatatacgtaggcaagagaaatggaaagcacagtgctccacagcaggagattaatgagcttcttttagcaaaggcagaagaaggaaagcttgtagtgcgacttaagggtggtgacccatatgtatttggaagaggcgcagaggaagtattatatcttaaggaaaaaggcatagaaacagaggaaataccgggtataagctctgcaatagccattcctgccatggctggaatacctgtgacacacagaaatgtaagcagaagcttttctgttataactggtcatacagcacctgctgacgagtcagatgtcacagcattacatagtgatataaagaattcagcagctatggacggaacatgcgtatatcttatgggacttacacatcttaaggaaatagctgatacacttatgcaggagggaaagccagcggatacacctgcggcagttataagtggtggttttaatgattcatacagggcggtatatggaactcttagggatatagcagagaagactgcaaaggaaggaataaagtcacctgcagttattgttacaggcgatgtggttggttttcaggaaaaattgaaataa

SEQ ID NO: 1066 - DNA, 1053 bp, Eubacterium sp.
atggaagtaagaaagcttaactggtttctgccggtatttcttgcagtttatgtcatattaaacatagccgcaggtatatttataggaatagcaccagagcttggaattgcacttccggactggattgtatatgtaatcagtgaggttatggcatttataatagtacttatatatatgctggttatgaagattaatatcagaagagatatgcagtataaggtcataggcggaaaggatatttttatgtcattgcttacgggcgtgcttattctgcctatggtgctgtttcttaatgcatttactatgcttttttctgataattatatacaggagtcgtcacagggacttctggaatatccatatattgcacagcttattctgattgcggtcataccgcctctggttgaggagttcatattcaggggactgttttttggaacttaccgcagatgtggtgtccttaaggcagcacttatgagcggacttgtgtttggaatgtttcatctaaacatcaaccagtttgcgtacgcacttgtgtcaggcgttatttttgcatatatggctgaagctacaggctctatatggtcatcagttatcgcacattttgtggtaaacagttattctataacaataaatcagatattaaagctttcagggctatatagtgcggttaatgatactgcgacaggtacgcaggatgagttaaccagcattacgatgtcatcaaggcttgcaggcatttttatgatgtttgttatcggtgctgtatttatgctgcttgcagtgctttgcataagaaatatggctaagagaaatggaaggcttgaagttataagagagagctttaggattggacataagaaaggttcttataataattccagttcagaaggtgcttctggtaatggcgaattgctatcggcagataatatgtcaggtgatggtgaagtgttatcagatacggcggctcgtagtaatcatgttctgacagcaccggctgttgcatctgttgcagcctgccttgtgtatatgattattatggaaatggcgtaa

SEQ ID NO: 1067 - DNA, 669 bp, Eubacterium sp.
atgataagaaatataggtttagaagatatatctgacggaaggttatacagtgaaaatgaccttgtaaggacggatacgaataattgtagtggctgtaagaaaatatgctgtatagggatgggaaagactattgtgcttgacccgtatgactgcttcagactgacttcaggaacagggaaagcatttgaggcacttgttaatgataatatagagcttaatgtggtcgatgggtgtatacttcctaatattaagatgcaggataaaactaatgcctgttcatttcttaatactgacaatatgtgcagtatccacggatacagaccggggatatgccgtatgtttccacttggaagatactgggaggatgatgagcatttccactacatattgcagaagggcgaatgtaacaaggataacctcactaagattaaggtgaaaaaatggcttggtatatctgatactgaaaggtataatgattacattataaggtggcataagtacttaaagaagatacaaaggtcgatgaaggacttgtcacaggaagagataaggacacttaatctgtataacttaaagactttctatatgaaggcttatgtgtcagaggatacattttttgatgaggtgaaagaaagaataaatatgtctgaggatatgtttggactgtaa

SEQ ID NO: 1068 - DNA, 870 bp, Eubacterium sp.
tactatatgaaaacaggaattgtatttgaaggtggagcattcaggactattttctcctgcggcgttatggatgctcttgttgaaaataatattatgccggattatatgataggtgtgtcggctggcgcagcttacggtgtgtctatggcttcaaggcagcccggacgtaatctggacgttcttataaaataccgcaacgacaagcgctatcttagcgttggcaatatgcttgacaaggagaataaagctatatatggacttgaattctcctacgaaaccatacctaatgaacttaatctttttgattatgatgcatttaaggcttataaaggcgacttctactgcgttgtgaccaatcttcttacatgtgaagctgaatatatgaagtacacgggcgaagaccgcacaaacactgtgcttaaggcaacttgtgctctccctatgctctttccgcctatcatcataaacgacactccttatatggatggcggacttactgactctattccatttatgagagcattggaagacggctgtgacagagttctcgttgtactcactcgtgaagctggctacacaaagacaacttctacctcaacaaaggctatcgcccgttattatgaaaaggaatatcctaagctttcagaggttatgctttcacgcgccgaaagatacaatgagtgtcttaaacaactgaaagaatatgaagacagcggaaaagttatggtaatccgtcctgctgtgagcaaaggcttctcaagacttgaaaaggataaaaataagatactatctatgtataacgatggttataatcaggggtatacacttactggggatataaagaaatttttcaattatagcaacagctaa

SEQ ID NO: 1069 - DNA, 759 bp, Eubacterium sp.
atgtttactaaaagaataataccatgtcttgattgcaaagatggaagagttgttaaaggaacaaactttgtagaccttaaagatgcaggcgaccctgtggaagtagcggcaatgtatgataagtcaggtgctgatgagcttgtatttcttgatattacagcttccagtgatggaagaaatacaacggtagaccttgtaagaaaggttgctgaaaaggtgtttataccatttacagttggtggaggcataagaacagttgacgattttaaagtgctgttaagagagggtgctgataagatatctattaattcagcggctattatgactcctgagcttatatcacaggcggctgacaagttcggaagccagtgtgttgtagttgctattgatgctaaaaggcagaaagatggtcactggagcatatataagaatggtggcagagttgatatgaagatggatgccattgaatgggctatgaaggcagaaagtcttggtgcaggagaaatacttcttacaagtatggattgtgatggaactaaggcaggctatgatatagagcttacaagagccgttgcagataatgtgtctattcctgtaatagcatctggtggtgccggtaatatggaacatttttatgatgcatttgcaaagggaaatgctgatgcagcacttgcggcttcattattccactataaggaaatggagataaaagaccttaagaaatatctttctgataagggtattcctatgagattatag

SEQ ID NO: 1070 - DNA, 966 bp, Eubacterium sp.
cgtgtttcggctgcacatcagaaagaactaatatatcatggattggaggaaaaggttatggttaaagatgtaattaaagtttcaacagttgcatttaatgcaaaatggggcgacaaggaaaagaacctcaatcgaatgaaaggatatatagaggcagcggcatcagagggtgctaatctgatagtatttccagagatggcacttacaggttatgatgatgaagaggataaggcaaagcctgataaaatgcagtctaagcttgcagaggtagtgccgggacattcatcagaggcaatagcagagcttactaagaagcttggtgtgtatgtcgcatttggtatgccggaaagagatgagaaggattcatctattatatataacgcagcgtgtgtgtgcggaccagaaggagttatcggagcttacagaaaaattcatctgccatatccggaaccacactgggctacaaggggaacaaagccatttatatttgatacaccctggggacctgttggtcttgccatatgctatgatacatattgttttcaggagcttatgcgctattatgcggctaagggctgccgcctgtatatcaactgtacggcacttgccaagtgccacggcatcgctcttggttcaacaacacttgaagctggctgcataacgaaccagatatatatcgtatctgccaaccttgcaggaacagataagtacaatgtattctggggaggttcaagtattattggtccaagcacgaacttctgggaagctgagtattacgcaggttatccatttacagacccaagagctatacaggataaaatgtatacagcaacgattgaccttgcacttgcaacgagagagaagtttgagcctaatccacttatagatggtggaacagacttcagaccagcaatatacaaggaactttacgaagacctgcttaaagaccctaagtttcaggagtaa

SEQ ID NO: 1071 - DNA, 996 bp, Eubacterium sp.
cggagcagtaagaaaaggagattaaaaatgtacaagaaacaggaattaatacctatatttttcacaatcgatgacggatacgcaccatatcttcatgttgcacttatatcacttattaaaaatgcatcaaaagacagaagatataagataatagttgtgtatcaggagcttaatgaggaaaacaggaataatcttgcaaagcttgttgaggattatcctaactttgagatggaatttaagtttatgaagcagagccttgatatgataacagaccgaattgagaacaggcttcgttctgactactttactatgactatatatttcagaatatttattccagatatgtatcctgagtatgataaggctatatatatcgacagtgatataatagttccaggagatatatcagaattatatgatacagatatgcacgataacctgattggtgttgtgacagatggttcagtcaatgatgtacctgagcttcagagatatatgacagagtcacttgggcttaagcttggtgattattttaactcaggtatgcttcttatgaatatgaaggaacttagaaatgtacatcttgcagagcattttctgtaccttcttaacaagtaccactttgactgtgttgcacctgaccaggattaccttaattctatgtgctatggaaagatagaatatcttgattcatgttgggatgccatgccaaacagaaataaaccagagatagagaatccaaagattatccactacaatcttttcgataagccatggtgctatgatgatatccagtatcaggattatttctgggaatatgcaaagcagtctgtatattatgataagataaaggcgtataaggcagcttatacagacaagcagaaggaagatgaccatgcacatcttcttgaccttttcaggagagcaggaactaatgcggatactgaagtaacatttagaaaagtacttgaaagtggtgaaaaggtaagattatga

SEQ ID NO: 1072 - DNA, 1395 bp, Eubacterium sp.
gtgcaaagaagtgcggagcatgtgcaaagcacttcttttgtatataaagcaggaaaggaaaataaaaatatgatatcaaggtcagtcaacaaagtaataagtgtaatggcagcttttgtggcagttgtgcttgtatgtgcaggtgtgttaagcagtggcatattgctgtcagtattgccagccagagaagtgtatgcggcacaggagccagcttcacctgataacagcagtgaaaaggttgagataaagacgtacagtgacttggcagcggcagcagcaaatgtagatggaagctatattcttatggcagatatagatatgtctaaggaaggcgaagagggctggaagccatggaacttcaatggtacatttgatggtaatggacacactttatacaatatggatataaagactacaacagatataactgcaaagacttatgacggaaaccttaaggaatatgacacatattttgcagggttctttggcataacagatggtgcggttataagtaatcttaatattgcaggtgcgtatattgagttagggcagcaggcagatatgtcatctaaaagcatatttgcagctattcttgcaggttatatgaataacacaacgataacagggtgcagtgtagaaggctatgtaagtcttacctccacttctaaaatgtggggaacagccggagttgcaggctttggaaacggtcttatagaaaacacggtatcggatgtaacgcttgtatgtacagatgcagacccggacgatgccgataaagatgagcagtttatgggtggtatctatgcagacggatatattgatataaaggactgcgaggtaacgatagatggttacatatcagaaagaggatatgtacattctggtggaatagcaggtctttatatactttatccggtatcaggaagttacgttgccgatatagcaggcaatacaataaatggaaagataacattttatgaggataatgaggacagaagggcttactgcaaggcactcgcaggtgagcgtatgaacctgtatacaacctcaagagataacacagataatttcatgcgaaatgaagtttttgattacacacagacacttaaaccggaaaattacgtaagaaatacttatactgtagacaatccatatgagagcactgagagcagcatttctgcgggtactcgcagcagtgatacagagtcaggtgagcttatagaaggtgttaatgataatgtcagaatggatgaaagttcaggcttaaaaaacagagttttttttgcaggtctgagcgacactgcaagagttattattatagtagtagtcataatagtggcagtcggattatattactttataacaaggcgtataagacgcaggtcggataagtag

SEQ ID NO: 1073 - DNA, 1644 bp, Eubacterium sp.
atggagattgctatgagagaatataaggggaaaagcgtattcgcaggaatcgctataggcaggataaaggtgtataacaagtctgaacagcaggtcaaaagagttcatatagatgatacacagcatgaaaaggaaagatatgcagaggctgtagaaaaggccgtagaacagcttcagatgctttatgataaggcacttaaggaagttggtgaggctaatgcagctatatttgaaatgcatcagattatgcttcaggatgatgactacagggagtcagttgaaaatataatagacagccagaaggtcaatgcagagtatgcagttgcgcagaccggtgataactatgcaactatgtttgcagccatggatgatgaatatatgagaggaaggtcagcggatgtaaaggatatatccgagcgccttatcaatatactgagcggacaggcagatgcttcggttatggcagatgagccggttatcatagtggcagatgaccttgcaccgtcagaaactgtccagatggataaggataaaatattatccttcgtcagtgtaaagggttcagtcaattcacatacagctattcttgcaagaactatgggaataccagcacttataggcacacctatagaacttgatgatagtatagacggaaagttgggaattgttgacggaacatttggctgcatatatgtagagcctgacagtgaaaagcttgaatattataaaaagcagcaggcagaacagttaaagaaaaaggaacttctccagcttttgaagggcagggaggatgttactgttgatggaaagaagataaaactgtatgccaatatcggaaatgttaaggatattatggctgtaaaggcaaatgatgctgccggaataggactttttagaagtgagtttatatatcttgagagagatgacttcccaacagaggaagaccagtttaatatatataggactgttgcagaaaatatggcaggaaagcctgttataataagaactcttgatatcggggcagacaagcagtgcgactactttaatatggataaggaagataatccggcgcttggagtgagggcaatcagaatatgccttacaaggacagaaatatttaagacacagctgcgtgcactgtacagggcaagtgcatatggcaatatcaatataatgtatccgatgatagccaatatgtgggaaatcgataggattaaggaaattgaaaatgaggtgaaggaagagcttgaaagacagggtatcaatataggtaatcctcagacaggaataatgatagaaacgcctgccgcagttatgataagcgatgaacttgcaaagaaggtcgacttctttagtataggaactaatgacctcacacagtatacacttgcagttgacagacagaattcaaagcttgatgcattttttgaccaacatcatccggcagtgcttaagatgataaagatggttgttgataatgcacacaaagcaggaatatgggcaggaatatgtggtgagcttggtgctgatacatcacttacaagaaagtttttaaagatgggtgttgatgaattatcagtgtcaccgggaagagtacttcctataagacagattatacttgatacagatgtttctaagctttaa

SEQ ID NO: 1074 - DNA, 1038 bp, Eubacterium sp.
atgggcactgacgaaagaggttatcgaacattttatacgcaattaatcacaaaatatgaggaggacaatatggaaactatcaaaagttatcttgaaacaatgtttgccaatatgccaaacacaccagaagttatccgtgccaagactgagctgcttggtatgatggaggataagtataatgaacttattcaggaaggaaaaagtgaaaatgaggctgttggaactgtaatctctgaattcggtaatcttgatgaacttgccgatacacttggaattaacagccagccacatgaagctgccgacaacagaagaattctttcactcgatgaagtaaaaagttatatacgtgcatactcaaaacgcagctttcttattgcaattggcgttatgttatgtatattttcacctgtattcccaataataggcgatttgtttaatatagcttttatggaggctattatggtttcacttatgtttgtcagcatagctgtagcagtagctctgtttattattgcaggaacatcccttaaaagatttgaagacataaaccataacttgtgtatgcttgattaccagacctcccagtatgtacagaattctaaagaacgtatgcagcctatatatacaatatgccttgctgttggcgttctgctctgtatcatatgtgtagtaccagctattattattgacagccttaatcttaatatatctgataatatgtctggtgcatttttatttattctgtgctctgttggtgttatgcttatcgtttttcaggcaaatgcggcatgctcatacagaaagctgttatcacttaacggctcagacacaatatcaggtaattacaccgcagaccataataaagatgtacagtatattaatcctacagccgcaactgtaatgtctgtatactggcctacagttacctgcatatacttaagcttaagctttcttacatttaactgggctttctcatggataatatggcctattgcagctattatataccgcatatttaaaagttttttgagaaaatag

SEQ ID NO: 1075 - DNA, 957 bp, Eubacterium sp.
atggagtatattgaagttacaggaaagtcagtagatgaagcaatcacaaatgcctgcctcaagcttgaaacatctagtgacaatattgaatatgaagttattgaaaaaggaagtacaggtttattaggtttattcacaaagccagctaagattaaggcaagaattaagtcaggtgttggttctgtagattcggaattcaaggcatttgaaaagaaggaaaaggaagtcatcagggaagcagcagaagttaaaaaggaagctcctaagaaagaatatgtaaaaaacgaagctgctgtaaaagagcaggctaagaatgtagagaagaagcctgtaggcagtacacatgaaccagaaaataaggaaattaaagcagcagagccagcaaaggcagcgcctaaggcagttttatccaacgaggaaatagaatcaagaattactaatttccttggtgatatgtttgaagctatggatattccagtagaaattaaggttacatttgatggtgaggatgagtgcgttaatgtagaacttcttggtgagaatatgggtcttcttatcggaaaaagaggacagacacttgattcaatccagtatcttacaagccttgtaatcaacaagggtaaggaaaagtatgtaagaattaaggttgatactgagaattacagacagagaagaaaggatactcttgagtcacttgccaagaatattgcatataaggttaagagaagcagacgttcagttgcccttgagcctatgaatccatatgagagaagaattatccattcagcattacagaatgacagattcgtatctacgaagagtgaaggtgaagaaccattcagacacgtagttgtatatcttgacagggaaaagagtggcaataacagatattcaagacagaattacaacgaaaacagaaattataatgacaatagaagttataatgaaaacaagtaa

SEQ ID NO: 1076 - DNA, 723 bp, Bilophila sp.
tccaatcaggccgtgaatgtggagggggctacgggggtacggctgttcgctgaagacgcaaagcatgtttcgttcctcaatatggcccgtgatgagggccggagcgtgagctatgacgcggtggtgctgccggaactggaaaaggtgctcggcaacgcggtggagcgtaaggccgtctttatccatttgatgggctcccacctgacgtatgcgctgcggtatcccccggaattcggcgtgttttcttccacggacgacatccccacaaaaccgtggaggccggaaagcgcaaaacggtatgtcaatacgtacgataattccatactgtacacggatcttatcgtgtccggcatcatcaatgccgtaaaacggaagggcgggaacgcctttgtggtgtatttttcggatcatgggcaggaagtgtatgatacgcgcccggtacgcgggcaaatagccaatgatccctcgaagcatatgctggatattcccttcctgtgctggttttctcccgaatatcagcgcaggaacgccgagtttgtggggcgggtgaaaggggccgtccataagccttgggtgacgtcggagtttgcctatgccgcggcggaacttgcccggctttcgttcggggggagcaaaccggaaaaaacgcccttctcggcgggctatgagccttgggcccggtacgcccccaatggaagcgagtacggctcgttggataaatag

SEQ ID NO: 1077 - DNA, 627 bp, Bilophila sp.
aatttcatggccatgcctgtggtggactacgaagggcgccttctcggtgtggcgacctacgacgacattctggacatcatgcaggatgaggccagcgccgacctgctcggcatggtgggcgccggtcaggacgagactgtggacacgccgtggctggagtcggtacagatacgtctgccgtggctcatcgtgaatatgctgacctccatgatgtcggcctttgtggtttatatgtttgagggttccattgctggcatggcgctgctggcggtgctcatgccgatggtggcgaatcaggccgggaataccgggcagcaagccctcgccgtgatgatccgccagcttgccacggaaaaatttgaccgcaggcgcgcatggattgccgtgctgcgcgaaggcaagatcggtattacttccggggcgatcatggcgatgctggcctgtgtgggggtctggttcacctcctcatcccccgaactcggcatggtcatgggcgcggcgctcatgggcgacatgctgctcggcgcgctggcgggcggcagcatccccctgatattccgtgccgtaggccgcgaccccgcgcaggcttccagcatcttcctcaccgccattacggacagcgctggt

SEQ ID NO: 1078 - DNA, 402 bp, Bilophila sp.
atgcaaagggacaggggacagcagggcttcacgctcattgaaatcatttccgtcttggtcatcctcggcattctcgccgctgtggccgttccgaagtattatgacttgcagcaggatgcgcagaaaaaagctgcgatggccgttgttgctgaagtgcaggcccgcgtgaacctgaaattcggacaggagcttttggcgggaaagtcttgtactgcggcacaaggccttgcggaggcattggcaacaagccctaccgatttgggaggctggaagctgacgttagggactaaaaaagatagtgtttattcggttactgatgccacgcctcccggagcgaatgcaactgctgttgcccttgccaatgccaatatcagcatccccgactgcactcaggcgaactga

SEQ ID NO: 1079 - DNA, 477 bp, Bilophila sp.
ggcgtgctgacggcgggcctgcgcggcgaataccggtttgaaacggattgggtcgacgtgacgccgcatgtcggggtacgctactacaacctgcgtacggacggatttacgtctcggatcgacgatcatgacgtgttccgtgtgggacgcgatacgcaggagttctgggcattcccgatcggcgtgagcttcggccgcggctttgaaacatcgttcggctggacggtgaaaccgagggccgacctttccgcagtgcccgctgtgggcgggctcaaggcgaagaccaaggcccgcgtgccgggcgttgcggcttccgatgcgatcaagtctaggatgatggacagcgtcgcctttgatggtacgttcgggctcgaaatgcaaaaggatgacgtatcgttgggccttgattacggcctccgcgcttcagagcataagacggggcatggcgtgaatgtgagcttcacctgcaagttctag

SEQ ID NO: 1080 - DNA, 558 bp, Bilophila sp.
atgcggggagcgtcgtcgggagggacggatttccttaccctgacgataaaagtcctctacccgcatttctccattgggttcgtaacccttgtctttgatcttctcgtcatccttctcggctggcccgttttcggaagcatcgactcggtactttatggtttggcttctactgcgcttacatcattggtcattgataagattatgtatggcatcggcgcgggaaagctggtggtgatcgtcaccaatcaagggcatgccatcgccaagcggattgctgaaatatccaagcgcggctccacattattaaacggcataggcacatatacaggaacatccaggcatgtactcctctgtgcctgcacaagaacggaaatctacaccatctgttcagctgcaaaagaaatcgatcagggggtctttgtcatggtcaccgaaacgagtgaggtctttggcaggggatttattgaagggagcgttaactcgcaagcgcttcccgtacgcaacaggaagaacaaaagacgtaagtaccgactgccgtcatcaacgccttcatattag

SEQ ID NO: 1081 - DNA, 1239 bp, Bilophila sp.
aacaccttttccgcaggcaccatactcatcagttttatctgcctgttcctcgttgtgggcgggatgtatctcgtcaacagccgtcgggaagcctccctgctgattcctgagagccagcccgctgccgcctcttccgtggcgcagccccttcaggcggaggagcgtccaggacatgccaccgcccgccacaaggcttctgtggcccagcgcctccaagagcaggtgatcccttcccttttcgccttatgggaaagggcaaagagtgccgctgccgtgcagcccgacgagccacttgtccgggaggggctggaggacgccgccatcgtttccgagatgcagcaggttcctttggagcaggaagccccgtccgatccctccgtcatcagcggcgtcatcgccaagggcgacagcgcctcagaactcctttcgccatatatgtccgctggttccgtccaacagcttctgcatgtgacgcgaaagctccatccgctcagcaacctccgcacggggcagccctacacgctggtctgctccccggacggcaagggcatggagcgctttgaatacgagatcaacgatcgcaagaagctcatcgtcacgaaaacggatgaagggcttgtcccccacgtcgagccgatagtctatgatttcagcttggtgcgcgtaagcggaaccatccgttccagcctgttcgagacgttggcttcgaccggggaatcgcctatcctggccgtgcgcattgcggagattttcggctcggagattaacttcatcaaggatttgcgcgaaggtgacagtttttccctgctgattgaaaagcggttccgggaaaacgagtttaagggttacggcaacgtgcttggggctacattcaccaatcaggggaaaacgtacgaagcctatagcttcgcaacggaagacggcgaggccttcttcaacgccaagggcgaaagcctcaagaagaccctcctcaaggctccgctggcgttcacgcggatttcctcaggctactccatgaaccgcaagcatccgattttcaagacccgtaagccgcatcagggcgtggattacgcggctcccaccggaaccccggtcaaggccgtcggcgacggcacgatcgaaaaggccgggtggggaaaaggttttgggaatatggttatcctcaaacattccggtgggctggagtccatgtattcacatctttccgggtttgcgtccggcgccaagcgtggggcgcgg

SEQ ID NO: 1082 - DNA, 285 bp, Bilophila sp.
ttgaaattccaaagaaataaccaagaaaatcccccaatcacagagcccaccagcggaaagattggagaaaaagcatatattttcaatatattgctgaaaaaacaaccatgtactatgacagagcctttagaaaatcatcaaaagggcgaatgtctcgtggatggagtggagttggcatgctacaactggaacaaggagggacgcaagcgtctttcacgggcatcggttcccggagcctcccgacgccgcaagtttcatgcgggaggaatcattcacggcctgatc

SEQ ID NO: 1083 - DNA, 351 bp, Bilophila sp.
atgatgctgcgccactgcctgattctctccctcgccctctgtgccgtgctttccggctgcgccgcgcgtgaatccgccgccccggcggcctctgctccggaggcggctcccgccgcgttgccgttcggcgaacaggtggccgccctgcccgaaggttccacgcaatactttgccgaaagcccctttgggcaggccacgcttgatgctggcccactctacctttccggcctgggcaacgaatgccgtttgatccgcgtcacgcgcggaaccgcgagctaccagctcacactttgcaaggaaaacggcacatggcgcttcatccccagcatctttgagggcatgccgcaatga

SEQ ID NO: 1084 - DNA, 609 bp, Bilophila sp.
atggttttggcgttgtgcagtgtgtttgttctttgcggtaccgttcaagccgcggaatctccgcttatggtgttgcagaagcaaatcgatcaaattttggatgtgttgaaagagcccaattacaaggatccgattaagcgggttccgctccgtgcccaaattgagaagtatgtccatgaagtctttgatttcaacgaattttcagcgcgcacggtgggcaggaattggccgagtttttccgatgcgcagaaagaacggttcgacaaggctttcgccaaccttttgctcataacgtatcttgatagaattcaggggtataacggggaaaaaattgaatactccggcgaagtcctctcgacaaagggggatcgtgccgagatccagaccatcgtcaccctgtccgacggtaagcccgttcctgtggcgtacaggatgatgctgaagaacgggaagtgggtcgtctatgatgtgctgatcgagaacgtcagcttgatcaagaactaccgttcgcagttccaggatgtcttgacgcgggggactcctgaacagttgatcgaaaaggttgaagcccgggccagagagcttcaggcccaatccaccgtcaattaa

SEQ ID NO: 1085 - DNA, 1104 bp, Bilophila sp.
tcgggaactctgaccgacgcggcccggcagatcgatttcgccctgctccagaccgtcttgcggctcaagctcgacaaggggcgcatcctcctcctgacgtccgactaccgcacgcaaggcaaggatatctaccacctccagcggatgcgcatctatctgccccccgttgccccaaccccggccccgcaaacggcgaggggcgaaaacgggcatgcgccgtccgccgaaacgggcgatgtgaaaggccccccggaaccggtgttccgcttcctcaacgcgctggccgaaagcctcgacatatgggccgaccgtgccgtactcaccgaatcgccgggcaagctcaccttggcggccaagggcgtactgacgcacgaaatctggtttgaagccacggacgagacattccccatcctgccgcccacggacaaggccccgcgcctgaccatcgtcatgaacgaactgggcgatgataaggccgttacggcctcgctgctggccctgaagctgccgattacgttttccgtgctgccctttgccaaggatgcggcggcgacggcggcggccgcgcacgaggccgggcaggaagtccttgtggatatgccgatggagccgatgcagtccccattcgtcaaggcgggccccggcgaaatcaccacgaagatgtccgaggaagacatgcggatcctgatggatgacgccctcggccatgtgccctatgccacgggcgcgagcagctttatgggctcccggctgaccacggatacggcggcgacgcggcgtttctgtgaaattctggcacgttccgggctatatgtgcttgacgacgtgacccatcaggggtcaattctatacgcggaagcacggaggcgtgggcttccggcgtggcgcaggacgcttgcgctggacgacggccccaaaaccgaaggcgccgtgctcgcgggcctgaaaaaggcggaggaaacggcgcgggccaaagggcacgccgtagccatcgccacccccggcccgcatgtcctggcggcgctcaaacagtggtcacaggaacgggacaaaggcatccgtctggttcccctgcggctccagcccgtcgaggaagaaacgctt

SEQ ID NO: 1086 - DNA, 735 bp, Bilophila sp.
atggaaaacgcttctatgaagtcccttgccccccattttgaaagcatcctcgacaccctctccgatggtgtcttcatcagcgacgtggaggggacgaccctgttcgtcaacaaaatgtacgaaaccctgaccggactgcggcagggagaaatccggggcaaaaacatccgtacgcttgtccagcaggggacgttcgataaagtcgtcaatccgcagatcgtcgagaccggaaaaccggccacccacgtccagcagctcgccaacgggaaacgcctggttctgaccgggcatcccgttttcgacgacaaggggcagttgtgccttgtcgtgacgtttgcccgcgacatcaccgtcctgacccagcttcaggaggagatgaccgcccagaagaaactcattgagcagttccacgaccgcctcgccttccttgcccgcgaacagacccgcgaactcgttcccgtctttgaaagccgcgaaatgaaagaggtcatgagccttgtggaacggttcgccagttctgacgccacggtgctcatcctcggcgaaacgggcgtcggcaaggacgtggtggcccgcctcacgcacgagctcagcccgcgcaaggagaagatgtttctcaaggtggattgcggcggcatttccgaaagcctcaccgaatcggaactcttcggctacatgccgggtgcctttaccggagcgggcaacaagggcaagagcggctattttgaaatggcc

SEQ ID NO: 1087 - DNA, 543 bp, Bilophila sp.
atgaatacgatttcttcaataaaggttcccggcctgaccgaggacaagtgcgtgacccttatcggcatggccggggctggaaaaagcaccggcgcccgcgccgtggccgaacgcctcggctgggcctatgtggataccgactatctgattgaatccacctatggcgcgcgccttcaggacgtgacggacgccttggacaaggaaagcttcctcgacgtggaggccaaggtcatcctgtccctccgcatgcagcgcgccgtgctcgccacgggcggcagcgtggtctatcggcctgaagccatgcggtatctggcttccctcggcccggtggtcttcctcgatgtcccgctccccatcattttggagcgtattgcccgcaagccggatcgcgggcttgccattgcgccggggcagaccgtggaagatcttttccatgagcgcgaggcgctgtatcgccggtgggccacctgccgcgtcgcggcggggaacctcagcgtttccgagacggcggatgccgttttcgacgccattgccgggcacggg

SEQ ID NO: 1088 - DNA, 558 bp, Bilophila sp.
atggaaaccgtaagaaagccgttgaatgaagaccgcgtagccttgttgctcggaagcgtcatctttatccttgccctgctcaagttcggcgggatagacatgctcggctgggccgtcaaaaccggtatgtgggtggacaacccgcttgatgcgtggaagtccgccaccaagggccttctccccggctatggggccctgtttgttacctacgccgtcctgacgggcgcgctggcgtgcggcgtgaagctcatggggaacgacgtggcgaagttcgtcaagtccttcaccatcatcttcttcatcgccatcatttgctatacgctgggcgccaacgcctacatcgcggccaaccccacccagctcaaggcgcaggggattccgtgggcgctgggcctgagcaccgaagccgggctcatcctcgccctcgtcatgggcatcgtgatcagcaactttatgccgaaccttgccgaatcccttaaggacgcatgccgtcccgaactgttcgtcaagatcgccatcgtcatcatgggcgccgaactcggcgtgaaggccgccgac

SEQ ID NO: 1089 - DNA, 528 bp, Bilophila sp.
atgatcgcactcgtgggcctgaccggaagcgatttcctgaactttctgcgtaccaacggcagattgcaggaagaacccctgtttgccgacaacacagggatctacgctccgggggcttacccttcggatatggacgacaaccccgtacagccggcagagcctgacgcatctgcaccacagccgactaagaatgcgacgcaacctgtgaccgggaacgctacgcagccgctggcaagtgagcagacagcgcagcaaaccgccgacagccagactacggagcttcccgaaaccgatcccgccatcccctccgagagcaatgctacgctgcttttggcgggctcctcttctggagacattcccgtcatctatgccacgggacggaactttgaacggctgagccttgtccccgctaactgggccccctttggcctgactgaaaaagccctttcgcttgaaggggaagtaaaagttctcgccccgcccaagatgctgcccaagcggcacgctctcaagaaaaaacggcgctaa

SEQ ID NO: 1090 - DNA, 387 bp, Bilophila sp.
atgaagcgtctattcgcgttggcccttgccgctacccttgctgctcccaccatagccgtagcaggttttcaggggccgagttccgctcaagggggaggtttccaaggccccactaccggcattgaggccgatactgtagccaaagctcaaaaaagctgggacgatgcccgtgtcgtgctcaccgggaacatcactcaacgggttgccggcagcgacgacaaatacatcttcaaggacgccacgggcgaaatgattgtggagatcgatttcgagctgttcgcaggccgaaccgttactccccagaacaaagtacgtctctccggcaaagtggacaaggactttatggaatcccccaaggttgacgtaaaggttcttgaaatcctgtaa

SEQ ID NO: 1091 - DNA, 471 bp, Bilophila sp.
cacattccggctttcgggttggaaatttttttagggagcatgcttatcgcgtttgccgtttggcaaatgtggggtggcctcaatttacggggttcatggggagacggcgttctcgcacggttaggttggggggctgcgtctgggatgtttaccggtgccgtggggttggggggaccaccgctggcggtatgtgcatcgatggccggatgggataagaacgtagctcgggccatcttcggggcattttttatgttcagtatcagtattgccgtgatatttgacattctttatgggctggtcactcccgtggttatgcagcacacactagttggacttccaggcgtattgttagggacgctggtcggcctacctgctgcgcgcaagatccgtcaggaaactttccgcagaagcatgatgtggatagtattgctgggggccatttctttattgttcaaggcttttttgcattga

SEQ ID NO: 1092 - DNA, 672 bp, Bilophila sp.
tgcgctttaaaaaggaatttgagcgtggagattgatggacttctggctgaactggagaatgccctcaagacagaaaagggcgatctggacaggcgcgttgccgtatacaatcgcatcgtcgccttagctgcggcctatcttgatattccgcacccggtggcatgtccgcagcttgtcccggtggatgacgtccgggggaacgactataacccgaacaaagtcgcccctcccgaaatgcggctgctcaagctgtcaatccgcaaggacggcttcaccatgcccgttgtggtggcccaagacggcaaggggcatgtcgtggtggacggttttcatcggcggcaggtagccaaaatggacgcacagatacggaaaagcctcggcggatatttgcccgtggtcaggctcgataaaagcattgaggatcgcatcacctccaccgtcaggcataatatggcgcgagggacgcatcaggtggagcttacggcaaggctcgtgacgttgctccgcaagcacagttggacaaatgaaaaaataggcaaggaactcggcatggacccggatgaagtgctgcggctgaagcagatgcaagggcttgccgaagccttcgccgaccgggaattttcgcaggcatgggatatgccccgccagagcacggcaaaaagacaggaataa

SEQ ID NO: 1093 - DNA, 381 bp, Bilophila sp.
atggacgccataagcatcatcgcggagcagcgcattcgggaagcctgcgagcggggggactttgattcccttcccggagcgggcaaaccgctggagctggaagacgattcgcatatccccgaagacctccgcatggcctacaaactcttgaagaatgcgggctatgtccccgaagaggttcttgaccggaaagaggcccagtccattgtcgacgcactggagaaatgcggggacgaacaggaaaagatccggcagatgaaaaagctcgaagtggtcatcgcccgcattaaggcccgccatcccaatgcgcccgttctcagcgacggcagcccgtactatgagcgggtggtcagccggattaccgtgaacaaaaagggctga

SEQ ID NO: 1094 - DNA, 504 bp, Bilophila sp.
tcctggacgccgcaccgctcattgcccgacatccatgagctttcatgcttcaatgtctatctgaaccccggcagatacgatgtggacggggttttgtcggccttgaggggcctctgccgccggagggggtatgcggtttgctggcccgacatcgaagccgccattgcccggtattgcggcaatgcgccaaggccgcccctgccaaggcgcccgcccgatcttgacgaaaccgttgcccggctggcccaactgtcgggcatgagccgggaagggttttcgcggcattttaaaagggcgtacgggcttccccctcaggcttttcagatcatggcaaggctgaattcggcaagggaattgctgcgggaagggaaatccccaatcatcgccgcatcggaggcggggtttgcggatcaaagccatatgggccgccatttccgccgtttttttggagtcacccccggccggtatcggatcgggaaagtcacatccgttctagaaatcctc

SEQ ID NO: 1095 - DNA, 435 bp, Bilophila sp.
atgacgcttgtcaaagattacaaacagatttggtatgacataatatactacctcagcggaagcctatgctattccattgggatctattcttttgccaaagatgctggcttcgctcccggaggcttttccggaatcgctctgatttgcaaccatctttggaacctgcctatcggcaccatgacattgctgttcaatataccggccatccttatcagctacaatgtcctggggcggggcttcctgttcaaatcacttatagcaatggggctgtgtactctctttttagacgtaatctttcctttattccctgtctatgaaggggacccctttctggcagccctttattccggcgtgtttatcggggtggggctggcgcttctgtatatgcggggagcgtcgtcgggagggacggatttccttaccctgacgataaaa

SEQ ID NO: 1096 - DNA, 549 bp, Bilophila sp.
gtgaaccattcccaaaagcccggtaaaggtgtcgtacctggcgaggatccaaaagccgattccctccgcgagcgtgtctatcaatacctcaaggacgccatgcgtgcgggaaacctgcggtatggcgaattcctcgatcaggacagcatttgtgaaaccctcgaagtcagcaagacacccttgcgcgacgcccttatccgcctcgaagcggaaggcttcgtaaccatcctgccccgcaagggcgtctacatcaaccccatcacgcaggatttcatcaaaagcgcgtaccaaatcatcggttccattgaggccgactgcctcaatgaagtcttcggcaagctcaccacctaccatgtccggcagtttgaggcctccaatgaaagacagtgggaactgctcaaaaagaacgactatacggaatattatgatgaaaatatccgttttcacggcatattcctgtcgctctccgaaaatatcctgctcgaacagacgctcatcccgctgcgccgccgcctctacgacttcccgcgccgccagtattcctacgaa

SEQ ID NO: 1097 - DNA, 234 bp, Bilophila sp.
ccgccgctgacaggggttctgcaagcgcctcacagcccctgctgggggatcgcggggcgcctcatcatcgcgtggggccttgccctccccgtttccgcggcttcctgcggcctgttctttttcccgcttgaccgcccggtggatcttcatggatacactattatttcaatagaaaagataatgtttactaaaataaagtcaggcagccttgacatattttatcttcaagtgtaa

SEQ ID NO: 1098 - DNA, 603 bp, Bilophila sp.
tatcgcgacacaatcgcggaacttgttcatttcagctcaaaaacggtcaactccaatgcggccctcgtaggggttcgcctcactgcggatgatgtactggacgccccttatgtctcggcgcgcacgctgatggcaaggaatgtatccctttcgctggattacggcaaaggcggtgcggcggtggcgggcatctgcaaacaggtaaacgccgtagtacgcaacaattcgtttgcggaagccgcatcccccgaagaacgtgcggctattgaacatgccatgaccgaggcctgttcctcggctttcagcgtcggcgttgggcatgtggatcaccgtttacggcaaatactgatcccaaaagaaggggctgaaggcgggtatgtgtccatgacgcccataaccgcgggcggtgtatgcgaactgttgtttgaaaaggaccatgggcttgtgtcctgccataatgccgcatacgaaaaggaaaaaaagtctgtcggaaaccccgaaaacaaggaagaaaagcctgccgccccccccgaaaacgatgaaggggcgggaaacggccccagcataaagatgcgcaagctgcggcaggcgcagttcggcatc

SEQ ID NO: 1099 - DNA, 303 bp, Bilophila sp.
atgtccgaagaacaacaggtacgcctgaacgtacataccgagaaaatgggcacttcttacgccaatgcctttcaggttcgttattcgcaggatgacgtgctggtttcctttggcgtcagcctgaccgatccttcctccgagccgggcgtgaagggcgtcgtcaccgccgacatgctggagcgtatcgccatgacgccccgtacggccaaacgcctgacgctgacccttatccaaagcctccgtgaatatgaggcccgtttcggtgaaatcgccgtcgaggagaaggctcccgaagggcaatag

SEQ ID NO: 1100 - DNA, 396 bp, Bilophila sp.
ggggcgaaggggacgggacaaactgaacgcatgacgctcttggggggaatgtttttggagaaaaggggaagcagcgccccatactttccccctcttttccccaaaatccagccctccctttccaatggcttttccaagtacggcttttccaaatggctctgtcatagtgtgtggttgtttcatctccgcagcacggtgaaaagacagcctttttctccagttttccctttggctgaatccatagttgaggcgtttttctggttatttctttggaacttcaaagaaaaaagcaccaaccattttctaggacacagccttccaaatatcgaatcaccgcccacagatctttctggaacggaaaaacgcggaaaaatattgaaaggctccgaactatga

SEQ ID NO: 1101 - DNA, 810 bp, Unknown
  Description of Unknown: Clostridiales sequence
atgaaaaagtttgaaggaatgattctggcctgtgatatggacggtacattgctggataataatcgtcagatttctccccgaaatcagcaagcactgcgctatttcacacaggaggggggacggttttcattggcgacgggacgtgcgccgcaggcaatcgaatgctatattccgcagctgccatttaatgcgccatacagcctgctgaatggatcgctgattctggatgagaagcatcacgtgctgcaatgcgcaggtatgccggagtgtacaaaggatttgattgagattactttgtcagaattttcacaattaggatgtgaaatttttgccggtgcgcaagtattgatccggaaaatgagcgatgtaacggaaaatcatatcaaagttcttgatatgaaatacagcatggttacgcaggaagagctcggcgatactgcgggctggtgcaaaattaactttacgggtgatcccgcattgatgcactctgtcagggaatttttgaaaccctatactgatcggttctgcatagcatccagtttagcgtccttctgggaaattacagcacatggagtcaataaaggaaccgcgctccaacagattgctgaaagctgcggcatcgcagcagatcatacgtttgcaatcggtgacagttacaatgatgaaccgatgctggaagcggctcacattggatttgcacctgcaaacgcggacgacggcattctaaaaactgcagatgttgtagtatgtgctaatgacaaagacgcagtggcaaatgccatcgaatatatggaagcacatttttgctga

SEQ ID NO: 1102 - DNA, 549 bp, Unknown
  Description of Unknown: Clostridiales sequence
atgcttatcggccacaacatcaccatccggccctatcggggccgccggcccaggatatcggaaaaggcacatatttttgaaaatgtctcgatctacggcgatgtgacgatctgcgagggctgcgttatcctgccgggctgtgtcatccgcagcgaatatttcccgatcgtgatcgggaagaactgcatcctgcaggatatggtttgcctgcacgacgactgcgacggcggcggcatcaccatcggggagaacgtggccgttggccatcgggccattgtgcacgcctgcaccattcacgataataccctgatcgggatgggcgcggtggttcaggataaagcggtaatcggcaaaaactgcctgattggcgcgggagccgttgtgccggaggggacggccatccgcgacgggatggttgccctcggcgtgccggcgaaggaaaaacgggcggtcacggaaaaggatatctcctatatccggattacgatagaggaataccacaccttcgcacgcgagtacctcgagggcggatacgaaccgattccctga

SEQ ID NO: 1103 - DNA, 597 bp, Unknown
  Description of Unknown: Clostridiales sequence
gccatgacccgccggaacatgatgtacctgttctacaacctgctgaacacggagacaacggacggacaggtatacgcgcagacactcggttacacgctcaacgataacgacgagatcgactatctgggcatggtttcggatacgatgcagggcccctatgtggtgaccggaagcctgtccgatatcgtttcaggcgaaaacaagacggtgtaccgcaacggctatgcctcttcggcggacgccatcgcggcgtatgacgtgatttattataacgactcgaccatctgggcctatgccaacgccgtgaccggcacctaccagtccgcggacccctcggcgacatcgcctacctcggtaacggtggcgggcgtatcctatgagatcgagacaagcgaagcggcgtttgaactgtccacgctcggcggcctgaacatcggcgacatcgtgaccctgctgctaggcagggacggaaaggtggccgcggccctgccggcggaggattatgcggtgagcgttgccggtgtggtgacgtccacggggacgggcacctattacaacgcggtcggcaatgcctacaccgcgcgcaccatcacggtc

SEQ ID NO: 1104 - DNA, 366 bp, Unknown
  Description of Unknown: Clostridiales sequence
ctgtgcgagacctatggcctgcatttcaaagaaaccatggatatggatatcgggctgaaatatcaggcgcttgcgcagggggagatcgacgctatggtgatcttcacgaccgatggacagcttgccgccgcggatgctgtggtgctggaggacgataagcagttctatccctcgtacctttgcggcaatgtaatccgcagcgaggttctggaagagcatccggagctggaaaacgtgctgcaaaagctgtccgggatgatttcggacagcgatatggcgcagatgaactacgcggtcgagaccgggggcagggagccgcgcgatgtggcgcaggcgttcctgcgcagtcatggcctgctgcagtag

SEQ ID NO: 1105 - DNA, 306 bp, Unknown
  Description of Unknown: Clostridiales sequence
atgaaaaacagtaccaaacgtttgataggcgcggttcttatcgctgccatctgcatgcctgggtcatttgccgccgattttacgaccgtgcgcgtggacaatgtggatgatttcggcgcgttgtctaaacggctgcgctacgcggatgacaaaacccccatccccctctccagctattcctgggatggaagcctgtttgccacgattcctgccgaaaatgcggatcgtccggtcgaggaattcagcattcaggatgcgatcccatcggggctgggggaaacctcttatgatatgctggagcttgcc

SEQ ID NO: 1106 - DNA, 1455 bp, Unknown
  Description of Unknown: Clostridiales sequence
atgaaaatgaaacgccggtcgatccgctttaaatttttcgttgcgatcagcgcggttgcgctggtctttatcggtgtgcttttgctgcttaatgtattcttttatcaggattactacatgatgatgcgccgcaacgaactgcgcgacgcctatcttggcatccgcagcagctataccggtgatatagagcagattgcaaccgtactggacaactacgaaagccagaccgccatccgtctggctgttgtctgctcggacggaactgtactgtacacctcattcctctccccggagacagagccggggaacgggggaacagacgtgcaaaaccctttccagctgccggatttcgatcttttcgaccagcagcgccgcggctatgccattttgcagtccatcgcgcagaatatcagctgggatacgctttccaaccggcattatcaattcctgaatgtcacgctgtgggataacgaccagtacctgtgccttgccggggcgctggacgacaatgtggacaaatgcctgttcgcctatatgccctatgcctatatcgagcagaattcctcgctcaatctggtatttctgctcatcgcaggcggatgcgcgctgctgatctgtctgatatgcggctatttcatctcgcggcagttcacccgcccgctgattgcaatggccggcgttgctgaccgcatgagtgaattggacttctccaccaaatatgaggggaacggcaacgacgaagtcggccagcttggacaatcgctcaaccgcctgtccgcctatctggagcagaccatcagcgaactcaagcagtccaacgaccagctggcgcaggaaatcaaggagaaagagcgtatcgacagcatgcgccgcgagttcatcgtcaatgtctcgcacgagctgaaaacgccgatcgccctcatacagggctatgccgaaggcctgaccgcaggcgtggcagacgatcccgaggatcgtaaatactactgcgacaccatcgcggatgaggccgaccatatgaacaaactggtcatgcagctgctgagcctgtcccggctcgaacttggcgcagaacaaacctacaacgaggatatcgacctgtacgcgctctgtgcggaagcagtgcgcaagacctctgttctctgcgaaagccgagggctgactgtccagtatgacaatacccacgccacagtccgcacggatggggacctgctcgatcaggttctgatgaattacctttctaacgccatccgctacacggtggacggcggccggattgtgatctctgccatccggacggaccgcacggtgcggctgacggtgtttaatgagggagaaggcctgcccgaagaagaactccccaaaatatgggaaaaattctaccgcaccgatcgcgcacgtacacgcgaggccgggggcaccggcattggcctgtcgctggtccgcgctatcgcg

SEQ ID NO: 1107 - DNA, 852 bp, Unknown
  Description of Unknown: Clostridiales sequence
atgaaaaaacatgtcgtttccgcagcggttttatgtgctgttggaatcgcgattgcagggttgcaatgtggtctgaccatacggcgttacactgtgcagactgataaaatcggggaggggaaggcgcttcgtcttgttatgctttccgacctgcacagctatacttatggcagcgaccagtcgccgcttctgcaccgtgtggcggctgaggagccggacgtcatcctgctttgcggcgatattgtggatgacaaaaaaccgatttccggcgcaaagctgttgctgcagcagatcacaaatattgcaccatgttattatgtgtccggaaatcatgaatattggagcgaggatgcggaggcaatttttaatctgattgagtcatacggtatctgcgttctgcataatgagcgggaggagatttccatcgccggggaacaatacatgatttgcggcgtagatgatcctgcggcgaacggtacacgcatcaggcgatcgtacggcgaccgtaccgaatatctgaacaccctggacagctttcgcgacctgtcggaagaccggtttaacatcctgcttgcgcatcgtccggagtacatcggggaatatgctgaatatccctttgatctagtactgtgcggccacgcacacggcggccagtggcgcattccatatctgctgaacggcttgatcgcgcccaaccagggcttttttccgacatacgccggcggacaatatcactgcggcgacaccacctccattgtaggccgtggactgatgctggactggaaaccgcggctgttcaatccaccggagatcgttgtggtagatattattgcagcgggggaaagaatgtaa

SEQ ID NO: 1108 - DNA, 462 bp, Unknown
  Description of Unknown: Clostridiales sequence
atgcaggaacagcggatcggcagcgagctcggcatgctgagcaacctgctgaagcgccagatggcgtgccaatcccatgggaaggagatcgaccatgtgaccggtatgcaggggatgattatccactaccttgcagtggcagatgacgaccggttccagaaggatgtggagacgcagtttcagctcagacggtccaccgcgaccggtatcctgcagctgatggagcagcacgggctgctgcggcgcgagccggtgccgcatgacgggcggctcaaacgtcttgtgctgaccaataaggctttggcgctcgacgcccggatcgttcagaagatccgctccacggaggagctgatgcgcgaaggcatcagtgcggatgaccttgccacatggttctgcgtgtgcggcaagatccgcgccaatctggaaaattaccaacgcaaatcttcggaggaaacactatga

SEQ ID NO: 1109 - DNA, 831 bp, Unknown
  Description of Unknown: Clostridiales sequence
tataacgcagcagatcggacatacttggcgatttgtaaaaatattggatacgatgtagtgacatcgggcactcataaagtgaaacggtataatgatgcatctgatcttaaaaaaattctgcaggattatcgtcagggaaccaatcgctgcggagagtgggtaaccggcctgaatgcatatttccggtgggatgcggcttatcacgcatcggttccgaatcaattcgttaactatgcacaatccgttgggcttttgaaggtgaaggatgtggcttccttatcacaggaaagattcaatcctgcacgctatgaatccgacagggtttttcattatatagaaatatcaggtattgattctatacagatgagagcgtatgcaaaggaaattcgatgtggtgaagccccaagcagggccagaaaattagtgcacagcaacgatataattttttctactgtcagaccggaacgaggcacggttgcggtgattgatgatacacaggataattttgtttgcacaactgggtttgccgtcctggaaacgcagaggatggaaccgatggttcttgcctatctgctgcaatcggattttgtggcaaaacaaataggcaaatacgtaatggggatttcttatccggtaatagatgaaaaagatctgatggaaatatatttgccgatcaactcctcagatattagaaaatatgacggtaaggcatcggttctcaaagaaaaggagagggaagtaacagcgcttcggaaagaatttaaagacgccataaaatctgatataaatagcgcttgcctgagcataacagaaatcggtggatatttgtaa

SEQ ID NO: 1110 - DNA, 543 bp, Unknown
  Description of Unknown: Clostridiales sequence
tttatgctggccgattcggcggactgggtgctggacagttcgctgaaacttacccggttcgacgattactggggcaacgcaccgaagctggagaccatcaatttcaaattcatcaccgaaagctcgcaggccatgatcgaactggaaacgggcaatgcggatttggttctggacgtacctgcgctgagttatgagtcaatcgaatcttcttctgatttcaaactgctgaaatttgactcggtagtaggcgattatattcacttcaactgctcgaaacccccgttcgatgatgtgagggtccggcaggcggtcgcatatgcgatcaaccaggcggatatccgccgggcggtttatctggatcaggcggacatcctgttttcagcaatcacgcctgctatctttggctatattgatgagtttgagggcgataactggccatatgaatacgataacgccaatatcgaaaaggcgaaggagctgctggccgaggcaggctatccggacggctttacagtggacttcctgatcgacgacaacagcgac

SEQ ID NO: 1111 - DNA, 531 bp, Unknown
  Description of Unknown: Clostridiales sequence
gaaaacgggcggatggcagtgggctacgccaggaaaatcagggagcaggctcacgatatgataagccgcattcaggcgtttgaccgaagccggcgcacgatcctgtttggcgcttgcgctcccgcccccctgtgggagattccgccgctgctatctggcctgtatcctgatatgacgatatcctctgagataagagggaatgaaatcctgttgcagggcctgagagatggtgtgtatcaactggtcgttctgccgtttcccgtggaagaacccggcatgatatgcgtaaaatacggcgaagaacatctgtttttttccctgccgccggcgcatcctttgtcaggcagcaaggcattgcacatgaaggacctcaatggtgaaaccatgctgctgcggaaccgtcttggtttctggcgtgaactgaccgcccgaaagatgccggatacccgttttctggagcaggaggatatggcgttcaatgaactggtaagatactccgcgctgccgagctttgcaacggatgtggggctt

SEQ ID NO: 1112 - DNA, 579 bp, Unknown
  Description of Unknown: Clostridiales sequence
atggggcggtacggtttgtcggattccaatatcaccaaaaaggcgctggcaaccgcgctgaaaaagctgatgcagacacagccctttgagaaaatcagcgtggggaaaatctgcgaggcctgcgagctcaaccgcaagagcttttattatcatttcaaagataaatacgatctggtagagtggatttttgacaccgagtttattgccgcagtgtctgccgccaaagtgaccgaccgctggtcgttcgtacgtgcactgtgcgaatacttttaccgtgaacgcgccttttacacaaagctgttccatctgaccgggcagaactccttccgccggtatttttccgagtatctgttccgcacagctgagccgttcctgcgtccaaatatcccacttgaggcacagcagaacgaaaattatgcattttttatttcctttatcagtgacgccattttcattgccattttccgctggctgagcgagggcgccaaaccgccgccggagcagtttgtccgccggctccagttcatctcccaaacccttgagaaccttgagggcacggaaaaagacagattgcagccg

SEQ ID NO: 1113 - DNA, 546 bp, Unknown
  Description of Unknown: Clostridiales sequence
gccatacctgtgggcattcatctggatcactgtacggaaacggatgtaatcgcgcaggccattgacagcggctttacctcggtcatgtttgatggatcaaaattgccagttcaggaaaacattcgcataacgcagcacatcgcgcagtcagcccataaaaatcatgtctttttagaggctgagctgggtacggttccgtacagcgatatgggtgaaaccgaaatccagctgaccgacccggaagaagccagacagatgcaggagcaaacctgggtggactggcttgcggtttcagtgggcaatatccacaggctggcgaagagtaaggtgcctatccaattccccgtattgcagcggattgaacaggcttgtcagcttccgctggttatccacggtgcaagcgggatcaaagaacaggacgtgatctgtcttaaggcgacgcaggttgggaaaatgaactttggtacggttttacgaaaggcatttggcgctggactgcggcgggaaatggaagaacacccggatgaatttgaccggctccgcttg

SEQ ID NO: 1114 - DNA, 489 bp, Unknown
  Description of Unknown: Clostridiales sequence
atgggaagcacgccaaacagcaatacgggagggaaaaccatggatcgaaccgaccagaccgggcgcccggagcgcagcgggcagagcagccagatcagaagacggccggccgtgcgggctgcgggaggaaaagcgccgggcaagccgtttaagctgaattaccggatgatgctgtgcatcgcggtgctggtgtgctttgtgctcgcgctgctgtttttcatcctgttcatggtgcgcggcagtacaatcagcgggctgaacgaacaggtggatacgctcaataaggagaaagagacgctgaccgcgcaggtgaataccctgacgcaggagaaccagtccatgctcacgagcctgacggcctccctgcctgacccgaccaccgcgcagaccaccagcatcgccgacctgatcccgcagctgaccgagggtgtgtatgtggtatacagcaccggctcgcagctgcagtatctgagcgtgccttcgggttac

SEQ ID NO: 1115 - DNA, 357 bp, Unknown
  Description of Unknown: Clostridiales sequence
gcgcgcgaggatgaggcgcctaaggtgctgctgaacgaggcgcagccgctgaccgaaagcgcggtggacagcacgctggcaaaagaaaatccacagcagtccgtatatacggaccagcaggcggcaaagcttgcgccgcacaagctgttcctgcgcatttctagcatgaaaagcgacgaatggccgcgcatcaaggcgatcctgctcacgcagcccggcgatacgccggtttacctgtacccgacggacaccaaaaagaagacgcttgccaagcgcgaattctggtgccggccggatgtgccgcttttggaaaaattacgcttcctcttgggggaagaagatgttataataaaataa

SEQ ID NO: 1116 - DNA, 558 bp, Unknown
  Description of Unknown: Clostridiales sequence
atgaaatatcagcagaagcgttatccgttttacaatcccaacctggtccggatgtcgatgggaacactggattttgtggtcaactacgcggacatgctcgaccagacctgtgtggaattccggcatgtccatgaatgctatgaaatttattactgcctgagcggcatgcagcatttgatgattgatgaacagacctatacgctggtcggcggttcatttgccgtcatcccgccaggaatctatcattataccatctatgaaccgctgctgctcaagcagtatgtggtatttgtatttacccctccaacggttagttctgtcaaaagccgcagcaaaagcacgcaatccgaggtggattttctttccgcagcgctgaagtattttgatgaaaacacacatttcatctgcaaagatcatttcaaagcggataaggtgctcacgcggctggatagagaaatcagcacagacctgcccggcaaggggcaaatgattaacgcgctgtatcaggaatatctgattcagatattccgcaacatggtctccgtcgggaaggaggaa

SEQ ID NO: 1117 - DNA, 489 bp, Unknown
  Description of Unknown: Clostridiales sequence
cgggaggggttccgcctgaaagacgctgtatgcaatgcaggcgtgctcggcgcgctcgccggggcggcactgtactttttgcattttcaactccccggcctggcagcggatttcatcagcacactggcctcgctcaacacaccgctggccatgctggtgatcggcatattcctgtcgcagtgccgcctgaaggacctgttctgccgcagcgtcatcctgcccggattgcttcggatggcggtgctgccgctggtttttctgttcctgctgctgtgcctgcatgttccggcgtggcacagcgcagggagcgcactgctcatggccgcattgctgtgcgccagctgtcccgctgcggcctctaccgtgctgatgacatcctcgctgggcatggattcctcttacggcgcacgccttgtactgctgagcagcctgctttccgtgctgaccattccggggatggctcttctggcctcctggctgatacaataa

SEQ ID NO: 1118 - DNA, 669 bp, Unknown
  Description of Unknown: Clostridiales sequence
atgttcggttttgggcataatttgaaaattgtttattgtgtctattatcctgatatattatactataacacgaagcgttaccatacacaatatctattattgagaaagctggtgttttcttttgtgaagctgaatggacacagtccggttgacctgattatcaacaaccgcaaacggattgaaaaggtgtttgcggcgctgctgctgctcagcctgatcctggccccgatggtcggcgtcaactatgaccttaccgaatacctgccggattcctcgccctccgcgcaggcgctcgacattatggagaaagaatttacataccccggcatggggcgcgtcatgctggaggatgtgacgctgtatgaagcgaagaacatcaaagaccgcatcgccgatgtggacggcgtggacatggcgatgtggtgtgataccacgaccaatatctatggttcgagccagtttattgattattcggatatcgaggattactacaaggacggcgatgcctacatggacatcatcttcctcgagaaagattcctccagccgcacgcaccgggctgtgcatgagatcgagcagattgtcggcggccgtggcctggttgcaggctcggccgtgtcggacacgaacctcggcccgaccatcaatgccgaggttgcccgtgtcatg

SEQ ID NO: 1119 - DNA, 516 bp, Unknown
  Description of Unknown: Clostridiales sequence
gaaaggccgtctgtttctgaaatttgtcaaaaatgcttgaaaagaatggtggttgccaactgcatttgtgtatgctatactattgtcagcatcaataaggggtgttctggtatgagaaaacgtctgttatccgctttgcttgcagctgccatgctgatgacaatgattccggccgcctttgctgcttccgatctggacgggcactgggcgcagccgtttattgagtatctcgatcaggaaggcgttatcaatccgagcgcgacaacaggaaagtatgaacccgaccgcgatatgacccgcgcggagttcatgcggtacatcaaccgcgcgtttcacttcacggaaaccgcttcgatttcctacagcgacgtaccctccaacgcgtggtattacgaaaccgtgcagattgccgcgcggtatgggtacataaacggtacgggcgataatcagatggacccggagggccgggtgacacgcgagcaggctgcggtcatcatcggccgcctgtacaaggcc

SEQ ID NO: 1120 - DNA, 504 bp, Unknown
  Description of Unknown: Clostridiales sequence
atgacggcgaaaaaggttttccgcagcacggcggcaaagctgattgcatttctgattgtcgtaggctgcgtagcgggggcgatggcgagggctgagttcggaatcatggatatcaggcgatggtccaacgaaagtgaggtggtataccggctggaggaccggttcgaggattcccagttgatgaatggcatggttaattccatggtagcggatttggactatgccctgcacgagggattgagtcaagattcgttcaaccggcagtttaacggagcaaactttataggggattattatgggcgcatgggcgatcgtgtgttgaaaaatagcgatatcacagaagaagatgctgcgtcttccatgttttttacagtggcccttgcggatgggaccctgtattacaccggaacttcgagctttatgccatttacctattcctatgtggacccgtcgagtggaatctatagcgaggaatatgcaccggaagacagcgtgatttatgtc

SEQ ID NO: 1121 - DNA, 480 bp, Unknown
  Description of Unknown: Clostridiales sequence
gacgaatgcaaggcctatgccgcaaacttcggcaaggattcgcccaatctgctgctgtacggctcgaccgggctgggcaagaccttcctgtccacctgcgttgccgaggcggtgtccgcgcgcgggttttcggtggcgtatgacacggcgatcaatattgtcgccgcgtatgagactatcaagttcggcaacggtgacggcgaggcggctgcggagcgcgcggcacgctatgagcgcgccgatctgctgattattgacgatatgggaaccgaaatgggtacggcgtttaccgtgtccgcgctgtacaacctgattaacaaccgcctgatggcaaagcggcccatgatcgtcaacaccaacctgatgccggaggcgctcagcgagaagtattcgcccgccgttgcttcgcgcctgctgggcgagttcatggcgctgcgctttttcggcgacgatatccgcctgctgaaaaagaagatgtag

SEQ ID NO: 1122 - DNA, 756 bp, Unknown
  Description of Unknown: Clostridiales sequence
cagcaatacagcaatattgcacgcgctctgcaggtccccaaggccgaggtcatgcgctcatgtgaacgcatccgttcgctcaatcccaagccgctcaatgggcagcaaagcggcgataccgtgacgcagtatattatcccggatttttatgttgttgaggataacggccagctgcgctgcgttatgaacgattactacctgcccaaaatccgcatcgaccctacctatcgggagctgattaagaataagcagctctcgcccgcagacagtgaatacctgcagaacaactacagacaggccagcgaaatcgtcaaattccttgcctatcggaaatcgacactgcagcgcgtcatcgagtacatcctgcgtgtacagaaagatttcttccttaacggccccggccatcgtgccgccatgagcaaccgcgagatcgcgcaggcactttcgctgcacgaatctacaatcagccgtgcagtcagcgggaaattttttgaatgcaaatggggcgttttttcactcaagtcgctttttgtgcacagtgccggcggcaatcaggaaaacgacagtctggatcagctgctgcagcgtctgcaagctctggttgcctccgagccgcccggcgcggcatacagcgaccagcagctcgcttccatgctgacagcggagggcttgccggttgcgcggcgcacggtgtccaaataccgtcagatgctcggcattccaaacgccagccagcgcaataaccggcttcgttga

SEQ ID NO: 1123 - DNA, 597 bp, Unknown
  Description of Unknown: Clostridiales sequence
gagacggtcaaactctccgagcgcggcgtgctggggctgttgtctgctgatttaaaccgtgcgtcagacaagctgcttgcgcagcgtgtgctgctgaacaagcgcgaccgcacacgtactgaatggattgcaggcgtgtcgcacgatatccgcacgccgctgtcgcttgtgcagggaaatgccgcccagctggagacggactgcgccctgccggaggcggcgcgtcgcaaagcagcggtgatacgcgagcagagccagcgcattggaaagctggtcagcgacctgaaccttgcctccaagctggaatacgaactgcagcccctgcatatcgccgtattccgtccggcggccatgctgcgtgcggccgcggccggcctgatgaacggcctgccggatgggcgtgtatcgctggcagttgacatcccgccagaggctggtgcgctgaccgtccgcggggatgaaaccctgctgcggcgggcagtggacaatctgctgcgcaatagtgtcctgcacaatcagggtacggtgcagatcggtttgacgctcgcggcagatgagcgctcgtggacggtcacggtgacagacaatggaaccggt

SEQ ID NO: 1124 - DNA, 606 bp, Unknown
  Description of Unknown: Clostridiales sequence
aatgtctatgcgtttatgaagcgcgtcagcccctactatttcaacggcgacttttacccgcgcccgaccatgtgctatgtggagcactgcaaccacatcagctttaccggcatcaccatgcagaactctccgttctggacactgcatcccgcaggatgcgacgatgtgctgatttccggcatccgcgtgctcaatccgctcgactgcacgaactcggacggtattgatccggaccactcgagcaatgtgcgtatcatcggctgccatgttacctgcgcggacgactgcatctgcctgaagtcctcggccggcaacatggagtatggtccgacgcggaatatcatcatttccggctgcaccctgacttccacctcggcggcgctcaagatcggcaccgagggcaccggggattttgaaaacgttattgtggacaactgcatcgttacgggcaccaaccgcggcatctccattcagatccgcgacggtggtaacgtaagaaacgtatcgttctccaatatcatcatcgaaacccgccgttttgcagactgctggtggggtaccgctgaaccgatcgtcatcacgacgcacgaccgcgtggagggtgtc

SEQ ID NO: 1125 - DNA, 1182 bp, Unknown
  Description of Unknown: Clostridiales sequence
ctgccagatgacattgcttatgtccctggtgtcaccctggatgggcaggccgcaacagccagcttcgatgagcagcagcggattttaaacattcaaacaggccagccgagcggtattattcgtttttatgtgataccaatagcgctggggaattattcagtttccgcttcgctttcgttcaggcaagagaataatgaagtataccagcccgttgggatggcaaattttgaagtgtctgccactgaattttccgttccagcaaaaaccaatcagcaaaaaataacggtttccgggataacgctgcctgaaagcacagtaaccgtttatgacaatgaagaagccgttggttcagtgacttcgcagaaagatggccgctggcaagccgaaatatcactggatggcgatgcaggattggtgcatcacgaaatatatgcccaaatcgaaaacagtaatttgggagacgatgctatcacgacggttcgcaagtcattgctctatagcgataattatgcacaagtctctaaaatcacgatggtcaatacggctcatggtactgactcgctcaagccaatcgaatatgtttgcgaatttgacttcataaacccggaaaagatcataccgcagtactggtattggccttcctaccctacgttttcattccagatggaatttgatatgggaaaggatgcaagcatccaggatatttatgatgtgtatacagtgacaacgaatggaagcggagaaaagacctatgttcctatgacgtatgatgagggaatggggatatggatcgggacccatgactatgatacgcaggatatccctgtaagcgttggggcatcgtattacattatgaacgacccggaagtaatctggcaggattatcagtcaattctggatcccggcagccgggagataacacctgttggagaggactccataaaatatgcgtttgactatttgggagaaaaagactattcgatgacgctttcctgtgaagcattcgaaagcgaatccgctttgaccgtgtatctggatgatgcaggctttcagccggaactggaactgaaccaaaatgaatgcatctatatgagtcaatcggatcgtaataagttctgttattttgacagcagggatcaaacagaaggccgatggtttgttatcgaagcagagatagatgcc

SEQ ID NO: 1126 - DNA, 354 bp, Oscillibacter sp.
atgagccaatatatcgcgctgttccaggcggccgtggtcttcggcaccgtgatcctgttcggcgctctgggggagatcctcacccagaagtccggcagcctgaacctgggcgtcccgggggtcatgtacttaggcggcatcgccggcctggccacggccttcttctatgagcggagctgcgccgccgccgggaccacccccgtgcccgccctgtgcctgctcctgtccttcctggcggccttcgccgcagcggccctggggggcctgctcttcagcttcctgaccatcaccctccgggccaaccagaacgtgacgggcctgacgctgaccatcttcggcggcggcgtggccaac

SEQ ID NO: 1127 - DNA, 1434 bp, Oscillibacter sp.
atgaagaacgtactggaacaactggagccgaagaaggtgtttcatttcttcgaggagatgacacggatcccccacgggtccggcaacaccgccgccgccaccgcctgggccatggagttcgcccaggcccggggcctgcgctgccgccgggatgagatgggcaacgtggtcatctggaaggatgccagccccggctatgaggaccaccccaccgttatgctccagggccatctggacatggtctgcgtccaggacaacggggtgaaccacgacttcaccaaggaccccctggacctctacgtggaggacggctatatcaaggcccggggcacctccctgggcggcgacgacggcatcgcggtggccatggccatggcggtgctggatgacgacagcatcccccacggccccctggaggcggtgttcaccgtggacgaggaggtgggaatgcccggcgccgccgcgctggacggctccgacctgaagagcaagtacctgctgaacatcgactcggaggtggagggcgttctgacggtgggctgcgccggcggcaccgcctgccacatctccctggaccagcccgcggagacagcccggggcgcggtgtgcaccctgtccctggagggcctctccggcggccactccggcaccgccatccacatgggatttgccaacgccaacaagctgctggcccagtgtctggcccaggcgggctatccccggctggtctccctcttcggcggcctccaggacaacgccatccccacctccgccaaggctgaggtgctggtcacccccggcgaggcggaggccctgcgcaccgccgccgaaggctgggccgccaaggtcaaggccgagtgcccccaggacccgggcctcacgctcaccgtcaccgtccgggagggggaggcgaaggccctctccgccgccgacagccggaagctgacggacctcatcgccgccgtgcccaacggcgtccaggccatgaaccccgacctgcccggccaggtccagacctccctgaacctgggcatcctgcgcctggaggatggaaaggcccagctggtgttcctggtccgcagctccgtggccgcggagcaggcgggcctgacggagaagctccagtccatcgccacggagttcggcgcggccttcgccgtggacagctcctatcccccctgggagtaccggcgggagtccaagctgcgggacaccatggtgtccgtcttcaccgagctctacggcaaggctccggtggtggagaccgttcacgccgggctggagtgcggcctgctgatggacaagatccctggcctggacgcggtgagcttcggccctgacatcgtggagatccactccacccgggagcggctggggatcgactccgtggagcggacctggcggttcgtgctggcggtgctcaaagcgctgtaa

SEQ ID NO: 1128 - DNA, 753 bp, Oscillibacter sp.
atgaccatagaacagtacaacgcccggctccgggagctggtggaccagatggcccggcggcacaagctcaaggccgtggtctctgacctggaggagcagcgccggaagctggcggatcaggtccaggcgctgaaggagcagacctaccaggagcagctggacgttgacaggctggaaaatatgagcgccgccaagctcttctaccagatcaccggccggttggagggccagctggagaaggaacaggcggagctgtacgccgccgcgctgcgttacgacgggaagcggaaggagctgcatgccctggaggcggatctggaggagcgccgccgggagctggacgctctggccggctgcgaaagggagtacgcccggctcctggaggagaaggcccgggccatgaagtccgccaacagctactacgagaaccagctggacgccctggaggagcgcatcgcctacctggacgcccaggagcgggagctgagggaggcgatcagcgccgggaacatggccctgggtgagatccagtctatccagcgctccctctcctccgccgagggctggggcacctgggacgtgttcggcggcggaatgatcagcgacatggccaagtactcccacatggacgaggcacagcggcggatccagtccctccagcggaccctgtcccggttccgcgcggagctagcggatgtgtccatccaggcagacctacagcttcaggtggacggcttcctccgctttgccgac

SEQ ID NO: 1129 - DNA, 627 bp, Oscillibacter sp.
atggatcaaatcattgaatacataaaacaactttacgatcccatttccatcatcgtttatgggtcatacgctgacggtaccaatcatctcaacagcgattttgatgccctggtcatttcccgcagcaacagaacgtttcacgacacggcttttgtagacggaactccgttggacgtattcatctatcccgaatcacattttgacggcaattatgattgcaacgatttcattcaaatttttgatggaaagatcgttttggataccgaaagcaagggagcggcactcaaggatcacattctgtcatatatgaaaaatcgtccgcagaaaacagacgcagagattcgaggggagatcgactggtgcgcaaagatgttcgcacggacaaagagacatgatgttgagggaatgtttcggtggcattgggtgctgaccgatagcttggagatattctgcgatgcggtacaccacccctatctggggcctaaaaaagcattgcgatggatggagacgaagcatccaagggcattcaccttttataagaaagccctggttgatttcagcgcggaaagcctatctgactggatctcatatttagaaaatatgattgagaaagagacctccgtatga

SEQ ID NO: 1130 - DNA, 342 bp, Oscillibacter sp.
atgcctgccgcgccgaaagatctgcccgcctgccctgtggagaccgccctgactttgatcggcgacaagtggaaggtcctgatcctgcgggacctgatgaccgggacgaagcggttcggggagctgaagcggaccgtcggcggtgtgtcccagaaggtgctgaccgcccagctccgggacatggaggccaagggccttgtcagccggacggtctacccggaggtcccgcccagggtggagtacagcctgacggagctgggacggagcctgaagcccatcctggacgccctgcagcactggggcgaggattacaagaccagaatcgccgcctgcggggagtga

SEQ ID NO: 1131 - DNA, 1347 bp, Oscillibacter sp.
atgaacgagtatgccttgcgcgtggcggaggacctgcggcggcggtacgcccacgagccggagtacctccaggcggtcctggcctggctggagctcatcgacccggccctgggggagaatccggagtatgagagactggacctgctcgcccggatggtggagcccgaccggatcgtgaccttcctggtcccctgggtggacgaccaggggcggacccacaccaaccacggctaccgggtccagttcagcaacgccctgggcccctacaagggcggactgcggtttcagcccggggtgaatctgtcggtggtgaagttcctgggctttgagcagacctataagaacgccctgatcggcctgccggtgggcggcgccgccggaggggcggactttgatccccggggccgcagccgccgggaggtcatgcgcttctgccagagcttcatgaccggattgtaccgctatgtgggggcggacaccgacgtgcccgccggggacatcggcgtgggggaccgggagatcggctacctctacggggcctacaagcgcctgaccggccgggcggagcggggagccctcaccggcaagggcgttacctacggcggcagtaaggtccgccaggaggcggcgggctacggcgcggtgtacttcctgtgccggatgctggaacggcaaggggagaccctggagggcaagcgcctggtgatctccggcttcggcaacaccgcctggggcgtgtgccggaaggccgcccagctgggggggaaggtcgtcaccctctccggccccgacggctatgtctacgaccccgacggggtgtgcgcccaggagaagttcgactttatggcggagatgcgcgccggcggggaggaccgggtggagccctacgccctccgcttcggcctggagttcttcccgggcaagaagccctgggaggtgccgggggacatcgtgatgccctgcgccacccagaacgagatcgccgtggaggacgcggtccgcatcctggtcaaccgggtggggtactacgtggaggcggccaatatgcccgccacgccggacgccctgcggctgctgcggctgagcccggacatcctggtggccggggccaaggcctccggggcggggggcgtggcggtctccgccctggagatggtccagaactccctgcgctacagctggccgagaaagcaggtggaggagcggctgcggcagattatggcggacatccacgacgtctccgccgcggcggcggaggcctacgggctgggctacgacctgatcgccggcaacgacatcgcctccttccagaaggtctcccaggccatgatggcccagggactatga

SEQ ID NO: 1132 - DNA, 300 bp, Oscillibacter sp.
atgagcgaggaatacggtcccgattttatcaccattgtggacgaggacggcaacaacatcgagctggagctcaccgatgagctggagcacaacggctgccggtacatgtccttcttccccgccgtggaggagggcgccgacgaggagagcgaggactacggcctggtgatcctgaaggtcatcgaggaggacggcgaggagctgctgtccaccctggacagcgacgaggagctcagcgaggtctacgacctgttcatggagcgcctgttccaggaggaggacgagaacggagaggcgtaa

SEQ ID NO: 1133 - DNA, 1266 bp, Oscillibacter sp.
atgacgcggcagaatctcatggacaatgtatacctgacctacgtcccatcggagaaattcaaaaccagctttctcagcgcccagatggtggtgcctctggccccagagaccgcggggctcaacgccctactggtgaatgttctgggccgggggaccctccgctgcccggatatggcggccatcgcccgggagctggacctgctctacggggcacggctggagcccagcgtgcggaagaagggagagaaccagaccttcggctttgtggcctcctgcgtggacgaccggctgctgccggcaggggagcggctgctggagcctctggcggacctgatgggggagatgttcctcagccccgccacccgcaacgggaggctccggggcgactacgtggacagcgagcgggagaatctggcggatctgatccgcagcgagatcaacgacaagcggtcctacgccgcgcggcggctcatcgccgagatgtgcgccggggagccctatggcgtcagccgcctgggggaggcccggggggtggagcggatctccctgcataagctcaacagccactatcaggccctgctgccccgggcccggctggagctgttctactgcggttccgccccggagaagcgggtggcgggtctgttcacgcgggccttcgccgcactgccccggcaggggaagcagatcgagccagcccccacagtccgccgggaggccccggcggagccccgggtcattaccgaggagatggacgtggcccaggggaagcttggggtggggttccgcaccatgagcgatgacggcgcggccaccatgatcatgaacagcatgttcggcggcacaagcacctccaaactctttctcaacgtccgggagaagctcagcctgtgctactacgccggcagcagttatcaccggaagaaggggctcatcaccgtgtcctccggaatcgagacgaaaaactaccagcgggctctggacgagatcatgacccagctggaggccctgcgccggggggagtgggaggactgggagctggagggggccaggagcagcctccgcaacgccctgcggtccatggaggactccgcctcggcgctggaggacttcaccatgggccagatggccaccggaagcgacgagaccatccccggcctgctctccgccgtcgaggcggtgaccccggagcgggtccgccaggcggcggagcaggtgcggccggatacgatctattttctcaagggaaaggaggcggaggaatga

SEQ ID NO: 1134 - DNA, 507 bp, Oscillibacter sp.
atgggcggccgggagaggacctgctgcttcaccggacaccggccggagaagctgccctggggctgggatgaggaggacccgcggtgccggcggctgaaggagaagctccgggacgcggtggagacggcctacgaggaggggatgcggcacttcatctgcggcatggcccggggatgtgacttctacttcgccgaggcggtgctggacctgcgccgccgccgccccggcgtgaccctggaggcggccatcccctgtgccggtcagagccggaggtggtctccggcggagcgtcggcggtggcgggacctggtgtctgcctgcgacctggagaccctgatccaggagcggtacaccccggactgcatgtttcgccgcaaccggtacatggtggaccacagcgccctggtcatcgccgtctacgacggggccgggggcggcacccgccggaccctggagtacgccatccgccggggggtgtccttcgtggacatccgcccggaggcataa

SEQ ID NO: 1135 - DNA, 207 bp, Oscillibacter sp.
gggtacggggccggaggccccgaaaactctggggatgtgggtgcaaagcccccacgacaaataaaaaaactttttgaagaagcaaaaaaacccttgacaagccgccgtatatacggtatattattaaagctcgcgccgggcggagtatgcctccatgtccgggagagcactgcgatgatgcgggagattgcggccgctggccggtaa

SEQ ID NO: 1136 - DNA, 1725 bp, Oscillibacter sp.
atgagagagctgctgcgatatttacggccctacgggggcaaggtggcgctggcgatggggatgatcgcggtgtccaccttctgcaatctgatgctgcccacgatcatgagccgcatcgtcaacgacggcgtgtacaacgccgacttcccctacatactccgctgctgcgtccagatgctgctggtggccctgctggggctatgttcgatcctgatgggggtgcggaccagcagccaggtggtggcggccttttccgccgacatgcggcgggacattttccgcaaggtcagcaccctgaccttcgaggagttcggcgccatgggcaccgccgccctcctgacccggtccacccacgacgtggagacggtctcctgggtggcctccatgctgtcgggcaccgtggtcaccataccggtgctgttcctggggggcgtgctgctggctctgagcaaggacgtggcgctgagcctgatcctgctgtgcttcatccccaccgtctttgtggcggtggtggtcatcggtcggcggatcgaccccctgtggcagaagtccgacgcctacgtggaccggcagaacgacatcatgcgggagcggctgtggggcatccgggtgatccgggccttcaaccgggagccctacgagcaggaccgtgtggcccaggccacccgggttatggcggagaacatcatcaaggccaacaccagcatgggggtcgtgtcccccctggccctcttcgtcttcaacgccgccgcggtgctgatcctctacgtgggggctggccggatggaggccctgggcgcccccgccgccggggacatcttcgccatcatccagtacatctccctggtgatgaacggggtggtgatggcggccttcgccatcgtcatgtacccccacgccaaggtggcggcgggccgcatcgcccaggtcaccggggcggagagcatgggggatggtacagaggaaaaggacgtgaccttccggggcgacgtggacttcgaccacgtgaccttccgctaccaggacgccgatgagcccgccctccgggacatcgacatccacatcaaggccggccagaaggtcagcgtcatcggcggcaccggctccggcaaatccaccctggtccagctcatgctgggcttccgcctgcccacggaggggaccatccgctttgacggcgtggacgccggccagtggggccgccgcaccgtgcggcggaacatcagcgccgttttgcagaagaccgccatctactccggcaccgtccgggacaacctcctcatggggaaccccgccgccggggaggcggccatgcgggaggccgcccggatcgcccagatcggggacttcatcgacaccctggaggcgggctacgaccacgagctggtccaggcggggaagaacctgtccggaggccagaagcagcgcctggccatcgcccgggcggtgctgaagaacgcccccatctacctcttcgacgacagcttctccgccctggactttctcaccgaggcccggctccgccaggagctcaacgagagaatggcggggcatacccgcatcgtcatcacccagcgggtgacctccgccatggactccgacgtgatctttgtcatggaccaggggcggatcgttgacaggggccggcaccaggagctgctggaccgctgcgccatctaccgggagatctatgcctctcagacgggagggggtgaccgccggtga

SEQ ID NO: 1137 - DNA, 336 bp, Oscillibacter sp.
atggagaaaaacatcccctccggcggcacggccatgctgctgctgaagctgctggaggagggggacatgtacggctaccagatggtggagaccctgcgccagcggtcggaccacaccttcgacctgaaggccgggaccttgtaccccctcctccacaccctggaggagaaggggttcgtcacctcctacctggaggggaccgacaccccccggcccaggaagtactaccgcctgacgtccacagggaaggggcagcttgtggaaaaggtggaggagtggcggcggtacaccgccgcggtggagaaggttttgaaggggggcgagacctttgcctga

SEQ ID NO: 1138 - DNA, 849 bp, Oscillibacter sp.
atggccgccgggatgggaagccgcttcggcggtctaaagcaaatgacgccggtggacgacggcggacacttcatcatggactactccatctatgacgccatccgcgccggcttcggaaagatcgtctgcgtcatcaaggaggagatgtcccgggattttgaggatcgcttcgggagccatatccgcccccacgtgcccctggcctgcgcgtaccagtccctggaccagctcccggagggcttctccgtccccgccaggcggaccaagccctggggcacggggcaggccgtcctgtgcgccgccggggagatcgacggccccttcgccgtcatcaacgccgacgactactacggccgggaggccatggaggccatcggcgccttcctcagccagccccggccggggacggaacacgccatggtgggctaccccctctccagcacgctgacggagagcgggtatgtctcccggggcgtctgccaggtggacggcgacggccacctggtggggatcacggagcgcacccacatcgagtcccgggccgacggtccggcgtacaccgaggacggcgagacctacgtacatctgccgccggacaccgtggtgtccatgaacctgtgggggttccagcgggacattctggatctgttccgggaccagttcacggtgtttctgcggggggaccacgacccgctgaagggggagttcttcctccccaccgtccccagccgcctcatcgccgagggccgggggacggtcagcgtcctccccgccaagagccgctggtacggcgtgacctaccaggaggacctgcccgccgtcaaggcggccctcgccgccatggtccgg

SEQ ID NO: 1139 - DNA, 879 bp, Oscillibacter sp.
atggcggcggggcggtggtaccgtgagaggggagtttcccgggaaaggagaggtcccatgcatatgttgaaaaagggctgcgagaccccatacggcgtcatccgatattggatttgccgggccggtgaaaatcgcccgtggctggtattcctgccggggctgaccgccgaccaccgcctgtttgacgggcaggtagcggagctgggaaaggggtataactgcctggtgtgggacgccccgggccacgggacgtccagacccttcgccctaaagttctccatggaggatctggcgcagtacctgagacagatctttaccgctgaggggatcgctgggccggtcctggtgggccagtccctgggaggctacattgcccaggtatacatggaggcatatcccggctctgtctccggctttatctccatcgactcctgccccctccagcgcaggtactacacagggctggagctggcgcttttaaaacataccaaggggatgtatttgtcgattccctggaggtggctgctccgctggggtgccgcagggtgcgccgtgacggaatacggtcaaaaactgatggcccagatgatgggcgagtacaataagagggaatactgcgctctggcagatcatggctaccgcatcttcgctcaggcggttgaggctggaaaggcgtatgccatttcctgccctgtcttgctgttgtgcggcgagagggacagggcaggttccgctaaacgatacaacagggagtgggcccgccggagcggatatcccctggtctgggtccccggggccggccacaacgccaacacagaccggattgattttgtcaacggccaaatcggggaatttgtccaaggcttatgggacgcatag

SEQ ID NO: 1140 - DNA, 516 bp, Oscillibacter sp.
cccgccgcttttgacgggtttatggcccactacggcaaattctccggcgtcaggaactatatcatgcttgccggcgaaaaggggtcggggctggatgaaaaatgcggctattacggcgaaaagatcgtcctcttcgcgcaggccctgggcctgaacacctgctgggtcgccttgacgtacagcaaggggaaggcggcgctccggctggacaagggggaaaaattgtgcctcgtcatagccatcggctatggacagaccgggggcgttccccacaagtccaaggagcgtgcgcgtgtgatggatgtgcaggggacgcccccggactggttcataagagggatcgacgcggcgctgctcgcgcccacggccatgaatcagcaaaaatttgtcttttccttgaaggacaatgtggtgacagcgaagccgggtctcggcttttacagcaaggtcgatctcggcattgcgaagtaccactttgagctgggggcgggaaccgaaaatttcagatggggctga

SEQ ID NO: 1141 - DNA, 558 bp, Oscillibacter sp.
gtgacaaaaagtgagctccgggcgctgatcgcccaacaggtggtggccctgcccccggactactgccgggaggcggacggggccatctgccgccatgtgctggactgggaggtctaccgccaggcgaaagccgtgttctgttatgtgggaacggaccgggagatcgacacccgccccattctccgggacgccctggaccggggcaaggtcctggcggtgccactgtgcgtggccaaaggggtgatggaggcccggcagatccgttccttggagaacctggtgccaggaaagtacggcatcctggagcccgggccggactgccccctggtggctccggaggcgctggacctggccctggtcccctgctccacgggaagccggtcggggcggaggctgggctacggcggcgggtactacgaccgcttcctgccccggacaacgtgccccaaggccctgctgtgccgggggcgcctggtccgggaggacattcccacggaggaccacgaccagctcatggacttcctggtcacggaggagggcctgacctcctgccgctga

SEQ ID NO: 1142 - DNA, 936 bp, Oscillibacter sp.
atggagctgctctactggtttgaatccatccgaaccccggtcctggacacggtcatgtccctggtgacccggctgggggaggagacgtttttcatgatagccgccctctttgtcttctggtgctgggacaagcgccggggctactacctgctggcggtgggctttgccggcaccctggccagccagtggctgaagatcgcctgccgggtgccccggccctgggtgatcgacccggacttcaccatcgtggaatccgcccgggaggcggccgcgggctacagcttccccagcggccacacccagtgcgccgtggggtacttgggcggcatcgcccgcttcaccgggcggctgtgggtgcgggtggtgtgtatcgtcctggccctgctggtggcggtgtcccggatgtacctgagggtccacaccccggcggacgtgggggtgagcctgctgatcagccttgtgctggtgctggccctctacccgctgctggagagcaccctgtggtttcccaaccggatgtacgccatcatcggcgtgatgctggccctgagcctggctttcgtgggctatatggagctgctgacccagccccctgtgggcagctctgaggcgctgctggaggcctatgagaactgggcggaggccaggaacaacgcctacaccatggcgggcgccgtggctggcgtcctggtggtctacgcctttgacaccaagttcctcaagtttcccacccgggccccctggtgggggcagctcatcaagctggtggggggcctggccctggtgctggcggtgcgggtcctgctgcgggagcccctgctgtccctctgcggcggccaccccgtggccaggagcctgcgctacttcctgatggtcctggtggcgggatgcctgtggcccatgacctttcagttttttgagaagcacgccaagtga

SEQ ID NO: 1143 - DNA, 738 bp, Oscillibacter sp.
atgaaaagcaaccgaaattggtatcgagacggcctgcgggacggggtgcccattgccctgggctacttcgccgtggccttcaccctgggcatcgccgcccggaacgccggcttctccgcctttcaggcggcggtgtccagcctcctcaaccacgcctccgccggggaatacgcggtgatctccctggtggcggcgggggccggctactgggagatggccgtcatggccctggtgtccaacgcccggtacctgctgatgagctgctccctgagccagaagctggcctcggacgccccgttggtccaccgggccctggtgggcttcggcatcaccgacgagatcttcggcgtctccgccgccgtccccggccgtttgaaccccttctacacctacggggccatgtcggtgtccatccccagctgggccctggggaccttcctgggggtggtgctgggcaacgtgctgccgccccggctggtcagcgccctgagcgtggggctctacggcatgtttctggccatcatcgtcccccccgcccggcgcagccgggtggtgctggccctggtgctgctgagcttcgccgccagctacatcgccggggccctgccggtcctggccgccgtgtcctccggggtgcggaccatcgtcctcaccgtagccatctccctgggggcggccctgctcttcccggtggcggaggaccaggagcgcgacacaagcgaggaggtctccccatga

SEQ ID NO: 1144 - DNA, 309 bp, Oscillibacter sp.
accgccgtggcgcagcagacccttcagctctccaactgggacaagatccccgccatggcccagattttccaggagtatgtggacacggagctgacggtgcccaatctggtgtggatcggcgagcaggccctgaccatgggcagcgagaacatccatttccacaccctgcccggcgacggcgccggctactacaagggcggctcctactacacggtggaccctgaggctaccctggagctggtcaatacatacttcaacccctatacctacgacctgaccctggacgacatggatatcctggtgccgtga

SEQ ID NO: 1145 - DNA, 1323 bp, Oscillibacter sp.
cgcctgtccgccacacttgccaccagaaccctttatgtggcggtggcactggaggacgggacgctgctgcgcctggccagtgagcagagctccgtggcggacctactgctgagcctgatcccctctatggcggccattctgctggtgatggcggccttggccgtttttctggcccaccggctgtcccgaaacctgatccggcccatcctgtccctggatttggagcacccggagaactgcgacacctacgaggagctcacccctctcctgcggcggctccacagccagcaggagaccatctccgcccagatcgcggagctcaagcggcagcagaacgagtttaccgccattacggaaaacatgagcgagggcttcctgctcatggacagccacaccaatctcctctcctgcaactccagcgccctgcggctgctgggggcggagattgccaattcaggggagagcgtgttccatttgagccgggcggagcccttcctccatgtggtggaggaggccctggcggggcggcacagcgaggcccttctggagcgggagggccggtactatcagcttttggccaaccccgtgatgcgggatggccggctggcgggagcggtgctggccattctggacgtcactgagcgggagaaccgggaggccctccgccgggagttcagcgccaacgtctcccacgagctgaagacgccgctcacctccatctccggtttcgcggagctgatgaagagcggcatggtgccccaggagacggtgccggagttcgccggcgacatctaccgggaggcccagcggcttatcaccctggtggaggacatcatccacctcagccagctggacgagggcgcggtgcccatggaccgggaggagatcgatctccacgttctggcccgggacgtgctggaccggctggccccggcggcggagaaggggcgcgtccagctccggctggatggggagaaggccgtggtcaccggtgtccgccatgtggtggacgagatggttttcaacctggcggacaacgcggtgaagtacaaccgccccggcggctccgtgaccatcaccaccggcatggagaaggggaagccctggttctccgtggccgacacaggcatcggcatcccggcggacagccgggagcgggtgttcgagcggttctaccgggtggataagagccactccaaggacgtggggggcacgggtctgggcctgtccatcgtcaagcacgccgccgcctacctaggcgccagcctggagctgcgcagcgaggtgggggagggcaccacggtgacggcccgttggaattga

SEQ ID NO: 1146 - DNA, 723 bp, Oscillibacter sp.
atgctcgacacgattttgttcgacttggatgggactctggcgccctttatgcaagacgactttgtacgcttgtatttcaaagcgctggttcgccgcctggctcccatgggctacgacggcgagaagctgcttgcggccctgtggcgcggtgtagacaccatggtggcaaacgacggaacgcacaccaaccggcaggtattctgggaaagctttgtggcggatctcggagtggctgccctggcccttgagggagatttgaatgacttctacggcggcccggactttgacgccgccagagcctgtctgcacgaggaggtggaccgccgtcctctgatttccgctctgcgcgaaaagggatacagcctggtgcttgccaccaacccgattttcccggcggtggcggtggagacccggcttcactggattggtctgacaggggaagattttgaccatgtgaccacctatgagaacagccgccacagcaaacccaacccggactacttcagggatattttggcccacatcggaaaagcgccggaggagtgccagatggtgggcaacaatccggtggacgatatggctgcgctggaggcggggatccgggcctatcttgtgacagactgcctggaaaatccgaccggccgccccatcgacgggtacacccacggcttcttccgggacctagagacatatctggccgctctgccggtggtggagaggtag

SEQ ID NO: 1147 - DNA, 324 bp, Oscillibacter sp.
atgccccgggaaaaattccagaccctgacggagcagatgttctacaccctgctgtgcctgaaggacgagtgctgcggcatcgacatcctggacaaggtcccggccatgacggaccggcgggtctccgtgggctccggcacgctgtacaccctcctggaacagttcaccgaggcggggatgatccgggagacccgggtggagggccggcggcggagctacgtgctgacggacaggggccgggagatgctggagcgggagtaccggcgggtcctggcccaggcggcggactaccgccgggtattcggagaggaggacgcgacatga

SEQ ID NO: 1148 - DNA, 339 bp, Oscillibacter sp.
ttgacggtggaggttttgaaaattgtcctcatccttgggatctcctgggcggcggtgatctggggcgtgaatctctgccaccagaggggcacctggttcctcgccggctggaacaccatgagaaaggaaaagcgggagacctacaatgaaaaggagatgtgccggctctatggcaggtgcgtcgttttctgcggcgtcggcgtcttcctgctgctctatggcagcttttatgaccgggacgccgtcctgctcgccggtctggggatcatcgcattgatggtcgtcctatccatcgtggttccgatcatacatcctgagaaataccggaagagatcctga

SEQ ID NO: 1149 - DNA, 393 bp, Oscillibacter sp.
atggccatgggcaacgagatcccggagcagctggccatgtttctccgctcagttgccctggggggtgtgctgggcctggtgtacgacctggcccggtgcctcaggcggctggggggaccgctgtggcggggcctgctggacgtggcggtgagcctgacggcggcagcgtccctgttcttcttcattatggccggcagcggggagctgcggctgttcattctgatcgggactctgggaggcggcgtgctgtttttctccctgctcagttcccttttgcggcctctttgggacttctggctggatctcctgctgattccagccaggctgctgggccggatcggaaaaaagttgtatcgaatttgcaaaaaactcttttcttttccgcgaaagtgg

SEQ ID NO: 1150 - DNA, 1299 bp, Oscillibacter sp.
atggcaaaattcatctcaaggctggcgccggggcggatcatcgccctgggattcgcccttgtcattctgctgggttcggggctgctgatgctgccctgcagcatccaggacggcgttaccgtccggtacatcgacgccctgtacacctccaccagcgccgtgtgcgtcaccggcctcatcgccattgacgccggggacaccttcacccctctgggccagttcttcctggcctccctgatccaggtggggggcctgggggtaacggcggtgggcgccggcatcatcctggccatgcggcggcgtgtgaacctgaagggccggaacctggtccgggaggccatgaatctggattccggccaaggtattgtccgcttcgtccaccgcatttttctgaccacactggcctttgaactggcgggggccgcgctgagcttcctctccttcgtccaggactacgaacccctggacgccctgggcatcagcctgttccactcggtggccgccttcaacaactcgggcttcgacattttgggcaacttccagaatctgattccctaccaggacgatgtgctgctgaacctggtgacctgtgcccttatcatcttcggcggcatcggcttcctggtcatccaggaggtcgtacgcaagcggttccgctggagcaaattttccatgcacaccaaggtggtcctcaccgtcagcgccgcgctgatcgtggtgggcaccctgctcatcaagctcactgaggacgtgacctggcttggggccctgttccacagcgtgtccgcccgtaccgccgggttctccacctatcccctgggctccttctccaacgcggggctcctggtgctgacggtgctcatgttcatcggcgcctccccgggctccaccggcggcggcgtcaaaaccagcaccttcttcgtgctgctccagggcatcaagtccgccgccaccaacaagacggaaaaggccttccactactctgttcccgccgacgccttccgcaaggcggctgtgatcaccctgctggccctgggcgtggtcctgacgggcacctatctgatggtgattctggaccccggcgtcacgctgatgcaggcgctcttcgaggtcaccagcgccttcggcacggtgggcctttccaccggcatcactcccgggctcagcgacggcagcaagctgctgtccattctgatcatgtacatcggccgtctggggccgctgaccatcgcctccctgtggtacttcaccaagggggagcgcacccactaccccgagggcaatatcgccatcggctaa

SEQ ID NO: 1151 - DNA, 2643 bp, Unknown
  Description of Unknown: Clostridiales sequence
atgaaacgtgcagtcaccttgctgctggccgttattatggtcctaagcattctgcccatttctcaatcaagcccgcagcaaagcgccgattacctgctgcttgaagattttgaaagcggcatagacggttattacggcggcgatttaagccaatacggcctggcattgcccaattttgttgctcagccaagcggccattcgggaaacggcatcttttcggttatgacgcagaacggccagtggtgcgaaaccttgcagagcaccgatacggcccttgtccggaattttgaagccaatgcggatgattacggctattttatgttctatatagccggtattcagacccttccgctcgaacttacggtaacgctcaggagcagtacgcagagatattactttaccgctccggacgccgcgctttacagcctggacggcgcaagccagacagtaaccgggggcaatgcctcaggcggaggcgaaaacacctccataaccatccccgccggattcagcggctatgtggtttacagtctggatatgtcagcagtaaattttgatgtaaccaacatcgtgctggacgtgcgcaccaacggagcgctcaaggatgattcctacggctttgattccttctacttaactaattcaccaaaggaaataatggatatgtacaatcaaaacaatcctgatgacgacggcaataaccaatatatgctgctggaagattttgaaagcttcgccgcagacggcactatgcccgcgggctattcttcctctgatcttaccagtttcggcgtgcctgccgtggccgaatatcaaattaaaaaaagcggacattcgggaaacggaatagcctcggtaatgcctgcaaattcccagtggtgcgaagtgctgctctgcggtcagaatacttccctagtgaaccgctttaaagcaaatgcagccgattatcagtattttatgttctactattcgggcatccccggaattgaaaccaatttaactgtcactctccgcggcgcttcctcccgtatttatcttacagcggataccgtatctctttacacgcttgaaggagaaagccttgaagttgtaggcggagacaagtcaagctcaggagtggctaattcctcctttgcggtttccgccagcttcaagggctatgtcgtatttaagctggatatgtccaaagtggattttgagattgccacaatagggctggacatgcgctgcacaggagcattcatgggggattcttactgctttgattccttctaccttacaaacgacccgcagcttatcatagatttacccaatgacggcggcataacgggtgaggaaagcaatattcccgatataccggacgatatagacgatgctgtagcccaagcaaaagctatgtttgattcgttattagattatacacccgaaataacatatacccccgaatatgacccggcaggctacgatggaataaaatgtttttactatgaaagcgtaaacgaccatcgcggtcaggctacgcgcgcctttgcatacataggctaccctgaaggcgccagcgaggatgaacccgtacccgctgtactgctgctgcatggttcgggaggatatccctttgctgaatggataaaaatctggaatgaccggggatatgcggctatcgccatccagcacggcgcgctgatgcccgacggcaaaggcggatggacgcaggatcctcagggaggagccactgaaggctacggaacgggtaatctgccccttgagcggcaatggctctatcatgccgtggccaaaagcatcctggcgcacaacatcctgcgtagcgacccattaattgacagcgataaaataggcgtaaccggaatatcggccggaggcgtagtagtggccaaccttataggatatgacagccgttttgccttcgcagtacccgtatatctatttggttatatgcacgaatcattatcggacagacgtgagcgctatgacgaggctacctataagctctgggaaggttcagtacgctttgacaatgttaaaatgcccgttctcatcctaaacagcgacagcgatttttcagccagcgtaaacaccagcagccgcagctttgataatttggaaaacgcccagatatgcataaagcacggcttgctgcatggtcatatagaaggctgggccccggcggaaatctatcgcttcgccgacagcattgtaaaagacggagagccccttgcctattttacagagcagccaacggccggtatgggaaatgatttgaatctagcgcttgacgtgccaaatgacgcagaggacgtcagcataaccctttattatactactgaacctctgagctataacgaccaaaaccagcttgaacaaacatggctgtctgttcaaggaacatattccaacggcaaagtagaggttaaggttcctgaagacgcaagcgtatattatataagcgtatgcactaaaactgcttcaggcaattattattcctcttccagactggtcggagcgcctcatgacgactatgatcagggcggggattcatccgcgctgccattagccttagcaggagccgccggtttaactggcgctctgtcagttgcaaccaagaaacgcaaaaaatttaattaa

SEQ ID NO: 1152 - DNA, 1194 bp, Unknown
  Description of Unknown: Clostridiales sequence
atgagcagcagaaataaaaaaatgcagactccggctggagtatatgacttccttccagatgaatgcaggctgagtacatatctgaaacacaatattttatcagaggctcaaagctggggatatgagcgtatagaaactccgtccattgaatatctggacgtatatcttactaccaacgcagtggcgtccataagggatatttttaagtttaccgattcttcaggccgtcttttggcgctcaggccggatataactacatcagtagcgagggcggtggccgtaaaaatgaaagaggggcccttcccgctccgcttgtgctatcagggcgaggtgttttccttcaacgctcaggcgggcgggttcacccagcgcacgcaggcgggtgtagaattgataggagggtcgggctccttttatgacgccgaggttatagctcttgccatttcctctcttttaagggcgggggtaaaggatttccaaatagaaatagggcaggtggatttttttaagggtcttatgctggaggcgggccttaacgatgagcaggcggaggaagtgcgcctgctggtggagcagaaaaatatgctgggcatagaattgctgcttgaaaagcttcctgttagccagccgctgcgcaaagttatttccgagctgccttatttgtttggagatgtaagcgtattgagctcggcgctgaatatgtgcccccatcccaaatgccgggaggccgtggataatctgaaggaaatatatgaatatttaaaagcatattcctttgaaaaataccttacctttgatttgggtatggtgcagagccttaattattatacgggggttattttccgaggcatatgtccgggagtcggcgagccggtgatgaacgggggccggtatgacgggctgcttgaagagtttggcgcgcagctttgcgctaccggctttgccgttgaggtgactaagcttataaaagcgtatgctttccatccggctgaagagggagaaaaacaggcagaggtgctttgcgatgcggagaattatgctgaagcggtgaaattatgcgcccagcttcgcagccagggcaagcaggccgtgcttaatttacagagcggcaatacaggcttatatgcggaaaacaactgcgctgaaggcgaaatatacatggccggcagcgaaaataccgagcgggttaaataa

SEQ ID NO: 1153 - DNA, 3579 bp, Unknown
  Description of Unknown: Clostridiales sequence
ttgtttgaattaaacaattttgattccatacaaatcggccttgcgtctcctgaaaagatacgcgaatggtcttcaggcgaggtgaaaaagcctgaaacaatcaattaccgcactcttaagcccgaacgggacggcctgttctgcgaacgcatattcgggcctacccgcgactgggaatgcgcctgcggcaaatataagcggggcgcgcggtataagggcctggtctgcgaccgctgcggcgttgaagtaacccgctccaaggtgcgccgcgagcgcatggggcatatagagctggcggcccccgtttcgcatatatggtattttaagggcatacccagccgtatgggccttttgctcgaccttactccgaaggaactggaaaaggtgctgtattttgcggcgtatatagttattgagccgggggataccgaccttaaggctaagcagatactgtccgagagcgagtaccgcgagaccatagaaaaattcggccccaattccttcagagtaggtatgggcgccgaggccataaaggaatttttaagagctatcaatcttgacgagctgtccgacgagcttaagcacgaattggaaaacgcaaacgtaggacagaagcgggtaaggataataaagcgcctggaggtagtggaagccttccgcaaatcgggcaataagcctgaatggatgataatggacgccgtgcccgtaattccgcccgaaatacggcccatggtgcagctggacggcggccgttttgccaccagcgaccttaacgacctttaccgcagggtaataaaccgtaataacaggcttaaaaagctgctcgaattaggcgcgcctgatattatagtgcgcaacgaaaagcgcatgcttcaggaggctgtagatgcgcttatagataacggccgccgcggccgtcctgttaccggacctggcaaccgtcctttaaaatccctgtctgatatgctcaggggcaagcaggggcgtttccgccagaaccttctgggcaagcgcgtggactattcgggccgttcggttatagttgtaggccctgaactgaaaatgtatcagtgcggccttcccaaggagatggctttagagctgttcaagccctttgttataaagcggctggtggaattgggcctggctcacaatataaagagcgccaagaggcttatagagcgcggacgcacagaagtctgggacgtgctggaagaggttatagtccagcatcccgtcctgcttaaccgcgcgcctactctgcaccgcctcggcattcaggcctttgagccggtgctggtagagggcagggcaattaaactgcatccgctggtgtgtactgcctttaacgccgactttgacggcgaccagatgcctgtgcatgtgcccctttcttcagaggctcaggctgaagcaagatttttgatgctggcctcaaataatatacttaagcctgccgacggccggcctgttgtagtgcctacgcaggatatgattataggtgtgtattaccttaccatagaggaaccctccctggcccgtccggagagcatatattccaatattgacgaagcgattatggcgtatcagacgggcaatctgccccttcatgccaagaccaatatccgcataagcgccgtagtcaacggaaaggaatatacaaaggtccttaaaaccaccgtgggccgcgccatatttaatcaggccgtgccccaggaccttggctttgtggaccgttcaatccccggcaatgaggtagagctggagatagataaattagtaggcaaatccgagctgggacagataatttcccattgctttgccagacatggagcggcccgcacggcggaggtgcttgaccgcattaagcgcctgggctttaattatgcgacaaagggcgccataacggtaggcgttaaggacgccgtagtgccgtctgaaaagaaagtgcttatcaaggaggccgaagataaggtagcgcttattaaccgcaagtaccgccgcggtcttactaccgatgaggaacgctaccgcaatgttatagccgtctggaaagagactactgaaaatgtgcttaatgcgctgatgacctcctttgacgaccttaacccgataaacatgatgattaaatcgggagcacgcggtaataaggaccagattcgtcagcttgccggcatgcgcggccttatggccgacccgtcgggccgtactatagaaattcctattaaagctaacttccgtgagggcctgaccgttttggacttcttcatttcttcccacggtacccgcaaaggtctggccgataccgctctgcgtaccgctgactcaggttatcttacccgccgtctggtggacgtgtgccaggatgttattgttcgtgaggacgactgccaggtaactcatccttccctgagcactcccaagggcgtctgggtagaagatatagtttacgaaaaggcggttatagagcctcttaagagccgtattaagggccgtgtttcagtggatgaattaaagcatcctgaaacaggtgaaatactggtgcatgccaatgagctgataaccgaggaaatagccgacgctatagtcgcggcaggttataagcgggttcagatacgttcggtattcacctgccgctcggataacggcgtgtgcgccaagtgctacggagcggatatgactactaataaattggtgagccagggcgaggccgtaggcataatcgcggctcagtccataggcgagccgggtacccagctgacaatgcgtaccttccataccggcggtgttgcaggaagcgatataactcagggtctgccgagggttgaagagatatttgaggcccgcaagcctaagacgctggctatactttcagatatagccggcacggtcaaggttactacaaagggcaagggccagtatcagataacggtaacggccgaggacggcgatgtccgtacctacaattcaggctttaacgtaattccctgcgtagcagacggcgatgtggttgccgagggagacgagctcacgcccggttccctcaacccgcacgaccttttgaggataaagggtgtcactcagctccagaattatctcctgcgcgaagtgcagacggtttataagcgtcagagcgttgaaataggagataagcatatagagcttatagtgcgccagatgctgcgcaaagtgcgcatagaggattcgggggataccgatctcctgccgggagaaatggtagatatttataaggttgaggccataaacgccaaggttgccgccgagggcggcgcaccggcgacctcccgccgtatcctgctgggaataaccaaggcttcgcttgctaccgaatccttcctttcggccgcatccttccaggagaccacccgcgtgctcaccgaagctgccatcaaaggcaagacagataccctttcaggcttgaaggaaaacgtcatgataggtaagctcattcctgcgggtacaggcgctaaacgctataaaaacgtggtgctggatgtggagcagcctcctgttgaagcggaggagcagagggaagagccggctgaaataatactttaa

SEQ ID NO: 1154 - DNA, 1908 bp, Unknown
  Description of Unknown: Clostridiales sequence
atgatggatttgtttgatgcggaaaaagaaaaggaacaggcggaacaaagacgaaaaaagaagctttgcgctatggtcagggaggaatttgagcggcgtgccgtacagcggcggccctttgaacttcaatggcagctcaatatgaatttcatgctgggcaaccagtattatgaaatagcttcactgtcgggcgacttgtacgaaaccgaaagagaatatccctggcaggagcgggaggtctataaccatatcgctcctattatggaatcgcgcctggccaaattgacaagggtacgcccgcagatgttagtccggcctgctacgtcggacgaagaagacgtacagagcgctaaagtctgtacggcgctggtaaaatcctgcttttcaagactggccatgtctgaaaaactggacgaggcggctatgtggtctgaaatctgcggcacggttttttataaaagcgtgtggtctgattctaagggcattcctgtggggtctgatgagagcggacagctgcgccagggggatatagaaacaaccgtatgtccaccgtatgaaatatatcccgattcgcccggacggacggatgtggacagatgtgaaagcataatacatgcgcgggcgtattcttctggcgaagttgaacgcatatggggcataaggccggagggcggcaaggtaaaggtttacggaatctcggctgaaaacggaggccttatgccgggcagttccgaactggaggacggcgtattagtgactgagtattatgagatgccttcggctgaatttaataaagggcggctgcttataacctgcggggatatccttctttacgagggggatttaccctataaaatcggcgagggcaatgagcgggggataccgtttatccgccaggtttcaatttcccggcccggctgcttctggggaatttctatcatagaacgctgtattcccattcagagggcatataatgctgttaaaaaccgcaaacatgaattcttgaatcgtgcggcagtaggagtgttggcggttgaagaaggttcagtggatttggagaatctggaactggaagggctggcgcccggcaaattgctggtataccgccagggcaccaatataccggctttccttcccggcggcaatcttccgggagagtttattcaggaggaaagcgaactgcttcaggaatttgaaatgatttcgggggtttccgagatgatgaggcgttcgtatgcgggggcaaatatcagcagcggtacggcgctgtcccttttgagcgagcaggacgatacccgcctttcggttactgccgagcatatacgctcggctatgcgctctctggctaaaatctggctgaggctgtataagcagtttgcgggcagcgcgcgcatagatagagttgtcggggcgaacggccaggtcagtgcgctgtattggaaggccagtcagataaccagtgatgacgtagtgcatgaaacggaaaacgagctgtcgcaatctctctctcagcgccggcagatgatatttgaccttatagccagaggcatctttacttctccgcagggcggcctgagcgagcgcactaaagcgcggctgcttaatatgcttggcctgggcgactgggaaaatgccgcggatatgcctgaaatgcagatggaaagggcgcagcgggagaatttccgcatgagtgaaggcgaagcggctgccgtggaaaattatgatgaccatgaggttcacgagacagagcatattaaatttatgctgtctgagcaatatgaggaactgagcgctaaaaagccagaatgggccgctttgttccaggagcatttgaccgctcatcagattttgttgaatggaggaatttcgaatgcagatacgcttgaacagggaacaacccgtgaataa

SEQ ID NO: 1155 - DNA, 1890 bp, Unknown
  Description of Unknown: Clostridiales sequence
atgcctcccatccgtgcagtcggaaaacccaaaaacgccggcgcaaccttaaagcgcctgctgagctatatgcttaaaactaaatggatgcttgtagccgtatttatatttgtggtctttacttctcttgcaggcgttataggcacttccatgctggatcctattatcaatgaaacaatactgcctctggtaggcacttcgcctgtatttgaagatttcctgccgctgctgagaatgataatattattggcgatagtttatgttataggcgcgttaagctcttatttccagcagttccttatgatacgcatatctaacagggctttaaataacatcaggagagatttgttcaaccgccttgaggatctgcccataaaatactttgacacgcatacccacggcgaaataatgagccgctttaccaacgacgtggatactgtgcgcgaggctatgagccagggcataacccagcttatgtccagcgctataaccataaccgctacttttatcgccatgctaataaaaagcccgctgctcactatgtttataatcttaatgcttattgtgatgctgttcataaccaaattcatcggcgcgcgttcatctaaaaatttccgtctccagcaaaaagctcttgggcgcgccaatggatacattgaggaaatgatagaagggcaaaaggtagtcaaggtattttgtcatgaggatgttgtggaaggcgaatttgcgcagcttaatgaaaatcttcgtcaagccgctacaagcgccaatacctatgcgagcattataatgcctattatgggcaacctgtcttatgtaaattatgcgctcatatcagccttgggcgcctggatgactatttccggcataggcggaatggatataggcaagctggccaccttcctccaatattcccgctccttctcccagcccataacccagataagcatgctctttaattccatactggcctctcttgccggtgcggaaagaatttttgaggttatagacagcgaacctgaacaggacggcggctatgttactcttgtcaacgctcaatatgcgcctgacggcagtttgacggaaagtgacaacagaacggggctatgggcctggaagcagccccaaaatggcaactcccccatttatactcagctcagaggcgatgtgcgcttaaacagcgtcacttttgcctatgaacctgaaaagattgtactgcacgatataagcctgtacgccaagcccggccagaagatagcttttgtcgggtcaaccggcgcgggcaagacaaccataaccaatcttataaaccgtttttatgagattaatgaggggcagattctttacgatgggattgatataacccagattaaaaaggacgacctgcgcaggagcctggctcttgttttgcaggatacgcatctttttaccggcactgtgcgcgaaaatatccgctacggccgattggactctactgataaggaagtagaagaagcggccagactggccaatgccgatacatttataaagcacctgcccgacggctatgatactgtcctgacctcggacggctccaatctgagccagggacagcgccagcttatagccatagcccgtgcggccgtagccgacccgcccgttttaatcctggatgaagctaccagcagcatagatacacgcacagagcgtcttatcgaattgggcatggataagcttatgcacggacgtacagtatttgtcattgcgcaccgtctgtccacagtacggaacgcagacgccattatggtgctggaaaacggcgaaataatagagcgcggcagccatgatgagctaattgcccaaaagggcaaatattatcagttgtatacagggcagtttgaattgtcctga

SEQ ID NO: 1156 - DNA, 1998 bp, Unknown
  Description of Unknown: Clostridiales sequence
atgaaaagaatattagaaaatacggaggaaatattaaattttaacatcagcggatttcatcaatatgttttgactgaaccggtgcatttaagctttgtcagccgtaatctgtgtgaaatgctttgtattgctcaggaagagctattaagcgaagataaagatttatatctgccgtttgtgcatcccgccgatagggaaagctattcagagtttttgcacagaattaaatcagaagaacaggagcttacggcggaataccgcataattaaaaaagacggttcggttatatatttaaaggatacgatgacctcaaagcgccttgacggcgggataatggctggttattcagttctgaccgatataaccaagctgaaaactgagaataatgatctgcgtttcctaaatgatactattccctgcggatttttaaaatatacctgtgaaaagcagcccagagtcacctatattaacgaccgcatgctgaagatattgaggttccctgaaatcaaagacggagagacggattatctggagctttgcaaggaaaatatttttcttatgattcctatggaggaaaggcgccgcttcactctttatctgaaccgcgtttataccgcaggcgtgcccatggccggggaaatacccgttctgcgctgcgacggcaccagagcgtatattttcggctgggttacgaaatgcgtcaatgaacagggcgtggaggaattccagagcgtgtgcatggatataacccaaaggcaccatgtaaagaaagctaatgaaaccaagcgttatattaaggctttgagcgacgtttacgataaaatatttgaatatgattttgcaaacaataccgtcaaatgcctgtatgcccaggattattccatgttcaggtggattgaaaatatcccaatgcagatggaggaggctaccgaaaaatggatagccggcaatgtggtggaggaggaacgggagagggtaagttcctttttccgcgccttttgccagaagagcttaaagctgacttcctccatgcccccgcagatagaatacagggcacgttcttccaagggggatatcaagctttacaggggtatctttttaaagatggatgataatataagcctgtattgctgccggaacgtacctgatttggaagaagcggactttttgagaaatgaaaacatctctttaaaagagaatatgcatgaattagttatgcgctttaaggacggtattgccgcttttgaggtgataaacgagcaggtaacgcctctttatgccagcgataacgtctgtgagttttttggttatactaaagatgaatggctgcgcttaatgaaagtgagcacgccgatgaaaagctttgtatcgcatagtaagtttgcatacgaggattttgtggagctattgcagaatggagaggcagaatatacttattttgatttgaatactcagaccgagcggcgcattaaagctatctgttcatctaagtcgcccggcggttcgtcgcccaggtatgtgatgctgtataatgtagacgatacccctcttgaaatacagccgtcaagggaacgccgggtttctattcgcacctttggatattttgatgtttttgtaaacggcaagcccatagctttccgcaataagaaatccaaggaattgttcgcgctgctgaccgaccgccgcggcgggtttataacctcagaggaggccataggctttttgtgggaggatgagcctgtaagccctgtaacgctggctaggtaccgcaaggttgcgttaaggctcaaaaatattctggaggagtatggcatttcggatgtggttgagtcagtagacggaaagcgcaggattgttccggaaaaggtgcagtgcgacctttacgattatctttcgggaaaggaagagtatgcccagcttttcaaaggaagctatctgaccaattacagctggagtgaaaatactttggctgaattgacaggcaaaattatatattaa

SEQ ID NO: 1157 - DNA, 1188 bp, Unknown
  Description of Unknown: Clostridiales sequence
gtgcgcaaaggatttgaggatgctcaagggcatataaaagcggccaatataagcgccgtgcccgaaaaacctgtgctgttggggcctgattcgggctgggtgcgcagtgaaagcaatcttataaccaacttttacagcatgtaccagccggaggttgtatatgtgcccgaatgggatgacggggaaggctatccctatttaatgtggttttttgcctgggcatataatcaggagaatgagcctcagggggaatatccgggctatccgggcggggacgcgatttttctggcccgtgccaaagcgctggaggggccgtgggaaatatattctatggattataggacaggcaaaaatttctgggacaaagagcagaatccgttttactggtacccggttatcacatgtcaggacgtttggtatgattcctggcatgcgggggacccgtcggtagtctatcatgaaggcgtattttatatggcctattctgctatgggatgcgatgaggatatgatcccttctcattacgatggtgactctgacggcaatgcctcctgtattatgggagcagtttcaactgacggcattaactggacgcgctctgaaaagcctttaataatctgggagcatgaaaagggatatgatgaaaaggcagacccgcgcaattatatgggagggcatcagcggcccagccttatgtacgaggacggaaaatggaagatgtggtacgactatcacggcaatttgataggctacgctgaaaatactggcgactttatggacgccgcaggctggcgggagctttactgcaatgaccggccattaattaagggcgtggattttgacgtagttaaaattggcgaagtgtactatgcttacggcgacccgtttttaagctggtacggtatcaatgacgatactctgcctgattatcctgaacctaacgggagctggaataagcgccagatagttgaatatcgttctgatgacggcatcagctggaaagttacgggctggttcaggccggacgaggggtatggagccaatcagataccccaggtgtttttagaccataaaaacagccgggtatgtttattttatgccactcagcgcggctgtaaattttctgacgattacgattggcgctgggataatatccgtatgatgtataaagatataaaattgttttga

SEQ ID NO: 1158 - DNA, 2124 bp, Unknown
  Description of Unknown: Clostridiales sequence
ggctcaggcaaaaccagggttttgacgcacagggtagtgcatcttataaaggatttagctgttccgccctggaacatactggccatcacttttaccaataaggccgcgggtgaaatgaaggagcgcataaacgacatgtgcgggtacgagggggaaggcgtgtgggtctctacctttcattccatgtgcgtgcggatattgaaaactgatatacacaacataggctatgacaaaaatttcagcatatatgatgaggacgactccctaagggtgataaccgaaatccttaaggagaaaaatatagaggattttaagcccaaggcgtttaagggagctatcagttcggctaaaaacaaaatgaccccctacgaatatataatggagcgcaaaaataagggctacggcgaatttgcagatttgctgcccgatatatacctggaatatgaacgcaggcttaagaagaataacgctttggattttgacgatttgcttctgcgcaccatagagctttttgaaaaatgtccgggcgtgctggaaaaatatcagcgccgctttaaatatataatggtggacgaataccaggacaccaactacgcgcagtatatccttgttaaaatgctgggagggtattatcataacgtatgcgttgtgggagacgacgaccagagcatttacggatggcggggcgctgatataagcaatatacgcaattttgaaaaggattataaggacgctaaggttataaagctggagcagaattaccgttccactaacaatattcttaaagcagccaatgcggttataagaaataacgccgaccgcaaggaaaaaactctctggtctgataaggaggacggcgaaaagataactcttgcccggctgaacgatgagaaagccgaggcgggctatgtttcgggcattatatccgagcaggtcaaaaaaggcgcgaaatattcggattacgctattctgtaccgtataaattctgtgagccgaaactttgaagaagcgcttgcgggaaggggaattccttacaggatttacggcggccagcgcttttacgaccgcaaggaaattaaagacgctttagcgtatatgaaattggtgcttaatcctaatgacgaggtcgcgcttaagcgcattgtaaatgtaccgcggcggggcataggcacagttaccatggaggaaatagagagcatagccagggaaaatgaggacagcattttcggagtgatgctggaggccgagcaatacggcctggagcctaagctgcgccgtaaatttacacagtttgtggatttaatgcaggaattaatcgtacagagtgccctgcttcccttaggggattacatagaatatatgtttacccttaccgggctggttgcccagtatgaaaaggacaagagcgaagaagcgcaggcgagaattgataacctgcatgaaatgataagcgcggcgcggcagttttccgctcagaatccgggaagcacccttgaagattatatggagcatgtttctttagttaccgaattggaggaacaggattcttccaccggcaggggcgcggttaatttaatgaccctgcacagcgcaaagggcctggaatttgatacggtttttcttgcggccatggaggacggaatttttcctttgagccgtgcgatttatgagccttctgaaatggaggaggagcgcaggctttgttatgtgggcattacaagggctatgcgcaagctttatatcacgggtgcggaaaaccgctttaattaccgtgaaaaggcggaggctataccttcgcggtttataagagagatacctgacgagcttattttaaggcagggcaggccttccctgggcgcgggggcttttaaccgccgcaggcaggagagcgtgcgtcccagctataatatgggcgcgctgggcgtgggcggcggcgcgcagcagcctgaagggaatagggagcagctctataaaacgggcatgaaggtggcgcataaaagctttggtcagggtataataatagacgtcagggatgacggcaggaatgtaattttgaaaatagtctttccgggcaaggggattaaggagctttcagcgaagcatgctcccctgaccatactataa

SEQ ID NO: 1159 - DNA, 1998 bp, Unknown
  Description of Unknown: Clostridiales sequence
atggaaaaattatttcattgcgtctcatattatcctgagctttggcctgaacaggaaattgaaagggatatcgcttatatgaaggaatgcggcataaatttggtcagaatgggtgaatttgcttggcactttatggagcccaggccggacgaaatagacgtatccttttttgttaagacagccaacaggctctatcaggaaggaatatatactattatgtgcactcctacgcccacgccgcccatatggctcactcataatcatccggagcgtttggcaactgacatatacggaaataaatacattcacggcgcacggcagcatgtctgtaccaacaatccctatttgcgggagcgcggactgaaaattacagaagctatggcaaaggcgttcagcggcagcccggccgttatagcctggcagctggataacgagcttaaagcgctggtaggggaatgcgtatgcagtgagtgccgcaagcgctggcacaaatggctcaaagataaatacggcgctattgaaaatttaaaccaggcctggggcactgaaatctggagcgaatactataacagctttgaggaagtagtccagcccctgaaccctcccgtaattcacaattcctccctaatgacgaattacaggcagttttcgcgggaaactgtaaacgaatttgcccatgaacaggctgccatgataagaaaatacagcaatgcgcctattactcacgacgtacatactaatttcgcgctggatacccatgctctgtttgaaggattggatttcacctcaatgaacggctatacgcaggatgacggctataatatatggctgtttgattatgacctttaccgcgccatgaaacaggacggccaattttttgtcagcgagaccagtcccagctacgccggaaacttattgatgaccacaaggccgcacagggaaggttttcttgagattgaggcgctgggcgcatacgccagcggcgccttcggcttttcctattggctcttccggcagcagcgctctggaatggaacaaacccacggcagccttatttcctcctggggtgagcctgagcttggttttgagcaggtaaaaagagtagaaaaaatgcggcaaaccatccagccctattttctgcgcacccggcacaaacatccccaggcggccatgacgtattctgaacaggcgcgcttattctttttcaccgagccccttttggagggtgaaggatattttgaaatgatgctcaagctgcacggcagcctggaatgcatgggcctgcacagggaccttataggggaaaacgcttccctggaaggctataagcttttaatcagcccgttcctgccctatgtttcagacgaatatatctgcaaagcaagcgaatttgtgcagaacggaggcatttggattatcggtccaatgacaggttaccgtactaaagagcatacagttcatacggaccgctgcctttcctctcttgaggagcttgcaggggtaagggtaaaatatttttatcccatgagcaatacaggcgcaatgggctgctttaaagggatgtccgctcccctggttctgcacggctgcattcttgagcctgttgaggctgaaagcgtgggcagcataaaaggcggcctgactcctgattattcctttattaccgaaaaaaagctcggcaaggggaaaatagtactgctgggggctatgcccaatatcaatttaaaggaaggccaagcgctttggcgcggaataatagagcattacgcagatgaagcaggcatagacgaccgctttaaggctaaagagggcacaacagttattttcagaacgggcgaatatgaaatagttaccgccattaacggaaacggggaagggggagaatattatctgccccaggacggctatgaaattttctccgcctcccaggtcagcgccggcagccgaatgctccctccgttcggctatgaaacggtaattttggggcataagaagtga

SEQ ID NO: 1160 - DNA, 1155 bp, Unknown
  Description of Unknown: Clostridiales sequence
atgtgcaaaagattatatatcataattgttttaactctccttcttgtcgcagctatttgcccttccctgggagcgcaagccgaagacattattgaggacagtataaacggcctggatttaagcgaatgggagcagtttcttaattccttaagtgaggacgagcgtgccctgctgcccggcgacagcgcaacaagccttattgaggacattgtccaggggaaattggatttaagctatgacaatgtgctggaggggctgctttctctgcttctgcaccagttttacaagctgctgccgtttatgctggagataaccgttctggcaatattggcctcggttattactaatatgcagaatagcggtcagggagtaaacgaaataatacgctttgtgctctatgcccttatcgcacttatattatgtcaaagcctgttttccctggtgagttatgcaaaaaacgcagtagaaaaaataggttctctcattcagctggctacacccatattgctggccctgcttatatccataggagcttcttcctcagccggtgttcttcagcccgattcagccatacttgtttcgggcgtaggcggaatcctgaccacctttgtcatacccataattcttataatgaccgttttagtgtttttatccaacctctctccgcgcattaagctgggcggcgtcgcttctcttatgcgcagcgtcgccagctggaccatgggtatagtctttacgatattcgccggggtaatctccattcagggacttgcagccgcctcctatgacggcgtatccctgcgggcagtaaaatacgcaatcaataccgggattcccattattgggggcatggtaggcgaaagcatgaacatggtgctctcctgcactctgctgattaaaaacgccgtgggaatagtttctctgctctgcatggcaggaataatgcttgcgccctgcataaatataatagcgtatatctttatgcttaagtttggcgcggctgtgctctctcccatttcggaaggcaatatatccaattttttcaaccagcttgccgattcgcttaagctgctgcttacggctgtctgcggcatgagcattatatccctaattctagtaggaataattattggagccggcaacgcggcagtatag

SEQ ID NO: 1161 - DNA, 2259 bp, Unknown
  Description of Unknown: Clostridiales sequence
atgtacgcaaagattattaccgatatagcgcatcaggatgtggacaggatatatacctacggcgtacctaaagagcttgaagctgctattgcgccgggtatgcgcgttatcgttcccttcggcggacgcaaagaggtggaaggctatgtgctttatttagccgagacttccagcgtaccgcctgaaaaacttaaatatattataagcgcgtgcgacgagttccccgcgcttaatcccgaccagcttgagcttgcaaaatggatggcgcaggaatatcactgcatgcgcgccagcattctgcggctctttttgcctgccgaaatgcggggcggccgggtcaataaaaaatataaaacaactgcccggctttcaggggatgaagaggctctgcaaaaagtgctttccaacggccgcacgggggaaaagcagcgcagggtaataagcatgcttatgcgccacgggcggctggactgcgcggatatagagaaagagctcggcggcgcgggcacgacccttaagacgctggaaaagcatggggtaataatattgcagaaagaggaaatcaggagaaatccttacgattccctggccccggcgcccggccaatggcacgaattaagacccatgcaggagaacgccctgaggcatatcataaacaacatgggccagggaagggacgtgcttttgcacggcataacgggcagcggcaagactgaagtatatatgcgggcgattaagcacgttttggagcagggggggagcgccataatgcttatccctgaaatctcccttaccccccaaacggtagagcgtttcagacagcggtttggagagagcgtggccgtgctgcacagcgcgctgagcgccggggagcgctatgacgaatggaggcggatacgcctttcggaggccagggtggtggtaggcgcccgctcggcagtgtttgcgccctgcgaaaatttgaagcttataataattgacgaagcgcacgagagctcttataatgccgaagggcaccccgcttaccggggcatagaagtggcgaaaaaacggatgaggctgtgcggcggagcgcttgttctgggcagcgctactcccacggttgagcagtactacgaggccaaaaacggcgcatatgatattatagaattaaccgagcgcataaacgggcggccgcttccccaaattgaagtagcggatatggccgctgagctggccgcagggaacaaatctattttttcccgtcagctttttgaggcgcttaaggagactatagaccagggcaatcaggctatactgtttttgaaccggcgggggcactctacaatagtcaactgccggagctgcggcaagaccgtgcagtgcgtcaactgcgaggtatccatgacctatcatctcagcgcggtaaattcgcggacgggaaagaatagattgcggtgccattactgcggatacgagatgccctatcctgaggtatgtccctattgcgggagcaaatttataaagcatatgggcgccggaacggaaaaggtggaggagcagtttaaaaaactgttcccaggcgtggctacgctgcgcatggataacgataccacgcgcacgcgcaacgctcatcttgagatactttccgcctttgcccgcagggaagcgcaggtgcttataggcactcagatgatagcaaaaggtttagatttcccggctgtggcgctggtgggcatagtttcggctgataccatgctgcagcttcccgattaccggagcagggagaaaaccttttcccttataacgcaggtggccggccgtgcgggccgggccgaagcggcgggacgggtcatacttcaaacctataccccccgccattatgctatagtcaacgctgtaaattatgattacgagaatttttacaatactgagataatgcagagaaagcaggggctttaccctccctttgcccgattgatccgtctgctttttgtgtccgaggattatgacgctgctaaaagggcgtgcatgttttcctatcaggaattaacaaaaagtttaaaggaggcagatttatggaggaacgtagtatttcttaccatgatgagcgctcctatcggaagaataaagggccaatacaggcagcaggtattaataaagctgcgcagcggccctgactgcgataaagccgagcaatacatatttgagcattatgataaaatagaaacagataatttttataaggacatagaggttaatccgtccaatttattttaa

SEQ ID NO: 1162 - DNA, 2712 bp, Unknown
  Description of Unknown: Clostridiales sequence
acgggcaatgaagcacagagctacatgacggctgataacccgtttatgataataggctctcttctcatatgcctgctgtttatatatctggtatatgttgccttttccataagaaacggccgcataaaggaatttgagcctatagccgcgggcgtgggggatgaaaccttccgccccataacgctgagggacgagagcctgaaaaatgaactctttgagaaagagctgattttacatgcaactggatccaacgcggccggcgaggaggacgcggttatggatgaaagcgctttggctgatgcagttcaaaatcaaaaaagtttaataggtccgtcctgcggcgaagaagaaatggagaataagcagggccaaagctcccaggagatgagcgggccggagaatgctgaagaagcggccggcgatgcagccaatacggcggaaaaaaacagtcttgaaggcacagaagggacgttggctatggacggcatggaaaacgcgcagaatattggggaggataccttaaagggtaacggcggcattcatcccggcgcggaggaatcggccttatctgagatccaggaaggtgtatctgaaacagatgcggctgcccaggcggagccgggcactgttcaggctgatgaacaaacggcgcaagctgataatggcgggaaagaaagcggggaacaggagaaaagcacctcggatgcgcctgctgcgcctgacggcactcctcttgtgcgtacggcggaaaatctctctgaattaaaggttatatgcacgctggaatcaaagcgcaggcatgattttaataaaatgcataagaagcggctgctggatttaaaggatatcctgataatggcggttgtaaccataatttattcagtggtagcttttattaatctgggttcaaccgagtataccccctcctcctattgggaaacccagacgccaaacgaggaggctgtaatagattttggcggggtatatgatatggagaggatatatttgaacctcaatgtgcaggaggtcgccacagattacagcatgcggctctattattcagaggacgggaccaactggcagacattagataccctgaccttcaacagctttaagctgttcgtatggaaccagacgggcgagctgaacggcgataagacggtaaatgtgcgcgcacgttatttcaggatagtttcagacagcctgaataaaggcatgcgggtaaatgaaatagtgttctatcaggatgcgcaggaggatattctcgtacccattcagagcgtggacggagcttcaggagagcatggagccgcctgcttaacggacgaacaggataccgccgccgtgcgcacctatatgtcctgcatgtattttgatgaaatataccatgcgcgcacagcctacgaaaatataaacagctggaacgtatacgaatggacgcacccgccgctgggcaaggttataatgtccttgggtatacgggcctttggcatgaatcccttcggctggcgtttctgcggtactgttgctggtattctgatgctgcccgcgatgtatattttcggcaagctgctctttaagaagcgggtctgggcttcggctttaatgctgcttatgaccctggacggcatgcattacgttcagaccaggatagccacgatagattcctattcggtgctgtttattatcctgatgttcctatgcatgtataaatattatacaatgagcttctatgaggacaagctttggaagacctttattccgctgggcctttcgggcatattcttcgggttgggggccgctacaaaatggatatgcctttatgccggcgtcgggcttgcggttatcttctttataagcctgggccgccggattatggaatatatgcgagcgctggacgcggttaagcaccctgaaaaatacagtcaggctgaacttaaatatttaaggcatataagcgacagctgtctgcgcaacgtaatactgacgctgctgttctgcgtgctgttctttgtaataataccggggataatatactgcctgagctatatcccgtatttcgatacgccagaaaacctgggtaaaaagtggtacgatataatctggcagaatcaagaggccatgtttaattatcattcggggctgtcggacagccatagcttccgctcgccctggtatgaatggccggttatggcgcggcccatgtggttctatgacggagtggatactgctccggcgggcatgatggaatgcatatcctgctgcggcaatccgctgatatggtgggcgggcctggtatgcacggtgataagcattgcaatactcgttaaaaaggcgctgaggcggtataaggtgacttcgccccagatgcttttaaggcggaacagggaagtgcagatgctgctgtttattactctgggccttgcggccaattatctggcctgggtatttgtgccccgctctacctttatatatcattattttgcttctctgccctttataatgatgtttacggtatatgtctttaaaaagctctatgagagcgcttcaggcaggcataaaaagcaggtggctgccggcataatagctttcttcgcctttgcgctggtgctgttcgccatgttctatcccatttataccggcactatggtatcccgctggtatgtggataatttcctggtatggctgccctcctggactttccacggctga

SEQ ID NO: 1163 - DNA, 1734 bp, Unknown
  Description of Unknown: Clostridiales sequence
atgatttgtaaaaactgtggacaggaaatccccaacgattctgttttctgcactcattgcggaactgcatgcgaacagaaaccagcagaagccgcaaatgaacaaaatgaacagcagactgtatccgatcaaacatatgttcagcagccggcggaggccgttcctccaaaaaagaagggcaaaggacctaaaattaaactgattgccattcttgccgctataataatagttgtagcaggggtgggcacactggcttataattcacagcctgttctatcccgcctgtttaacggcgaaaaagagcatttaaccatgctggtggaccggctggaggaaaaatatactcaaaatgaaaatgctcctgtaaacaacgttaaagctaaaataaattataatttcagctatgacttaaagcagctggaggaagccggcctgccgctggacggcatagaaaataccgaaatttttctgagccaaacaatgcgcatagattcggataaagctttataccgcattgaccaggaagggtctttgctgggcgctgaactgcccgaaatatcggttgttcgcaattcctccgaggatatgggtatttatattgagtcccttactaaggattatatagattatagttctttcctaaccctgctcaatgaatacggcgtacttactcaggcagagctgtctgcaaatcaacctgtgacaaccaatctctctgcagagcagctggaagagctgctacctttgctggaaaaatataaagatgctatcattgatactgccctggattccggagaagtagtctatgaatccaataacgacgacctcggatttaatgcttactactacgaaattactttaacccctgaaagcatatacgatattatgcaggcaatcatggaaactctaaatactgacgatcagctcaagcttgagctttgcgagctcatcagccccgataacccacaagaaatgcttgaggaattgaatacttctatttcggagctgttagacggaatggcacaagaccgcgactcttttatccaagaaatggaaacagaactggatgaaataaaaatagaactttggtttgacggccgaaataacccccttggcacagctttagctattaatgcttcagaggacagcacgaaccaggatattgaaattactctgcttgactacaagcacggccgggatacgcttactttaattggccttgacatagacggagagaccatgtttgaattgagcaatgaagcggaggtaagcggctccaggaaacagggttcgttggatttggaaattaaccagattaagctgttgaagggagaatatgacctcaccggctatgaagtgcagggaatacagctttatgaaggcaccgccgactttacattgacagtagaaacagattcctccatgaccgcagactttagtctggaatgcactatggaccggatgaacaatggaatgcgtatggacatcgagccgactgtgtatatatcaggctataacatggcaaccaccatggactttggagctatttcttcagaaataaccgttgaaccgctggatgaagaaattgaagaagtaaatgttgttgaagttactgttgaaaactatgctgacgttcttacgcctgatgaatttttagccaaagtggaagagttcgcttcaacccttgaaaatctgggaaacacccttccttcaaccgattcgccgttatattaa

SEQ ID NO: 1164 - DNA, 2991 bp, Unknown
  Description of Unknown: Clostridiales sequence
atggataagcttatcagggaatttaaaaatcccccggcggcataccggggcaagcccttctggtgctggaacggaaagctggaggggcaagaactggagcgtcagctggaggtctttgagaaaatgggcatgggcggcgcattttgccacagccgcaccggcctgaggacagaatacctttcagatgaatggttcgagcttataaaccgctgcgcggctaagggcaaaaaggacggcatggagatatggctctatgacgaggaccgttatcccagcggtacagcgggcggcatggtaactgaaaaccgcgaattgggcattcattatctccgcctcaataaggcccagggagattttaaatggcaggagggcgtaatctgcgcgtttatcctggaatttaaagaggataaaattgtacgcaaggagcgtatatataaggatgcggctgttcctgaaaactgtgaaatatggtattttacttcggaaataatgaattccggctccttttataacggcaatccctatgcggataacgccaatcctgagacggttgagcgttttatcgagctgacccataagcggtatgtggaaaaatgcggggagtacataaaggacggtaccataaaaggcatatttacagacgagccccatcacggcggcgttatgaacggcttcgccatttccaatcccgacggcgcgcaccttattcctcatcctaagaacctgtttaagcattttgaaaatgaatacggctataaattggaggattatctgcccgaaatatacgcttttgacgcttcgggacgggcggagcaggtaaaatggcattacatgctgcttttgcagaagctgttcctggagaattttatgggcaagataagggattactgccatgaaaacggcctgctgtttacaggacatgtgctgcacgaggactgccttacggctcaggcggttatgcagggttcggtaatgcgctgctatgaatatatggactgcccaggcgtggacgtgctttgggaggagaaccgggattatcagatagtcaagcagctttcttcagcagcgcgccagctggaaaagccctggctgctcagcgagctttacggctgcaccggctggcagaccaattttgcctcctataaggcgatgggggactggcaggcgcttctgggcataaatatgcgctgtcagcatctgagcttttacaccatgcagggcgaatccaagcgtgattacccggccagcatattttatcagagcgcgtggtgggatcagtttggcgcggtggaggattatttctcccgcataaatgttttaagcatgggcaaagctctttgccgcacgctggtagtcaatccggtggagagcgtttatacccgcatacatccgggctgggccttcttcctcaatgccgtggacgaaaaagtgtgcaagctggagggagaatacaaagcgcttttctatatgcttattgaaaataagattgattttgattacggcgacgaggagatgatgtccaggctggcgagtgtgaaagatggcgttctcagcgtgggcgcagggaaatatgatacggttatagtgcctccctgcctgaccctgcgctcttccacctttgagcttctggaaaaattctccgctcagggaggcaagcttatactcatgggggatatgcccggcctggaaaacgcgcttaagagcgacaggatggagaagcttcagggcgagcgcataccctttgatgaaaaggagcttatgtccagactgcccgtgcccccggcgactgttaaaaaagagggcgaaaatgtcaaagcaattctctcccgcgtaaccttgataggggacagattatttgtatatcttatcaataacgaccgggtaaatccggtggggcctgttgatattgaaattgagggagagggcgtccttgagcgctgggacgcgcgtacgggcgaaataacccggctgcccggcgggatgaagctggagaaaacctttgcgccgggagaagaaataattctctgccgctgcgcttccagccaggctgctctgcctgaaaattattccttgggcgaagaaagaactatttcagaatttgcctataagctggaggaaccgaacgtatgcgtgcttgaccaggtgagcataaaagtggatgacgaggaatttatgcctgtgcaggagatacttaaggcggatatttatttaagggaccgctttaagatagaacggcgttcgggcgagatgcttcagccgtggtataaagagtcccgcaatattaaggaggaaaacgtctgccgccttaccatgcgctttgaatttgaatgcgaatacgtcacggatatgaagcttgcgcttgagacccccgaattatttgaggtgaaaatcaacggccatgaagtgcatgccggcggcgattggtttattgacccctgcatcaaaacagcggacattcctgccggcgtaataaagcctggaataaaccaagtggttctgaccaccaattttaacggaggagttaatcttgaggcgctgtatattctcggacagttcggcgtccgcattgacggactgcgccggattatagaacagctgcccaaaactcttgcggccggggatatctgctctcagggtctgcccttctacggcggcgtgatagaatatatcatgcctgaagcaataaagggcaggacgagagtcagcgcgctctttgacggcgcatgccttcaggcgaacagcggcgaaaacaattcccttatagcctttgcgccctattatacggatatagacgctcagggaccgctttctctgcgcctttaccttacccgcagaaacaccttcggccccctgcatatgaagccggctacagccttttcttacggcccggaaaatttcgtgacccagggcgagaactttgactataccggctacatgctcctgcccgcaggacttagggagcctgttaagctgacggcgcttaaaaaataa

SEQ ID NO: 1165 - DNA, 2211 bp, Unknown
  Description of Unknown: Clostridiales sequence
atggagttttattcagttaagggcaagcggcccgtaaggctaaaggagagcacccgcgctttggctgcgcgcgccctttcgggggaatttgggcaggaggccttccatactccatttgttgaaataacaaatccggaatatgaaaatatgtcctcggaagaacagtatatctgcatgctgaataccatagtaaccaaagctcccttgcgtattgttccgggcgaaccttttgttggttctgcaacattgggagacgcaatttttgcacaggtccctgcgcgttataatggccaaaacgtattctgcgggataaatcatataaccgtgggctttgataatgtgctgtatattggccttaacggccttcgtgcccagatcaggggcagaagccaatgccagaaggatgaaaagaagcaaaattattatggctgccttgaaaaatgcatagacgcaatagaactttggcataagcgttatctggacgaattattgagcttaatagcgcagcatccgggcgagggttatgaagaagtttatgaaaatcttaaggacgtgcctcttaatcctccgaaaaatttcaggcaggcactgcagtccctgtggttcctctttgcttttacccggcttataggcatatggtcgggcattggccggatagataaaatgctgggcggatttttggaggacgaccttgcaaagggcgccataagcatagaagaagcgcgcgaattgacggcccatttctggataaaaggctgtgaatggtgcaagggggatttagtaaagggcagcggagacgcccagcattatcagaatatcctgctgggcggccgggatatcacgggcaaagatataaccaatactctttcctatctggtattggatgtagtggaggaactggggataagcgattttcccatagccatacgcgctcataaggatatgcctgagagctttctcaggcgggcggcggaggtagtgcagtacggcgcgggcattatagctttttatgacgaacagagcgttatagagacattgatgaattacggctatccttacagcgacgcggtaaattttacaaacgacggctgctgggaggttcttattcccggcaagacacgcttcagctattgcccgatggatatgcttcattatttgcagacagacgtgctgggagtaaataaagctatagaacatgacggcagttttgtgggcatgtatatgtctcttcaaacagcttcccctgctgaaagcgacgcacccatacctgaatatgcagattttgacgaattgtatgaggctctgttaaagggaatagaaaaagcggtagcctgggtgcattcggatttggacagcagagcgtattaccgaacggaggaagctcctgctacggcccttgttatgtcgctgtttgtagaaggctgcattgaacggggcgtggatttttccaagggcggttcttattacgatgtccaggccatacatatgggcggggttcaagactgcgccaacagcctgctggctattaaaaagatggtctatgaggaaaaattactgactctttcggagcttataacccttctgcggaatgattgggagggcagagaggatttaagactgtatgcgctgaacaaactgcctcattttggaaatgacaatgcccaaagcaatgaaatgacagtgcgccttttaaatgactatataaacattgtgcgcgcttatgaccatagggcggacggcattaaatgcccgccgggagtttccactttcggccgggagggtgaatggaggtacgccaggggcgctacggcggacggccataagcgaggggatatactttcgcccaatctcagccctgcgccgggagcagataagcatggggctacggcggctatacaggcgtattgctctcttcccttaaaacagctgccgggctcatgtgcgctggatatcaaactggggccgttcatggcccgcggggaagagaatgtagacgctgtcatggggcttataaagggcttttgtaccctgggcggctattttatgcagatggatatagtggatgatgcgattttgaaggatgcgcagctgcatcccgaaaagcatcccgaattggctgttcgtgtatcgggctggtcggctcgttttgttaccttggacgcacagtggcaggagatggttataaaacgggcgtcagccggcgggatttga

SEQ ID NO: 1166 - DNA, 3723 bp, Unknown
  Description of Unknown: Clostridiales sequence
atggacaaccgggtaaaacgcatttttgtagaaaagaagccgggcttcgatatagaagctcaagccctggcctccgatttgagagataatctgggaatcacaagcatcacaggcgtgcgcctgataaaccgttacgatattgaaggactggacgatggccagctggacctggccgtgcccaccatcttcagcgagcccaacgtagacaaagtttcctttgaaaccatgcctgtttcaggacagattttaataagcgaatacctgcccggccaatacgaccagcgggcagattcggccgcccagtgctgccagctgctgaccggccaggaggcgcccctggtgcgctgcgcccgcgtttacgcttttgagggcctgctctctcccgaagaaatggagcgcatagaaaaatatataatcaacccagtagaatcgcgcaaagcttctccccaaaaaccagacacccttaaaatgacccttgagcagccgggcgccgtagaaatcctgactgattttataaactataccgatgaacagataaaagaataccataagcagatgggctttgccatgtctcatgaggatttagcatttgtccgggactttttccgtcaggaagggcgggcgcccagccaaaccgaattaaaggtaatagatacatattggtctgaccactgccggcacaccacctttttgacccgcctggattcagttgaaattgaagaaggcagctttaccgcccccataaaggacgcgctggccctctatatggatatacggaaagaccttaaaaaggaggataggcccgttacccttatggacatggctacccttgccgctaaggagctgcgcaagcagggctttttaaatgatttagacgtttcagacgaaaacaacgcctgctctatagtggtaaacgccgtcattgacggcagggaagaaaaatggctgataatgttcaagaacgagacgcacaaccaccccaccgagatagagcctttcggcggcgcggccacctgtctgggcggggcaatacgcgatcccctttcggggcgcagctacgtttaccaggctatgcgcataacgggcgcggccgacccccgcgtacctgtcaaggacactatgcccaacaaactgccccagcgcaagataaccacgggcgccgcggcgggctattcctcctacggcaaccagattgggctggccacggggctggtgcatgaaatataccatccgggctatgccgcaaagcgcctggaaataggcgcggtggtaggtgcggctccctttgaaaacgtccggcgcgcccagcctgagccgggagacgtcatcctgcttttaggaggcgcgacaggccgggacggctgcgggggcgcgacaggctcctctaaagcgcatactcttgaatccctctccacctgcggcgcggaggtgcaaaagggcaatcctcccactgaacgcaagcttcagcgccttttccgcaacacggaatgcgcgcgcctgattaaaaaatgcaacgatttcggcgcgggcggcgtatgcgttgccattggagagctggctgacggcctggacatcaatttagacgccgtacccaagaaatacgaaggcttaagcggcactgagctggctataagcgaatctcaggagcgcatggcggtagtgctggataaagccgactgcgcgcgctttattgagctggccgcggctgaaaacctggacgccgtacccgtagccgcggtaacggatacgggcaggatgcgcatgttctggcggggggatacaatagtagatatcccgcgcgcctttttagacaccaacggcgtaacccagcacgcggacgcccttataaaggcgcccaagggccttaaagaatactttgagcctgaaaagccctgcttcggcggactgcttgagagcataaccgacctcaattcctttatacagaagggactgtccgagcgctttgattccaccataggcgcaggcagcgtattaatgcccttcggcggcaaataccagctcacccccgtgccctatatggcggccaagctgccagtaatgggggaaaccgacctttgcacagttatgtcctggggctttgaccccattctttccagcctctcgcccttccacggcgcgtattacgcggttgtggaatccctcgcgcggctggcctgctcaggcgcggatatttcgggcgcgcgcctgacccagcaggaatattttgaacgcctgcgctctgagcctgaacgctggggcaagcccgcggcggctctgctgggctccataaaagcgcagatggactttaaagcgccctctatagggggcaaggattccatgtccggttcctttatggatttggacgtgccctccacccttgtcaatttcgccatagtcacagccggcgcttcggatataatttcccccgaatttaaggaggagggcagctatatatgccttatgcgccccgacagggatgaaaactgcatgcctgacgcgcaggagcttaaagcgcgctatatagccctggctgctttaatccgctcaaaggaaatttccgcggctatgccggtttcccgcggcggcgcggcggcggcggttataaagatgtgcctgggcaacggcataggagcggaccttttaaatctctccccccaggaattttttgctgacaatccgggctccgtggtatttgaggcgcgctcggccgaaactgctcaaaaactggacggagtgataataggccggacgggcggcggcgccataagcctgaacggagaacagataaccctcagcgaggcggctcaggccggactgtcagtgctggagaatattttccctgtatacgcctccggcaccgaggccagcgcggtttcccaacccaaacgggaatatcccgcctgcgcgccggggcacaaaaccgcgcggcccagggtagtcatcccggttttccccggcaccaactgcgaatatgacagcgcgcgcgccttttcccaggcgggcggcctgcctgaaatcctggttatacgcaaccgcactcccgaggatatagcccaatctatagcccagcttaaaaagctcattgattcggccaacatactcttcctgcccggcggattttcgggcggggacgagcccgacggctcgggcaaattcatagccaccgtactgcgcaaccagaaaatcatggacgccgtgcatgagctgctctataaccgggacgggctgtgcctgggcatatgcaacggcttccaggcgctgataaaaaccggcctgcttcccaatggaaaaatcgcccccttagaagaaaattcccccaccctgacctttaacactctgggcaggcatatttccactgtcgcgcatataagggtagcgggcaataattccccctggctgtctctctgccgtccgggcgaaatatacgccgtgcccgtttcacacggcgagggacgcttctgggcggaccaaagccagcttaaggcccttattgacaacggccagatagccacccagtactgctcccccgacggaattgtttcgggttcgggagaaagcaaccttaacggttcggtcatggccatagagggcataatttcacctgacggccgggttatgggcaaaatggggcatactgagcgggcagggcgcaatataatgaagaatgtacccggctgctacgatatgaagctgtttgaagcgggctgcaattattttaagtag

SEQ ID NO: 1167 - DNA, 1161 bp, Unknown
  Description of Unknown: Clostridiales sequence
atgtcctttataaataaaaagaggcttaaaaatatagaatatatcctgcccgttatagtgctggtaatatccctgtttggagtattctgcatacttatggccacggccagcccttttacgggcgaagagcttacctttgacgaaatattggctaatctgaacctttccaaagttaaaatgcagttaatttggctggctataggttttgtctgcatgatagtggttatgctggtaagctacaggctttacgcgaaaatctggtatgcggtgctgggcgtttctttagctctgctggctttggtaatagtattcggctcggtgcgcggcggcactaagggctggcttgtgatatccgaatctcaaaacattacctttcagccttcggaaatagttaagctggcggttgtgatattgtcagcgcattttttgagcaggcggcccttaaaaacctttgtggatttgctgccggctattggggttttctgcgttatagtcgcggtactgctctatcagatggatataggcacaacccttgtttacgttgtgatatttgcgggcatgctctttgtttcgggagcgaagctgcggcatatcgggatattggcattggcggccgcagttgcttttctgctcctttggttttttgccatgggcgaccagcagaagagccgtatattaaatttcggcaatactgaggatgtggatcagctaagatattctaagatagcaataggttcaggcggcgtttttggaaaagggcttttcagcgtgggcaatatgagccagttaagctatattccggcgatagagactgattttatttttgcggtaataggcgagtccctgggctttttggggtgcctggtcgtaattttgctttatatggctctgatattccgcctctggcagcttatgcgcggctgcaaggataaatacggcaaattaataatagccggcataatgttcatgtatatgttccacatttttgagaatataggcatgactataggcgtaatgcctataacgggcatacctttgccctttataagctacggcggcactaattttgttaccaatatgataggtatcggtcttgttatgagcgtttgcttttaccgtcctgaaagcgttgttaataatcctgaggagctggaaatataa

SEQ ID NO: 1168 - DNA, 1065 bp, Unknown
  Description of Unknown: Clostridiales sequence
agaaactttcgtaattatgaatatctggagctgccccttgaaaataatatatatattttcacaggggaaaacgcgcagggaaaaaccaacctgcttgaagctgccgcgctgttaagcacgggaaaaagccaccgcacagcgcgggacagggatatgatacgcataaacgagccttttgcgcgggtaaaggctgtaagcatgcaggcggacggagaacatactgtggacgtagtgctttcccggagtgaaaaaaagcgggtgctgcttaacggcttgcctataagccgcataggagatatgataggccagattaaaagcgtgatgttttcgcctgaagatttggatataatcaaatcagggccctcacagcgccgccggttcatggatttagacaggtgccagatgaaaaaaagctatttttacgcattgaacacctataatcatgttcttgagcagcgcaaccacctgttaaagctgacggcggctaaggaagtggaggacactttatttatatgggatgaaaagcttgcagaggcagctcagcccattatggccgagcgcaagagatttatagaaaaattaagccccctttgcgaaagctttcattcagaattgagcggcggcaaagagactcttaaagcgatatatgaaccttcagtagaaggggaagaaggagagcttaaggaaaagctgcttaatactctcagagttagttgggacagggacataaaaaataaagtaactggaaacgggccgcataaggatgatatagcgtttaagctgggggataaggatttacggtggttcggttcgcaggggcagcagcgcactgcggctctggctcttaaattggcgcagcttgaattgataaaagaagaattgggagaatatcctgtattgcttctggacgacgtgctgagcgaattggatgtatccaggcaggaacggctgttaggcaggcttaaaggcattcaggcgcttattacggcggctgaattgtctgaaagcttgaaaaagctcccagccaggattataaaagtaaaggaaggaaagctgtatctttaa

SEQ ID NO: 1169 - DNA, 1395 bp, Unknown
  Description of Unknown: Clostridiales sequence
atgcgagaaacagaccgaataatagataattatgcggaggaaatggcgcagcgcctgcgcgagcttatacgcatcccttcagtcaaggataatcccctgccgggcgcgccttttggcgagaatataaaaaaggctctggattacaccctctctctttgtaatgagctgggcctggaaactcaaaatgttgacggatacgccggttatgctcagatatcaggcgaaaaaaaggaacaattaggcgtgctttgccatttggatgtggtcccggcgggagacggatggattcatccgccctatgaaggagggatggaaaacggcgtcatatacggcagaggcacggtagatgacaaaggtcctgccatttccgcaatttttgcccttaaggcccttaaagccgcgggagtaaagtttaaaagaaccccccggcttatctttggctgcgacgaggaaagcggctgggagtgcatggactattatgcggataagataggaatgcccgaaatgggcttttcgcccgacgcagattatcccataattaatactgaaaagggcatttatcacgctcagcttaaaaagaaactgccagggaacggaaaatacaggctttccatacacggaggcaccagggcaaatgtcgtgcccgatttggctcaggcgcacattgaaggaaatatagataaattagccgagacactgctggattataactgctctgaaaacggcctgagctttactgctgaaaaaaacacattggatattactgccaagggagtaagcgcgcacgccagccagcccgaaatgggacagaacgcattctttgcgcttttaactcttttagataagctttccctggggggcgaagaagggcatattattcaaatgcttaattgcgcatttattaataagactgatggcagcggcattcccggcttgaaaattcaggatgaatttggaccgctgactatcaatctgggattattggatgccggaagcttttacggcggggagaaggatgaaataagcctgacattggacatacgcttccccgtaacctacaattaccaatatatagaggataaattagcggcattttttgacggctggacacttatacgcggacatgtacaggctccacaccatactcctgaagagcacgaattggtccaagctctcaagagagtttataaagaatattttaatcgggaaggcagatgtctggccataggcggaggcacttatgcccgtgcgctgaaaacaggcgtagctttcggcataaccccggagggcggtatttcacaggctcataacaaggaagagaacatatccatcaagcagcttgtgctcaatgcaaaggtatttgcggcggctattgaggagctggcctgcaaataa

SEQ ID NO: 1170 - DNA, 1524 bp, Unknown
  Description of Unknown: Clostridiales sequence
atggctgtcagaaaaatgcaaaaaataaatatgcgctgggtatcaatcggcataaccgtaatactgtgccttgcggccgtaattataaccctggtgctcgtcaaatcctaccaggatgaatccgatgcgtatatcaacagcataaagcaggccctgcaaaacggttcggaggaatttgaaatccttaattcgtccgtgatttacgacggcgtatatatagagaacgtaccggtaggcggccttaccttagacgaggcaagggaaaaagtagaagaaaatataagctcaggaacaggcgagccttatatcaatatgacttacggcggcaaaacctggacgttaagcggagcagacctgggagcgcaaagctctcttgaaacggccttggaacaggcctggaacgcagggcgcaccggctcctcctcagaaaggctggctcagatagagcaaatagcgcaggagggctatcatatcagcattaccgtgctggccgacacctcccttattacgcagacccttaaccagataaaatccgagatagaccaggaggctgtaagcgctacggtatccttcaactacaacacacagaccaatcaggctgaatttacctatacagaagaatctgccggccgtgagctgaatgttgaaaccgcggccaatgaaatactggttgcatttcaccagtcttcccaggtcaattacgagcttaagcctgaaaccatagagcccgaagtaaaactggcggacatacagcacgattatgtcaagctcagcgaattttccaccaggaccagcagaagcaacagctcgaccgaatcgggcaagcgcaccaatatccgcatttcctccgctgcctttaataattatgtctggatgccgggcgatatactctcctttaaccagactaccggtaagcgtaccaaagaaaagggctatgaaaccggactgttcataacttccgaccgtatatatgacgaaataacgggcggcggcgtgtgccagacttccaccaccctctttaacgcctgcatagaagccggcgctaccgagatcggcaaaggaggcattatagagattaccaggcgctatccccactcctggccgtcaacttatgtcgcaccgggtcgggacgcttcggtaaactggcccagcgccgatctggtcatgcgcaacaaccgcgacacccccctgtttatccgcgcttattttgaaaattataccgttacctttgaaatctggggagtggcctttgaagataacgccgactatgaaatagaggtagtgctcatagaggagacgccggctcctgagcaggaatatattattgatacctcacacaaatatgtggaccagcccggcgaatatgaagtagtttcagaatcccgcaaaggctatgtttatgaaacctatcagatcaaaaaggtgcccggccaggaaccggtaagaacacttatatatacttcaacatataacccgataccaggcaaaacctactatctgcccgcagaaggcaccagcgaataa

SEQ ID NO: 1171 - DNA, 1920 bp, Unknown
  Description of Unknown: Clostridiales sequence
atgaaatacagcagtttttccagaaaaaataaaaaaggcagtaaaaatacgggcagatatccgcatacccaagcagaaacgcaaaaagagaatcctgaaaataaaagcgggcttgagcggacggatgataatgcggtcatggatgatagcggacagaataccgatacagcagaaaatccgtctgcatcattaaacccatttgtgcctgacagcccgcccaggccagcggatgcggctccgcctaaaaaaaccgatttatccgcggacacggctaaggataggagcagtaacctgccctcgcaggtgcctcagtccagcgcgccctcccagcagacggacagagttcagcctgcggaccggggaattgctgaaaatgccgctgagctggacggttcagccgataacagcaccgcggcccaaaccaagctgtccaacgcttccggtctcccccggcaggacgaggccgagagtgagcagagcgacgaatcagatatggtggacatggctccaggcagatcggaacgtcccaaaaggaaaaaatccaaagccatatccgctaaagagaatttaattttccttacagcctgcatagcagttattgtggctattcttgtagtatccataaaggattccagcaataccgcagatgtaagtcctgaaatcaccccgcctgcagggcagtctactctgactccgcccggcgcctgggccaatcctacccctaccgggcctccccttatttccgagccttcgggcatgataataatggataacagcgtgaacgcaaagcagattttagttgaagaaaagcgcatcaaccgcccggccgtttacggcagcgagctgcttttttcggcgggcaacggctccattgaaaagcctgtgctgaccactctgtatctctttgacgttaccacccagaaatacacaaaaatcgccaccacccagattgaggacggggaaatttttgagtattttctaagtgataaatggattatctggctggataccgaccataagggcaccaacattatatataaaatgaacaggcagacaaacgagataagcaaggtacgcgaagtaggcaatctcaggcccaagctcagcttatacggcgaccttctggcatggatggagcaggtttcggaagaaagcgacaggctgtacctgcttgaattaaacagcgaagaagatatcgtcatagaggaattccatgaaaccgcctatgcgctctcggctccgtatatctatgaaaacaccgtcatatgggtgggcgccgacccgtcgggcagcggggacagcgccattttccgcgcagattttaccatggacgataactacaaccctgaagaacaggagcagggaggagagcagacctctgccatcagcgctgcgcccagtacgtccgcagccggacagactgcggcccaaagcacttctgcggcagaaaccgcctcccctacagcctcccccacagcctctgcctctgcctctgcctctgccacggcgcccgaaggaccgtggctccctctgccctcaagcgccgaaaacgagacgttaaaggtatactactatcctgcgggaatgtatgtgcatgaacccatgtacaacggccaggtagtggtatggatagataaaaacaaggcgcctgattccagcctgtatatgctggatttgacttcgggcgaggtttccctattgcagacgggggttacctcctacgcgctgggcactgattttgtagtcataaacagcaaccaagagatatgggcctattattacagggccaatactttaatacgggtttccagcgctgaccgggcttccattctgcctgaaactcagggccgggttgtggtctgggaagataaatcctccagcagttcaggggacgtttttatgtataatattctcggatag

SEQ ID NO: 1172 - DNA, 1623 bp, Unknown
  Description of Unknown: Clostridiales sequence
atgagctataaggcgctttacagaaaatggcggcccgaatttttccgggacgtggtggggcaggaggtaatagtgcgcacactcagggcgcagataatgtccggccatatagcgcacgcttatctttttaccggtccgcggggtacgggcaagaccagcatggccaaaatatttgcgcgtgccattaactgccttgagcctgaagaaggggacgcctgcggcaaatgcggggtctgccttgcgcttaagggcgaggctatggatataatagagatggacgccgcaagcaataacggcgtggatgaaatacgtgcgctcagggagaatatagtttttccgccggcggtaggaagatataaagtgtatatcatagatgaagttcatatgctctctcagggcgcgttcaacgctcttttaaagactctggaagagccgcccgagcacgcggtgtttatacttgccactaccgaggtgcataaactccctgccactattctttcccggtgccagcgctttaactttaaaagcatcagcgtatcggatataagcgggtaccttaaaaaagtgcttaaggccagcggcgctgaatttgagccgcaggcagtggatttaatagcccgctcggccgaggggggcatgagggacgcgctgtccatagcggatatgtgtttgtcctactgcggcagcaatgttggatatgaggacgtagtaagcattttgggtacggcggacagggaattcatgtttaagtgtgccgacgcgcttataaattcggatgttaagggggcgttggacgcctgcgcgcaattaacggacagcggcggggatataggggtattcatgagggatatcatgagccacctttcggatgtgcttacggccaagctggcgggaaaagaggctttaacagccctgcctgacgatattgtttcccggctccttgagcagggtgaacgtgctgatgcggacaggcttatgcgcgcgattgaactgctggcgcaggcggagagcgagcttaagcagcattcccggcccaaggttatattaagcgccgttatggccagaatctgtactccccgtctggaagaggacgcgcttgcgttaagggaccgaatttccgtgctggaacaggaattaagcagcattaaagctaatggcatagagatgtcttctcggccggcgcagcctgcaaagaccgaggataaaaaagaggcttcatccaattcatccaaagcgcctgcggcagaaaaaaagatttcgggcgctgttaaggaaaccaagcaggatgctcagcagggtgaactttgggaggcgcttttagcaagaatgcgcaaaaatgccatgcccgtgtatatgacgctgaaaagcgccgagggcgggcgcaggcaggataatgcatatatagttatgttttctcctgagcatgagagcaagatgaaatttattaatggcaagacagaggcaatatcaaaggaactggaagctctgacgggggaaaaactggctgtgcgtactgagcagactgtccccgcacaaaagcaagaggagcaggatgagcttatcgcaaatataattgatatatttggagaagaaaatatacattttaaagattcggaggaatga

SEQ ID NO: 1173 - DNA, 2184 bp, Unknown
  Description of Unknown: Clostridiales sequence
atgaacacggcaaaatggatatggattgataaaaacgggccgcgcaaaaactgctatgcgcgtttctttagagaatttttcataaaaccggatgaacaaaatccaacaggagaaatccgcatttcggtctcggataattacacgctgtacctgaacggtaattttatttcgtgcggtcaatataaggactatcccgacttaaagcattatgattgccttaagctggatccctttctccagataggaaaaaacgctctggccatagacgtatattatcagggagaacagagctttcaatgcgctcagtccacccccaggctctggtacgagctaaaggcaggcgatgaactttttacaagcgacgaaaacaccctttgccggctcctgactggataccggcagggggaaatggaaatggtaagcccccagcttgcctatacttttgaatatgacgcaagacgggaagcggaaaatcagcccgaagaagccaaccttaaaaattttgctcctgcagtcagcatcactgaccattggaatacccgtctctctccccgtcccataaataaaaccattatacagcccgctgttaattcctgtatcattgcccaaggcgtattgctggaaccaccccaaattgatggggagcagcaaagctcaacggcaacgcctgcaaagcgcatatattacgatttaacagcgccccgttacgttcaagagcttatagctctacccaaaacccatccccagcccaaggcctttgatgcgcccggcctgccccttccgtctgacggatacactttacaggctccggaaaactacgacggctgttatgttatagtagatttgtccgctgaatacgccggctacccgctaatagacataacagcgcccgaagggacagtgttggatataggttacggggaacatctggaggacggcagagtgcgctcttttatcggcgggcgtcattttgcttttcgctatacgacacgcgcaggcaggcaaaaatttattaattattttaagagaattgccggaaggtaccttgaaatgcatattcgttcaagcgagcagataaccgtacacaacctatcaattctgcctgaagaatatcctgttaagcgtgaaccatatcctatgggattaaccgacgctctaggcagacgcatctgggacatttcagccaggactcttgaattatgcatgcatgagcattatgaggactgtccatggcgggagcaggcactttacgccatggacgcccgcaatcaggctctgtcgggatattatgcctttaaagaatatgattttccggctgcttcatggatgctgatggcccaggctctgcttcctgacgggcagttaaggattacctcgcctacagacagcgagcttagaatccccagctttacatttgcttgggccgtagcctcggccgaattggctgaatacggcggtatagagcggataaaatatatgcccgctcttaatgaaatgctaaataaagctattgcgcgcagaaaaaatggtctgcttttaaatcccgaaggcgcggaatactggaatttttatgaatggtctaacggtcttgcagggcacctgggacaagctgtaccccaaagttatcctgaatgtccttataatgccttcttcagcggagctcttcaatcaggcgcatatctttgccgtacattaaagaatattgagcaagcggaaaaatatgaaaaggtaaataaagaactaaaaaaagccttttgcattttctgggatgaggacgcccaggcttaccgcacaggagaagcaggtgatggacggccatactctgagttaacacaggcattggctcttaaatttaatcttgtgccatcagaacgggcccaaaagctccgaaagcgtctagcccagcaagataatggtcttgagcctataactctaagccactatatttataaaatagacgccttaatgcaggaaccagatatatatttcaatactgtatacaatgatattttaaagatatggggcagcatgctttttaaaggcgcaacttccttctgggaaacactggatggggcaaatgcatttgacaaagcgggcagtctttgtcatggatggagcgcagcgccaatatatttctttggcaaatggatggatgaaaacaatctgtttaacattaaaagttag

SEQ ID NO: 1174 - DNA, 2097 bp, Unknown
  Description of Unknown: Clostridiales sequence
atgaaacagaaatatttcagtataaatcttttctgggatttctttaagcaaataaaactgacggggataattctaaccgcagtattatgcataattacggccgtacccactttggcacaatacattacaaacggcagatatataaacgaggccgtgcagatatcccaggtaactcccgtgctctattttgtaatatactttattcccataatatacactgcgggcatattcaaatttctcaataaacgccgggacagcgatttttaccacagtttgccccctacacgcctgtgcatgtatttttcaggctgtctggcctccttctgctggagcctcataacaatcatatcaatggtgcttataggctatctgagccttattatatgcagtctgagctgtccggctgtttatataggctatttaacagcttacaacgccgttgtcgcccttataataacgggctgcgcctgcatagcgctcagcgccacaggcactctgcttcccggattgtgccttacattgattataatgttcctgccccgtttaatacttaccctgattaatatcatggtgcgcgatcagtccataatagccagcgcgcttaatgacggcctgctgtttaaccagaactataattttgttactgcgcctctcttcagtgcaatagcgtcaggcaattcaaacgcagccactttgcccgcttttgcaggcggatatatatataccggcgtccttggacttatatatatcctgctcggagccttggcttttcgggccagaaagagtgaaagcgccgaaaagagcgctcccaacagagctttgcagcatatttacaggcttttaatatccctgcctaccctgctggccgctgcggtattaataacctccaacagtgacgaaagcctgatagtaatactaattgttttatcggtaattatctattttgtatatgaagcaataaccaccaaaagctttaaaagcatgctcaaagccgcgccgcttttcctggccgatatcgcagtatgcgctatagtctgcctggcctcatacggaatcagccagaatatacttaacgatactccgcaggcagatgaagtgaatcatattgagataaacgtatcaaacagtgatggatactatgtaactccttcctatactcaggcattgcaggccactatagaatacaaaaacaaggatattgtttctcttgcgtgcgaacagctggataaaaccgcgcagactgccaaggcaatcaagaatgacccccgcagtcccgaacatatctccggccgcagcgttaccttcgtattaaactcaggtactaaaataacacgcactgtagatttcgggagcgctgcagcccagtttgaaaacctgctttggagcgagccggcttatgtggaaaatcttattaagctgcctagtgactcccagatatccagtataggcagttactcaacagtaattttgactcaggaccagttccgggagctgtgggagagctataaagcggaatatgcatcgctgtccaacgaggctaaggcagaggcaaaaacgcaggattattccagttcgcctttctatattaaccttacaggaactgttggtttaaccgtatggagcgacagatatgccatcacctcattaactcccaatacgtttaatatggctgcccaatatgccaaccagcagcagcctatcagccaatttaaagaaaagctccaatcagttcaagaaattacggagcaagccggcaactatgaggttaatatagatataggcttttataacacctcgcagctggatatagaggatgaaaacctggccgcgatgttccagggaggatactctactaccatttcttcttatcatgaagaatacttgcccgttatggaaatcttaaataactgcacaatgtccgaagccaagcctgatcagcctgttttaactttagatcttatgctctacgagcaggacgtggaatacggctacagcgtgcgctcagatgaaagccatgctgttgtaagcatagaccaggaaagccttacctctcttattaacctgcttttccagcagcaaagcattaacgcggcataa

SEQ ID NO: 1175 - DNA, 1059 bp, Unknown
  Description of Unknown: Clostridiales sequence
atgaaaaatattgttttgcttaaaggagacggcataggccctgaaatagctgcgcaggcagttaaggtcctttctgttttagacgggtttaatattgatgaaaaggatttcgggggctgcgctattgataaaacgggcgaacctctgccccaaagcactcttaaagcggccttaagcgcagatgcggtattgcttggagctgtaggtgggcctaaatgggactcctgccctaaaaggccggaagcgggtcttttaggcctgcgcgccgcgcttaaggcttatgctaatctccggcccgccgttatttatgaggatttaaagcatatatcccctcttaaggatgagataatttcgcgcggagtagatataatggtggtgcgcgagctgacgggcggcatatatttcggcaaaaggggccgcggaacagaagagggcggggagtatgcctatgatactgaaaaatattccgcagcggagattgaacgcatagctcgtttggcttttgacatatcccttaagcgtaataaacgggtgtgcagcgtggataaggccaatgtgctggaaagttcgcggctgtggcggagtacggttcaaaaggtggctaaggattatccggaggtagaattggagcatatgtatgtggataatgcttcaatgcagcttgtacgcgacccggcccagtttgacgtgattttaacttccaatatgtttggggatattctctcggatgaagccagcatgctcacaggttccataggcatgctcccttcggccagcctgggcgggcaaaccggtctttatgagcccattcacggttcggcccccgatatagccgggcagaatatagctaatcccataggtatggtgctttcagttgctatgatgcttaaatattcttttaatatggataatgagagcgcgctgctggaaaaggcggtcaatatggctgtttcgggtgcgcgcaccaaagatatctgcggcggcggaaagagtgtgggctgcgaagaaatgggcgacattatagcgcataattttgagcggctgctcaggggagaataa

SEQ ID NO: 1176 - DNA, 3171 bp, Parabacteroides goldsteinii
atgaaactaagcaaaacaatttcactaacactactttctttaactctgggaagctatctgcatgcgcaggatattcaatcgttggcaggaacctggcagttcagtctcgaccctgccgatcaggggatgaaagaaaactggcaagaccgttcgtttgataaaacgattgccttgccgggaacaaccgatgaagcgcaatatggcgagaagacgtccggttccgatttcggtatcttgacccgtgcttataaatactacggtccggcctggtattcgagagaaattgaaattccatccgaatggaacggaaaacgcattcggatggaactggaacgcgtcttatgggagtcacgtgtttttgtggatggaaaggaggtgtccgtgcaggatgctttgtctactccccattaccatgatctcggttatctatcccctggtaagcatcgtttgactattcgtatcaataatgatctgatctataatattggcgataaaggtcatgtctatacggaatatacgcaaagtatttggaacggagctgtcggacgtctgcaactgaaggcaatcgaaccggttcatttctctaatccacaggtatttaccaaggtttctccctgttccctgcaactgatggataccttgatgaatacttcccctaaaaagatcgatgcacatataacctggcaactgaccgagcgtgggagtggaatggttgtttttacggaaacaaccgaacagccgctgcagaagggagcgaacgtactgaattttaaagcatctatgccggagggtatcaagctatggaatgatgtcactccccatttgtatcagttgaaagttaccatacgggataaaaagaaaatatacgatacccgtgaaattgagttcggtttccgggaagtgacaacatccaaatcaaaaattcttatcaacggaaaacctgtttttctgcgtggtaatctcgattgcgtgcattttccgctgacgggttatccgtcttgtaaggtagaagattgggaaaagattttccgtattcataaagactacggtctgaaccatgtccgttttcattcctggtgtcctccggaagcagcttttatcgcagctgaccggatcggtatttatatccaggcagaaacgatttggatcgactggtggatgtctgtcgagcagaaagaacggaaagagatggataccaaaggccatccgcagggattgggtaagaatccttcggccgaccggtatgtgcagcaggaattaacccgtatgatcgatgcttacggcaaccatccgtctttcattatgcaatgtatcggtaacgagttgggtaactctgatttcgaagtgatggagtcgtggatgaaacccttgaaagaaaaagactcgcgccgcctgtatgcaacttcaacggctcgtaagatcatgccgctcgatcaatatatggtcacccattatatggacggactgggcggaacccgcggtcttcggggcggtgcttctaccgcctgggattttgaagatgtgtattcatgttcggacatccccattctttcgcatgagatcgggcaatggccggtttatccgaaatgggaggagataaagaaatatacaggtgtactgaaggcacgtaacttagaagagttccgcgaacaggcacgtaaaaacaggatcgaggagcagaatgaggaatttgttgcggcttccggtgccctgaaccagatcatgtacaaatatgaaatagaatccttccttcgtacgccttcctgtgccggtatccagttgcttagcatgcaggattatcaggggcagggcgaagcgttgatcggttggctggatgttttttatgatagcaaaggcattacaacgcctaaacagttccgtgcgcaccatgatacgacagttcctttgttacgtatgcctaaatatgtatgggaaaacaatgagccttttacggctgaaatgcagttggcacattacggaactgaagatttgcaggagggactttactggaagattaaagatgaagacagtaatctggtcgcttccggaaagactgcatcccgccgttggcccgtaggtacttccgaactgggaggtaaaataaattgtgatctttcttctatctctgccgctcaaaaactgacggttgaagtcggtttgcagggacggtccatcgttaaccgttggaatatctgggtttatccgtctgcaaaatcttcggacaaacctgttgtggccgaagatgtgtatgtcaccgaccggatggatgcggaatgcctgaaacgtttggaaaaaggagagaaggttcttttgcaggcgtctgctttagggacggaagaaacctgcgataagattagtttttatcctttatattggtcgctgactttcttccccgggcagggtaagaatacgatcggtatgattgttcgcgataaacatccgttgtttgcccagttcccgaccgattcacatagcgactggcagtggcaatccgtttataaagatgcccgtgccttctatataaacgactatccggaaagttataagccgattgcgcagccggtcgatgatttccaccggaataataagctggcctctatctttgagttgaaagtaggaaaaggaaaattgcttgtctgcggctttgacctgaaagatgaaaagaatccggctgcacgccagttgaagaatagcatcctgcattatatgagttcggacgatttcaatccttcgtatgaaaaggatattgcctctttgcggaaaatgctgacttatgtggaacctctgaagagtactgttaccggcgagttcagcaatgctttgctgtatatagactgtgcagctccggataaaacctttgccaataagaagacaacatacgagataactcccgactggcaggcaaaggagatggagttgacgatccaatgtcctccgggaatcattggttccttatatgtttgttttgccgacaaggataagaaaggacgcacggggcatctagtcttcgaaggtcgtgactacgaattggtaaaacaagagaatgaagagtcatgggttaaactccatattatgcgtgaagattcaaatgacggaatacttcgtttgaaagcaaaggttaagaacggaccggatttggttatttcgaaagtggctatcgtggaggaatga

SEQ ID NO: 1177 - DNA, 2313 bp, Parabacteroides goldsteinii
atgaagaaagtagctgttctggtaacctttttgctgatcgtcctgcaagcggccgatgcgcaaaaggtgggactggtattaagtggtggaggagctaaaggtgctgcgcatatcggagtcattaaagccttagaggagaatgatatacctattgactatataaccggtacatctataggttccattataggtagtttatatgccatgggatattctcctgatgagatgctggaattaatgttatcagaagaatttagttactggcagaccggtaccgtagaaaatgaatataaatattactttaaaagaccggacccgactcctgagttcggccatttttctattgatatgaccgattcattgcaaatcaaggccaactttttaccgcaaagccttatcaatccgatccagatgaatcaggcgtttatggcattgttctcgcaggctaccgctaaagccggatggaattttgacaatctgtttgtcccgttccgttgtgtcggttctgacatctataataaaaaggctattatattcaagaacggagatctgggagatgctgtccgtgcttccatgacattccctttctttttccagccgatctggaaagacagcattcctctgtttgatggcggtatttacgataatttccctgtcggaccgatgaaagaggcttttcatccggactttattttcggatcgactgttgccggaggaaataacaagccgtccaataatgcttataatcaattggaaacgatgattatgcagaagacggattatgatgttccggaagaagatggcatgatggttaaattcagtttcccgactgtttcattgctggacttccaaaaagcaaaggaattgatggatattggttataaacgtacgatgagtatgatcgactcgatcaagcaaagagtgccccgcagggttccgcttacggaagttaatatgcgtagggttgcttataaggaaagtttgccgccgctgatctttcagaatatatatgtaactggcgtttccgaatcgcagcgtaagtatatcgaggcacaactgcatcgtgatatgaatcatgaattttcgatggaagaatttaagcgggcttatttcaagatgctcacttcttcgaagatacgggaaattatgccccatgctgtttacaatcgcagggagaaaaagtttgacctctatctggatgtaaagatgaaagaagaaataacggtcggtttcggaggtaatatttcatcgcatcaggcgaatcaattgtttttgggattgggttatcagtatttaggccgttttgctgccgatgttaattctaactttcaggtaggtaattctttcagtggagttatgctgaacggacgaatctatttgcagaccaggattccgacttatcttaactggcagggggtatattccgataaaagatatcaggaaagtcagtcgctgttttacgaagatgttttaccggccttcatcaaacaaaaagaattgtatatgaagctcaagctgggattcccgttcctgaacagggcaaaatcagaaatcggttttgcatacgggcaattgaatgattactattttcagagtaataatatgttgttccctaattctaaattcgatcatagctggtacaatctgttcagcggttcgctgagtatagaacggaattcactggatgctaaacaatatcctatagccgggcggaaacagttcctgatcgctcaatatgttacaggtactgagaattatgatccgtctccaacatcccagagtcaatcgatcagaaaaaaggtttacagctggttacagttgaaaggggagtggcagcactatgaaacattaagtaaccgtttcaatctgggattccagggagaattggtcatatccagcaaaaacctgatgaataactatacggcatcggtattgcaggctccggcttttacgcccacgccgcatagccagattgttttcaatgaggctttccgggccaatcagtattttgcagcaggcatttcaccaatctataagtttagcaaattacttcatttccgtctggacttgtacggctttgctcctttatatgaaataaagaaagaaactaatgcggacaatccttatatggcagttccttattatggcaagtttcttcattcatttaagtacatgggagaggctgccctggtgttacagttaccttttgcctctatcagcctgtatgccaatgggtatagttatccggcaaagaatttcaacttcggactgaacatcggttacttgatcttcaatccaaaaatgttagattaa

SEQ ID NO: 1178 - DNA, 1824 bp, Parabacteroides goldsteinii
atgaataaaactatcctgcttgttgtgttttgcttttccctgttcgtttcggggtattcacagggaatacgctttgattcttacccttctcatccccggttgctggtaaagaaaggagaggagcaaaagattaaatccgatctggctcttaatccggagatgctccggttgcataactatctacttgggcaatgcgacgatctgatcacgacgcctgtgctggcatataaaaaagaagggaaacggttgctggccgtatcgcgtgaagccttgcggcgtatcttctatctttcatatgcttaccggatgacaggagaggataagtatcgtttgcgggcagagcaggaaatgattgccgtgtgttcgtttaccgattggaacccgtcccattttctggatacgagcgaaatgactatggcggttgcaatcggttatgactggttgttcgatcggttatctccggatgcccggaggctggtgcaggaggcgattctgaataaaggttttgccccgtcgagggataaaagatataactggtttctgagagcgaccaataactggaaccaggtctgtaatgccggactggtttacggtgcgctggctgtgttggaagatcatccggaagaggcccgtgaaatcattgaacgtgctttatctacagtcggcttgactttgaagggctatggtcccgatggcgcttatcccgaaggatataattattggggatacgggactaccttccaggttcttttgaatgccgcgttggaatccgccctggggactgacggcggtctctcttcggctgaaggttttctggcttctgcccgttttatgcagtttatgaccggaacgaccggtaaatgttttaacttcagcgattcccgtgagactgtttttgctttgccggctatgtactggtttgccgacaagctgcaagaccctacactgctttggaatgaaaaggatatgttgagtcgggcggagttgtctttttcggatgaggagagccgtttccttccgttgattccgatttatggttcacaatataaaatgaatgaactggtacctcctgccatgaaattgtgggcggctaacggacagacgcctgtcgtgctggtccgtacgggttgggagaatggagaaggtttctatctgggaataaaaggaggaacggcttcgaccagccatgcccatatggatgccggatcgtttgtgttcgatgctttgggtgttcgctgggtgcaggacctggggatgcaggaatattattcgctggaaaaggaaaatgtagatttatggaatatgtcgcagaacgggcagcgctggaatgtgttccgttataataacctggcgcataatacactgactgtaaacggtaaataccatgatgtaaaaggttttgtacctgtgacaaatatctattcggaaacgcataaactcggagcctctctgaatatgacgggtttgttcggcggagaattggaaaatgccgttcgtgaagttgctctgatcaatgaaaaatatctgtcggtgattgatcgtgtaaaagctggcagtcagccggcaactgtcagatggacgattgtaaccggggccattccccgtgtattggacagtcatatggtggaactgacaaaagacggcaaatgtatgcaactgatcgttgatagtccatccgtaacttctgtgtccgtccttgataatgtatcgaagaatagctatgatgcttccaatgagggaacctgccgtatcgttttcgatgtaagtctggaaagcgggcaggagagcgatatcaaagtccggctggttcctgctgctgactga

SEQ ID NO: 1179 - DNA, 1809 bp, Parabacteroides goldsteinii
atgaatgatgatagtgctatggaaaacataaaactaacaatagataacagagaagtggaagtcccgaaaggtactaccatcctcgacgcagcaaagagcatgggaatccgtatcccgacactttgccatatgaaactcgaagatttgcattacgagaacaatcccggcgcctgccgtatctgtgtagtggaaattgaaggccgccgtaacctggctccgtcttgtaagatggaatgtacggaaggaatggttgtaaggacccatactccccgggtaatgaatgcccggaagacagtgatggaactgattctgtccaaccatccggccggttgccttacctgtagcagcaacggatattgcgaactgcaaacaatagcccacgacttgggtatccgtgaaatacggtatcaaggagaacaatccacctttgagatagaccgttctccttccatcgtccgtaacatgaataaatgtatcatgtgccgccgttgcgaaacgatgtgtaacaatattcagacagtaggagcattgacggccgtcaaccgtggtttcaacgcagccgtgtctacagcctttgagcgtgatatcgccggaagtacctgttcttattgcggacaatgtgtttccgtctgtccggtaaatgccctgagcggccgtaatacccagcagccagtattggatgcattagctaatccggctaagattgtgatagcccagactgctccggctgtacgcaccgccctcggacgtgacttcggctgtgagccgggcacattggttaccggaaagatggtatcggctcttcgccagttaggttttgactatgtctttgatactgactttgcagccgacctgaccattatggaagagggaacggaacttcttcagcgtctcagcaaatatctttcaggggatgaagaagtaaaaataccgatgatgaccagttgctgtcccggttgggtcagctttgtcgagcagcacttcccggagttgcgcgaacatctgtctacagccaaaagcccgcaacagatgttcggagccatagccaaaagttattttgcagaaaagctgggagtagaccgtaaagatatagttgttgtctccatcatgccttgcctggcaaagaaatatgaagccagccgtccggagtttgccgtagaagggaatccggatgtagatatttccatctatacccgtgaactggcccgtctgattcgttatgccaatataaacttcaacgaacttcccgacagcaacttcgaccatcctctcggcgaatcgaccggtgccggagttatctttggaactaccgggggagttatagaagccgcctgccgtacggcttatgaactgtatacgaagaagccgctcgaacgaatcgagtttaaggaattgcgcggactggaaggtatccgtagcggaacgattaactttgacggcgttcctttgaagataggtatcgcccacggtctcggtaatgcccgtaaactggttgaagaagtaaaaagcggaaagtctccttatcatgttatcgagataatggcctgccccggtggttgcatcggaggtggcggccaaccgttccatcagggaaggatggatgttttgcgtaaacgtgccgccgcgctttacagcgaagacgaaagcaaaccgctccgcaaaagccatgagaatccgtatattcagcagttatataaagaatacctgggcgaaccctgcggaccaaaggcgcatgaattactgcatactcattacttcgaccgcaaagaagtagtcaatatgtttttggaaaccgataaagacgaataa

SEQ ID NO: 1180 - DNA, 2067 bp, Parabacteroides goldsteinii
atgaataatagaactttgttcaggaagtggtctgtctttcttgcatgctttgctttttgcggtcagcaggcatttgcagcaggaggctccgccagccctttggagataactgttcttgtagtagtcattcttttggcattgttgtttgtcctggcggctttttatttgagaaagatgtatgccggtttttcgagccagtcccaaaaggcggtaaaggaaaaggagttgcttgccctgaaccagattgagattgagcaaaaaaataatgagttggaagctgctaagaagaagttggaggagcagaaggaggctatcgagtccaaagcggcagaactcgaatctgagagaaatgaactggaatctcaatataatgtattgtcaacagcgaataaagagctggttcagaaactttccacgcaggagacgatgatctctacgctgaacagcaataaaaaagacctggagcagttgctcgtcaccaagatcaaggagagtgatgccatgcagcgggaggttgccgacaggctttcggaagccgagtcccgtttgaaggatgccgaaatgatccacgataacttctttatcgagacaatccacgaaatgcgtacacctctttcactggtgctcggttcattggcattggtggtacagaataaggatgaagaaaaagatatgtccacccaattactttcggcttatcgtaatacacttgctttgcaggaccttgccgatcagttgatcggaacccgccgggcaaacgatgtcgccaattatctgcgcatcgcccgttacgacctggtggaaatatcccggcagatatgcgacctgtttgtagactgggttgcgatgaataatgtcgatttccaggtcaatacccagacggctaagttatggatctggctcgaccgccgtaaaatggaatatgctttacgtacattattatctaatgcatttaagaatacatttgtttatggcaaagtcacgctggatatttcagtcgtcaggaaagacgggaaagcatattgctctctgtccgtgcaggatgaaggactggatgagaatgaaagtgctcgccgcggtttgaagcaggtgcacgatatggtggatgacatcggcggattttatagcaacgaaacgacttcgtcgggcactgtctatacattattaataccgttaggcaaacaacacctgatggaacgccgggtggaatttgtagaacccgaagctgacctggtgagattgaacgaccgtcagaaggaagagatcgccgaatttattcaggttgtcccacagaaaaagctcaccggcaagaaaatccttgtcatcgacgacagcgaccagatccgttggttcctgaaacatgtctttactaaggaatatgagattctcgaagcccgtaatggggaggagggaatacaagttgcctttgccaacaatccggacctgatcctttgcgacgtgatgatgcctgtgaaagacggttttcaaacctgcaaggagttgaaggccgatccgcgcacttcacagacaccggttgtcatgctgacggcgaaggtggagagcgaagacatcattgtcggtctcgaagccggggcggatgattatatcaccaaaccgttcgatgtggagattcttcgcagcaaactgaacaacctggtgaaacgccgcgaacaattgaagcaattcttcaccaagtcgctggcaggaacaagcgcaccgaatacggatgaaagcgattccggcataccgagcaatccgtttatggacctggttgttaaaaacatcgagatgcatcttgacgattccacctttgaggcaaaggtgctcgcagactcattaaacatgagtctgccgacattgtatcgtaaaattaagcaattctctgattgcagtatcctggaactgacccgtacgattcgtctgaaaaaggccgccgaattaatccagacgcagcagtattcggtgcaggaagtcgcagaaatggtcggtttcaacgacacggccaccttccgcaaacgtttcacggaacaatacggaacgacgccttcgcaatacgggcagccgtaa

SEQ ID NO: 1181 - DNA, 2211 bp, Parabacteroides goldsteinii
atgaaagatgtagaaagtaaggtactgcccgtccttgagatgagttgtgcggtttgtgccaataacgtggagggtaccgtcaaagcacttcccggagtagaagaggcatctgttaattttgcagcgaatacattatcggttacataccatccttcggtaatcagtttacagaaaatgcaggaagccgtacaggctgccggatatgatttggtggttgaggccgaagatccgctagccgtacaggaagagatggcacgtaaacattataagaaactgaagcggaatacaatcggagcgtggatattatcagtgcctttggctttattggggatggtgtttatgcacatgccctacgctaactggataatgatggtgctggcattggctattatggttctgttcgggcggtcgttttatgtgaacggtgtgcgccatgcgctgcaaaagagtgccaatatggatactttggtggccctcagtacttccattgcttttatattcagtttcttcaatacgatttatccgcagttctggattgaaaagggattggagccgcatgtgtattatgaagcctcgggggtgattattgcctttgtgctgttgggcaagttgatggaggagagggcgaagaacagtacttcttctgctattaaaagcctgatgggattacagcctaaaacagctcgtcttgtaactgacggaaaagaggaggaagttcctatctcttctttgaaaaggggaaatattgtaagtgttcgtcccggtgagaaaataccggtggacggaactttgctgcaaggctcttcttccgtagatgaaagcatgctgagcggggaaccgattcctgtggagaaagttgccggcgaccgggtattggccggaacaatcaaccaaaaaggagcttttacgatggaggcgaccggagtcgggaatgaaacagttctggcgcaaatcgtcaagatggtgcaggctgcccagggaagtaaagcccctgtgcaacgtatagttgacaaaataagcggtatatttgtcccggtagtcgttctcctgtctatcataacgtttatctgctggatggtgattggcggcgaggattatttctcttatgcccttctttcagctgtttcagtattggtgattgcctgtccgtgtgccctagggttggcaactccgacggcactgatggtcgggatgggaaaaggagccgaacggcatatcctgataaaagatgcttatgcgttggagactctttgtaaagtcgatacgattgtactggataagacggggacattgacggaagggattccggttgtcgtggattcctgctggttgacagaatcgaatgtctgttatctggatattctctatactgctgaattgaaatcggagcatccgctggcgtctgccattatccgttggctggaagattcgggagcctctacgtgtgaagctggagattttgaaagtcttaccggccggggaatccggatggaagtcaatggtgttacttactgggttggaagccatggattgttggaggtatttggttcggagataccggatgacactatgaagcagatacgtcaatggcaggacaacgggataagtgtcgtttattatggcgaaggtaaccgtttgctggctgtactggctatttcagaccgcatcaaaccgacatcggctgcggctgtaaagaccctgacggatatgggaatagaagtgcatttgttgacaggcgacggtgtgaagacggcggaaagagtggctgatactttaggtataaaatattttaaggccgaagtgatgcctgatgataaggaagaatatatcatggctcttcaaaagtcaggaaagaaagttgctatggtaggcgacggtataaacgactcgcaggcactggctcgtgccgatgtgagcattgcgatgggaaaagggacggatattgcgatggatgtagcgatggtgacattgataacatctgatttgttattgttaccggaagcaatcaaattgtcgaaacgaacggtgcggctgattcatcagaatctgttttgggcctttatttacaacctgataggaatacctttggcggccggcgttttgttcccggtaaacgggttgttattgaatccgatgctggcaagtgcggcgatggctttcagttccgtttctgtggtgcttaacagcttgagactgaaatttatgaagtaa

SEQ ID NO: 1182 - DNA, 1350 bp, Parabacteroides goldsteinii
atgccaggactgaacattaatccggaatatatgggcgaagaacgcagggaactgtctttgctggaattgaataacctggtgcgcggtgcggtcagtgaggctttccccggcacttgctgggttcgtgcggagatgagtgatgtgcggacgaatgcttcttccgggcattgctatctggagtttattgaaaaaaattctataaccgggcaattggttgccagggcacgtggttcgatatgggctaaaacgttccggatgctgaagccttactttgagatggagacggggcagatgtttgcttccggactgaaggtgctggtgaaagtatcggtcgaatttcatgaactgtacggatacagcctgacggtgctggatatcgatcctgcctatacattgggggatatgctgagaaagcggatggagattatccgccagttgaaagaagagggtgtatttacattgaataaagaattaccgttccctgtcctgcctaaacgtattgctgttattacttccccgacggctgccgggtatgaggatttcctgaatcagctggcaaataataaagcgggctatccgttctatccgaagttatttcccgccctgatgcaaggggagagaacggaagagtctgtcatcgcagcgctggaccgtatttaccatcatatcgattgtttcgacgtggtggtcattatccgcggcggtggttcaacttccgatctgaatagtttcgactcctatctgctggcggcaaattgtgcccagttcccgttgccggtgataacgggtatcggccatgagcgcgatgataccattctggatatggtggcacatacgcggatgaaaacgccgacagccgtagccgaatttctgatcggccgtatggatgcagcggcggaagaactggaagaccttcagcaggaggtgagcgaactggcaagcacgatcttattgaaacaaaaaaacttcctgcaattgctgggggcacgtttaccggtgattgtcacgaacaggatcgagcgtaaccgttctttcctgcaaatggcaggcaataaacttccggcttctgcttcggccatgttgctccgccggcgttcaacgcttgaaagcctgcaaatgcagttgcagaaccgtgctgcttcgcgcctggcggaaggcacgcggtttatccagttgacggagcagttcattaaaatggtatctcccgattatgtattgaagcgtggttatagcttgtccctgaaagacggcaaaatcatcaaacatgcaaccgatctgaatcccggcgatgaactggtgacccggtttgcggatggggatgtgaagagtatcgttaaaaacgcaaagtga

SEQ ID NO: 1183 - DNA, 2145 bp, Parabacteroides goldsteinii
atgaagaagctgtttatcgtattatttgctttaatggcagggatgacttgggcacagcaatctcctgttactgccggcagcgacggaaagtcgtggacattggcaacacgttcttttatctatcagatccgtgtttcggatcagggaaaggtgaatatgttctattttggcgataaaagtcagaatccggacatgctacggaatccgctgggagaagaaataactgtccgtggcggttattctgctacgacaccgatgctggaagccgtttttaaagaccgggtaagggatatagaactcacttacgaagggtcggaaatgctgacgcaggatgggtatgccacattggttatccgtcagaaggataactattatccgttggctgttaccgaatatatccgtgttctgccggaatacgatttgcttgagaaatgggtagaaataaagaataccggaaagaaagggaatattgaaatagaaaatgcccagtccggaacgttctttcttccgaagaacgcttatgagctgacgcatctgtccggcagatggggctatgaatatcaaatgaatgtaaccaaactgacacagggattgaagacgattcagacaaaagacctgcgttcgtacggttcctctttctttgcaatcagacccgaaggcgaacaggaggagacttgcggcgaagtatggttcggctcgttacaatatagtggcaactggcggatggactttgagaaatatgctcccggcgaagttcaggttaccggaggaataaatttctgggaccagttgttggttctacagcccggaaagagttttaccactcctaaaatgatgatcggatataccaaccgggggatggaaggtgtttcacagaacctggcttcgtttacccgtgagaaagttctgtatccttctcatcgcaatcaggttcgtccggttttatataacagctggtatgctaccacttttgatgtgaatgaagaacatcagctggctttggcaaagatcgcaaaagatttgggcgttgaagtctttgttattgacgacggttggtttaaagggcgtatcaacgataaaggcggtctgggtgactggacggtcgataagaataaattccctaacggtttgcaaccgatgatcgagaaaatcaatgctctgggactggatttcggtatctggatagagccggaaatggtaaatccgaacagtgacctgtaccgccagcatcccgactgggtgttccattatccgaaccgcacccggcatgaaacccgtaaccagttgatgctgaacctggcacgtgaagatgtctatcagtatttatatagctgcttctctacgttgttacgtgaaaacaatatcaagtttatcaaatgggatatgaacagaggggtgacggaacctggattcctgtcggctccgaccgatgaacagcgggccgttcgtattaaatatatcgagaacctgtaccgtttgtttgaaacattgcgtgcggaattcctggaagtatggtttgaaaattgtgccggaggtggcggtagggtcgacttgggtatgatggcccgtaccgatttctgctgggcaagcgacaataccgacccggtggaacgtacgtttatccagtattctttcctgaatgctttcccgtctaattcaatgattagctgggtgacgcaggaagattggcataaccagaggcatccgcttgaatttaagttcgatgtatccctgtgcggtgtcctgggtgttggttatgatattacgaaatggtctgataaggaaaaagaggttgcccgtgagaagattgctctttataaagaaatccgtgaaacagttcacaaaggtgatcattaccgtctgatatcgccttacgaacataaccggagcgtactccagttcgtcaataaaccaaaatcggaatcagttgtgtttgtgtataatctggcggaatatccggataatgccataccggaaaccaaacgttctaaaaaggtaaagctgcgtggtctggaacctgatgcctcttaccggattgaaggtatggatggtctttatgccggtcgtcagttgatgaatatcggagtggaatttcccttgtacggagcattcaaaagccgtatatttaagattgtaaaacaataa

SEQ ID NO: 1184 - DNA, 2010 bp, Parabacteroides goldsteinii
atgaaacaaaagctgttcataacgttcatattatgtgtatggataccggtggcctatgctgccggtattccgcacttgcttccctggccgcaacaggtagactggaacaagcaaacgttttccggaaaagaaatcgccctcctggcggaaggaaatacggagcagatggttacggcctggttgcaggagaataacatcggcatcaaccccaccagcaaacacaaattacaaataaaacttgtaaaagaactgccggaagcaaagctgaacgcaaacgaagcctataaactgcaagtatcctcccagggtatcaccatcgaagccaccacggaacagggagtgtactgggccatccagacccttcgccaactaacggaaaagaaaggaaacagagcccatatcacgggatgtcggattacagactggcctgccttccgtatccgcggattcatgcaggacgtaggccgcagttatatctccctggaagaactgaaacgggaaatagccattttatcccgttacaaaatcaatgttttccactggcatctcaccgagaaccagtcctggcgcctggaaagcaaagtctttccgatgataaacgacagcatcaacacaacccgcatgccgggcaaatattataccctgaaagaggccaaagaactcgtttctttctgcaaacaacaccaggtgatgttgatacctgaactcgacatgcccgggcacagtgccgctttcgaacggaccttccgccacgacatgcaaagtccggaagggatgaaaatactgaaacagctcatagaagaagtctgcgaaacattcgatacgccttatctgcatatcgggaccgacgaagtggagttcaccaatccccggtttgtgccggagatggtcgcattcgtccggtcgaaaggcaaaaaagcaatctcctggaaccctggctggcattaccaaccaggtgaaatagatatgacacacctgtggagctatcggggaaaagcccaaccgggaataccggccatcgactcccgtttccattatctgaaccatttcgatacctttgccgacatccgtgctttatacaacagtaccgtctacggggataccgaaggtagcgatgatatggcaggtgtcatcctggccgtctggaacgaccgcctggtacaaccggaagaaaacatgatacgggaaaaccacctgtatcccaacatgctcgccatagccgaccgtgcctggcagggaggaggctacgaatacttcgataaagaagggacaaacctgccttccgaagacagccgcgcatacacttcctttgccgaattcgaacaacgaatgctctggcataaagagcatcatttcaaaggatatccgttttcatacgtaaaacagacaaacgtgaaatggcgcatcaccgacgcattccccaataacggcgacctgaatagcgtgttcccgcccgaaacagccttgcaaaacagctatacctacgatgggaaaacctacgaaacaaacgaaacgatcggtgccggaatctatctgcgccacgtatggggcacactcgttcccggcttttacaaagacccgaaagaaaaccataccgcttatgcctggacctgggtatattcgcccaaagaccaggaagcaggggcctggatagaattccagaactacggccgttcggaaatggacctggcgccaccgcagggcaagtgggactacaaaggcagccgcgtatggctgaacgaccgggaactgcttccgccggaatggactgcgacccataccgtaaaatcgaatgaaatcgcgctggggaatgagaactgtgttgtcagggaaccactcagggtacacctgcaaaagggatggaacaaggttttcctgaaacttcccgtcggaaagttcacgcttcccgaagtcaggctgaacaaatggatgttcacattcgtctttgtcaccccggatggtgaaaaggcggtagacggcctggtctattcaccggataaaaagaaataa

SEQ ID NO: 1185 - DNA, 2679 bp, Parabacteroides goldsteinii
atgaaattatttatccaattgtttatcttgctgttgtcactcagtatactgtatccggcaaatgctaccgaagccgataaagcacctactatcacattgaatatcagcaatctccctctacctgatgttcttgtgataatcgaaaagcaatcggagatgtccttttcttacgaatcttcggttatcaaagatattccgaaagtaacattgcaggtaaatcaagttccgttgcgtacctgtcttgatatgcttttcagggatctctccgtcacctatactataaaaggaaaatttattatcttacgaagaaaaagcaatctcgttacgatcagcggctttatccgcgatcaatatacaaccgaataccttatcggtgcttccgtctacaatcccaaaacccaggaagggacagcaaccaataaccatggttttttcagtctgaccgtacaacaaggtgatatccagctggaaacatcttatattggttaccagcgcttcgcatatcatttgaatgatctgaaaaaagatacggtcatggaaatactgctcaaaagcggtaaagaacttcaggaaatagtcgttaccggaacaaatgcttcacaaaatccggtatacactccccagatggggacattgaagatttcacagaaaacagtaaaatcaatcccaacccttctcggagaatcggacgtgatcaagactttgcagacacagccgggtgtttcggcaggaacggaaggtttggctggtatgtacgtccggggtggcaatggcgatgagaacctctatatgatagacggcattcccctttaccaggtaaaccacctgggaggactcttttccgcttttaatgccgaggctctgaaagatgtcgatttttacaaatcggcttttcccgcccgttacggaggaagactttcaagcgtagtcgacgtacataccaaagatggaaatatgaaagaatatcatggcagcgccatgctgggcctcacttccggaaacattaattttgaaggtccgctcatcaaagataaaacatcattcaatgcatccctgcgccgctcctggttcgatgtgctgacagttccggcacttgccatctggaacagaatagagaaaaaggatggaaaaaaacgaacgggcagatatgcgttcaccgacatcaacatgaaggtaaaccatcacttcaatgaccgcagccaaggatatgtcaacctttatttcggacaagattttctaaaaggaggaagtaccgattataaaacgagtgatgataatctctactacgaatcgaaagatatcgggaaattacgctggggaaataccgttgcctccgccggatggtcttatgtgatgaatcataaaatgttcagtaatatttcggcttattacacacgttataattcctccataagaagaatagaggaaaaccagacaggtaaaaaagacgatgaggagtataagaaaagtaaaagaaatacatcgactgaaaatggtatcaacgacctgggtttccgaatgaatttcgactatttgcccactcccgcccatcatgtccgtttcggtagcaattacatctatcatcatttccgcccggaatatacccaaaatgaagtgaccggcgattatgaaaaactggaagtcaaagatgtgaaagagactttatcagctaatgaactggctgtttatgcagaagatgactggacagtcaatcattttatccgcctgaatgccgggatacgtttcagtctttacaatgtccgtcaaaaaacgtatacttcgctggaaccccgcatatcttcccgcttcctgatcaatccccatctaagcctgaaagcatcctatgcccggatgagccagtacattcaccagataaacgaaagttatatgagtctgccgacagatacctggatgccggttagtaagaaactccgcccactggtcagcgaccaagtatcggccggcgcctattacaatctgcacaacgactattctttctcagtagaaggttattataaatggatgaatcatattctcgactataaagacggatataatttcctcccgtcattcatcggttgggaagataaactggcccagggcaaaggatggtcgtacggggtagagctgattgcccggaaagaaaccggacgtgtcacaggatggttaggatacggactgatgtgggcagaccgccagtttgctgaaataaatgacggtaaacgttaccctgccaaattcgacaaccgtcacaaactgaatgtcgtagcaaactggaaactaagcgacaaagtagaattaaccggcagctggacatttatgacgggaaaccgccttaccgcttctttcgaaaattacgaagacctcggacaggcacattttccatccgacgtagctcctattcctccgtttatgaatacaccgggaggacttgaatatttcaccgaacgcaataatttccgcctgccggcttatcatcggcttgatctgggtatcaatatttatcgtcctaaaaagaacggatgcatgggtatctggaatatcagtatatataatgtatattgccatatgaatgcgattaccttaaaaaagcgtttctggtataattattattgttatttcgaaacgatgagtattctgcctattataccatcggtttcatacacctataaattctga

SEQ ID NO: 1186 - DNA, 2208 bp, Parabacteroides goldsteinii
atgaaaaagtatctcttattgtgtgtatgcgccggatttttggcctcggcagaagctaaaacgaaaacggactggaaagcaaactggataaatacggaacaatgccagagtgcgagcaatacctggctggcctatcgtaaaacggtaactttggctgaagttcctcggacactgaccgcacatattgcagccgacagtaaatattggttatggatcaacggccggatggtggtgtttgaaggaggcttgaaacgtggcccttctccttatgatacttactacgattcggtagagattgctccttaccttacgtcgggggaaaatacgatcgctgttttggtgtggcattttggtaagaacggattcagtcatgtgaacagtggactggcagccttgttatttgaggcgattgctcccggcatagagattgtatccgataaaagctggagttgtagggtatatgatgcttatcagaataccggtgctccttatccgaactatcgcctgtcggaaagcaatatccgtttcgatgcccgcagaacattagaaggatggaaccagcctggctataagaatacgtttcccggagccgagatcgctgcagtggttggtaaagcgcctttgggaaacctggttgaacgtcctattccgctctttaaggattttggtttaaaggagtatccgggtgtccgccggtcggagagaggcgataccctgttctgccgtttaccttacaactgccagtttacaccctatctgaaagtggagtcggcggaaggtgcgacaatccatatgcagacggataattatcggggtggaggaccggaaaatatccgtgccgaatatgtcacccgcaacggcatacaggagtatgaaagttacggctggatgagcggtcatgagatgtggtatattcttcccgaaggagtaaaagtactggaagttaagtatcgtgaaaccggctatgatacagagtttgccggatcgtatcaatgtaacgatcctttcctgaacgaactttggaaacgttctgcgagaacattatatataacgatgcgtgacaattatatggattgtcccgaacgcgaacgtgctcaatggtggggagacgaggtgaacgagttgggagaggctttctatgcactttctccttcttcccataaactggccgttaaaggcatttatgaactgatgaactggcagcgtgccgacggctcattgtttgctcctgttcctgccggtaactggtcgaaggagttgcctttgcagatgctggcttcggtgggttggtatggtttctatacacagtattattatagcggagacagtacatttattccggttatttatgaccgcctgcatcgttatctgcatgaaacatggcaggtcgataagagtggcctgcccatcgaacgcagtggtgaatggagttggggtgactggggcgaacagatcgatatgggggtattgacgaactgctggtattatctggcactgaaagcagaaaaggaatttgcacttcaactgggtaagaaagcagatgcagaagagatcacccgtatgatgtatagtattgagaaatgctttaatacgaaattctggaccggcactgcatatcgttctccgggttatcatggcaaggatgacgaccgttcgcaggctatggccgttctatccggtttggcgacaaaagacaagtatcctgccatactgaaggtcttgaaaaaagaatatcatgccagtccttatatggaaaagtatgtattggaagctctttttcagatgaatgccccggaggttgccttgcagaggatgcatgaccggtatgccggtatgttaagttataaggattataccaccttgtttgagggttggggagtcggcgctgaaggtttcggaggaggtacgatcaaccatgcctggagcggaggaccgctgacgctgctgagccagaaagtgtgtggtattgaaccgacatctcccggtttccgtacattccgcataaaacctcagatggggtctttgacggaagcatcggcatcagtacctacccattacggagatataaaagtgaaattacgcaagtcaggacgtactatattaatggaaatacaagttccggaacagacgagtgcagaggtcgtttcgtcgaaaggaaagatacagcagataggctccggaacctataatttaaagtgccccttttaa

SEQ ID NO: 1187 - DNA, 1767 bp, Parabacteroides goldsteinii
atggcacacggagatcacttgaaagataatgcaaaacccaaagaaggacgaaaaaccttctgtcggctgatatcgtacctgtcatgcgaccggcgcttgttgttcgtgattggcttcctgattattgtcagcatcatagccaacctgctgggctcttatatgttgcgtcctatcatcaacgactatatcattccgggagatttccacggattgatacggacactgattattctggccgtcgtgtatctgacaggggtcgcagccgtgtatatccaatatatattattgaacaagatcggccagcgaacagtcacccggatgcgttccgacctttttgagaagatggaacacctgccggtcaagtatttcgatacccatcagcatggcgacctgatgagccgttatacgaatgatatcgacaagatcagcgacgccttgaccgacagcctctccgatatgctctccagcgctctgacgctgattggtatcttctgcctgatgctttatatcagtccggtcctgacgcttgtaaccctgattactgtcccgctgatgttcctcagcgcaaaagaaattgtaaagcgaagccgcaaatatttcaaagcacagcaggaatctatcggtacactgaacggttatatcgaagaaatgataagcggacaaaaggtcgtcaaagtattcggccatgaaaagaaagtaaatgccgactttgaagtgcagaacagcgatctgaaagagaagtcgcaaaaggcccagttctactccggactgatgatgcccgtcatgcagaacctgaatacgctgaattatgtatttatcaccatcgtcggcgccctgctcgccatcttccgcggattcgatgtcggcggactggccgccttcctgcaatactcccgccagttcgggcgcccgatcaacgaactcgccagcctctacaacagtatccaggctgctatagccggtgccgaacgtatctttgaagtcatagacgaaacacccgaagcgccggatacttccgacgcaatcgcattacagcatgtacaaggcgacgtagccatgaaagacatttatttcggatacaaaccggagaaaacgattctgaaaggaatctccctgcatgcaagggccggctgcaaaatagccctggtcggtgccaccggagccggaaaaacaactatcctgaacatgttcccccgcttcttcgatatccagtcgggagaaatcacgatagacggtcatcccatccgccggatcaaacgaaacaacctgcgtcaatccatggcaatcgtcctccaggatacgcatctctttaccggaaccgtacgcgaaaatatccgtttcggccgtctcgatgcgaccgacgaagaagtcattgccgctgccaaactaacggctgcccattcctttatcaagcgcctcccccaaggctatgacacgctccttgaaaacgacggtgccaacctgagccagggacagcgccagttactcaacatcgcccgtgccgccattgccgaccctcccatcctgctactggatgaagcgaccagcaatatcgacacccgcagcgaaatccttatccagaaaggtctcgaccaactgatgcaaggacgtacgagcctcatcatcgcccaccgtctctcaacagtgagaaacgccgaccttatcctcgtcctcgaacatggaaagattatcgaacaaggcagccatcaggaattactggcactgaaagggaaatattactccctcaaccaggaacagttcgaatga

SEQ ID NO: 1188 - DNA, 2073 bp, Parabacteroides goldsteinii
atgaaagtatgtattgctgaaaaaccgagtgtggcacgagagattgccgaagtactgggggctacaaaaagaatgaatgggtatattgaaggaaacggatatcaggttacctggacattcggacatctgtgtacactcaaggaacctcacgaatacaccgacgactggaaacgatggagcttgggagcacttcctatgattcctccccgtttcggtatcaagttgattagtaacccgacctacgaacaacagttcaaagtgattgaaagcctgatgcagaatgcagagatggtcatcaactgcggtgatgccggccaggaaggagaactgattcaacgttgggtgatgcagaaagccggctgtaaatgcccggtttaccgtttatggatatcatcccttaccgaagaagccattcgcgaaggtttccagcatctgaaagaacagactgaatttgccagattatatgaggccggattatcccgtgccataggcgactggttgctgggaatgaatgcaacccgattatatacaatccgttacggacagaaccggcaggtactttctatcggccgtgtccagacaccgacactggcactgattgtaaaccgccaggcagagatagataatttcaagcccgaaccttactgggagttgaaaaccgtctaccggaatacgaccttctccgcaaccaagggtaaattcaccaaaaaggaagaaggggaagccttcctcgaaatcgtacagcaggaagactttaccgtcaccgatatttccgaaaagaaagggaaggaatacgctccccgccttttcgacctaacctcgttgcaggtggaatgcaacaaaaagtttgcatttaccgccgacgatacattaaaactgattcagtcattatatgaaaagaaagtgaccacctacccccgtgtagataccactttcctgagtgatgatatttacccgaaagttccgaatacgctgaaagggctggtcgattataccgagttgacggcttccctgttgaatgccaagattcccaaaagcaaaaaagtattcgacaactcaaaggtaaccgaccaccacgccatcatcccgactggcgtacccgcccgtaacctgacggagaatgaacggaaggtatatgacctggttgcccgtcgtttcatcgccgccttttacccggactgtgaaatctccactacaactgtactcggtaaagtgggtaaagtagatttcaaagtaaccggaaaacagatattaaaaccgggatggcgcgtcgtattcggtgcggagcaaaaggacccggatgccgaactgaccgaggaagaaggcgtattgccggacttcaccaaaggagaaaccggaccgcataaacctttattaaaggagacctggacgactccgcccaagccttatacagaggctacattgctccgtgcaatggaaacggccggtaagctggtcgataatgacgatttgcgtgatgccttgaaggaaaacggtatcggccgcccttccacccgtgcagctatcattgaaacgcttttcaaacgtaactatatccgtaaagaacgaaagaacctgttccctaccgccaccggaaaggaattgataggtacaatacacgaagagttactgaaaagtgccgaactgaccggtttatgggaaaagaaactgcgtcagatagaacgtggaacttatgaggcaaaaacattcctggacgaactcaaacagatggtccaccaggtagtcatcaacgtcctttccgaccagtccacccgcaccatcaccatcgaggaggccgccaaagaagcaccgaaagaggagaaaaaagaaaagaaaccccgcaagccgcgtgcaaaaaaggaagaggctcccaaagagaaagcagtcccccaacaaccggcaaaaccggtttgccccatctgcaagaaaggaaacatcctgcgaggcaaaacagcctacggttgttccgaatataagaatggttgtacattccggctggattatgcgacttatggggaagggttatcggatgaggaacttatttctgtaatcaatcaaattcagaaagaataa

SEQ ID NO: 1189 - DNA, 2775 bp, Parabacteroides goldsteinii
atggttaagttctattcttctttattcatatttccgatatttttattagctgtccgggggattgaagggcaagcgcaggtcgctccgttaccgacggatacattcaggatggttgtgcctgattccatacggctggatgatgagatagccgttggatatgcaacggggaatcagcggaccatgtccggttctgttgataaagtttccgaaaaacgtatgaacaagggatttgtctccagttcgctgaacgctttgagcggacaggcggcgggggtcagtatctctaccggagcaaacagggcggctgcactgagtgctgtccgggtgaggggaacgacttcgctgaccggagggaacgacccgctggtcattatcgatggcgtttcttccgacctgaatacgcttagttccatttatccggcggatatcgagagtttcactatcctgaaagatgcttccgagacggcacaatacggttcgcgtggtgcttcgggggtgatcgaggtggcgacgaagaaagggaaaggcggcgctttcagtatcagttacgatggtagtttcggggtggaggctgtctataagaatatgaagatgctgtcgggagacgatttccgggcggtggcttccgaacgtaatatcgacatactggatctgggttataatacgaatttcccggatgaaataacccggaccgggattgtgcagaatcatcatatagctttgggaggaggctctgaaacgtccaactatcgtgcttccctcggtgttatggaccgggatggcgtggtacggacaaacgatttccagaactttaccgttaaactggatatcgcccagcgtgctttcaatgatcggttgaagatagacctgggtgtcttcggttccctgcaaaagaaccgttatctgaatgatatccagaagactttctattcggcagccgcgtttaatccgacattcccgaaccatcgggacgagcagaccggagcatggaacggggtaaccaatgccagccagattaccaatccgcttgcctggctggaggtgaaagatgatgattcgaatgcccatttcaatacccatctgaagtttacggtcaacctaagcaaacaggttaagttttcagccttcggttcctatacatataatataatagataactcccagtatctgccgaccacggtatgggcgcacggacaagcctataaaggagagaggaagatggaggacttgttgggtaatttgttgctgagttattcgaatgattggggaaagcatcacctggatgcgcttggactggtggaagctcagaagaatatcctgaccggattttatacgactgttacgaatttctcaacggataaattcggatataataatttgcaggcaggggccgtacgtctttgggagggaacgaactcttattatgaagacccacggttgagttcttttctgggacgtgtcaactatatgtatgccggaaaatatgtggcgacggtcaatgcccgtgcagatgcttcctccaaagtcggcaagaataataaatgggggttctttccttctgtctcggctgcctggataatcacggaggaggattttatgaaacagttcacttttctgaataatctgaaactgcgtgccggctacggtctttccggtaatcaggatgcgatcgattcttataactccctgcaactggtgaaacccaatggcgtggtatcggtaggaggtagcccgacggtaacgatgggcgtaatccggaatgccaaccccgatttgaagtgggaagtaaaacgtaccgtgaatgcaggtatagatgtcggtttcttccgtaaccgtctgttgatgactgtcgattattatcattcgaagaccagcgatatgctttatctttatgatgtgagcgttccgccttttgcctacaataaactgttggcaaacctcggttcgatgcggaatagcggtgtcgaactgggtttcggcgttactcctttgcaaacgaaagatatggaattgagcatcaatgtcaacgttactttccagcagaacaaactcctgtccctgagcggtatgtacaaaggcgaacagatgtcggcaccggaatataccagtatctccgatctgaatggcgctggtttccacggaggttataaccatatcgtctatcagattgtcggacagcctttaggtgtcttttatcttcctcattgtaccgggctgacacagcaggaggatggtagttacagatatgagattgccgacttgaatggcgatggtgtgaatctggaagatggcgaagaccgttacattgccggacaggcgactcccaagacgatgctgggatcgaatatcagtttccgctacaagcagttcgatgtctctttacagataaacggagccttcgggcataagatatacaacgggacttcccttacttatatgaatatgggcagtttccccgattacaatgtgatgcaaggtgctccggagcagaatataaaggatcagacggcaacggattactggttggagaaaggtgattacatcaactttgactatctgaccgtgggatggaatgtcccgctgggcaagtggaagaaatatgtgcagaacctgcggttgtcctgttctgtcaataatctggcaacgatcaccggctattccggtctgactcctatgattaatagttatattgtgaataatacgctggggatagacgataagcggaattatccggtttaccgttcttatacggtcggtttgagttttcaattttaa

SEQ ID NO: 1190 - DNA, 3093 bp, Parabacteroides goldsteinii
atgaaaagacagcagggaattatagaatgggccatgcattattaccagatcaccttattggtgctgaccgtcttggtcggtctgggaatttatggcctggtaaatatgccgaaacaggagtttccggaatttaccatccgtcagggtgttgtcgtgggtgtttatcccggggcgacttctgctgaggtggaggaacaactggcaaagcctttggaacgctatctttatacttttaaggagataaagaagaagaaaacatattccatgtcgcgtgacggaatggtgtatatcatggtggaactgaacgatgaagtgaacaataaggacgaagtctggtcgaagattaagctgggtttgcagaacttcaaatcgcaattgccttcgggtgtcctggctgtcattgcgaacgacgacttcggtgatacctccgctttgttgattacgcttgaatcggaagataaaacatatcgtgaactggaggattatctggaatcactggaagaccgcctccgtcgtattgagtctgtttcaaatctgcgccgttacggcatacaaaaggagcaaatcagtgtctatctcgacagggataaactgacggcttacaagttggatacccgaatgttgatgacgacacttttcacacaaggatttactacatcgggaggctcgttgaaaagtgaagacctcgatattccgatccatttctcgaacacctatgcttctgaaaaagagatagccgaccagattatcctggcggatggtgacgggaatataatccgtctgaaagatattgcacgcatagtccgtgaatatcccgagcctgacagttatataatgaataacggaaagaaggctatcatcctttccatggagatgcgggaaggcaataatattgtacagtacggaaaggaagtggataaggtgctggcagctttccaggaagagcttccggaaagcgtgtccattcagcggattgcggaccagcccaaggtggtggatgattcggtgagttcgtttgtgcgtgacctgtttgtctccatcgtggtcgttatcctggtgatgatgctgctttttcctttcaaatcggctattgttgcggctacttccattccgattagtatttttatatctatcgggattatgtatgctgtcggcatcccgttgaatacggttacattggctgctttaattgttgtgctggggatgattgtggataactccatcattgttatagatgcttatctggaacggctggataacggaatgtctcgttggcatgccgcagtatcgagtgccaagaactatttctcttccatctttctggcaacgctcagcctttgcattatcttctatccgttgctgtttacgatgacggggcagatgctggactttctgaactggttcccctggacgataacgatttcattgatgacctcgctggctatcgccatgatatttattcccatgctggaacacacccttatcaaaaagggattgaaaaacgggcagaagacggacggaaagaaacgtttcaacttgttggatacggtacaggctgtctatgaaaaggtacttgaatggacttttcgctatcccaagacaacgttgtttatcggggtattatccgtgttgctggctgtggtgattatgatgcgtatcccgcaacgaatgatgccggaagcagaccgtgaccagtttgctatagagatttatttgccgcaaggttcgtcattggataaaacggcagccgtttgcgacagcgtatatgctttattgaaagatgacgaacgggttttgtcggctaccgcatttgtgggaatggcttccccgcgtttccaggcaacttatgctccgaatatgggtgggaagaattatgcgcagtttattgtaaatacaacatccgtagaggcaacggccaacctgctggatgaatatgccaatacttatgccgattattatccgaatgctttcatcaagttcaagcagttggattatcagactgtgagtttcccgatagaagttcgctttatgggagatgatataacggccttgaagcaggtggccgatacattgatgacatcgttgcaggatatggatggcctggtttgggttcatacgaattttgaggagatgctgcccgaagttcgtgtaacgcttgaccctgtggagtcgtcccgcctgggaatttcgaaagcgatggcggcagctgatatggctatccgttataacggtatgtcggtcggttctgtctgggaaggcgattatccgttggctatctgcctgaaatcggataaaggagaggatgcatacgattcgtttgatgggataggggatgcttatttgccgacggctgttccgggtgtcagtgttccgcttcgccaggtgtctgagatacagggaggatggaatgaagggcagattgttcgccgtaacggagtgcgtacgttgagtgtgattactcaggttaagcgtggctttaatgaaacgaatatgcagaagaaggtagaaaaggtgatgaacagccgggtgatacccaatcttccggagggcgtatcttttgaatacggaggtgtaaaagagtctgacgaggaaattatcactccgataatagaggggctttcgattgccgtcattattgtcttcctgttcttgctgataaactataagaaaatcggattggctgttgctaccctaacttctattttactgtgcctgttcggagctgctctcggtctttgggtgtccgggatggagttcagtatcacttgtgtgttgggtataatcagtttgataggtattgtggtacgtaatgcgattatgatattcgaccatgcccaggatttacgtatcaatcatcacatctctgtcaaagaggctgccatggatgccggtaaacgtcgtatgttaccgattttcctgacgtcggcaacaactgcggtgggggttgtcccgatgattatcagtaacagtgccttatggacgccgatgggagtcgtgatttgttcggggacagtatttgccatgatattggccgttattgttattccggtattttactggatgatattcggagggaataaaaaagtcgtataa

SEQ ID NO: 1191 - DNA, 2376 bp, Parabacteroides goldsteinii
atgaaaactattttaagaaactttgtcagcgtgcttcgccgtttcaaaatggcgatgttgctgaatgtatttggattaagtatcgcttttgcagcttttatggtgattatgatgcaggtgaattacgactacacgttcgattcctgccagccggaagctgatgcaatctaccgcatggacatggactttcagggaaaagcgagtgccgtcttcagccgtccttttgcgagaggctttacagagtcatcgccccatattaaggccggcatgattatggcgtcgtggaattccgaacttttttatagtgtcgaacggcaaggggagaggctgaatttccaggacccggttgtgaatgcttcgcccgggattacccgtgtctttcatttcgatatggtggaaggagatgaaacggcgctggatcagccggaaactgccatcattcccgaaagtatggcgcgtcgcttgttcggatacgagtcggctataggaaaacggctgatgaatgtagagacgggaagtacggtagcaacaataagcggcgtctttaaagatttcccccttaattcttccatccggaatattatctaccggcagatgcacccgaaagaaaactacgatacttggaataatcagaattatttcttctttttccgaatggatgatcctgctaatacgaaggatgtgaaagaaaactttatgaagaattttgatgcatcccaacagttcggtaaggattttgactgggagaaagatggtattgacctgcgtatcacaccgcttcccgagctacatttcctggaaaatgtttctttcgactcgatgccgaaggccagccgtcagacagtgcgtgtcttgtttgccatagcttttgtcatcttactgattgcgggtatcaactttaccaatttcagtacggcactgacaccgatgcgtattaaaagtatcaatacgcaaaaagtgttgggaagtccggatagtgtgcttcgtttgagtttgctggcggaggcgattatcgtcagtgcagtggcttatctgatttcgctggggatattgtttatagccggtaagacttttatagcctctttggtggatgccgacatggctttttcggcacagtcgggagttattactactacggcggttattgctgtggctgtcggtgtgttggctggcctttatccggcctgttatattacctctttcccgccggcactggtactgaaaggcagtttcggactgtctccaaaagggaggttgctcagaagtacattggtcagtatccagtttattgcttcatttattctgattatcagttccctgttcatgtttttgcagaaccggtttatgcagaatacaccgcttggatatgacaaggacgaattgatcgtgatggagctgaacggtaaggtgaataagagccaggatgtattggcgagtgaggtaaaaacattctccgggattgaagatatcacttttgccgaacaggttttatcgagccgggacttctatatgggatggggacgcgagtataaagataaggatattaactttcaatgtatcccggtgtctccttctttccttcgtgtaatggggattaaagtgaccgacggacgcgattttcgcccggaagatgacttgaaagatacgggatgctatatatttaatgagaaagcccgtgagatgtacgatctggaactgggggataagattgacggtggcgagattattggttttatgcctaatatcaagtttgcttctttccgcaacgaagtttcaccaatgactttctatgtctggggaaaatactattggggaggggaagtcgacagtaaatattatgcagcagcctatgtcagggtaaaggccggcagtgatttgcgtgcggcaatgaaacatattcaggcttcattaaaaaagatcgatccggtttatccttttaaagtctctttttatgacgagatattacaacgtacctatgtaaaggaactgaagatcagtaacctgatcaccctgttcagtgtcattgcgatcttaatatccatagtgggagtcttcggactggtggtgtttgagagtgaatacagacgtaaagaggtggctgtccgcaaagtattaggatcgtccactccgcaaatattggtactgttcaacaggagttatctgattattctggttatttgttttatcttgtcggctcctgtggctttctatggcgtatatcgctggttggagaactttgcttaccgtactccgatgtactggtgggtatttctggcagcctttattattgtttcggttatcacctttataaccgtaactttccagaactggcatgtcgctaattcaaatccggtggagagtataaagtcggagtga

SEQ ID NO: 1192 - DNA, 2439 bp, Parabacteroides goldsteinii
atgaataaaataacaataaataagaacgatatgattaagcattatataaaagtagccatccggttgataaaacggagttttctgttttcatctatcaatatgctgggtttcgtgctgggaatgacagccgctttcctgatctatctctggatagtggatgagctgacattcgaagatttccacaggaaccgcgactctgtctaccgggtgattgccgtagaccggaaagacggtggggaaatgaaagaatcagcttacacggtggccccgttgagtaaagcattacgggaggagttcccacagatggagaatgcaacctttgtgctcaacttcggtatgctgaaccttcattcgggagcaaatctgatcgaagcgaagtatacatttgtggatacggccttctttgatatgttcagtttcccggtgatagcgggcgatcccgccctgatgaagaaagacccgcagcagatcgtgctggcggagtctacggcaaagaagttgttcggagattctccggctgtcggtaaagatgtcacctgtcagtttctggggcaagttcaccgttataaagtggcggcagttctgaaggtgccccgtaaaagccatatccggtttgaagtgttgctgagtgaacaggcctattttgaaccgctgagctgggattttgcggaaggaacgaatgtatatatccagttgaggaaaggcgccgtattgtcggaagctgaccggaaggctatgggccgtacctggataaatcagcgggaagacgggaggccgttggagttccagccattgaaagatattcatttacatacctcatttaaagacccgtcggtcgataattacggaaatatgtcgcaaatctggttgtttatggcgttggccctgttgattatttttatgggggcattcaactttaccactttgtcgactgcccgtgcatcgctgcgttataaggagatcggtgtccggaaggtgacaggggcgaaacggaagatgctgattacgcagttcctgtccgagagtctggttcaggctttcctttcgctggtcctggcgttggcactgacggaattgttgttgcctttcttcaaccggtttgtcgggaaagatattgttttgttgtttaactggcagactatgttatttatcctgttcggtataataggagtcgggagtctggcaggagcgttccctgctttctatatgtcgtcgttcaaccctttgctggcctttaaaggcggaaaggcaaccggccggaaagggacgcttatcaaaggcttggtgtgtgtgcagtttgtcattgccattacgatgcttttttccacttcggtagtcttccgtcagcttcattacctgcaaaatgcagacctcggactggataaggaagatatggtcgtcgtggattgtgatgtattcgaactgatggcctactacggcaaccagggaatagatgattataggcaggaagtaatgaaaaatccgaatgtcgggaatgtggcgggaggcgtggacttgtcgaattaccttcggggacataagacggaagaagccgttttcagttggatgggtgaaaacggacaggtcgattcgctgaaaatggtcggtgttgtgggggacggcaattttatgaagacattgggagtgaccttgctgaaaggcgaatctttcggtgccgacaagaatgcctatatggatggcacttatcagaaggagtcgccggtagtcattaatgaaaccgcctggaagatgatgcaggtgaaagacccggtaggcatggtcgttcagaataaaggatggttcggggagactgcgcggattgtcggtgtggtgaaggattttcattttcagtcgttgcgtgaggaggtcaaaccggcttacatctattattcccgtcaattattgaatacaatgtatataaagatatcacccgagaataaggcggggacattgaagttcctgaaagagaaatatgaagagatgcgcccggacaatgtattttcctaccgtttcttttccgatgcgttgaacctgaattatgcccatgaacagcagttgagccggatgtttctgatctttacggtcctggcaatcgttgtcgccatgatgggcgtactgggactggttgccctggcaaccgcacagcggacgaaggaaataggtatccggaaagtgaacggtgcgcattccgaccgcattgtccgtatgttttgccgggaatatatgatttgggtgggaatcgcctttgtggtagcctgtccggtcggttatcttctgatggttcgctggctgagtaattttgcctatcagactcctatcagttggtggctgtttccgctggcgggactgattatcctgctgataaccttcctgacagttgtagcacagacctggcgggcagcttctcggaatccggtggagtcgttgagatatgaataa

SEQ ID NO: 1193 - DNA, 2721 bp, Parabacteroides goldsteinii
gtgaaatacttcctatccatattattccttttatgcctgttgcttgccggttgcgaccgtgccgatagggaaaagaaatatgtgataggaatttcccaatgtatgctggatgatgcctggcggcagcaaatgattcgggaggtggggattgaggcatccaattatgatagtattaaagtccttattaaggatgccgataatgataacgaccgacaaatcgaacaaatacgcgaactgattgcacaaaaggtcgatgtcctgattatttcacctttcgaatcagcgccgataacagatgtggccgaagaagcattccgtgcaggcatcccaacgattatcaccgaccgcaaagtaaacacgaaccagtataccacctttgtcggagcgaataattatgatctgggttttgccgccggaacatatgctgtcaaacatttactgcctcatgccactattcttgaaatttggggaatgatgggttcttctcccgctcaggaacgtcacaacggttttcgggatgccttgcaggaacggacggatttaacctttcgccccgtggaaggcgactggcggtatgatgtcgcagccaaacgcctgaaagagatagacttttcacaacccatcgactttgtatatgctcataacgatatgatggctattgccgcccgtgaacattttctggcaatagacccggtgcgtggtaaggagttacatattataggaatggatgccgtggccaatgccggactggaagcggtggcggatggacggattaatgtctctttcctttatccaacgggcggtgaacaggtgatacggaccgccatgcagttgcttagaggggagaaggtggataaatatattcctttgttgagcggtttggttgataaatcggctgcccagaccttgttgcttcaatctgaacggttgagcaattatcaacaacgtatcgagacacagcggagccgtatggatgaattgctgaaccgttttaattttctccgggattcattgagtgttatcacgcttttgatggttggcttcatttctttgtcggtctatgtattctatattaaccgtaagatacggctaaaaaaccgcgaattgcgtgagattaataagaaagaggaagaacaacgccgtaaactgatatccctgaatgcggagatagaagaggtgacagcctccaaactccagttctttaccaatatatcccacgaagtacgtactccgttaacactgatattggggccgttggacaggttacttaacttattgcacgattcgccctacctttcagacctggagttgattcataagaatgcggggcgtttactccgcgtcatcaaccaactattggatttccggaaggtggagaataagcaggagaaactgaagatacgtgagacggaaatcgtttcgttcagcagtgaggtgaagtcatatttcaatagtatggcgaaggtgcgcaatattacctatacttttgcctcggacatgaagaactgccgtatctggatggatgcggatatgattgagaaggttttggtgaatttgttatccaatgcatttaagtttacggccgaagggggaaagattggggtagcgctggaagagtcggacgaatgggtgacgatacatgtcgaagacaatggctcgggtatccaaccggagaatttgccttatctcttcaaccgtttctattcggagaacagccgggtggggacaggtatcggtttgcatctggtccatgaatatgtaaagatgcataacggagaggtaacagtggaaagtgtccccggacagcgaaccgttttctccgtttgccttcggaaagataagacgcagctgaacggcgaatatatcacggaactgcctgtttcccatttggcgtatgatgcttcgaacctggatgattccgaagagaaaacgttgttggcacagacatatccttattccgttttggttgttgaagacgatgatgaggtccgtgcgttcctggaaaaggaattatcggagaacttccgcgtatttaccgctaccaatggaaaggtcgctttgaatcttcttcaggaggaaaatgaaatatcgcttgtcttatccgatgtgatgatgccggaaatgaatggcttcgaactttgccgcagtataaaaacggatatcgccatcagccatattcccgttatcctgttgacggccttgtcggatgaacgtcagcgtatgtatggcatatcgggcggggcggacggttatatccagaagcctttccatgtgaactttgtaaaactccgtataatccgtatcctcgatgaacaaaaaaagttgcgcgaagcatttctgaaaaagctgcaaagcagtaatatgctgatggcgcaaccggagaaggtggagaatatggatgacctgttccttcgccggttcctgacacagattgaagagatatataccgattctgaatttaatgtggagaagttgagtgatacgctcggtttgtcgcgcggccatctccaccgtaagataaaagacctgaccggaaccagcccggtcgattttctccgtaactaccgtttaaagaaggctgccgttcttctgaaacaaaagcaatacaatatcaacgagattgcttaccgcacaggcttttcgtctcccgcctattttgccaaatgctttaaggccgtttataaccaaaccccgaaagagtatcagaatacatcagaatag

SEQ ID NO: 1194 - DNA, 2895 bp, Parabacteroides goldsteinii
atgaacaacgttgttcgtgctatcggaacagcattgttcatgcctcttgaaaaaactggttttttatggcattttcggagatactcatttaaagaagaaataataaatatgttgaagttttttttatctatatgtataacactgatgttgctgacttcttgccaaaagccatcgtcagagatttctttggcaggcaagtggcagtttgccatggacagtacggatgtcgggataacggagaaatggtttgaacgttcattttcggataaaatacagctgcccggaacgactgatgaagcgggatacggcattccgaatacgcttcccccttcagtggagaagccgcagattcttcatctgactcgtaaaaacagttatgtcggtccggcctggtattcgcgggaagtatccattccatcggattgggaggggaagtctatagaactaaaactcgaacgtgttatctggcaaacttctgtttgggtagatgataaccctgtgcagggaagttgtgaaagcctgataagtccgcatcgattcgatctgaccggttatctgacgcccggtaagcacaaactgacgattcgtgtggacaacaggaaacaacatgatattactgtaaacgatatggcacatgcttataccaacgaaacacagattatgtggaacggtataatcggcgatatctctctgatagcaaaagaagccctttccatcgaagatttgcaggtttatccggacgtatcaggtaaacaaatccgtataaagggaaaagtttccaatacgggtgaagctacagaaggttcgctctcgataaaggtggaaaatcaaaaaagtggattggtcgtatctgcccttaaacaaaaagtggattttcaatcaggcgaaaaccttgtaaatctgacctgttcaatgggggactcgatagaaatgtggaatgagtttaaccctgtattatataaagtggatttagaggtgaatgcaggttcggttaaaacggaaaggagtacaaagtttggcatgcgcgaattcagccggaatcaatcggacctgctattgaacgggaataaggtctttctgcgaggaacactcgaatgttgtatcttcccgctgaccggacgtcctccgatggaaccggaaggatggaagaaagtgttccttacggctcgcgaatggggggtgaaccatctgcgtttccattcctggtgtccgcccgaagctgctttccaggtggcagattcattgggattctatttgcaggtagagcttcccctatggtcggtaaaagtgggagaagattctcatacaaatgacttcctgtatgctgaagctgaccgtatacttgcagagtacggcaatcatccctctttctgtttcttcagtctgggtaatgaactgcaaccggattttgaattcttatcccgattgttgaagcataccaaagaacaggacccgagacatttatatacaaccacttcttttacatttgaaagaggacatggagactggcctgaaccggatgacgatttctttatcacgcaatggactaagaaaggctgggtgagaggccagggggtattcgattcccagtctccttcgtttgacaaggactatatcgcttctgtcgaaggaatgaatgttccgcttgttactcatgagatcgggcaatattctgtttttcctaacctgaaagagatagataaatataccggagtcctggatcctttaaactttaaaggcgtaaagcaggaactggagaaaaaaggcttattggataaggctgacgattacctgaaagcatccggttatctggcggctatcttatataaagaagagattgaacgtgcgatgaaaacggcaggttgcagcggtttccagttattggacctgcatgacttcccggggcagggaactgctttagtcggattgctggatgccttttgggatagcaaaggtgtaactgatgcagaaacattccgtcaggcctgttcgccggtaacacctctggttcgtttcccgaaagcagtttatacgagtggggaatcttttacggcgtctgtcgaagttgctaatttcacagataaagaactgaaagatcagtctgtttcctggatactgaaagatgaaaagggaaaagaaataggaaaaggcatgatgtcctgcccttcgctgtcaatcgggttgaatagattgccggaagcgattacctgcccgttggcgcagcaggaagcagctcggttactcctgtccgttgctttggataatactccatataagaatgaatggagtatttgggtatatccgtcccaattgaatccggtgaaggatgatgtcgttgttacccgtgatttacgggaaactcagaaggcgcttgcctatggaaagaaggttttatataatccggattataaaaagatagaagggttggaaggtaaatttgtccctgtattctggagtccggttcattttccgacgcaggcaggttcgatgggaatcctttgtgatgcgtcccatccggcattcgcccatttcccgacaggcaattataccgattggcaatggtggtcgctgctgaagcaatcaaaaacgattgttatggatactttgccgtccgtgactcctttggtggaagttgtcgataactttgctaataaccgccgtttgtcaaacctgtttgaagcaaaagtaggtgaaggaaaattgcttttctgctcaatggatatattgtcggactgggaacagcgtccggaagcccggcagttgtattttagtttgcttgaatatatgaaaagtgattcgtttgatccgtcaagtgcgatggaatcggatgttttggctcaattgtttaaatccggcctctcttcgggagcaagtaatccggaagatatttattga

SEQ ID NO: 1195 - DNA, 1908 bp, Parabacteroides goldsteinii
atgaatttgccaaacggatatcctcttcaaaacggaaagtatcgacttactcatgtagttggtcagggcggctttggtataacttacaaaggcgtttggtatacagaagttaagggaccgctaggaacgatcaaaacggaagttcctatatgtgtaaaagaatatttttttaaagattactgttacagagatcctgactctttcgctgtcaaggttcattctgaaacgggcagggttctttttgagaagtttaaagagaaactgatcaaagaagctaaaatcctgtccgatgttcatcatccccatattgtgaatgtattggaagtgtttgaagaaaatgacacggcctatattgctatggagtatatttcaggtaatagtctgaaatataagatggataaggagggcataatgcctgaagcgagagttctcagatatatgcgtcagataggagaggcccttcagtttgtccatgagaagaatattcttcatctggatatcaaacctagcaatatattgattgatcaggcagggaaagcgcgtctgattgattttggtgtgagtaaacggtatgatatcgagcagcaggaaacgagtaccacgatgttaactttatcgaaagggtttgcttctattgaacaatatgataatgaaggtacgcaaagtttttccccttgcccggatatttattcgttaggagcaaccatgtataatctgctgacggggaagattcctacagaatccattcttcgtgcagcacgtccgttgccttccccccgggatttgaatccctccatttctgcaaaaacggaagcggctattatcaaagcgatggagattgttccggctgaccgtttccagtcaatgtcggaaatgctggctgcattggattttccggaagttgaagaagaggagataaagaaagatatttcttcccccgaatatttcgaagaagatgagacaacgattctgtttacgacccgtttgccacaatccggaaaggatgaaggggatgagactgtactgaataacgtcgatataccggcagtacctaaaaagaaaaaaagaaaagtaacgttaatctctttactaattattatatttgcaagtataggttcagcggtggctcttttggtacagcgcagtaaagctgttcctcctgttgctgaagttttgaattctgttccggaagggaataataatcctgtatcagattcgactgttcctgttgttattgacgaaaacaatacatcgggagttgttgaagcagaacctgaaactgaatctgaatcgaagaaagagagtaccggcgttcgaccggactcacaggaaaagaagattgttaaaccggaaacgactccgaaacagaccgatcctgtaaagcagaaagtcgaacctgtcgttaacgatataaagcagccggtaacagcaccttcagttcctactgaagcagagatgaatgcagagtttgaagcattgatcgcttccggtaaaaataaaatggcagcatcggatgcatccagtaatgcggctgattttataaaagcaacagaggagattgccgatgccggtactgatttcagtaaggctgccaagatcaagatgacagatgaattgattagtctgattgaaaaacgtaaagtcaaagaagaagagatacttttggctggcagaaaagcactgtatgatgaagtgaagccttttggggaactcatgatcgttcagaaaaaggagacacaaaagtttggagctatcgatgccaatgcgagagaacgtatcaaatgtaagtatttggctgcctatcaaacccagcaagggtatagggcgtttcttagagaggatgatctgttcgatatttataatgcagaaggtataatgattagtgaacgtttaccggattattattaa

SEQ ID NO: 1196 - DNA, 2418 bp, Parabacteroides goldsteinii
atgaaacgactctctgtaattggcagactagtgctgctttttgccttcgcgctggtttttcaggccagggcccagcatgtaaatctgaaaacccgttccacccagatagggataaacaatgaaggttacttttcttctatccaggtagaaggcaaggatattctccatacgggtaaatatccgctcgtaacggcctgcacggacaacaaactcataacaccatccaaaatgagtgccaacggaaaccaacttaaactaacgatgtccgacggcggcacaatcacactgaaacataaggaaagcgatgtctgcatcacattggaggtagcaaatatcccggaaaaatacgacgtattactgttcggcccgttagctgttacgatcaatgaagttgttggagacgtggtcggtgtcgcacagggtaacggcgttgctttcggtatacaagcgctgaacattaaaacgaatgccggtatccctgaggaatacgggcaattgattaccagcacatacggttataaaggaaaatctgctgaactgtcggtagccagcatcccggacttcaaactggcagccgccgatatttctgacgggacggtattccatttctccgcccgcagaagaaacaaacaggaatatcgcaaagtacagcaaatacagaaatcactggtccttccggtcgaaggggaagacggactgataaaaggttcaaaaatcgctctcttcggctgtaagaatacagatgctttagcccgtatcggcgagattgaaatcgagcagggacttccccacccgatgttcgacggcgaatgggggaaaacagctcgcgcagccatgaaatcttatctgatctctgatttctcggaagacaattttgatatgatcctggacaaggctaagattgccggtttcgaatacgtttaccatagtggcccgttcctggactggggacatttcaactgggaccccaaattcaccaaaggcggggatgaaggcgtaaagaagatggtagacaaggcaaaggcacagggtatcgctgtcggtgtccataccctcagtaacttcacgactacaaacgacgcctatgtaacaccggttccttccgaccacttgctgaaacaaggcatactcaccctgacagccgatctgaacaaagaccagaccgacattacaatcaaaaagtcagacctgttctccatgccgatgacgctcaacacccttcagatcgacaaagagctgattacttacggcacaacagaagaacagggagaaaacatcctgctgaaaaactgtaaaagaggtgcctggggaacaacagccgccagccattcacagaaaacaccgctgtacaaactctgggactacccttacaaaaccctcttccctgatctggtcctgcaaaataaatacgctgaccgcctggctgagataatgaataaaacaggtatccgccagatatccttcgacggtctggaaggatgttcctacaccggtcaggacgaatatgcaaacaaccgtttcgtctatcgcttctacaatcagctcgaccagaatgtgcttaacgatgccagccgcctcagccataacttatggcacatccacactcgtatgaactggggtgaaccctggggcgaagcgatgcgcaccggtcaggttgaaaatcgtatcaaaaaccagtcattcttccaccgcaacctgttcccgcgtatgctaggttggttcctgatccgtctggccgaccgtaatttcgaatgttcttccctcgaagacctggaatgggcattatccgaatcagccggtttcgatgccggttatgcgatgacaatcaacagtaacacactgcgccgtcacggacaaatcgataaattactggaagcgatcaaaaactgggataagctgcgcgaagcagaagcattcacggacgagcagaaagtccgtctgagagacccgcagacagaatggcacctggaaaaaacagacgaacagaactacaacctgtatccgctctatatatccaaacatttccgttgcaacctgtccgaaatgcaaccgggacaaccgggcggtgccgactggtcatggagcagtccttatgaaagcacatatgccatccgtctgaaagtagatggagacggaaccatcaaagacccgtcattcactacgcctcaaggagtgattaagttcccatgcgagattgcagaccgccagtatctgctttacacattcgacggcaaggccgtagtaaccgataagaactataatgtaatcagcgaagtgcagccccagggaaatgccgtacttcccgcaggctcatcagccgtagccttctcctgtgaacagaccagtgaagacgctcccgaagtaatcatccgttacattaccaaagggactccggaagtgataaaactgaagaagtaa

SEQ ID NO: 1197 - DNA, 2556 bp, Parabacteroides goldsteinii
atggcacatttaaatcatatgatttatcaggtggctggcattgcggcggtaagtctgttgacagcctgttcgacgcaacagcaagatgttaacttgcaggaagtcggagtcagccatgaattggcccgtttcagaaaagagcatttcggtcaagtcagatataacctgtttttctccattcctgaatccaggcaggagccggtcaggggcaaggctgtcatacaactgtcgctgaaagaaaaactgccgcttattattgatttcaggggagatgcttcacaggtcgcttctgtcttgctgaatggtggggaagtgccttatgaggtaaaaaatgaacatattatcatcccggcagaacggagcgtcgtcggagagaataaagtatctgtagaatttactcctgccgaccagtctttgaacaggagggacgagtttctttatactttgctggttcctgaccgggcgcggactgcgtttccctgtttcgaccagccggatatgaagtcgttatttacgctgacgctggaagttccggaagcatggcaagccgttacgaacggtgccatagagaaaacagataccctatccgttcccggacgcaagttgatttcattcagggaaacagaaccgctgagtacttatttgttcgcctttactgccggaaaatttattcgcgaaacatacacccgggatggaagggaaatctccttgtaccacagggaaacagacccgaagaaagtcgcccaatgtcccgaaatcgcatcggaagtctttgacgctttaacatggctggaagattataccgccattccgtatccttttgccaagtatgatttgataatccttcccggtttccagttcgggggaatggagcacaccggggcaacgttctataccgaccgccgtatgttcctgaatgagaacccgacattgaacgagcagttgagccgcagtgccctgattgctcacgaaacggcccatatgtggtttggcgattatgtgaccatgcaatggtttgacgatgtctggacaaaggaagtgtttgccaattattttgcttcgcagattgtcgaaccgctatatccgggtgtaaaccatgctttgaatttcatgcaggattatattcctcccgcttatgtggaagaccgtactgccggagcaaatccaatcaaacaggaattggataatcttcgtaatgccggcctggtctacggtaacatcatctatgataaatctcccgtcgtcctggaaatgctgattaaaaagatgggtaaggaatctttccggaaaggcattcaggaatatctgaaaacatatgcctacggaaatgcctcttgggagggcctgattggtattctggatacatatacggatgacgatttgtccggctggagccatatttgggtaaatgaaaaaggcatgcctgagattgccgtttccattgtcggcgatagcctggtcgtttcgcagaaagacccttttggtaggggattgaactggccgcaggacctcacttatctgattgttcccaaaacaggggaaccggaagaaatttcagtttctttcgggagaaattcaaattccatccggaagaaattgaaaacggtcccggaagaggggagtttcattattccgaatacggatggaaaagggtatggctttttccggttgaacgaagcggatgccaaggcttgtgccgcctatctttcggtttgtgaaaatgaattgctgagaggttccctgttaatcacattgtatgaaaatctgttgaaccggacgatttcgcccgaatcatatatggaggctatgttgaattatctgccgaaagaagataattcgttgttattctcggccgctttagggtatatcggtaattgtcagcgtttatttccggcggatacagcgcttctggaaaaaacattaggacagattgtggcgacctcttccgttcctcaacatcgtttgcaggcgttccgttcgtatcgttccatagcagagtcgccggaagcaatcgccgcattatatgacttgtggaagaagcagcaagctcccgccggctgttcgttaagtgaaaacgattatatcagcttatcttatacgctggcccttcatttgccgaagcaggcggatgagattataaacagccagcaatcgcgtataactaatcctgaccggaaacgggagtatgcctttatttctccttccgtctcaccgcataaagaagtgcgcgacagtgtttttgcctctttgctggtagctgaaaaccgtcgggtagaaccctgggcatctgctgctttggcgaatctgaatcatccgtcacggcagaaagaagcggtagcctatatccgtccggcactggaagcgatgcaggaagtgcaacggacaggagatatatttttcccgacagcctgggttcgtgccttgctgtcaggccatacgtcgccggaggcaagggcagaggttgatgctttttttgcctctcacctggattatccgccgatgctggcaaacaaaatacggcaacaggcgaatcatttatatataattgaacactaa

SEQ ID NO: 1198 - DNA, 1725 bp, Parabacteroides goldsteinii
atgattaacaaatggaattttcaaaccccgacagaagaagaattacataagagagatgcgctggcagccgaaatcggtttcagcccggtcatctgtctcctgcttgttcagagagggattacgacggctgaagaagccagaaaattctttaaacccaatctgaacgatctgcatgacccgttcctgatgccggatatggataaggcggtgaaacgattgaacagagccttgggcaataaagaaaagattctggtttacggcgactacgatgtagacggcacgactgccgtatcgcttgtgtataagtatttaagaccctattcatcgacgttggattattacattcccgaccgctatgacgaagggtacggtatttcttataaagggattgattatgcctccgacaacggagtcacattaattatttcgctcgactgcggaatcaaagcaatcgaaaagattgagtatgcaaagacaaaaggcattgactttattatctgcgaccatcacatgccggatgatacattgcccgatgccgttgcggtgttggatgctaaacgtatagattccatctatccgtacgagcatctgtccggttgtggcgtaggcttcaaatttatgcaggcttttgccaaaagcaataactttcctttctccgaactggagaaattactggaactgacggctgtcagcattgcttccgatatcgtgcctattacgggagaaaaccgtatcctggcttattacggactaaagcagttgaacagtaatcccagcctgggactgaaaggtatcatcgacatctgcggacttaccgggaaagagataaccatcagcgacatcgttttcaagatcggtccgcgcatcaatgcttccggacggatgatgaacggaaaagaagcagtcgatctgttgctcgccaaagatgtagaatcagcccgcgaaaagagtgaaaacatcaaccaatacaatgacgaacgacgcgaactcgataaaaagataaccgacgaggcaaacgctatcatcgatgaattcgccaatatggaagaccggaaagcgataatcgtttacaatcccggctggcataaaggagttatcggaatcgttgcgtcgcgactgacagagaaatattaccgtccggcagttgtgctgaccaaatcatccgaactgatcaccggttctgcccgctcggttaccggtttcgacatttataaggcaatagagaactgccgtgacttgctggaaaacttcgggggacatacctatgccgccggcctttccctgaaagaagaaaatctggatgaatttaccgaacgtttcctgaagctggctgccgacgagattatccccgaacagatgatcccgcaaatcgacatcgacgccgttctcgacctgaaagacatcaataccaagttcatgagcgaactgaaaaagatgaatcctttcggtccggacaaccagaaaccggtattttgctcgctgaacgtaaaagattacgggacaagcaagctggtcggcaaagaactggaacatatcaagctggaactgatagacgacaaatcgaacacgcccatccatggcatcgctttcggaatgcaccagcacagcccgcatattaaagggatgaaaccttttaatatctgctatacgattgaagagaatacatataacggaaacacgaccttgcaactcatggttaaagacataaaggtcgatgacatatga

SEQ ID NO: 1199 - DNA, 3705 bp, Parabacteroides goldsteinii
attagacgcgcttataaatctcaatttttatgtaagtttgcctatgcaaaaaatacaaatcaaatagactttcatcgtatgaaaatgtgtaaacagcaaaaagtcccccgtatccttacgctctgtggagcagcagctacttcgttgttgctttgggggtgtagcggtgcaggggcgacaaccgaatcgttcgaacgttcggactactatacgcgtggtatagggcaataccccggtaacccgaaggaggatttctctcctgagttggctccggataagtcaaattatcgcaatatagcccttctgcgttcggctttcaactcctccagtcatgactataacctgacggcgcagttagtgacagacggtattgtgaccgaccagcaaccgcagtatttaatactatcgactccggcgggcgaagttccccggcgtgaacgcgaatggatgatcgacgaaggtccgtattcccggaatacatttgaaggggcggatacttatttccagttcgcgctaaagaattacagcaaacaagccgacaaattggtgctgacaggaactctcatttatgacgaccagttggcaaaagacggttacgaaattatctgccagggttccaatgacggacagaactggaccgaggtcggcaaactgagcggcaaaggattgccgggcgacgctgtacgttaccgtatgccggtaaccgacccgaacaagcagaccgaacagatttccatgccggtccgtaaactgaatgaaaccataacattcgataaagaggcgaattactccaattaccgtgttctattgaagatggctggtgcccatagctgggtgtttacggctgctgatttctataataaaggcggaatggtggaaatgaaaccttcccaattcttcaatagtgcctggatgagtgccactacgggagaagaatggttgtatgtagacctgggcagccagtctgaattcgacaaagtcgttttacgctggataaacaaagccgtaaaaggtaaagtacaggtgtccgataatgctgaacaatggacggatgtcgctgaacttcccggtggggaggaattggtcgatgaaatctcgctgaacggtaagaagaatgcgcgttatgtgcgtatcctgatgcaacagccggccaacgacagccgttatatcctgagcgaactggaagtgatgggtaaaggtggcctggttccgcagcctgtagctgcacctgctgcatcgaaaggcgaaatctatttgtccggtggcaactggaaacttcagcgtgcgtcagaaataacggctacgggagaagaaatatcgactcctggtttccagcctgaaaactgggttgttgccacggtgccgggaactgtcttgagcagttacaagaatatcggtgccattgccgatcctaactatgcagataatcagttgcagatatctgagtcgttcttcaactccgacttctggtatcgtgacgagtttgaggtgccggcagactttaaacaggatcgtgtgttcctgaatttcgacggtatcaactggaaggcgaatgtatatgtaaacggaaaacaggcaggccgcatcgaaggtgcctttatgcgtggcaagttcgatgtaacggacctgatcgttccgggtaagaatgtggtagccgtagagatcatcaagaaccagcatatcggtgctatcaaagagaagaatgcacagagcacggacttcaacggcggtatcctgggggctgataacccgacattccatgcaacgatcggctgggactggatcccgacgatgcgtggccgtaatatcggtatctggaatgatgtcttcctgacaacgaccggaaaagtgacggtagctgatccgcttgttaaatcggtgttgccgttgcccgatacgacctctgctaaactgacggcggaagtgatcgtgaagaaccatgatgcaaatgcggtaaaaggtatgctggaaggcaagatcggtgatatcacattccaacagccggtggaactggctgcgggcgaagagaaagcggttgtcttcgatgcaaaggatttcgctcagttgaatgttcagaatccgcgtctctggtggcctaaaggatatggagagcctaacttgtatgatgccagcttcacatttaaaatagatgataaggtatcggatgccaaagactttaaagtcggtatccgccagatgaccttcaatgaggataatcagattttgagtctctttatcaacggccgtcgttttgttggccggggcggtaactggggattcagtgagtctaacctgaattaccgtgcacgtgaatatgatatcgcggtggcttaccatgccgatatgaacttcacgatcatgcgtaactgggtgggtatgattggtgatgaagaactgtatgaagcctgcgaccgccacggtatcgtggtttggcaagacttctggctggcgaatccggctgacggtcctgatccttactatcccgaaatgtttattgccaacgcggaagattatgtgaagcgcatccgtaaccatgcttccatcggtatctattgcggtcgtaacgaaggtttccctcccgaacagatcgacaaagcgttgcgccggatcatcaaagaggatcattcggatatacattatatatccagttcggctgatgatgtagtaagcggtcacggtccgtaccgtatgcttcctgcaaaggaatacttcacattgaagaccggtaacgacaagttccatagcgaacgcggtatgccgaatgtgctgacctacgagagtatgctccgtaccttctctccggaaggtatctggccgcaggataatcagtggggtatgcacgactatacccgcgaaggtgcacagggtgctacttctttcaacgagattattgcgaaaggatacggcgaaccccgtagcgccaaagagttttccgaactggcacaatgggtgaactatgacggtcaccgcagtttgttcgaatcccgcagccagaaccgtaaaggtttgctgatgtggatgagtcattcctgctggccttctatggtatggcagacctatgattattacttcgaaccgacagccgcctatttcgctatcaagaaggcttccgagccattgcatatccaatggaacccggtaaccgatgaagtagaagtcgtaaactacagtggtggcaaccgtaagggcttgacagctaaagcacaggtgctgaatatggatgcttctgtagcctgggagaaagaagttgctattgacagcaatgaagatacgaccaacaaatgtattcagctggaattcccggataacctgtcgaaggttcactttatcaagatggtcttgactgaaaacggaaaggttatttccgagaacttctatcacagaagcctggaagaaaacaactaccaggatctgcgtaatctcccgaaagtggcattgaagtccgatgtcacgacaaacaaaggaactgatggaaactggaacggcacagtcgttatcgagaatactacttcaacaccggcattaatgattcgtgtaaatgtagtaggtgacaaggatggcgagcagttccttccgatgttctattccgacaactacttcgctctgcttccgggtgaaaagaaagaaatcagcttccgctggaaagacgaagataccagaggtaatgcgcctaaagtggttgtgtcaggatataatgtaatgtaa

SEQ ID NO: 1200 - DNA, 2157 bp, Parabacteroides goldsteinii
atgaaaaacaaattatttcttttaatctgcctgattgttatatctatatcgttgaaagccaacgataaaacaattattcctattacaacagacaatatcagtctgatttataaagtaggtaataacgggcgtttgtatcaatcatatgtagggcaaaaactccgttttgatagtgatatcgaccagttgcctatgcttggcgaggcttatatcacacatggtatggaagattatttcgaaccggctatccggatattgcacaatgacggcaatccttccctgttgctgaagtatgtatcttataaaaccagcgatttgcaaccgggtgttacggaaaccgttattaaactgaaagacgacgtttatcccgtaacggttgatcttcattttattgcttatgccgaagaaaatataatcaaaacatataccgagatatctcatcaggagaagaagccggttgtgctttataattatgcttcttctttgcttcatttgaatgctggtaaatattttctgacagaatttgccggagactgggcacatgaagtcaacatgacggaacaacagctttcatttggtaaaaaagtattggataccaagttgggaagccgtgccaatatgttcaattcgcctttctttttgcttgcactgaatgaggaatcaaaggaaaatgaaggagaagtccttttcggaaccattggttggacggggaatttccgttttacttttgaggtggataatttgaataatttgcgtatcctttccggcataaacaactatgcttcagaatattcgttgaagccacaggatatattccggactcctgagtttatctttactttcagtgcggaagggaaaggaaaagcaagccgcgacttccataaatgggcccgtaaatatcaggtaaaagacggtgataaaccgcgtatgactttgctgaataactgggaagccacttatttcgattttaatgaagacaagctggttgatattatggacgaagccaaatcgctgggagttgatatgttcctgttggacgacggatggtttgccaataaatatccccgtagcagtgaccgtcagggcttgggtgactgggatgaaacagtgacgaagttgccgaacggcatcggtaaactggtgaaagaggcaaccgacaaaggtataaaattcggattatggattgagccggagatggtgaatcctaaaagcgaactctatgaaaaacataaggattgggtaattcatctgccgaacagagatgaatattacttcagaaatcaaatggtattggaccttagtaatccgaaagttcaggattatgtatttggaattgtagacaatctgatgacgagatatccgggtatcgcttattttaagtgggattgcaacagtccgattaccaatatttattctccttatctgaaagatcagcagtctcatttatatattgaacatgtaaaaggattgtataatgttttggaacgtgtaaaagccaaatatccgaacctgccgatgatgctttgctccggtggcggcggacgttctgattatgaagcgttgaaatacttcacagagttttggccaagcgataatacggatccgatagaacgtatcttcatccagtgggggtattctcatttcttcccttccaagacaatggctgcccatgtgacaagctggaataagaatgcaagcgtgaaattccgtacggatgttgcgatgatgggtaaattgggttttgatatccgtattcatgatatgactccggcagaacaggaatattgcaaaggggcggtgaagaatttcaatcgtttgggtagcgctattctggatggcgacctgtatcgtctggtgtctccttacgaaggaaatcattctgctgtgatgtatgtgaatgaagcgacggataaggctgttcttttcgctttcgatatccatccccgatatgcggaaacgttacaacctgtacgtttgcaagggttggctccagaagctcagtatgagataaaagagatcaatttgcttccggataccaaatctatattaaaatgtaacggaaagacgtattccggtgaatatctgatgaaagtcggtattccggtattttccggtaggcaattagctagccgggtgattgaaatatcgaaaaaataa

SEQ ID NO: 1201 - DNA, 1899 bp, Unknown
  Description of Unknown: sequence from a bacterial species not precisely identified
tgggagaatgctccgcgcggattcggattcgacaatacggctctgaaactctatctgtggccggaaaacggcgtcaacccgctggatcttcctctggggctctccgcttccatgcgcctctggctcaatccggacggcacggagctgccggacgaaaaaatgccgcttcttctcccggaaaacggatggctccggcacagcggcgtattcggcgatcttgaagacgccgctgcgctgaaaagcggtttccccaaagcctggaaactgatcgacgatgtgttccgggcggaacagcgggaagcggcagtccgcaacatgtacggctacggggatttcggagatttcggttcccgcgcatgggtcaccaatcatgaaacggcggcagtccgcaatctgtggacccgctacctgcggaccggaacctatgaggatttcgacatcgcacaggatcatgtccgtcaccagcgcgagatcgacatgtgccatgccgggcggttcatgaaaggcgtttatccgcactacacctggacgcatatcaactacaacttccataccggacatttctggctcacgggactggtgaatcactatctcctcaccggagaccgccgcacgctggattcgatcatcggcgcggcatccgtcctcattcagaaatccgtaatcaaatataaaaacggacgcgagcggcaccgtatgctgttccaccttgcggaaatctacgaactgaccggaaatcccgaagtccggaaagcctttgaacggcagtacagtcacggcggcgcttccgatccggcagcctattacggcggaatctcccatgaagcgctcctgaaactctacgacgtcaccggcgaacggaaatatcttgaccgtctgaaccgggaagccaaagagtttctcgctgcaaacacccctctgccgatgccggaggtgcgcacaaagccgccgactctcacaggagccgctgatgaaggacgcgggtgtatgcgcctgttcatggaagccgtcatggcgaaacgcctcggcagcgccgattatctgcactatctctccaaaggaaccgggacctggctctggagcctgctctctccgaacggtcgcgacacctgtctggaatgggcggcattccacctgagcggactgcgcagtttcggcttgaaggaggatccgcgtctgccgtccgaatactctttccttcatcgtctgaccggacgaatgcgcattcagaacggcgatcagccgtttgaactggagctactcccggatgcggatggaaaagccgcgcttgagctttaccggatacgcagcttccgttactggtcgttcaaacgcgacaacgacaaagtgcttgtcacggcaaacgatgggaaagcgggaaaaacgatggaactctacaacaacgttcctgcggaatacggagttttccgcacagattccccggacggcaaagcggtccggctgaaactccggttcatcaacgactgctggggaggaatttcatccggcacgccgttccgcatcagttctgaacgctggtttgccgcaagagccggcattgcggtcccggtcggtttctacctccgcgccccggcaaacggtccgctccggatctcctggcgctggctccgggaacgcaacacaaacgccggagaatctctgggaatcctgttggaaactccggaaggcaaacggctcgtctccgatgttttcacgatcccgtttgagtatcaggaagaccggaaaatctgcacctattccgcagaactgacgattccggaagcatatcgcggaaaaattctgaaagcatggatcagcgatccgaaatggatcgaatggaggctcagcgggttggatgatccatggctcgccgacaagcccggctttctggaacgataa

SEQ ID NO: 1202 - DNA, 3492 bp, Unknown
  Description of Unknown: sequence from a bacterial species not precisely identified
atgattcgtcatttgttgccgtctgttttattctgctcggtctgctcctgcgccacggaaccgctctggcagctcggtaccgcggatgcctcttcgaaggaattccggattcaatacgaaccctgggaatacggcaggactccggctttgccgaaagctcccggctttgacgcggaaagcaatacgttccgctgtcgggttacgacgcgcgggatcaccggaaacccggcgatggtttccgggatcagctctgaaaacttcaaaatgtggatgcaccccgacgaggtcgtcaccgccctgactctggaatggagcgagaatggccccggaaaccgccggatcgtattccacaccgaccgtttccgcaatatcggcgatggcgccgacgctctggagctccttcttcccgacggttcccgcgaactgttttccgtccccgattccccgaaagagacgaaaaaagatcttgcgcttaccgcagaattctccgtccggcagggaaccaaccacctgacgctccgcgctctctgcccgaacaaacatttccggctcagtttcgaccggatcgccctgtggaaaacgactgcgcccgcatcccgtccgcaacccaatgcggagctgttcttttccaataaggattttatctacgatcccggtgaaaaagcctcagttcaattcaaaatctggaatatgaacggtcccggcgaacttgcttacacgatttccgacgcgttcggcaagacggttttccggggcaccgccgccgttgcggacggaaatgccattctttccctgcccgcctcgcaacgcggatggtacggaatttcctatacactccccggcggacggaagggaactgcctcttatgcggtgctggaaccggtctccagagagttcattgaagattcccggttcggatgtcatgcggtgaaaggctttgcctacctgaatgtcttctggaagaaggaccaggaacagcgccttcaccgggcatggcgcgccggagcgaaatgggtccggctgcacggagtcaaatgggcaaacctccagccccgccgggagatcccgcccgactggagcgggctggacggcaggcttgaactgctggagcgctacaggatgggcgttctgcttcaaatgggaatgaccccgaaatgggcatcgccttccaaatcggaacggctggttcctccgatcggagtcaaggcgtatcaggcatatccaccggaaacgggggcgtggaaacagttcatttccgcgcttgccgcccattgccggggacgtgtccggtggtatgaaatctggaacgaaccgaattatcaaagctgtttctggctctccggaagcccggaagactacgccgttctgatccgttccgcttatgaagccgcaaagcaggcggatcccgactgccgcatcgttgcgggcggactcgtcgacgcacacggttttctggcggaaacactcaaggcaaacaacgggaaagcgtggtttgacgcaatgggatttcattatgtaatccgcagccgctcctatgaccgctggcgccaggtcctccgtgattatccggatatgccgctgttcaacacggaggaatcgtggtggaattcatccgatcctctggaattcgcggcaaagctggtacgggggcatgtgatcgaagccgcaaacggcgtcgcaaaaacgttcgcattcgggttctttgaaaaacgcccgtattcggaaatccgttacggctctgtaaacggagacggctcccctctgcccgcctacgcagcctaccgcacaatgacacaccggctggaacacgcgcgttacgcaggcgcgctgaccccggcttccagtccgctgaaactgcatcttttcctgcgcgggaaaacgccgattgtcgtcggctggaatgaaggacggtcccccgtcgaagccgagctgtttcccggcacggactgtgtggttgctgttgatctgatggatcgcggggaaaacgttccggcgccgggcggcagactgcgcagggcttttaccgccctcccgcagtttgtggaagggggcgatccggaatggcttgccgtgcaggcatcgtttttccgcggacttcccggtctgttgacgggaagagcgggcacctctgtttcgcgcggctttccgccggaacttcctcccggattgaccttgaagctccttcctccgccgggatggaacggttcattggaaaatcccgatgggaaatacagccgttttacactcggtatcccgcaaaacgccgcaccggggacctataccgctcattttgaactggctgaaaacggaaaaagagctgttcttccgctccggatccgggttgacggagccgatgtttcgggaaatctgctccggaacggcgatttccggcaaggcggggaaaacgttcccgcatactggttcaaaggcaaaaagggagtgatgacccgtctgcgcggcggaggaatcggaggctccgacgcctggcgtgcggaaaataccggcagcggcggcgtctactggggcgcttccggccggatcaaggtttcgcccggcgaagagtatcttcttaccgccacggccaaaggggaaaacggctcgttcggcgttgtctgcacgatttctgacgggaaaggaaaacggcttcagccgtcccgtccgggaatcaatatgctgaacacccgcaccggctccgaatggaaccggtatttcgatacgatccgcattacgcatccggaagcggcctggctgaacatcgccctgctggtgaaccatgcggcgcccggcggagtcacattcgaccatattgcactttatgcgatcacggaccgctatccggcagcgaagcatctatggcgcgggtccggcaagactgcgaagaaaaaagtgacggtagacggcgtgctttccgagtgggacggcgttccggcgatgtccgtgaaccggcgggaacaggtcgttctgccggggaacagaggcgcatggaacggagcggcggacctttccgcgacctgccgggtcatgcgggatgcggaaaatctctatctggcgtttgaagtgaaggatgatgcggaaagcccgcgtttcccgcttgacaaagcatggtgcggcgattccattcaaatcgcgttcgatccgctgatggagggacaggactggtccgatcttgttctggcgcacactcctgaaggccgtccggttgtctggcgttatcacaagttctggacgccggaactgctgaccggaatcactgccgtcggagagctcaaattcgcaaaactggcgatccgcccggtccccggcggcaggatttacgaggcggcaatccccctgcgggagctttacccgctgacagccgggacgcgggagtgcggcttctcttttctggtcaacgataacgatggcagagagcgcaaatacatcgaatggtcttccggaatcggggcaaaaaagaacccgaaacttttcgggctcctgacgctggaggactaa

SEQ ID NO: 1203 - DNA, 744 bp, Unknown
  Description of Unknown: sequence from a bacterial species not precisely identified
atgcatcagctgaaaaccgttgccgtcattcccgcccggcttgcaagtacaagattcccggaaaaagtgattgccgaactcggcggaaaaccgatcattcaatgggtgtgggaacggacctcgaagtcgaaagccggtcaagtccttattgcaaccgacagtgaaaaagtcctcaaaatcgcggaatcgttcggagccgaagccgttatgacctctccaaaccatccatccggttccgaccgcatctgggaagccgcgaagggaatcgactgcgacattattatcaacgtgcagggcgatgagccgttcatgaaaccggaagtcattgacgctctgatcgacgtcatggcgggcggggacaagcccgatatggcaaccgtggtcgttccctcgacccgtgaagagatcgcctcgaatccgaatctgccgaaagtggtggtcggtgcggacggaagcgcgctctatttcagccgttccgaaattccgttcctgcgcaccggcggaaccgatatgccgctttaccgtcactggggcatctatgcctaccgccgttccgcgcttgaacgttttgtctctctgccggaaagtcctctggaaaaatgcgaaaaactcgagcagctccgcgctctggaaaacggcatgaaaatcaaggttgttaaaacacattttcaaagcatcgggattgacactcccgaagatatggaacgggcggaggcgtatctccgggaacacaacgagcggtaa

SEQ ID NO: 1204 - DNA, 2604 bp, Unknown
  Description of Unknown: sequence from a bacterial species not precisely identified
atggtgatttttatgacagattatatcatacgattgatgaaaaaggaggaatgtgttgaaatgaagaaaatgatgacaatgctggggctttgtttcctcagttctgtgtgggcggacgggacggatcgtgcggctttctggtatctttccgggaaagatgcggaggtttgcagactggaaaatggaacggatcccgatgatgcttccggggcggtgctgaagctgtcgttccggttccggaaaggcggaaaaggtgtcagagctctgatgctcaatttgagaaaaccgcttgttctgggctcggagcatgaacagctttctcttttcgcacacagcagtgcttccgggcaccggatctattttgaatgcctggaccgtgacagtgaaacgctgctttacagttacacggcaaggtcaaaattgcggactcttgaccggaaagggtggcaggaattccggttgacgccatcgcaggattacgcggattgctggggcggcggagcaaaagccaacaaaaaagcggatttcccgttgaaagtggtccgcatctggcttgatcccgccggagcggaggagtacagcggaacactgctgctgaaagagatgaaggtgatccgccgcgggacggacagagcgtttcgggtggaacaggcggagatcagtgtcctgcatggccgggcggagattcagcgggaacgggattccgggggagcggcttttgtgttgaagatttccggcgacggctttccgggaatctcttttcatccgcggaacggattctgggatctttccgcgtaccgggcgctcaatgtcgatgtggagaatctcagcggaacggaacaggttgactgtcacttgaggatccactccgcaggaccggacggagtacgcgacgttcgttccgtatacagcacgatagcgcttaatccgcgggagaagcggaccgcggttctctttcttccccatgcggaaccgggttgccgtatcactttttccgttccgctgaaaggggctccggacggactcgacaaagctccgaatctgtttgcggaccgtattacgcgtctttcggtttatacgcagtatccgcacaggaataccgggagtggaacggtgcatctgagaatcggcaatatccgtccggcaattccgtaccggaagaatctgccggagcgttttttcccgtttgtcgatgagttcggacagtatattcatgatgaatggaacggcaaagtccgttcggtttctcagttgatcgcgcgtctggaagaggagggacggcaacttgcagattcaaagcgcatcgcttcctggaaccggttcggcggatgggctgccgggccgcgactggaaaaaagcggatttttccggacggcgaaataccggggcaaatggtggttggtggatccggagggctgtctgtttctttccaacggcatcaatgcggtacagtttttcgatgactttgcggtcaaagctcccgaatggtaccggactccggtgaagaaaggggagcgcatggattttgtccgtgccaatctgctgaaaaagtatcgcggcaaactgtttcccgcggtttatgaacggacacacaggcggttggagaactgggggttgaataccattggcggctggtctgatccgggcttgtgcaaacagaggaaaacaccttatacggtcgttctttttgataacggaaaagcgccgaaattcggcgggctctatgatccctttgatcccgcgtttgaaaacgctctggcggagaatctgaactcggaaaaattcaaatggagcatcaacgatccgtggtgtatcggatattttgtcaacaacgaactgcattttgagcggcatacggcatttgcacaggcggttgcggtttccgctccggagacgccggcgaaaaaagcgatggtaacgttcctgaaaacgaaatataaaacagcggagcgtttgaatgatgcgtggggaaccgcattccgttcctgggaggatttccgcagaaatgccgcggctccggaccggaaacgcgccggaagagattaccgggcgtttgagaatcatgccgcagaggagtatttcagagtctgccggaaaaccgtaaagaaatatgcgccggatcagctttacctcggagtgcggttcaatggaaactgtcatcccgacgagccggagcttttccggatcgccgcccgttactgcgatgtggtcagttttaacaactattccaataccgtggcgcagtatatgcttgcggatttgccggatgtgcctctgctgatcggggaatttgccctgaatgtcagggatcgggggatgttcaatgattcactgcggacttgcggcatgacccagcaggaccgagccgatggttttctgcgttactggcagggtgtgctggttcatccgaatctggtcggcgctcattggttcacctggtgtgatcagcccgtaaccgggcgcttcgatggagaaaactaccagttcgggcttgtggactgcacggatacgccgtatgaagagctgaccggtgcgatgcgccgggtcggggaggcgatgtacgggtaccgtttgaccggaacgttgacacaaccgttgaaataa

SEQ ID NO: 1205 - DNA, 1191 bp, Unknown
  Description of Unknown: sequence from a bacterial species not precisely identified
atgccgcatatcaaaattcatcacgacaaggcggcagacaaagcggctctcgccgcgctctgtccgttcaaatccattgaagtcgtcaacgatcagctctccatcaacgccggatgccgcatgtgccgtatctgcatcaaaaaaggcggcggcgtatttgaatacatcgaagacgatcttgcgcccgccgtcgacaaaacgctctggcgcggaattgccgtcgtcgcggaaatcgaagaaggcaacgttcatcccgtcacgttcgaactgatcggcaaggcgcgcgaactggcggcaaaagtcaactatccggtctactgcctgatgatcggttcggatatttcttccaaagccgccggacttctggaatacggcgcggatgaagtgttcgtctacgaccgtcccgagctgaaatatttccggatcgaaccgtacacggcggtattggaagacttcatccgccgggtccagccgtcatcggttcttgtgggcggaacctccacgggccgctccctcgctccccgcgcggcggcgcggttccgtaccggactcaccgccgactgcacctgtctcgacatctccgaaaccaccgatcttgaccagatacgcccggcatacggcggcaacatcatggcgcacatcaacaccccgcggcaccgtccgcagttcgcaacggtccggtacaaaatcttttcgatcccgccgaaatccgcaccgaagggcaaaatccatcaatgcgacatcgccccggaaaagctgatttccgcaatcgaaatcctcaatatgaaggaaaaagaacaggaaaaaggcatcgaagaagcggaagtgctcgtcgttgccggacgcggcatcaagaaacaggacgatctttccatgcttcaggaactggcagggctgctgaacggacggctcgcctcgacccgcgccgtggtggaagccggatggatcgacgcccgcaatcagatcgggctcagcggcagaaccgtcaagccgaaactcatcatcacctgcggagtctccggtgcaatccagttcgtcgccggcatgaacagcgccgaaacgatcatcgcgatcaacacggatgaaaacgctccgatcttcaaagtcgcgcacatcggcatcagaggcgatctctacaagatcgttcccggcctgatcgaacaaatcaaacagcagaaagcgaaggtgtga

SEQ ID NO: 1206 - DNA, 720 bp, Unknown
  Description of Unknown: sequence from a bacterial species not precisely identified
gtgtttttggcaggaaaacagctcttgcattcctgttgtttgcgtgatatattccggatagacaaagataagttggggggatccaacttgaatgaaacaattcaaaaaggagaatgtatcatgtctacactggtcacaagagaagcacccgattttaccgcgaatgccgttatgggcgacaacactttttgcgagtttaaactttccgcgctgaaaggcaaatatgttgttctgttcttttacccgatggattttacgtttgtatgtccgtcggaaattctggcgttcgacaataagtatgaggaattcaaaaaacgcggctgcgaagttgtcagcgtttccacggactccgaatatacccactttgcatggaagtcgcttgcgccgaacaagggcggtatcggcaatgtcaagttcccgatggttgcggatatgaccaaaaacatttcccgcgattacgggattttgttcaacggatcggttgctctgcgtggtttgttcctgatcgaccgccagggagtcgtccgtcatgctctggtcaatgatcttccgctcggcagaagcgtggacgaggcgatccgcatggttgacgcgttgcagttctacgaagagcacggcgaggtctgccccgcgaactggcacaagggcgaggaggggatgaaagcctctgcggaaggtgttgccgaatatcttggcaaaacctattgcaggcagaaataa

SEQ ID NO: 1207 - DNA, 2052 bp, Unknown
  Description of Unknown: sequence from a bacterial species not precisely identified
atgctctgtttctgctgcgcagtccttgtctgcggaggagaatatggaaaagaacttccgctgaaacggatccccggagtggacgaaggggcgatggcaacggcgctgtaccggaatacgctgtgggtggcgggttccagaggaactctgtttgctttcgacgtttcagagccgcggacaccgaaactcgtctcgaaactccgggtcatgaaaaactgccgtcaaatggcagtccgcaacgggctcgccgcagtggttggacggcaaaacggcatggtgctcgttgacatccgcaatcccggatcgccgcgactcctgagccgctatcagtcgattgagcttgcaacgggaatcgacctgacagaaaaatacgcctatatcggaaaccgtatttacggagtggaaactgtcgatatttccgacccgcgccgtccacgctttctaggcaacatgctgacggaggaagcgcaatcggtccggaccgccggaaaccgggttttcgtcggggactgggccgccggacggatccagatcgccgacgcctcgaatcccgcctgtctctccccacggggattcattcagctggacggttacggcgacggtctggatatacagggcaatcttgtgttcgcctcgaccgggcatcaccgcaaaacggggccgaagaaagaccgtccgggcaacggccacggcgtcgaaatctgggacattcaggatccggcgcgtccccggcggctttcccggttcggctttccccgcttttacaatctcggaaacgattactggaccgtgcgggtttccggaaattatgcgttctgcgccgatacccacaacggctttttcgtcctgaacgtcgccgatccgcaaaaaccggtctgcatcggacatgcccggctggaagaaatcgtggagccgaaacgctacgattcaaacggaaaactgttgacgaactcccggttggcggatgccgtaagcagtttgacggtcggaaacggcgccgtctatctgaccgggttgaaaacggggctttatgtggcggagcttccgggaatcgccgcaccgcgcgaaccggattccgttccggaagcaaaagccgtccggcaaaagctcccggaagtggcggggttcaccgtctggcgtcccgccggaatggtccgggaagcggcggtctccggcgatacggcgttccttgccgcttcggaggacggaattcactgcgtgcggctcggagaacgggaaataacgcctttgcggcactatccccaacacttcgcctttgatgtaaaaattcgcggcaacaccctgtacgcagcggaaaacggtgacggactcggcgtttacgaaatccgggaaaacggtgttcttgagcgcaaagccggaattcccatgccgtggggagtggattgccagcggatctgggcgccggagggaacgaatctggtgatcgcgtcggatcatggcggctggatcttctttctggatgtatccgatccgcgaaaagcaaaagaggtgttccgccacagtcaggtcgggcttatctattccgaccttatgacgcatcagacaatcggaggccgctatctgtttttcaactggcatcacagcggctatgcctggtatgacgtatcgggagaaaaaccggttcgggcaaactggaaacggatccggtttgccacacacagggatggtgcggcgagcttgggaacgcgctgtctggcggtttcggacggcggatattatctgctgaacgcgaaccaggcgggagagccgtccggctggaaacggatccggattccgggaaagacgttgagcggagtgccctcaatcaatggaaacacagcggttctttcctgtcgccggacgggagagatcacggttctggacctcgcagatccgcaccgcccggtctggaatgaagcgcgttccctgacagttccgggactgcccggcgccgtcggattttcccggaaccggatggtgatccccgccggatatgccggcctttatctggaactttttccgggaaaggaggttcagaaaaagtctgaatga

SEQ ID NO: 1208 - DNA, 1311 bp, Unknown
  Description of Unknown: sequence from a bacterial species not precisely identified
attatggagttttacacagaaccggaacggaaaattgagattgcggatcgtgcggacgtgatcgtcgcgggaggcggccccgccggatattccgcagcgattgcggcggcgagaaacggagcaaaaacgattctcgtggaacagttcaactgcctcggcggaatggcgacaagcggcatgatgtcccatttcaccggcggaaccgattcagacctgtaccgggagatgatgaatcgtgttcaggcggaaaaatccggtatctttttcgccgggcagggcgcagggctccagcagatcaaccatgaagtcctgaaaaaagtcctgctggatatgctgaccgaagccggagtgaaactcaaactttatacctttgtgtgcggtgtcgtcatggacggcggagcagtccgcggcatcattacggaaagcaaatccggacggcaggcgatcatgggaaaaatcgttattgacgccacaggagacggcgatgtcgccgcacgcgcgggagcggaatatcagcttggacgcgaagaagattccaaatgccagcccgtcactctgatgttccggatcggcggcgtgaattactccaaagcgatcctgcccggcagttttgaaacgacggtcgatgttccgaaaggggaaatccagtcgcttgccagacagcaccttgccgcacctgccggtcacgtcctgctctaccccacctggatccccggcgaagtctgcgtcaatatgacgaacgtcaccggaattgacggaacaaacgccgacgatctgacgaaagcggaaattatctgccggaagcagatggcggatattgtcatgttcctccgcgagttcgctccgggatatgaaaactgttatctcgtcacttccgcccagaatgtcggagtccgtgaaacccgtcatttcaaaggtctgtacacgatcactccggcggatgtcgtcgaagcgcgtgtatttgacgactggatcgccaccaaaaactggtttaactttgacatccacaacgtcgaaggttccggtctcgataaaaacggcgaacagcacaagttcaaagccaagggagcctacacgattccgtaccgcgcatgtgtaccggagaaaatcaacggtcttctcctttcgggacgcaacatctccggaacccacaaagcacattccaatttccgcgtcatgccgatttgcatgaatgtcggtcagggagttggaaccgccgccgccatcgccgtcaaagacggagtcgagccgcgcaacgtggatatccgcaaggttcaggcagcacttcaggcgcagggcgtcaaactctga

SEQ ID NO: 1209 - DNA, 876 bp, Unknown
  Description of Unknown: sequence from a bacterial species not precisely identified
ttttctttatcagtgatagattatttcattccgctcagtcagacagcaaataaattgattccgggagtaaatggaatgaaaaatattattccactcgtcgtatcggttatcctagggttggccgcagtctatatcgtcagcaaacttctttttgaaaaagaaaaggcagatacggaaaataagatctctgtcgttgtggccgcacgggatctggaggctcatgatgaactgtcccagggagcacttacctataaggacgttccacagtccgctgttcccaaaaatgctctgctctgggagaatgtggggttggcatacggtcaggaactgcctcatgcagtttctcaggacgactatattctgatgacggatatccggattcagacaacgctcagcgactgtgcacgtccgggggaatggactctcccggtaacattttcagatcctgcccttgtaaggatgctgatgccggacgacgaaattgccattatttccacttatgtttccccccatgttgttgtcaacgagaatatgacggcaagcgacggctccggagttaagatgaccgagtcgagagagacctccgtccttttgccatgtgtgcgggtaatcgggatcgccaatgaacgcggctcgttcagggaaagcggaagttccagcggtacgattttcgtttctctgccgcctcagcaggcgatgcttctgatcgccgcacaacgggaatctgaactttaccccgtcctgcgcaaacggaacgattccgccgcactgaaccggaaagacggcggcgtgattaatgccagcacatttaccaaactccggcagggactcacaccggcggaactgccggaaattccgaacaaaaaccatcggtga

SEQ ID NO: 1210 - DNA, 1188 bp, Unknown
  Description of Unknown: sequence from a bacterial species not precisely identified
atgaaaacggattcccattacggaatttacggcggacagtatgtcgccgaaactctcatgactccgcttgcggagctggaacaggcatatctggatgcaaagaacgatccggcgtttcaggcggagtttgaccggctgatgaaaaattacgtcgggcgcgaaagtccgctttattatgcggagcgtctgacggagctttgcggcggtgccagaattctgctcaaacgtgaagacttgaatcacaccggtgcgcacaagatcaacaataccatcgggcaggcgcttcttgccagacggatgggaaagaaaaaactgtttgcggagaccggagcgggaatgcacggtgttgccaccgccacagtcgccgcgctgttcgggatggaatgtgaagtcttcatgggggcggttgacgtggcgcgtcaggctccgaatgtggaacgcatggaggtgctcggcgcgaaggtcacttccgtaaccgagggcagcgccacgctcaaagatgcgatgaacgaggcgatccgccgctggattacggaggttgatgaggcgttctatgtgatcggaacggtcgccgggccgcacccgtacccgatgattgtccgcgattttcagtccgtgattggacgggaagcccgcaggcagtgtctggaacagtacggcaaactgccggcggaagcgatcgcatgcgtcggcggggggagcaacgcaatggggctgtttgccggattcctcgatgatcccgccgtccggctggtcggtgtggaggccggggggaagggcgttggaacgggtgaacatgccgccagtatcaacgggggacgcatcggggtgctgcacggaagcaaaacgtatctgattcagactgatgagggacagatcgtggatacctacagcgtttccgccgggctggattatccgggagtcggtccggaacattcgtatctgcatgataccgggcgcgcgatctatacaacgatcaatgacgaagaagccgttcgcgcattcgacatgctgtcccgttatgaggggattattcccgctcttgagtccagtcatgcggttgccgaggcgttgcgccgggcgccggagatgagccgggacgacctgatcgtggtatgcctttccgggcgcggcgacaaggatatgcagagcgtgagaaattataaagcatcaaaaaaaggaatctga

SEQ ID NO: 1211 - DNA, 750 bp, Unknown
  Description of Unknown: sequence from a bacterial species not precisely identified
atgaacggtgatgttccggtaaaatcattgaagaaagcgctggacctgctttccgttctgctgtttcaggacggggaggaaaaaggatttgcggtcaaagaactcggcgagcggcttgggcttccggcaaacagcgtgcacaatctgctgaagacgatggctgtttgcggatatgcggaaaagaatgccgacggccgttatacatacggacccgtctgccgtcagatcgcgtaccggaattatcaggcgggagacgagtttcatggtatgctgctggagatcatgcgcggcgcgatccgcaggatcaacgagtcgatggtgtttgccgttctggaaaacgatgcctggacggttctcgtgcgggcggaaccgaccggaaagattctgaaagtctgcctggaagaggttcagcgctgttatctttacgaagcggcaacgggacgtattctgtacagtttctcctcaccggaacgccagacggaactgcgccgggcgaatggtgatccgtctccgtcctggccggactgggagaaagaggcgcggaagatccgggcagagggaagctgttcgcttctccgtacccggtatgatacgttcagttacgcggttccggtattcgacggccggggaaaacttcttggagcgttcggcgtgctgtgtccgccgctgaactgttccccggagcggaacgcgcagatcctttccgtgttgaaagaagctgcggcggaagtttccgcgcggctccgctga

SEQ ID NO: 1212 - DNA, 1347 bp, Unknown
  Description of Unknown: sequence from a bacterial species not precisely identified
atgaaacgctttctgctgccgtgtgttcttgcgcttgtttttctgattcatcttgccgcgggttttgccattgccgcccggcataccgattttttcctccatcatgacggccgggagtatctggaactttccgaatcgtatgcgaagtacggggcgttgctcagcgagcattcccgttactatgaggtccggcgcgattttctgatgccggaggcataccgcattcagctgcctccggtggtcacggggattctgatccagatgggatttccgccgcttgccgcggcggcggttttctgcgctctggcggttctgcttgcgtcctgggcggtgttcgatcttgcccggacgatgtttcattccgagcggacggcgtggttcgctctgcttctgttttccctgcatccgctgctgattcagtacggcgtgcagttttccagcgagattctgttctgtgcgtttctcctgttgacgttccgctgtctctgcctgccggaatccgaccgcaaatatgtgcttgccgcggctatgctgactttggcggcttattcccgtgcaacggcgtttctgtttttcccgtttcttgcgtgctggttcatgtataacagaatccgcgctctgcggcgggcgggaaagccatggctgcggattgctccgtaccgttccgtgatcctgtttacgctgaccgctctcctgctgtccgctccggtcgctctgcggaactggcacaatttcggaacgccgtcggtgagcggttatttatcgggttttgtcctgtacaacgggaacaaccgtcatctgatgcgggcgtattccgctgacagccgggattttgtgcatcacatggaactttcctggaactctttgctggaactggtgaaaacgcttccgccggagactgccggaaatccgcgtgtgcagagcgaactgctcgcggaacgggcaaaagaagaactccgtgcaatgagtgccggagaaaaattccgtcttttcagcgggaaactgatccattacctgcagccgaatccgaaatcgccggatcattccccgctgctgtactgggggctgaccctgagcatttccctgctttatctctgcggcattgccgggattctgctggtccgccggagggatccgcttctggtcccgtttctgcttctggctcttacggggatcatttcccatgtggtgttcaacattaatttacgctatcggattccatacattgatctgccgctgatcctgtattccgcggcgtttctgtccatcctgtgggaccggatccggaggaaaccggaaacggaatattgtttttccggagaaatgcgatataataattcaaactga

SEQ ID NO: 1213 - DNA, 1092 bp, Unknown
  Description of Unknown: sequence from a bacterial species not precisely identified
atggcagcggaattgttttgtgtgattatggcagggggaagcggggaacgtttctggccgttgagccggaaagggcatcccaagcagttcctgaaccttctcggacgggaaacgctgatcgaacagactctgctgcggctgcagggatttgttccgccggaaaaaattttgatcgttacaaaccggaattatgtggagaagattcatgcgctttgtccggaaatcccgccggataacgtgatcggtgaaccctgtgccagagatacggctccatgcgtggctcttgccgccgggatcgtgaaggccctggcggaaacgtctgatccgcagattgtctttctgccgtccgatcatgcgatcaccaaccgtgccgcgatgatcgccgatctggaagcatgttcccgtgccgcgcggcagtacgatgctttggccacgattggaattgcgccgacttatccctgcaccagttacggttatatcgaatgcggagcggaagcggaaggcgccgggcggatgttccatgtgacccgctttttggaaaaaccggattccgatgttgcgaaacagctgctggcacagggaaattacaagtggaacagcggcatttttctgtttcccctgcggacgctctgccgggagctgaaagagcatgccccggaattgcttgcgctttccgccgccgtgacggatgcatggggaacggaacagtttccggcggttctggaacgggaattccgcgcagttccgaaaatttcaatcgactatgcgattatggaacatgcttccgccattctgctccgggaagcgtcgtttgcctgggacgacgtcggcaactgggcatcgctccgcaatcatttccccgcggatgcggacggcaatgtcggcaacggttccgcgctgctcctcgactgccggaattgtattgttttcaccgatacgccggatcagatgattgcggggattgaccttgacaacatggttgtggtgaaaacgaaagacgcgcttctggtctcgccctctgcaagcgtggcaaaattgaaacgcctgctgtcggaagcgtccggcagcgaggcgttcggaaaatttctctga

SEQ ID NO: 1214 - DNA, 777 bp, Unknown
  Description of Unknown: sequence from a bacterial species not precisely identified
atgacaaaacacgcccggaaaacgcagttcacccttatagaactcctcgtggtaattgccatcatcgctatccttgcgggcatgttgctgccagctctgaactcggcccggaagactgcttacaagatctcctgcgcctccaacctgaaacagatcggcacggcttccatgacgtacagaaacgatttttcggacttcgccatgcctccggtcttcagcagttatccgagccaggctcccggagcacgctactgccacctttaccactggccctacacattcggcacactttacatgagcggcaaactcaaagacaacggggatgccgatcacaacggcacttcatggaaagcatttcactgcccggaagataaaactcaacttgtcaacacagcccgcctcagctacgttgccgccggaacatggggtactgatgacggcggacgcacccatcttaaaacgacttccgtcaaaatgccgtcccgcacctatctgatattcgattctgatttcaataacgattccgcttcgggacgttacgtcaatgcctgcccgaactggtcgggaacagatggcgaagtgtttgccgaacagcacaaatgggtcggaagagtccactcactccaagccaatatcctgtacgttgacggtcacgtcactacaaaacgaacctggaaaggactggacaatcccgattcccgcatgtacagcgacaacctgctcgcagagcagaacggcaccagaaactggggcaacgtcggtaccatggacttctga

SEQ ID NO: 1215 - DNA, 1242 bp, Unknown
  Description of Unknown: sequence from a bacterial species not precisely identified
atgaaccgacgtgaatttctgaaaagcgcttttgccgttgccgctcttgcaccggtcacccgtcttgcggcgaaagccggagccgatggagacaagacatcggacgtcctgcaggggcggatgatcacccgccgccgttataagaacaccgcacagacgttgccgctgctgggattcggctgtatgcggctgccgcagttgtcgccggacagaccggaaattgattacggcaccgtcaaacagatgatcgaccgggctatgaaagccgggtgcaactacttcgatacggcctacatgtatcacgacggacgcagcgagcgctgtctcggcgatctgctgaaagcctatccgcgcgactcctattatctgaccgacaagatgccggtatggtttgccagagacgccgcagggatcgaacggattttccgggagcagttggagcgctgcaggacggactatttcgatttctatatgcttcattccctggattcggcgaactgggaactggcacagaaatataaagcctgcgaatttctggagcggatgaaaaaagaagggaagatacggagaatcggattctcgttccatgattcgccggaagtcctgcggaagatcgtcgatgcgcgggagtgggatttcgcacagatccagctcaattatcttgactgggaactttaccgttcccgtgaacaatatgaaatcctgaccggggcggggattccggtgatcgtgatggaacctctgcgcggaggcgcgttggcagcgttgtcgccggatgcgtcggacattctccggaaagctgatccgcattcaagcaatgccgcgtgggcgttccgttatgtggcaagcctgccgaacgtattgtgcgttctttccggcatgaccctgccggagcatgtggaggacaatatcagaaccttctccccgctgaatccgctgacggaaagcgagcgcaaaactctggatcaggctttggcggcttaccggaagcgtctcgctgtaccgtgtacggcatgccgttattgcatgccctgtccggccggggtggaaattccaaaaattttcgggctttacaaccagtataagatttccggaaacaaatggctctttacgaataattacaacgttcttccggaggatgcaaaaattgcttcctgcgtcaactgcggaaaatgtacgaagcattgtccgcagaaaatccagattccggcggaattgcggaaaatcgcaaaggaattgtaa

SEQ ID NO: 1216 - DNA, 873 bp, Unknown
  Description of Unknown: sequence from a bacterial species not precisely identified
atgaaagaggtcctgttccagccgttcagctggggcgtctgggtgagcctgacgctcggtttgtggcttgccagactcggagagggcggcttccgcgccaacatcaatctgtccagatcttttatccggaagaaattcgggtcattcgaggagttttccggaattttggaaccattcgcaaatgaactggggatcagcgcccttgctctgcttgttgccatcggcgccgttctttttattgtcgtggtggtacttggctttcttctgttgtgggtccgctgccgctcccggttcatcgtgctggatatgctggtgaggggtgttcacgcggagacgttcggttcccgctggggccggttccgccgtcaggggaactccctgttctggacgcttctgctgctgggggtgctgatcttcctgtgcatctgcggcatggcgctttttgtggttctgctgcttattgcgctgataggcggcgggaacagtttgtccccggtatttccgctgatcgttgtctgcatggttccgctcctgctgttcacggcagcccttgggttttatacgtcgctgtttctggactattgttccctgcagatgtaccggaccgactgttccggaatggaggcctggcaggtgttcaaccggaaactgctggagcggccgggagtgtttttccggtattgcgtcgggctggttctgattgcgctgctgatcatgggggctgcggtactgctttcctgcgcgacctgctgtatcgggctgatcttcctgctgcttccgtttgtttccacaatggttctgcttccggtcctctatgtccgctggcagtatattctggaatttttcgacaatccggaaatgctgaatcagtga

SEQ ID NO: 1217 - DNA, 1656 bp, Unknown
  Description of Unknown: sequence from a bacterial species not precisely identified
atggttattgcgaagatgaacaatgtgctggtcaagcacagccgtattctgtttggtgctttcacaggcatcatcatcatttcatttgtctggttctttacgccgggcgcaagcggaaatattctgttcgggacaaatccgatgtcgccgaatgcggttgtcggatcagtgttcgatcagaacgtcacccgcggcgaactgatggagatcatcaaggacaatatgctggtaatggcggcgagctatggcgtcaagcccgcaatgaacggactcgacgagcaggcattggaagaggcgtttcagaaagctgttctgctttccgtcgccaagcgtatgggtgtgacggtttccacggaacgggttggcgaatacctccgttctcttcccgcgttcgccggaacggatggtaaattcagccttgaaaaatatcagaattatgaaaaagagatgctgcagccgcttggttacaatgcgttggatcttgaccgcgcggtccgcaatctgctgacgatcttctcgcttggcagttccgccgtcaacgaagtgcttgtaacgccgaacgagatcgcggattttgaacagactgttctggaaaaatacaacgtgaaaacgattctgtttccgtttgaagccgcgaaaaaacagttgaagcccaccgaagccgaactgcagagctatcacaaggcgaatcagcagcagtttatggctctgccgcagttcaaggcgaaagtcgtccgcttcaattatgcgaactatcaggataaagtgaatgtttctgcggaggacgtcaggaaatattatgagtccaacaaagcggaattcacgaagaacgggaagacctctccgcttgcttccgtgaccgctgcgatcaccgcaaaactgaaaaaagacgaggccgtgaaactggcgcgtaaagccggacgcgatttccgcgaggctctgtacgatgcgacagctgagcttgatacggctgcttatgcggatgcgttttccgctcttgccgcaaaacaggggttgactgttgttgaaagtggctggttcaccggagagtccgccggaatggataatgtcggaagagagccgcgtttggtcgaggcgatcgtcgccctgccggaacgctctccgatctccagaaccgtggaaggcgagcgagcggtgtttgtcgccgtcgtaaccgccaggaagccgtctgttccattggaatacaaagcggtggcggcaaaggtccgggaagcatggctgtccggaaaggcgatcgccgccgcgcaggaaaatgcccgcaattttgtgttggagatgaacaaggcgaagaatcccgccgccgctcttgccggactcgccaaaggcgctgtcgtcaaaaacgtcccgccgttttcccagctggagcctccgaaagagaatacaccggttgtcatgacgcttgcgacctccacggataacggtaaactttcccgcacgctggatctgccggacggggtgttcatggtttttgtcacttcccgcacagctccttccacgaaagaaatggcggaaaaacagaaagagcttgccgagcgctacaagcagggaaagcagtacgcgatttataattcattccagacctggatcctgatgaatacccgtaactatatgacgcgtgaggcacaggaacggtaa

SEQ ID NO: 1218 - DNA, 723 bp, Unknown
  Description of Unknown: sequence from a bacterial species not precisely identified
atgtatccctgccgtctgttcaacgccggaaacacgcacgttcaaattgcggagttctccggcgtttctctgcgtctgcttgaaacggttcccaccccggaattccggattgacagtttcgcctccggaacaatggcggcggcgtccgtcgtccctgccctcgaacagcagttccgggaggcgggcgcattcatcatcagctcccggatgccgggctgtcccgtcgatctctcacggatgaaacatcccgaaacgttgggggctgaccggctggcaaacgccgctgccctgatcttctccggtcccctgcccgcactttgcgtggacttcggaacggcgatcaatctggaattcgtcgatgcggaacggcggatgcgcggcggcgcaatcctccccggacggcgcattctgcgcaaatctctgaatgattacacggcaaaactgccgctcaccggcctgaccgcagcggttccgtcctttcccggcaacaatacggttgatgccatcgacctcggcacggactgcgccgcgatcggagcggtgcgggaactggtccgccgcatggaaacagaatttccgggacaaaaaatccggcgcgtcgcctgcggaggcgatgcgccgttctttctgcgggaactgccggatttcgagctggcggatgaactgttcaccctgcgcggaatcgcggagctttaccgtcacggagtcgtatcaatcggataa

SEQ ID NO: 1219 - DNA, 927 bp, Unknown
  Description of Unknown: sequence from a bacterial species not precisely identified
gtccgggagaatctggaggaattctccctgctgttctggatcgcgacggcggtcgttcttctgccgggcatgatttgcggctggctgattgcgcgccggttcgtctccggcatccggcgtgtcggcgatgccgccgcgcggatcgcggaaggggatttttcccagcgggtcgcacagaaaaacgatggcagggagatcgacgatcttgtttccgtattcaatgcgatgaccgcgaataccgagcgtctgcttaccgagctccgcgatgtaacggataatgttgcgcatgatctgcgtacgccgcttacccggatccgcacgattgcggagatcacgatcagcggtccgcaggagttggcgaattaccgggaagcgattattgacattgccgaggacagttccggcatgatcgccatgatcaattccatgctggagattacccggattgaaaacaactttgaaactttgaaaacgacggatgtttcgctcagtgcccaactgcaccaggcgtatgacatcttttccatgcaggcggaagagaaaaatctggaatttatcctttccctgccggaacaggaggtggtgattgccgcggataaactcaaactccagcgagtgatttcgaacctgttggacaatgcgatgaagttcacgccggaaaacggacgtgtcattctgtcgcttgccgtggagccgggagcggccgtcatgcggatttcagacagcggagtcggtatttccgatgcggacaagcagcatatctttgaacgttttttccgcgccgacgccagccggaccaagccgggcaacgggctcgggctctccatggttcacgctattgtgttggcgcatggggcgacaatcgcggtttccgacaccgccggcggcgggaccacgtttacgatccggtttcgccttcccggataa

SEQ ID NO: 1220 - DNA, 1431 bp, Unknown
  Description of Unknown: sequence from a bacterial species not precisely identified
atgatgaaaccgttgatcgccgccttgttcggcagtttgttttgcagctctgtcaccagagcggatgatttgcaggcgattcgcgatctgaaactggagaatggcagaatattgtcggtaaagcggattacgcgtccttatcatattgacaaatgggaccggaagatcacgaaagtgccgtcgcgtgtcattgtgaagctggtgctcatgcccgccaaaggagcgtgtgccaatgtggagatctggctgccggagcgtgacaaatggaatggccgttttgtcggacgcggaaacggcggcgccggcgggcatattgatccggatggttttgtcggtggaatcaagatggggtgcgcaagcgccacgactgatatgggaacggcgcccgctccggatatcggcatcggcaatccggaggtctggaaggatttcggcttccgttccacgcatctgatgaccgttgcggcaaagcaggttattacggcgttttacggaaagccgccgacgtattcctacttccttggacattccaccggaggacagcaggctttgcaggaggctcagcgttatccggaagattatgacggcattggcgcgggcgttccggcgcactgccgcacgccgctccacgcgtatttcctctggaattaccagctggtcggacagtgccgtctgaccaaagaacaggatcagaatctgatggcggcggcagtggaatatttcgctgcgcgggagaaaaaaccgtatgccgggaaagtgatttccgatccgcgctgtaccatgcaggatatcgaagccgtaattgcattggcgcggaagaaagacccgacgctgacggataagcatgcggaaatcctgaaaaagatttttgacggtccgaagaattccaaaggagaacgcattttcggaggagttccgctgggcagttcaattttcccggcgaccgggaaccgctatctgtttcagtgggtgacggagaaaaatattgattataacgcgatcaattttgacggagatattgatgcctatacccggaaactgggagtttatctgaatgccgagaatcccgatctttccaaattccgggcgcggggcggaaaactgctgatggtttcgggaacggcggattcggttgtgccgtttcatgccacgctggattattatgagcgctgtgcggaaaaagccgggtccatggaacagctgcaggagtttttccgttactactggtatcccggcggaccgcacagctgcggtttgcccggtacgttggaaaaactcattgcgtggcgggagaaagggatcgctccggaaggtatcagcgtgaagctgaaagacggtaccaatgcgacgatttatccctatccggcgggagtgaaacgtggcggggtggaacgggtcaatcccaaattctctccggcagcggaagagtga

SEQ ID NO: 1221 - DNA, 888 bp, Unknown
  Description of Unknown: sequence from a bacterial species not precisely identified
atgacattttcaggcatttttatgttattttcatcctctcttgaagcaatcatgaattcagggacctttcccgaaaacgggcggctgcattcccgtatattgccggaaacgccccttctgaaaccggaaaagctgatcgtatcctttcaaaactactccggaagccacacccatgtacaggcatttcatcaacgctgcgtcctgaaagttcatctgaaaggaaaaagcatggcgcatgtggacggaaacagattcttactttctcctggcagcggaattctgatctttccctttcagcttcactttatcggatcgggcggagaccgggaacagtatcggctgctggttgaattttcactttctgtggaagaccttgatgcaatctcccccctgaaaaatcacccgtttcaactggatgacgaagacctgtttcttctgcagcggctggtggacaaagccgacaggcaggatagtgccggaacttcttactgctttgcggaatttctgacaaagcgtttgcagaaaaacgggacagggaccctgtctccggaatctccaggcaatgacaaattcaatcagatattccattacatacagactcatctggaccagccgctctcactcaaaacgctctgtgagcagtttcatttatcggaaaaatctctgcggggaatcttccgtaaaaatctgggtccttttcccttgggcggacagttgcgcagtctgcgtctgcaccgggcggcggaatacctgctgtatacggatcggagcataggagagatcagcgccctgtgcggttatacggactcatttgtattcagccgttcctttaaatcattctccggtttatgtccgcgagcgtaccggaagcagcatttgcggccataa

SEQ ID NO: 1222 - DNA, 1587 bp, Unknown
  Description of Unknown: sequence from a bacterial species not precisely identified
atggatttcagagcacgtttcgcaccgtcccccaccggacaggtccacatcggcaacatccgtaccgcgatcttcaactggttggcgacccgtcattgcaaaggtacgtttcttctgcgcgtggaggacaccgaccttgaacgttccacgcaggaggcgatcgacaaacttcttgaatgtatggactggcttggactcgattatgatgaagagatcatgtatcagacgaaacagagcgacaagcacaaggagtccgcacagaaactgatcgactccgggaaagcctattatctgaatcccggcgaggaacactctccggttcttttcaaactgccgtatgactgcgattccatgccgttcgtccgcgagaccggagcggcggagattgtgctggaaccgggatccgaagtcgcgctcaaccttgccggtgtcacgttccatacgctgagttccaagggcaaatccgtggagaacatggcgtcgcttgccggattcaagaatctgaagatttccgatgcttccggcaatcttctgtttgagctcaatgacgaaacgatgaagacgctttccgcggatccccgcgaaaaaacggtggtcgccggagccgcgaagctgaattttatccgccgggaagtcttttaccacgaccttgtcaaaggcgatctcgcaaagccgcttgacaatatgaaggatttcatcatcgtccgcagtgacggcagtccggtttttcatctcgcgaacgtttacgacgatatgcagcagcgggtcacgcacatcgtccgcggagacgatcatgtggagaatacctatcgtcacctcttcctgtttgaatcgctcggcttcactccgccgcagtatgcgcatcttccgatgatcgtgaatgctgcgggcaagccgtacagcaagcgcgacggcgatgctttcgtcggggatttccgggaaaaaggctttctgccgcaggctcttttcaactatctcgcattgctcggctggtcgcccggagacgaccgggaaaagatgtcccgcgaagaactggtcgaggcgttcacgatcgaacgcgctctttgttcgcccgcccagttcgatatccgcaagctgacgaatatgaacggcatgtacatcgcggaaatgccggtggcggatttttgtgctcagatcgctccgttcatcgggaagctctgcccggaagccgtcgggtcgccgattctggacaaggtcgcggagctgatgcagtcccgtaccaagacgtttgccgatgtcgcgcagtggaaatacttcttccggaaagcggaggagctggaatatgatcccaaggggttgaaaaagctcctgggtgatgatacagtacgcaaagcggtggcgtcgttcgcagaaaaagtgacggcgcttccggcgctgacggtgcaggcggttgatgatctgatccatgcggtcgaggcggaatacggaattcagcaggacaagctgaaacagccgctccgcatagcttccaccgggaccacgatcggcgcgggtatctgcgagacgatcgtgctgatcggtgccggcgaatgcgccgcccgtatcgcccgtgcgcttgccctgtaa

SEQ ID NO: 1223 - DNA, 918 bp, Unknown
  Description of Unknown: sequence from a bacterial species not precisely identified
atgcgcatatatttttccggaaaacagggagcggaaatgccgggaatcacggattttgtacggatggaggagagcgcgagctaccggggaccggaaacgggagacggcggttatcagccgttttatgtcaactaccagcaggtccagccgatccgtaacgcgttttaccgggttcacgcatcgccagattatgagatgatcatcccgcgggagaagacctaccgctgtctgcttgacgaccgcccggtcaaggtgaaaaagggggaatttctgattgtccatgcgcaccagcggcatcaggatctgttttcgacggacgctccgtatcacacgtttcatttccgcatgtgcggttccggagtatccgctccattggagaacctgtttgccggggggctcctgccgcagtgtcaggtggcggaactgcccgatccccgtcagctgaatgtgatcgttcagctgctgcggcgggagttgaaaggagttccgcagccggagacgttccatatctgcaattccctgttccgctcgattttctggaaatgcatttccggttatccgccggagcatctttcgggattgttccgcgccggatttcagaacaggcggatgacagcgcatctgatccgcattttcgagcgcaatctgacggaaatgcccgatctggacgcgctctgccgggaggctgggatgagccggagcagtctgaaccggctgacgaacgaactgtttgccctgccgccccggaaagcgttcctgaaatacaagatacaccgggcacagcagcttctaacctcggatccgacccggaagctcaaggagttaagtgactatctgcactttgaaaaccagtttcatttttcccggatcttcaagcgctacgcgctgtatcctccatcgaaattccgaatgccgtaa

SEQ ID NO: 1224 - DNA, 840 bp, Unknown
  Description of Unknown: sequence from a bacterial species not precisely identified
atgaataagtaccatctatttgtcaaaggattgagcgcgctgtcacaattcagcggtttccacttcgtgctcaaaaccggagaacgggcatggctgacgcctcttccgcttgaacagcgttatcactgctgcgaattctgcaaagcggtgaaacggagcggggagcggatggagctgcagtgccatcgtcatcatgcggaaaccgcgctgaaagaagccgtaaaacggcggaaaccgtttgaaacgacctgccatgccggagtgacggaactcgtttttccgatcatcaccgggaactgccgcggcgcactcttcgccggtcctttcctatccccttccggaacggaaaatctgccggaacatttacgggaactcggccgcaccatgccgaaattttcccgatcccggatggactctcttgccgggctgctgaccgctctgctcgctgcttgcgaaccggagagctggcaggaatccccgcgcacgctgctaccctccccggattacagccgtcttgattcccggatgcagaaagcgatccattatctgcaccgtaatttccggaaaccgctccaaaccgccgatgtgtgcagatacatcggtttgagccggtcgcgctttatccactgtttcacggaggcggtcggcatcaatttccgtgattatctccagcgtctgcgtctgtcggaagcgatccaatggatcgaactgaccgatcttccgctcggcgccatcgccgccgaatgcggcttcacggatcaaagcagcttctccgcacagttcaagcgctactatcacctctcccccggcgaattccggaaacagaagaagccggaataa

SEQ ID NO: 1225 - DNA, 744 bp, Unknown
  Description of Unknown: sequence from a bacterial species not precisely identified
atgaaaacattgattttgaataaagcattgaagattttcgaggttctgacgcaggctgagaatccgttgacgctgaaagaaatctgccgtcggacggggatcacgccgcctgcggcaagccgtctgctttccgatctggcggagggcggttatgtgcacaaggtctcctaccgggagtttgaacccgggctcggtatgatctatctcggacaggggagtttgcggcacaactttttcccgcagaacgcgactcagtttttgcaatccgagctccggcggatggggatcggcggggcgcttgcgggaatgttcaacgatcatctggtctatctgtatcattccctgcatgagcacgggcaccgcatttccacgcttccgctgccggatcagcggctttccggttccaatattgcactggtgattctttgtgtccggtacggtccggagcgtgcgcgggaggtcctttgctcggagcttcgtgcgaattgcacggggattgagctggagcggagagagaattccgtgctccggcgaatcgaagcattccggaaggatcatttcgcggtctggaacgacgaggccgcgcattggaacatctgcttcccgcttgtggacggtacgcaggtgtacggtctttcctttctcggcgagaacggggggcaggcgattccgccgcagctgtttttggactgttccgccgttgcggcgaagatgcgcaggatcttttccggagcttccggctga

SEQ ID NO: 1226 - DNA, 732 bp, Bacteroides salyersiae
ccggttgtaaacgagccggctcattttttattccggtgtttgattattctctatgaactaaaaaatatatctttgctgcaaaatattacagtataccccgctatgaacatcatacttgctttaaaacggccttttatctggctttcccgtgtgcgccatcgctgtggatatggtgtacattccccttttgcctttgaattgatcacttgtcttttctacgagaaaactccttattacgcttataaggaattggcgcaggaagaaaaaaaacagaagaggaatcatggtaaaggatggcgaaacgagtctcttaaagtaaagcgtctgttgttccggttggtaaacaggatacaacccggtacgattatcgattttggtactccatcctcttcttctttgtatttgcaatccggaaaggcaactgccgattatacgtttgcttccgagctttccgaactttttctggaagcggacgtacccgtagattttctttatatacattgtcatcagagtccggttctggtggaagatgtttttcgtatttgtcttgcacgggtcgttcagcagagtgttttcgtgattcgtggcattcattattccaaagcaatgaagaacctttgggagcgattgaaagcggatgatcgggtaggtattacttttgatctttatgacgtggggattcttttctttgataaaacaaagataaaacagcactatatagtcaacttctga

SEQ ID NO: 1227 - DNA, 1503 bp, Bacteroides salyersiae
atgaatttaccagctccttttaccgaatatacccgtgccttgttgggcaacgaagaatacgaaaagttatctgccgctttggaacaggaacctcctgtcagcatccggctgaatccatcgttcctcaccgatgccaattcccccaattctcccatctcccttctctcatctcccgtctcccctgtgccttggtgtccggaggggcattatctcggccagcgtctgacgtttacgttcgaccctcttttccatgccggttgctattatgtgcaggaagcttcgtcgatgttcgttggacaagcgttgaagcagtatgtttccgaagaaccggtggtgatgctcgatctttgtgccgctcccggtggaaaatcgactcatgcctgtagccttttgcccgagggtagcctgctggtagccaatgaagtgatccgtaaccgttcgcagatacttgccgagaatcttaccaaatggggctatcccggtgtggtggtaaccaataatgatccgtccgatttccctcgtttgggcgctttttttgatgtaatattgaccgatgtaccttgttccggtgaagggatgtttcgtaaagaccccggtgctgtcgaagagtggagcccggaaaatgtggagatctgttggcagaggcagcgacgtatcattgccgatatctggccttgcttgaagcccggtggtatccttgtttatagcacttgcacgtataatacgaaagaagacgaggagaatgttcaatggattcgtgatgaattcggggcagaggtacttccggtgaatgctccgggagggtgggggattaccggcaatctgcttgcggcagccgacttccctgtttaccgcttcttacctcacaagacgataggagagggcttttttctggccgtgctccgtaaaccggaagcagaaaggcagggcggaatagttacttctgtcaatcgggaagttacagcttgtggtgcgatgaacgaaaaactttcccgtaagaaaacggccgccgcccgcaataacagtaaaccatcttctgccccgatgggtaaagagcagatagccgtggcaaaaagctggcttctttctcccgaagattttgaggtgtctgtcaatggaagctttatcactgcttttccaaaggagtacacgggtgaatgttctgttcttcagcgatatctccgtattgttcaggcaggggtcgtgcttggtgaggtaaaagggaaagatttgattccgaatcatgcattggctatgagtcctttgcttttgcgtacggaggcttttgcttccgaagagatcggttacgagcaagccatcgcctatttacggaaagaggctatcaccttgccggcaacagcccctcgcggttatgttctgcttacttatcggaaagttcctttgggttttgtaaagaatatcggcaatcgtgccaataatctctatccgcaggagtggcgtattcgcagtggatatttgcccgatgagatacgcattttgtga

SEQ ID NO: 1228 - DNA, 894 bp, Bacteroides salyersiae
atgttgacagattcttttcttgattatcttcggtatgagcggaactattctgaaaaaacagttttagcttacggagaggatatttctcaattacgggaatttgcacgggaatttgcacaagaagagattggagacttcaatccggcagaagtgacgcctgaacttattcgtgaatggattgtttcgttgatggataaggggtatgcttcgacttctgtgaatcgtaagctgagttcgctccggtcgttttataaattccttttgaaaaaaaaagtggttcttgtggatccgttacgaaaaataacaggaccgaagaataaaaagccacttccttcttttttgaaagagaatgaaatgaatagattgttggatgatacggattttggtgaagggtttgagggttgccgggatcatctgattatagaaatgttttatgccaccggtataaggctttctgaattaattggattggatgataaagatgttgatttctctgcttctcttttgaaagtgacgggaaaaagaaacaaacagcggttgattccttttggtgatgaactgaaagagggcatgttggaatatgtcaatgtaagaaatgagcaggttttagagagcggaggcgctttttttgttagaaagaatggtgagcgactttataaaaatctggtctataatttagtgaaacggaacctttcgaaggtagtgacgcttaagaagcgaagtcctcatgtgttgaggcatacttttgctacaacgatgctgaataatgaggcggaattgggggctgtaaaagaacttctgggtcatagtagtttggcgactactgagatttatacgcacactacgtttgaagaacttaaaaaagtgtataaacaggctcatccacgagcttaa

SEQ ID NO: 1229 - DNA, 1443 bp, Bacteroides salyersiae
atggaagatttaaattttagaaacggtgatgccaagactgatgtatttggttcaaacagaatgttgcaaccctctccggtagaaaaaatacctgacggaccgactactccggaaattgcctaccaaatggtaaaagatgaaacattcgcacagactcagccccggctgaacttagctactttcgtcaccacttacatggacgaatatgccaccaagctgatgaatgaagccatcaatatcaactacatcgatgaaacagaatatccccgtatcgctgtaatgaacggtaaatgcatcaacatcatggccaacctgtggaatactccggaaaaagacgactggaaaaccggtgcattagctatcggttcttcagaagcttgtatgttgggtggtgtcgctgcatggttacgctggcgcaaaaaacgtcaggctcagggtaaacccgtagacaaaccgaattttgttatttctaccggcttccaggtagtatgggaaaaatttgcccaactgtggcagatcgaaatgcgcgaagtgcctttgacactggaaaaaacaacccttgatccggaagaagcactgaagatgtgtgatgaaaacaccatctgcattgttcctatccagggcgttacatggacaggattgaatgacgacgtagaagcgcttgacaaagcgctcgatgcttacaatgccaaaaccggctacgacattcctatccacgtagatgctgcaagtggcggttttatccttccgttcctgtatccggaaatcaaatgggacttccgtttgaaatgggtgctctctatcagtacctccggtcataagttcggtctggtttatccgggtctcggttgggtttgctggaaaggcaaagaatatcttcccgaagaaatgtcattcagcgtaaattacttaggtgccaacatcacacaggtaggtctgaacttctctcgcccggctgcccagattttgggacaatactatcaatttatccgtttgggattccaaggatacaaagaagtacaatacaactcattgatgatcgccaagtatctacacggtgagattgccaagatgactccgttcgtcaactactctgaagacgtagtgaacccattgtttatctggtacatgaaaccggaatatgccaaagatgccaaatggactttgtatgatttgcaagacaaactggctcagagcggatggatggttccggcttataccttgccgtccaaattagaagattatgtagtgatgcgtatcgttgtccgtcaaggattcagccgtgatatggcagatatgctgttaggtgacatcaagaacgccattaccgaattggaaaaactggaatatcctactaccacacgtatcgcccaagataagaatctgccggtagccacaaaggtattcaaccatacaggtaagccacaagcgactaaaaaataa

SEQ ID NO: 1230 - DNA, 831 bp, Bacteroides salyersiae
atgaataaacaaaaattatttgagaatatcaaacgcaaaaaatcattcctttgcgttgggcttgatacagacatcaaaaaaataccggatcatctcttggatgaagccgatccgatcttcgctttcaacaaagcaattattgacgcaactgccgatctttgtatcgcctacaaaccgaatttggcattctacgaaagtatgggtgtaaaaggctggatcgcttttgaaaaaacagtgaagtatatcaaagaaaattatcccgaccagtttatcattgccgatgcaaagcgcggtgacattggaaacacatctgcaatgtatgcccgtaccttctttgaggaactgaacatagactcggttaccgttgctccatacatgggtgaggacagcgttacaccatttctgacctatgcgggtaaatgggtaattcttcttgctctcaccagcaacaaaggttcacacgatttccaattgacagaagatatcaatggagagcgtcttttcgaaaaagtattgcggaaatcacaagaatgggccggtgatgaacaaatgatgtatgtagtaggtgctacccagggacgtgcctttgaagatatccgtaaaattgttcctaaccatttccttcttgtacccggtgtaggtgcgcaaggcggttcacttgaagaagtgtgcaaatatggtatgaacgatacttgcggattaatcgtaaactcttcccgtggaattatttatgcagacaaaaccgaaaactttgcacaagcagccagaaaagccgcacaagaagtacaggagcaaatggcaaaagagctgaaaaaagtgattaacgattag

SEQ ID NO: 1231 - DNA, 993 bp, Bacteroides salyersiae
atggtgtcagctattacaagaacattaaagacgaataataaaattgtctatgtatccttactttcgattttaacttttttcttattattggattatattccgggcatgcaagctttttcggcatgggttactcctcctttggctttgtttttaggattggcttttgcattggtttgcgggcaggcacatccgaaatttaataagaagacttctaaatatttgttgcaatattccgtagtaggtttggggtttggtatgaatctccattcagcacttgcctccggtaaagaaggtatggaatttaccgttatctcagtaataggaactttggtgattggctggtttatcggacgtaaattattgaaggtagaccgtaatacttcttatttaatcagttcgggtactgctatttgcggtggtagcgctattgctgcggtagggccggtagtgaaagctaatgatagcgaaatgtctgttgctttagccactatttttattttgaatgctattgcattgttcattttcccggtaataggccatgctttgggtatgagtcaacatgaattcgggacatgggctgccattgccattcatgatacgagttcggtggtaggagccggtgcggcatatggagaggaagccttgaaagtggcgactaccattaagttgacacgtgccctttggattattccaatggcatttgccacttcgtttattttcaaaagtaaagggcagaagattagcattccttggtttattttcttttttgtattggctatgattgtgaatacttatctattgggaagtgttccggaggtgggtgccgctattaatggcctggcacgcaaaactctgactataaccatgttttttattggtgcttccttgtctattgatgttgtgaaatcagttggccttaaacctttggtccagggagtattgctatgggtggttatcagctgtagtacattagcctacatttattggttctaa

SEQ ID NO: 1232 - DNA, 903 bp, Bacteroides salyersiae
gtgttgcaaaaaaaattatatatttgtatccaaatcaaaaaaaaagaacaggaaatgaaacttatcgcggaaagtggttctacaagaacggagtgggctctggttgaagataatcgtctcgtacagagggttttcacagagggtttgaatcctttttttcagaccagaagagaaataagcaggagcgttagactcggccttcctgaatctttcttcaaaagaaagttggaacaagtttattattatggtgcaggatgtacctcttatgaaaaaaagaatgttttgggtgcttcattggtagcgcaatttaaaacccctatccaagttgaaagcgatttattggcggcggcacgcggattgtttaaatgtgatgccggaattgcttgcattttgggaacaggttctaactcttgtttttatgacggcaaaatcattgttaaaaatgtaaaggctgctggttatattttaggtgatgaaggaagcggagctgttttaggcaaactatttctttctgatgtattgaaagggttagcccctaaagatattacgaccgacttttatgaaaaattccgtattacagctaatgatgccatggaatcagtttataatttaccatttcccaatcgttttttagctactatttcctattttcttgcagactatttagataatgaatatgtctatgagttattagtgaataacctaaagaactttttcatccgtagcgtatgtcaatatgactataaaaattatcctattcgttttatcggttcagttgcctacagctattccgaaattctaagagaagtagccagagactttggagtagaattagatattatagaagaaacgccaatggacggattaatagaatttcattctatgaatattgaagaaccataa

SEQ ID NO: 1233 - DNA, 888 bp, Bacteroides salyersiae
atgaaagcatttgtatttcccggtcaaggtgctcagtttgtgggcatgggtaaagacctgtatgacaactctgcattagcaaaagaattgtttgaaaaagcaaacgatattctcggatatcgcattacagatattatgttcaacggtactgatgaagatcttcgtcagacaaaggtaactcagcctgccgtgtttttacactcggtaatttccgctctttgtatgggtgacgatttcaagccggaaatgaccgccggtcattcgctcggtgaattctctgcattggtagctgccggtgctctttcattcgaagatggtttgaagttggtttatgcacgtgctatggctatgcagaaggcttgtgaggtgactccttctacaatggctgccatcattgcattgcccgatgaaaaggtggaagaaatttgtgcgtctgtttctgccggaggtgaagtttgtgttcctgccaattacaactgtcccggacagattgttatttccggttcagtgcccggtatcgaaaaggcttgcgaattgatgaaagctgccggtgccaagcgtgctcttccgttgaaggtaggtggtgcattccattctccgttgatggatcctgcaaaggtagaactggaagctgctatcaatgccacggaatttcatactcccaaatgtccggtatatcagaatgtggatgctttgcctcataccgatcctgctgaaatcaaaaagaacctggtggctcagttgactgcttccgtacgttggactcaaacagtaaagaacatggttgccgatggtgctacggattttacagaatgcggaccgggtgctgtacttcaaggattgattaagaaaatagattctaccgtttctgctcatggaatagcataa

SEQ ID NO: 1234 - DNA, 837 bp, Bacteroides salyersiae
atgatagttactgaagctcatcttatttatttttcgcctacccacacatctaaacaagtaggtgaagcaattgttcacggaataggaataactaatttttcaacgaccgatttaaccttaaaaccggttgaagaaatggagcttccgacttctgcattggctgttgtggtagttcctgtatatggcggacatgtagctccgttggcaatggagcgtctggaaagtatccggggtaacgatactccgatagcattggtggtggtttatggtaatcgtgcttatgagaaagctttgacggaactggatgcctttgttttactgaatggatttaaggtaattgccggggcgacttttataggtgaacactcttatagcagtgcgaaatatccgattgcggcagggcgtcctgactctaatgatttggaattagcagtggaattcggcaagaaattgaaagccaaagtagaagcagcttccagcctggaaactctttatccgattgatgtccgggctattccccggccgcgacaacctttttttccgttatttcgctttttgcgtaaggtgataaaactacgtaagagcggtgtgcctttgccgcgtacaccgtggttggaagacgaaagtctttgtacgcattgtggtgcatgtgtacgtcattgtccgacaggcgccatattgaaaggtaatgaaacacaaacggatgtagaaaagtgtattaagtgttgtgcttgtgttaaatcatgtacgcaacaggcgagagtgtatgatactccgtttgctgtgttgctttcgcagtgttttacccggcagaaagatccgaaaacaatcttatag

SEQ ID NO: 1235 - DNA, 1137 bp, Bacteroides salyersiae
atggctattacaatcaaaaaagtatctggaagaaaagaactaaaaaagtttattcgtttcaatttcaagatgtataagggtaacccttattctgttcccgatctttatgacgatatgcttaatacgttcaacaaaaagaaaaacgctgcgtttgaattttgtgaggccgaatactttctggcttataaaaatgatgaactggtaggccgtgtagcagccattatcaaccataaagccaatgagaaatggaataaaaaagatgtacgtttcggctggatagatttcatcgatgacatagaagtatcttctgcattgctgaaaaccgtagaagaatggggcaaagccaaaggcatgacagacatccaaggcccattgggatttaccgacttcgatgcagaaggtatgctgatagaaggatttgaccagctcagcaccatggcgacaatctacaactatccttattatccccaacacatggagaagttgggatacgaaaaagatgctgactgggtagaatataaaatctacataccggacgctataccggaaaagcataaacgtatctccgatctcatccaacggaaatataatctcaaaataaagaaatatacctccgccaaaaagattgccgcagactatggacaggccatttttgagttaatgaatgaagcctacagtccgttgtacggttattccccactgtcacaacgccaaatagaccagtacgttaaaatgtatctgccaatcgtcgacctgcgcatggtaacccttatcacggatgccaatgacaaactgattgcagtaggtatctcaatgccttcattatcagaagctctgcaaaagtcacatgggcgtctgttaccttttggctggtattatcttctgaaagccctgttcatgaaacgacgggcaaaaatgctcgatctgctgcttgtagccgtgaaaccggaataccagaataaaggtgttaacgctttgttattttccgatttaattccggtttatcaaaaattaggttttatatttgcagaaagcaacccggagctggaagaaaacggaaaagtccaggctcaatgggaatacttcaaaaccgagcaacataaacgtcgtcgtgcgtttacaaaaaagatagaataa

SEQ ID NO: 1236 - DNA, 1098 bp, Bacteroides salyersiae
atggacaatgacatcgatatttttaatcttatcaacaggcagttctccaagcagatatccaaagaggaagaggctgttttgaaagcatggtatgaaaacagcgcagaaaacaagcaggtgtacaaagagtattatctgttgataaaaggattgcgcatctctcaaaacaagaaattcttctcctcacaaatcggagatgcctatgccggcttcgccagaaagaccggtctaaagcagaaagaaagcaggcgatattccgtgccccgctcctggatgcggtatgcagccgtttttgccatagcattcgggctgggtgcaggttcctactatatagcccgctccggctcatcagactctcgcctggcacaaacaattgaaatcccttatggctccaaatctaaagttactttacccgatggaacctctgtatggttgaattccggaagccggttatcttatctggaaagtttcggtcattccaaccggaatgtttctctggacggcgaagcctattttgaggtcaccaaaaataagaaactcccgttcagtgtactttccggaaaggtaaagattaaagtactcggtaccaaattcaactttaaatcttataaggaagatgaaagtgcacgggttactttggtagaaggtagcctgaatgtcggaaatatcgaaaacaatgtaagaaacgtgctgcttatccccaaccagcaggcagtcatcaacaaaaaggaaaaccgggttaccgtgaaaaacgtagatgccaaaagttatgccatgtggacacatccgaaacaggaaatattggatgttatcccgagcaatgtcaccgggcaacccacggcatccatacgggttccaagcgtaacgatacgaaacaccctcttcttcaacgaagaaccgctaagtcagattgtacgtgatctggaacgggcattcaatgtaaaaatcgaaataaaagaccgccaactgagcaccgaacgcttctatggcgatttccgaaacgacgaaacgattacagagatactggacatcatggccgccaacaacaatctgtattacacgatcgatggagatgaaataattatatcaagaaaataa

SEQ ID NO: 1237 - DNA, 987 bp, Bacteroides salyersiae
atgttacaatcatataataaggaacaagccattctacgaataaaccgattatcggaacaaggcaaagagtttgtctttatcattgattatttacaagattgttcgtacatagaagaaacaaaccgattggattcttcgtttgtcttgtataatctgaatggatttaccaatcaggattctattttccctcttcgtaaaactgccgtgcaatggaatatcgatttcccacctttcgaccaatataagccatctttcgattatgttctggaaaatatccggggtggcaacagctttctcactaatctgacttgccggactccggtcacgaccaatctaagtttgaaggagattttttatcactcaaaagcgatgtataagctatggttgaaagatgcttttgtggtattttctccggaaatttttgtgcggataaaagggcggaaaatctattcttatccgatgaaaggcactatagatgcttctcttccgtctgcatacaatcaattgatgaacgatccgaaagaaacggcggaacacgctacgattgtagatctgatacgaaatgatctgagcatggtggcggaacaagtttccgtgacgcgttatcgttatgctgatatcctgcaaaccaactccggttctattttgcagaccagttcggaaatctgcggtatccttcccgatgattatcggacgcggttaggggatattatctttaaattgttgccggccggttctatcacaggtgctcctaagttgaaaacaatggatattatagctcatgccgagaactataaaagaggtttttatacaggaatttccggatattttgatggtaataatctcgacagtactgtaatgatacgctttatcgaacagcaaggagacaaactttattttaaaagtggtggaggaataacttgtagaagtaatccggaaagtgaatataatgaaatgaaacagaaaatttatgtgcccatttattga

SEQ ID NO: 1238 - DNA, 1182 bp, Bacteroides salyersiae
atggaaaaaattatctacaatttagtattcaacagaaaaaaaagcctgaataaaaaaggcatggctttagttcaaatagaagcctatttgaatagaaagaaaaagtacttttcgactaaggtctatttgaaaccggaacagtgggatgcaaaaagaagaagagtaaggaatcatccgaatgcagatgcaataaatcggatgatttatgagtatatggctgagatagaaaagaaagaattggggttatggcagcaaaggaaaacggttacattggatgctttaaaagaggcattggtaagcgtgcaagaggaggaggagtcttttctggcttttttccgtaaggaaatcatcaattccagattgaaggagagtacaaagcaaaatcatctttcaacgcttgaattactgagggagtataagaaagatgtttcatttaccgaactaacttttgagttcatatcttcttttgatcaatacttgcaagccaaaggatatcatgtgaataccatagccaaacacatgaagcacctgaaacgtcatataaatacagcaataaacaaggagtatatggaaatacaaaaatacgcttttaggaaatataaaattaaaagtgtagaaaataaccatactcacctttcgccggatgaacttaataaaatagagaaacttgatttgggagatagatataccaggctggaaaagactaaagatgcttttttgttttgctgttatgcggggttacgttattcagattttgtgaatctgtcttccgaaaatatcgtcaaaattcaaaaagacacttggttgatatataaaacaataaaaaccagaatagaagtgagactccctctctatctattatttaaaggaaaaggtcttgaaatattgaataaatatcagaataatctttcggatttttttaatctcagagataattcgaatgtgaataaagaactgattattatatcaaggcttgcaggaatacataaaaaaatatcttttcataccgcaagacatactaatgccaccttattaatatacaatggagtgaacattactactgtacaaaaactattgggacataagagcgtaaaaacaacacaagtatatacgaatgttatggatatgactattgtcagagatctggaaaaagctaaaagtaccaaacgttctccggtgtaa

SEQ ID NO: 1239 - DNA, 978 bp, Bacteroides salyersiae
ccggagaaagcaaaaaagagcgaaaacatcatccgtatccctgtcaaaacttatacttttgcaacgtttttacagttatataagatcatgcagtttcaatcaataaacaaaacaaaaggtatcctgtacgcggcagtctcctcttccacgttcggactggcgcctttcttttccgtgatgcttctcaacgtcggtttctcttctttcgaggtgttgagttatcgttggggaatagcatctctcacactgatacttttcggctggctgtccgggtgtaacttccgattgaataaaaaagatttcggaaccgtctttctattaagtctgtttcgggcagctacttccctgagccttttgatcgcttatcaaaacatagccagcggagtagcttccatcattcacttcatgtacccattggccgtggccatgagcatgatcctctttttccatgaaaagagatcggcatggatcattactgccatatcgatgtcgatcgtcggcgccatactcctttcatcggggaacatcggtcatggcaacggtaacactacgctcggtatcatatctgcctgtatatccgtattctcttacggcggatacattatcggagtaagaaaaagtcgtgcagtacagatcgaatcgactgtgctgacttgttatgtaatgggattaggagcgcttttcttcatcatttgcggctgtttcaccagtggcatccggctggcaaacgagggtgttacctggctatacatcttagggttagcattaccggctacagccatttcaaacatcacactggtcaaggcaatcaagcacatcggccctaccctcacctccatattcggggcaatggaacctctgacggcagtcattatcggcatagtagcctttaaagaatcattcaccgtagcaagcgccatcggaatcatgctgatcgttacggcagtcaccattgttgtgtgcaaaaataaaaaataa

SEQ ID NO: 1240 - DNA, 1284 bp, Bacteroides salyersiae
atgaacaaaactgtaaacagtatgaaaagttttcatccgaagaaagccgttacctttgccacgatcaaaaaaagtagaaaaatggagaataggaaatataattcaagaaggtttgtccttgtatttgcagcattgctgtcggcattcggcccgtttatgaccgatttgtatctgccggcttttccggaattgatggaatatttcgatacgactacttccctgatacaactcagtttgacttttggcgtgatcggtttggctgccgggcagctggttatcggtccgttgagtgataagtacgggcgtcgtcgtccgttgattttatctttgacggtgtttgtagtatccacgcttatttgcttattatgccgggacgtgattacatttatctgtttccgtcttttgcagggtattgctgctgccggaggagtagtgatttcccgttcgatagctgtcgatctatatgaaggaaaagaattcactcgtttttttgccatgctgagtgctgtgcaggggttggcaccgattgtagctcctattgccggtggattattgttagggataacagactggaggggtatttttgcagtacttcttttaattggtgtggcgatcttggcggctgctttccgttttcgcgagtcgttgcccgaagaacgcaggcaaacagggagtgtactggccacttttgcaaattttcgttcggtgttgggtaataagcattttgtgtgctacatgctgatacagtcgtttgcaatgggagtattgtttgcatatatttcctcatccccgtttatttttcagacagaatacgggttaaccccggtgatgtacagcgtttgttttgctttcaacggattggcgattatgacgggaaatttgatagttccgagatttggaagcgaagaacgggcattgggtataggagcctgttgtctgctgatagcttcgcttgtattggccgtttgcctgatgggcggctggtccgtggttgcgatagaaataggatttttggtattgcttttttgtgtgggcatggtgctgcccacctctacctcgctggcattggcattggaaagaaagaattcggggaatgcttcggcgatgttgggattctttcaatttactttcgccggtttggtagctccgttagtgggactgggcgaggtttcagttgctacaagttgggtaattgtcatagccagttgtgcaacgtgcggattggtagggcttttattaatggcgacttctcatactttttttcagaacacatcatataaatag

SEQ ID NO: 1241 - DNA, 921 bp, Bacteroides salyersiae
atgaaggagacacaagaggaattgacatatcacgtaccggtattactaaaagagagcgtagacggaatgaatatctgcccgaatggcacgtatgtagacgtgactttcggtggtggagggcattcccgtgagatactttcgcgtttggaaaaagacggacgtttattaggattcgaccaggacgaggatgccgaacgaaacattgtcgatgacccgcgcttcattttcgtgcgaagcaatttccgctacctgcacaactttctacgctatcacgatatagagaaagtagacgccatactggcagacttgggagtatcctcccatcacttcgacgacagtgaacgaggattttctttccgcttcgacggtgcattggatatgcgtatgaacaaacgggccggactcacagcagcagatgtggtaaacacttatgcagaagaacggttggcagatatcttctacctgtatggagaattgaaaaacagtcgcaaattagcatcggttatcgtcaaggcccgtgccaacggacaaataaagacaatcggcgagtttttggagatcatcaagccactcttcggccgggaacgcgagaagaaagaacttgccaaggtgtttcaggcacttcgcattgaagtaaatcaagagatggaggcgttgaaagaaatgttgacagcagcaacggaagccttgaaaccgggaggaagattagtcgttatcacttaccattcattggaagaccggatggttaaaaacattatgaaaaccggtaatgtggaaggtaaaacgacacaggattttttcggtaacctgcaaacgccttttaaattggtgaacaacaaagtcattgtgccggacgaagaggaaatagaacgcaatccgagatcacggagcgccaaactaagaatcgcagaaaagaaataa

SEQ ID NO: 1242 - DNA, 1101 bp, Bacteroides salyersiae
atgattaagtattttgatttacagcgtattagtgactcttttgaaccggagctatcggaaacggtggttcgtgtaacccgttccggttggtatcttcaaggagaagagacccgtgcttttgaagaggcttttgccggatattgcggaacccgatattgtattggtgtaggaaatggtttggatgccttgacccttatttttatggcttatcgcgagttgggagagatgcagccgggagatgaagtgattgttcctgccaatacatatattgcttctattttgtcagtggttcgtgccgggctgaaacccgtgttttgcgagccttcttttgattcctgtaatatagcgcccgaagcgatagaaactttgattaattcccggactaaagcgatacttcccgtacatttatatggaagatgtgctgatatgcaacctatattgaatatagcggcatcttatcgtctgaaagttgtggaggatgctgcacaatcgcatggggcggtttatcatggaaaacgtaccggtaatcttggagatgcggccggattcagtttctatccggcaaaaaatcttggagctttgggagatggcggtgcagtgacaacgaatgaccaacagcttgctgcgatgatacgttctattgccaattatggttcttctgccaagtatgttcatctttgcaagggaattaacagtcgccttgacgagctgcaggctgctgtgcttcggcttaaattggctcgtctggatgtcgataatgagcgacgccgaaatattgcctgccgatatcttgatggaattaaaaatcctctgttgactttaccgtctgtcgatgactggaaacaacatgtatttcacatttttccggttttttcttcttgtcgtgacagattgcaagcctttcttgcagcggagggaatacaggcacagatacactatccgatacctccgcataaacaggaagcctttaccgaatatagctctctgtcattgccggtgactgaacgaatacatcgggaagaactcagtctgccgatgtctccgctgatgacggatgaagaggtcgatacggtaattgccgcactgaaccggtttgtgtaa

SEQ ID NO: 1243 - DNA, 675 bp, Bacteroides salyersiae
atgatacgcaaattgatactcggtttttgttttctgctggcaatgtttccggcaagtgctttctctttggagggcctctctgttgaaagcccaagagaacaggtggtggtatttattgatgggaagcaggtgtgccggcctacatatagttgttttatcgctaacctgcatggtggcagttatcgggtggaggtatatgccgcccgtcgtggaaaccgctttgaaagagagaacttattgtttgatgagcgtgtttattgttcgggtagggaggtgaaggagatcgtcatcgatggtccggacagaccggagcacagaccgggcaggccggataaacccggacaccggccggatggtttcaattccagggagccggtgatgagcgacagctctttcaatcagttcatgagctcattgaaaaagcagccttttgaatccgaccgtaacgctttacttgacaatgcattgataagttcgtattttactaccgaccaatgtatacggttactggaattttatacatttgacagtgaaaagaaaccgttccttaagaaaatatatccgaggattgccgataaggcgaatttcttccgggcattggataaactgacctttagttcggataaggaggaggtaaatcagtttataaaggtatatcatgagaataataactaa

SEQ ID NO: 1244 - DNA, 1257 bp, Bacteroides salyersiae
attaatatgttcagacacattcttacaattatatggaataaccgtcgtcacaatggatggctgatagccggtttgtttgtgatgtctacttgtatgtggtatgcggtagattatgtttacacggttacggtcaatcagacccgtcctttaggattcgactggcacaatgtgtatgccctcaatatcggggtactgacccctgaaagccataaatttttatcggacaaacttcataccaagaatgctacaggtgatttttacactttcatggatcgcttggaacatcatccggctgtggagtctgtttgttatacacgcatgcataaacattatgtatggacgaatcaaggtgcctctcttatttacgatacaattacttgcaacagttggatgcgtaccgtcagttccggatatttccgggtatttcgggtgaaaggggcggatggaagttctccggaacagttggcaggcagggccaatcttaccgatattatcattacggataatttggcatgccagctctttcccggacgttctgctgtgggtgaatgggtaaaaaacaccttgaatggcgacagtgtacgtattgctgccgtatgcgaaaatcaaaagtataatgaatttacctcccaccaacgggctacctacataccgttgcatttcacacaaaagcgtcctttttactatctggaggctccctatttgggtgtgtacattcgtgtgcatcccgattccgacggtgatgattttattcgtagattccgtaaagacatgcgtgaacagttgatgatcggcaacttttatcttgaagatatgcgccctatgaccgatttccggaacgagcaattgaaagaacctcgtaatgatttgtatacctatctatcagtggcggtattctttttattgaatgcttttctggcagtgttgggcactttttggtttcgaacgcagcaacgtcgttccgaactcggattacgtgtagctttgggcggttcaagagtcagtctgtgcaggcttctttggggagaaggggtagtattgctcacattggcattcattccggcaatagtagtggcggcaaacttgggattggcagaaattgtatccgattatccggttgaattcaccttgttccgttttgttgccggtatttttatcacttatctattgttggtatttaccgtttttctggctgtttggattcccgcacgtcaggctatgaagatacaaccggcagaagcattgcgtgaagagtaa

SEQ ID NO: 1245 - DNA, 1767 bp, Bacteroides salyersiae
atgaaaaaattacatcttctatttctttttattggaattttattttcatgtcaaaacgaggacgatccggatattataatcaatatacctaagaaggaatatacagtagaaagtacaggcgggattgtcgatatcattctgcaatccagtatggaaccaagcattgatattgaaaaaaaagaatggttgcattctgtaaatacaagatcggaacagtttaatataaaaagttttatatgcgacccaaatcctctatcccaagaaagaacttccaaaataatctttaccataccggggtcagaaattatacagactattttaatcacccaaaaggcatctgtaagtaatgagccctgtatcacgtcatttgttttcgaagcggataaaaatcctcagttattaatttccgatattgttgcaacaattaataaagacggaactatctccgcacatgttccatatgtgttacctcacaaacaattaattcctaccataaaattggacaatgaaaagacatgggtaaaagtaccggaaaacatggaaggacttaacttttcttcgcctttgaacatcacaatagaaaacactgaaggaaaaacgaaagaatacaaagttttagtatacgctttcacgggattgcctgtgatgtatatcaatacggaaaatgatacagaaattacttccaaagaagaatatgtcaacgcacatctacgaattgtagaggatatctatacccgctcgggagaaatattcgagagcgatgtaacaattaaaggaagaggaaattctacttggtcgctgcctaagaaaccatatgcgttgaaatttgataaaaagacttcgctgttgggtgaaccaaaagataaatcatgggtgttattggccaattacacggataaaaccaatctgcgaaatgaagcaagtttctttatgggaagaatcagtaatttggaatggacaccaaggactcactttgtagaattattcatgaatgaagtatattgtggtacttaccaattgtgtgagaaaataaaaatagcagattcgagagtcaacattacagacgatggatacttaatggaaatagatcaacctgacaggatcggcccggaagacatatcattcaaaacgaagaatttgacgttttgtgtcaaagatcccgatatagaaaaaaatggagagcgtcataaatggatatctgattatgtaaataaagcggaagaagcattattgggaagtaattttttagatgaaactgaagggtatgccaattactttgataaagtgagctttgtcgattggtatttgattaatgaaataacgaagaataatgatgcatgtttcttcagtagttgttatttaaacattactccgggaggaaagctaaaaatgggaccattatgggattatgatattgcattaggcaatgttaactataatgacaatcaaagctacgaagggttttggataaagaagaaagtaacttggttttcccgaatgttcgaagatccttcttttgtggcattggtaaaagaacggtttgcatacttcaaatccaaagaaaatgatatgctgactaatattaacgaaaatgcaacttatttgaagttttctgttattgaaaacaatgcgaaatggaatacgctatacgaacagacgtggcctaactatgcggtttggggatcttataataatgaagtgcagtatctgaagcaatggttgagtaaacgtttggcatggctcgaaagtgctttctcggaattgtga

SEQ ID NO: 1246 - DNA, 606 bp, Bacteroides salyersiae
atgtttgcagattttaattttcaacagatgatcagtgcgtttatcgtattgtttgctgtaatcgatattataggctctattccaatcataatcaatttgaaggagaaaggaaaagatgtaaacgcaatgaaggcaaccgtaatttcattcgttctgctgatcggattcttttatgccggcgatatgatgttgaagctttttcatgtagatatcgagtcttttgctgtggccggtgctttcgtcatattcctgatgtctttggagatgattctcgatgtcgaaatattcaagaatcagggacccattaaagaagctacattggtgccgcttgtctttccgcttttggccggtgccggtgcttttactactctgttgtcattgcgtgcggaatatgccagtgttaatatcatcatagccttggtgctgaatatgatttgggtgtattttgtggtgagtatgacagggcgggtagagcgttttcttggaaaaggcggtatttatatcattcgtaagtttttcgggattattttgttagctatttccgtaaagctgtttatgagtaatataaccttgatggtagaggcgttgcagaagcatttgccataa

SEQ ID NO: 1247 - DNA, 831 bp, Bacteroides salyersiae
atgaagcccatccaaaggaaatatctgaaatatctgcttattgccatcgtctgcttcctcgtatttgctttctggcctcaaagaaaggaaaaggaagaaggacatccgcgcgattatgcggaaatagcggcagacggtattctccgcgcggcaacagaatacaattccatcagcttcttcgttgacggcgatacggtgagcggattccactatgaactgatagaagcctttgcccgtgataaaggaattcaggcacaagtctctccggtgatgagttttgaccaacgtctgaaaggacttgaaaccggtaaatacgatgtaatagcatatggcattccagccaccagcgaattgaaagactcgctgctcctcacctcgcccataatcctaagtaaacaggtattggtgcagcgaaaagcaacgtccgaaaacgattcgctctttatcagaaaccaactcgatctggcaggacgaaccttgcatgtcgtaaaagcctctccatccatccttcgtatccgtaatttgggagacgagatcggggatacgatttatatcagtgaaatagaaaagtacggttcggaacaactgattgcaatggtagctcatggagacatcgattacgctgtctgcgacgagagcattgcacaagcggccatagattcactgccccaactggatatcagtacagacatcagtttcacgcaattttactcttggggggtaagcaagcaatcgcctgtcctgctggatagcctgaacacatggcttacaagtttccgccaaggaaaagagtataaagaaatattgcataaatattatcctgttaagtag

SEQ ID NO: 1248 - DNA, 645 bp, Bacteroides salyersiae
atgaaaaaactacttacgaaaggacagatagccctgctcgtcatcttttcagtgctgattatagatcagattatcaaaatctggattaaaacccacatgtattggcacgaaagcatccgcatcaccgattggttttatatctatttcactgaaaacaatggcatggcattcggtatggaaatcttcgggaaactattcctcaccaccttccgtattgttgcagtcgctttaattggctggtatctttataaaatagtaaaaaggggattcaaaaccggttatatcatttgtgtttcattaattctgaccggagcattagggaacattatcgacagtgtattctatggggtaatctttaatgaaagcacccattcgcaaattgccggctttatgcccgaaggaggaggatattccacttggttttatggtaaagtggtagacatgttctatttcccgataatcgacaccacctggcccacttggatgccgtttgtaggtggggagcacttcatattcttcagccctatattcaactttgccgatgccgccatcagttgtggtatcattgcgctgcttcttttttatagcaaatatctgaacgagtcttaccactcacacggaaaaaaagacgaagacagaaaatga

SEQ ID NO: 1249 - DNA, 567 bp, Bacteroides salyersiae
acatttgcaagcgataaccggaaagtaatcattaaaataaataataaaactatgctaaagaaaattgcactattaattatgttagtactcccgatgggtgtatttgcacaatcaacacttaagttcggtcacatgaattcgactgatattattcctacaatgcccgaatatacaaaagccatttcggaattgcaggctttggaaaaaaactacacagatgaaattcaacggactcaagcagaattcacaaaaaaatatcaggaattccagcaagcaatagcaaaagattctctaccgcaaaacattgcagaaagaagacagaaagaattgcaggatatggctgaaagacaagaacaattccagcaggaagcacaacagggaatgcaaaaagcacagcaagagaaaatggctcctgtatatcagaagttagacaatgcgatcaaagctgtaggtgaagcagaaggtgttatctatgttttcgaccttgcgcgtacgcaaataccttatatcggtgctcaaagtatcgatcttaccactaaagtaaaagctcagctcggaattaaataa

SEQ ID NO: 1250 - DNA, 1443 bp, Bacteroides salyersiae
atggactattcacaatttctatatatgaaagaggagctatcactggtagctgtcatcctcattatatttttggcagacttgtttatgaacccggataaacggaacaacatgaacaatgcgcgtttcgccactatcctgcccattgtactgatggtcattcatacaatcatcaatctggtacctgccgccggtagcgccgaagcttttggcggaatgtatcagtacgccccgatgcagaccatcatcaaagccgtgctcaatatcggtacaatcatcgtatttttcatggctgccgaatggctgaagttagaagatacttcaatcaaacgcggtgaattttatattatgaccctctctaccctgttgggtatgtacctgatgatttctgccggacacttcttgatgttcttcatcggacttgaaacagccagtatcccaatggcagcattggttgctttcgacaaatatcgtcatcactctgccgaagccggagccaaatacatactgacagctttattctcaagcgccttgctgctgttcggcctgtccatgatttacggtagttgtggtacactttacttcaacgacctgcctgcccacatcgacggcaatatgctgcaaataatggcattcgtatttttcttcaccggtatgggattcaaactgtcactggttcctttccatttgtggacagctgatgtgtacgaaggtgcaccgagtgtggtcacagcctatctgagtgttatttccaaaggttcggctgccttcgttttactgacggtactcattaaggtatttgccccgatgattgccgactggcaggaggttctctactgggttacgattgcttccatcacattggctaacttatttgccatccgccaacaaaatctaaaacggttgatggccttctccagtatatcacaagcaggatacattatgttaggtgtgatcggtggtactgctgacggaatgtcatcactggtctattatgtactggtttatgccgtagccaatttaggagtatttgccgttattaccatcgtggcactacgcagccataagttcacgctcgaagagtatgcaggactttataaaaccaatccgaaattagcatttgtgatgaccctatccctattctcactggccggtattccgccatttgcagggttcttttccaaattctttatcttcatgtctgcgttccaggcaggtttccacttactggtatttatcgctttggtcaatacggtcatctcattatactactaccttctgatagtaaaggcaatgtacattactccttcagatgatccgataccgacattccgcagcgataactgtacacggatagggctggccatctgtgtactcggtatagtaggtttaggaattgcaagtattgtttatcagacgatagacaaattcgcgttcggattataa

SEQ ID NO: 1251 - DNA, 744 bp, Unknown
  Description of Unknown: Firmicutes sequence
atggagcacctgattttctattttggtgcctgccttatgggactggcaagtttcgtaagtatgctggcggtttacaacagtaacaaaagagtattgggagatttgaaaaatccgtcggagacaaaagataaatggttaagcggctttgtacaggagtatcagaagctggcaaaagacaatatagagatacataacccttctgtttatgtaacgaaacgaatgagaggacgaaagatagcactatggaatatgcgccagataaagggcatttcctggggaacttttatcctctcttttttattgatgggagtggagattctgcttttgcggcagcagggcggcaaagcggaccagtttttggttctgggaagggaactgccattgatgagtgtggcggtctttacgggaatcggcatgggaattgtcctgcttctttgcagacttttgattggtacgggctatcaggaggaggaactggaaaccaatcttctggattatgtggaaaactgccgaagcgggactgcaaaaattatctctatggaaaatgccagaacttccggaagcagggaaaaccggggcagcagaaaaaaggaaaaccagacaggagagaagaaagaaaaagcggcccggcagatagaacagggaatcatggaggctgcagccacagacagccgttacagccatctgctcagtaaagaggaagaggagattgtaaaagatgtggtgaaagaatttctaacttga

SEQ ID NO: 1252 - DNA, 996 bp, Unknown
  Description of Unknown: Firmicutes sequence
atgaagaagaaagcattggtttttattttgacaggagcagcagtactgtctctttcaggctgcggtggcacagagcaaaaggtttccggaagcggactgaccacagtccgcgccgctgtgatgacaaacggtgcgcagcactggattgcagctgtgggagaggaagaaggtatttttcaaaagtatgggataaaactggaaacatcagaatttgcagcaggtattaatacggtggatgccgttgtaaccggacaggcagatgtgggaaatctggcagactacgcgctggtaaaccgcatgggaagtacacaggataaaaatcttcttattctcagccgcatcagttccggaaccgggggcgccctttacgtagacggcagtaaggtaaaaagcctggaagacctggcaggacagccctttgccacacagccgggaacggtatgggacttctggaatgcgaaaacttatgaaaaagcaggcataggggaaacagaacaaaaactggtcaaagtggacagtgcagcttcggcggtggctttgatgacaacaggaaaggcagcggccttctgggcaagcggcgcgaatgcggcaaagctggaggaaggcggacttgaaaaacttctgacgctgaaggatttgggccttacagtggattcctattatattaccacggcttcttttatcaaagagcatgaggatgtggcggaaaactatctgaaggcttctaaagaaacggttgactggatatattcccatgaggaggaagcggcggaagtggtttcggacaagctgggaacatcaaaggaacagtttctgtcagaacttcaggataccaatctgaccatagactattctgaagaaaccaaaaaacatttggaggacataaaagcctgggcagttgcaaagggggattttgacgactatgaactgtcagattttacagatttagagccccttcgggcagcgctgcctgacgccgaagcagcggaagaataa

SEQ ID NO: 1253 - DNA, 873 bp, Unknown
  Description of Unknown: Firmicutes sequence
atgaaagaaacacataaatttacaaaaattttgtcaaaagctatcatttacattgctctttttgttctggctatttctattattgtaccggttggctgggtatttatggcgagtgtaaagcgcaatgcggaatttatcggtgcagatattaatccatgggcgctgccggcagacccacgttgggaaaacttcaaacaggcttttgtagatgcgagaatgggagagttcttcctgaactccgttatggtaacagctctggcgcttttcctgcttttggtgcttgctcttccggcttcttatgtactggcaagatttgatttcaagtgcaaaaagattttgaatttggcctgcatggcaggattatttatcaatgtaaactatattgtagttccgatttttctcatgctcacagacgccaacaaggcttttcaggtggattttttcctgaataaccgtttccttctggcgcttatttacgcggcaaccagtcttccgtttacgatttatctgttaagcggatatttcaaaacgctgccaaagggctttgaagaggctgcttatattgacggctgcggttactggaaaactatggtgaaaattatggttccaatggcaaaaccaagtattattacagtcattctgtttaacttcctttccttctggaatgagtacatcattgcttacacgttgatggatggacatgacacactggctatgggactgaaaaacctgatggctgtggaaaagacagctacgaactacggtatcatgtatgcaggtcttgttattgttatgcttcctacattgattctgtatattgcagtccagaaacgtctgacagaaggtatgacactgggcggactgaaaggatag

SEQ ID NO: 1254 - DNA, 1317 bp, Unknown
  Description of Unknown: Firmicutes sequence
atgaagaaagttgtaaagttcggaggaagttcactggccagtgcggagcagtttaaaaaagtaggcgcaatcatccgcgcagacggaaccagaagatatgtggtaccttctgcaccgggcaaacgcttttcagaagatacaaaggtaacggatttattgtatgcgtgttaccgcgccgccaatgaagagatttttcagaaggtactggcagaaattaagagccgttatcaagagattattgacggtttggaattgtctctgtctttggaagaggattttaaaattctggaggaaaacttcagacagcagattggggaagagtacgcggcttcccgaggagaatatttaaacggtaaaattatggcggattatctgggctttacctttgtagatccggcagaaatgattcgctttgacggaaacggacagtttgacgcagagattacggaagccttagtggcaaaaaggctgaaagacgtgacagaagccgtagttcccggtttttacggtgcaaaagaaaacggggaaattaagacgttttccagaggcggctcggacattacaggttccattattgcaggagcattagatgtggaattgtatgaaaactggacagacgtatccggggttatggtgacagaccccagaatcatcaacaatcccaaatccattgacaccattacctacagagaattaagagagctttcctacatgggcgctaccgtacttcacgaagatgcgattttccctgtcagaaaagccggaatcccgattaatattaagaataccaatgcgccggaagaagacggtactatgattgtggaggatacctgcaaaaagccgccgtataccattaccggtatcgcaggcaagaagggattctgttcgctgtttattgaaaaatccatgatgaattcggaaatcggctttggacgcaaagttttgcaggtgttggaggaacagggaatttcctttgaacatgtaccttccgggattgacactatgactatctttattcatcaggatgaatttgcggaaaaagagcagcaggtgattgccggaattcacagagctgtgaagccggattatatggaactggaaacggatttgtctctggttgccgttgtgggaagaggcatgcgttccaaccgcggtaccgccgccagaattttcgcggcccttgcccatgcgaatgtcaatgtgcgtatgattgaccagggctccagtgagctgaatgtcattgtaggcgtaaaagacgaagattttgaaccggcgattaaggccatttacgatattttcgtagagacacaggtttaa

SEQ ID NO: 1255 - DNA, 1608 bp, Unknown
  Description of Unknown: Firmicutes sequence
ctggccagcggttattcttccggtgagaaggacaacctgcgctatacctttaactggaacaacaagagatttcccgacccggagggtttctttgaaaaaatggaaggtatgggaattaacgtgattccaaacatgaagccgggaattctggaaaatcacccttaccgggaagtttttgaagaaaatgatgtgtttgtaaaaacaccggataaaaagagcgactaccgtggacgctggtggggcggagaaggacgctttgtggactttacaggtgaaaagggaagaaacacctggaaagaacttttaaaagaaacgctgttgaaaaaaggttccaagacggtatggaacgacaactgtgagtatgacggcattgaggaccgaaatgcgttctgtgaatttgagggcatgggcggaaccatggcagagctgaaaattattcattccaatatgatggcttatacggcaaaggaagccctggctgaggtatatccggaagaacgtccctacattattaaccgggccggattcgcaggaatccagcgttatgctcaggtttgggacggagataatctgacagactggcgtacggtgaaatttaacattgccaccattatgggcatgggaatgtccggtattgccaataccggctgtgatatcggcggttttgcaggtcctgctccggaggcagaacttcttcttcgctggattcagaacggtattttccagcctagattctgtatcaattccgcaaacagcgacaatacggtaacacagccttttatgtacgaggaaaccctgccttatgtacaggctgcatatgcccagagatatcgcatgataccgtatctgtattctcttatgcgggaagcgcacgaaaacggtatgccggtgatgaggccgctgtttctggagtttccggaggataaaaactgctacacagacgaacatctgacctttctgttcggaccgtctgtgctggtggcaaacgtggtggaaaaaggggcgaagacacggaaaatctatctgccaaagggcgctgtgtggtatgatatgaacgaccattttaaggcctatgagggcggacagaccatagaaattccggttaccctggcttctgtgcccatgttcttcagggactgcggcgtgtatgttaccagcgaagatgtgacccagattaagagagataccctgaaaactctgaacttcctcattagctgtgaaaacgacgtgacatttacttactatgatgatgacggctggtctaagaagtttgaagacggagagtatgcatctacaaaaatcgaggtaaaggccggagacagaaagaccattacctttacaaagaacggttcttatgaggaaacctgggataacctggaactgaatctggtgagtaaggaaaaaggtgcttactgggtaacagtagaaggagaaaagattgcccaattcctgacaaaagagagctttgaagaagcggaaagcggctggtactatgacatgtccgaccgaattatccgcatgaaatgctcgaaaccggacaaagacagctttaccattgtgataagctgtgaaaaatttgatttgattggtatggaatttacagattaa

SEQ ID NO: 1256 - DNA, 1344 bp, Unknown
  Description of Unknown: Firmicutes sequence
atggaaacaaaaaaccgttttttttcgaatgctgatttgcggaagttgattgtaccgttgattattgaccagtttctgcaggcatttgtgggactggcagattctattatggtagccagcgtgggagaggcggctgtatcgggagtttctctcattgacacggtcatggtgctgattctgaatattttcacggctcttgcaaccggaggcgcggtgattgccgggcagtttttggggaagaagcgggaagaaatggcctgtaaagcgacaaatcagcttctttcgtttaccttaaaagcctctctgggcgtgatgctggtgtgttatctgggacgggactttatcacacatgtagtgtttggcaaaatcgatgcggatgtcatgtataactgcaatgtgtatctgatgattgtctttgcctctattcccatgaccgctctttataatgcaggggcgtctgttttccgggctatgggaaattcagccgtggctatgaaaacatcctttctgatgaatgccattaatatctgcggcaatgctcttttgattttcggttttcacagaggcgtggaaggcgttgccatccccactctggtttccagaactgtggcctgtgtcgtgatgttagtgcttttgaataatcagaaacatgtgctgcatatttatcatccgttttcttttaagacagatatcagcctgctgaagaagattctctatatcgggattccaaacggtctggaaaacagtatgttccaactggggaaaattttggtgctgagtattgtaacgggattcggaacggcctccattgcggcaaatgcggtgtcaaacaatgtggcgacttttgcagtgctgccgggtatgtccatcggttttgccatgctgactgtgacggctcagtgcgtaggagcgggagattttgaacaggtgcattattatacgaaaaaactgatgaagacagcgtatgcggctttggccgccatgaatattctggttgtgctggccattccgtttattattaaaatatatgggttgtcggcagaagccagtgaatacgcgtattggattctgatttaccattctgcctgtgtggttaccatatggcccttgtctttctctctgccaaataccttaagggctgcggctgatgtgaagtttgccatgattttatcgattatttctatgtggattttccgcattggtttcagcgttgttctgggtgtgtatctgcactggggcgtgttcggcgtgtgggtggccatgaccatagactggctgttccgcgcggtaagctttaccattcgatacgcaagaggaaagtggaaacgggcagcgctggtttag

SEQ ID NO: 1257 - DNA, 906 bp, Unknown
  Description of Unknown: Firmicutes sequence
atgtttgtattaaattgcacagaaggagagcgaactatgcatgtatttgaattaccatctaatactgtttacgaatatatatttacgggcaaatttcaggctccctccccccattggatacatcaggagagtcctttgaaagattatgaacttttcgttgtgactgaaggtactctttatatttcctatcagggagaaacctttactgtcgaaacaggagatttccttctgctcccaccaggcggtatcagaaagggggttcgcccttcagactgttctttttactggctgcactttgttacgggacagaatccttgcccaaaggaaatccctgacgctctgcttttggcttacattgtcacctccagcaaaacaatccctgttcccagacatggctctattccaaacctggaaaaagttgtaatcctcatgaaacaactccaggatgaggtcaaaaataattatcctgcatgcgggctgaatgccatgacaaccagtattcttatggaactttatggtcaatattacatccgggcacaaagggtcagcagcattaaagatgtccaaaaacagctttattacgatatcgtcgactatataaaactcaatgtgtcaaaaaatttgaaagtggctgaaattgccgcccattttggctacaatcaaaaatacctttcccacttattcgcttctattacaggcactcctctgaagcagtttattctttctataaagattgatgcggctaactttatgcttacagataccaacaaatccatttctcaaatatcccgggaattgggttttttagacaaccacaactttaccagaacttataaatctgtaactggactttctccctctgaataccgcaatacttttgctaaacgaatgttgtttgacaaataa

SEQ ID NO: 1258 - DNA, 771 bp, Unknown
  Description of Unknown: Firmicutes sequence
atcatgaatattcgggaattggaatactacaaaatggtgtgtcagcagaaaagcattaccaaagcagcccatgccctgtatatgacgccccagggactgagcaagattattaaaaatattgaaaatgaactggaggccacgcttttaaatcgaacttcttccggtattacactgacaaaatccggggaatatctgtatgaacatctggaagattttcttgtaccttaccatcatatctgcagtgaaatccgctgcattgagcagcgcttcctgcagggagagggcaatgtggcgtttacggtgggagattccagcaccggatatatggatgctacttttatggaaaagtttgagattaagctgctggtaaaccgtgagcatgctcttgcaaaaaaggaatctgtgagcattgcggatttaaagggagagcgtctgtatcttgaaagcccggaattcagtattcatcatctgattgtggacaaatgccgggaggcggggtttgaaccgaaccttgtgtttgaaaccagcggtttcagcctgtgccataagatggtgcagcaaaacaaggggatttccgtaaccgtagattttatttttgaggacatgaaacaggattccttagtcatgctgcccttttcagacggggagtatttctggtctacttatatgctcacccggaaaggaagtgtgccaaatcctgatattttgctctttcacaatcatgtcatgcgctggctgaaaatgatagctgagaagaaactgatacgatag

SEQ ID NO: 1259 - DNA, 960 bp, Unknown
  Description of Unknown: Firmicutes sequence
atgtctttctccggaaacgtaaaagaggagctgcttcgccaggaagaccctgccagacattgcaggattgcggagctggctgccattattgcctttcacggcgagattgtccgtctgtcaaccaaagaaattattctcaggttatctgcggaaaatgaaagtattataagaaagtgctttacattactggaaaaaacgtttaaaataaatggcgaagtttctattgataaaagaatagtcaaaaaaaacaaccgatttacaattgacgtagaggacccgaaggaaactgtgaagattttacaggctgtgaagcttttgacagcggacagaagacctatacacagtgataccctggtcagccaaatggttattcagaagaattgctgcagacgtgcatttttaagaggtgcatttctgtgtgccggctctatcagcgacccagagaagttttatcattttgaaatcgtgtgtacgactccggcgaaggccctgcagctgcaggaaatcatccagtcttttgaaattgatgccaagatagtaaaacgcaaaaagtatcatgttgtttatgtaaaggaaggcgcacaaatcgtagaacttttgggacttatgggagcaggagtgtctcttatgaacctggagaatgtcaggattctgaaagggatgcgcaacactgtaaacagaaaggtgaactgcgaaacagcgaatatcaacaaaacggtaaatgccgctgtgaagcagatggaggatattatttatatccgggataccgtaggtctccacagactgccggaaaatctggaagagacagctttattgagattggaatatccacaggcatcattgaaggaacttggaactttactgtcaatccctgtaggaaaatccggtattaatcacagactgcggaaaatatgcagcatagcagaggagctcagaggagtcaaggaggaacaagtatga

SEQ ID NO: 1260 - DNA, 699 bp, Unknown
  Description of Unknown: Firmicutes sequence
atgcggagaaagtggctgaaaagaatcatggcgctgtgtatgctctgcgccatatatatgctgggcagggaaggggctgtgctggtggataaaacagcggaaaacagcaaaggcgtgatagtcattgacagcggacacgggggcattgaccccggcgtagtgggaatcggaaatctggaggagaaagaggtcaacttaaaaattgccggatacctggcagaatatctggaaaaagaaggctatgaaaccgtgctcacccggaaaacggacgcagggctttatgaggaaaacagccggaataaaaaagtgcaggatatgcagaagcgctgtgccattataaaagaaacaaagccgattcttacggtgagcattcaccagaacagctatccggattcgtcggtgtgcgggcctcaggtattttactataccaattcggtgcaaggctctaagctggcaaactgtattcagggtgagttaaacacacagttggaggtaagcaagcccagaaccgagaaggcgaaccagacctattatcttttaaaacgcagcgagggaattttaaacattgtagaaacgggatttctgacaaatcccagggaagcagaacttctgggaacggaaaagtaccagaaaaagtgcgcaaaagccatttgcgacggaattttaaattttctaaaaacggtagaaaaggacgcataa

SEQ ID NO: 1261 - DNA, 1182 bp, Unknown
  Description of Unknown: Firmicutes sequence
atgatagcagataaaatgagagaacttgtaaagaacagttccgccattcgtgccatgtttgaagaaggaaagaaaatggcaaaggaatacggtgcagagaatgtctatgatttcagcctggggaatcccaatgttccggcgccgccacaggtaaaggaagccattttaaaagaactggaggaggcagactctctgatgctccacggatatatgagcaacagtgggtacgaagatgtaagagaggcggttgcccgttctttaaaccaacggtttgaaactgcctttgcccagaataacattgtgatgaccgtaggagcagcaggcggattaaacgtcatactgaaaactcttttgaatcccggggacgaggtgctggtcattgccccttatttcggagaatacaattcttatgtggcaaattatgacggaaaagtagtggttgtaagccccaatacagagacttttcagcctaatctgaaggagttggaagaaaagattacagagaaaacaaaggctgtgattgtaaactcccccaacaatcccaccggagtagtgtattccgaggaaaccatcaagcagatgacagcaattctggacagaaagcagaaggaattgaaaacagacatctatctgatttcagacgaaccttatcgggaattggcctatgatggtgtgaatgtgccatatttgacgaaatattacgccaataccattgtggcctattctttcagtaagtccctctcccttcccggagaacgcattggatatctggtgattccggatcaggcggccgacgggaaagagattcaggctgccgccaatgcagctaccagaatcctgggctatgtcaatgctccgtctttaatgcagcgggccgtggccagatgtctggatgcaagagcagacgtgccttattacaacagaaaccgggaagtcctttacaatggattaaaagaactgggattcgactgtattaagcctcagggggcattttacctgtttgtaaaatctccggtggaagatgaaaagatgttctgcgaagctgcgaaaaagcaccgtattctgctggtgccgggcgcgtcctttgcctgcccgggctatgtgcggattgcttactgcgtgtcctatgagaccattgtgaacgccatgcctgcttttcggaagctggccgaagaattttag

SEQ ID NO: 1262 - DNA, 435 bp, Unknown
  Description of Unknown: Firmicutes sequence
atgagaatatcaacgaaaggaagatatgcagttcgcctgatgttggatttggcaaccaattattccgggagtcccatacgtctgaaggatgcagcaggaagacagggaatctctgagaagtatctggagcagattatcagcgtcctgaacaaagcaggatatgtgagaagtatacggggacctcagggaggctatgtactgcagcggacaccgaaggaatataccgtgggaatgatattgagacttacagaaggaagtctggccccggtagagtgtgcagagcaggagttcgctggctgcagccgtgaaaatgattgtgtgacgagaatcctgtggaaaaaattgaatgatgccataaacagtgtagtcgatgaggttacgctggaagatttaatcagctggcaggcggcaaaagcagacgaatatatcatataa

SEQ ID NO: 1263 - DNA, 1893 bp, Unknown
  Description of Unknown: Firmicutes sequence
atgagtgaattcagattaactacagtagaagaatttgaagctgctactgcgagacttctggaaacaggcgcaaaagtcggcgctgattcctggcaggctcgtgtgaaaaatcagacaccacattgtaaatttggtgaagagggcatttgctgccgtatctgtacaatgggaccatgccgtattacaaagaaagcgccaagaggaatctgcggctgcgacgtacacggtattgtaggacgtaactacctgaaatttacagcaggcggttccgctacccattcagaccatggtcgtgaaatctgccataccttatatgaatcatcagcagatggctgctataaagtaaaagaccctgaaaaactggttcgtattgcaaaagaatgggatatcgaaacagaaggcaaagatatctatgatttggcacacgaagtggctctggaaggtctgatggaatatggtaaaccgtttggaacacagagattcttaaagagagctccggaatcacagcagaaactgtgggaagaaaatgaactggctcctcacgcaatcgacagagaagtttcccgttctttacatatggctcatatgggatgttcttccaaaccggaagcgctggtaaaacagtctatccgtgccggactttccgatggatggggcggttccatgatgggaacagagttctctgatattttatttggaactccaaagccaatcgaaacagaagcaaaccttggtgttatggtagaagaaaacgtaaacatcgttgttcacggacatgacccaagtctttctgagatgatttgcgaagttgcagacagcccggaaatggttgcatatgcaaaagaaatgggcgcaaagggaattacaatttccggtgtgtgctgtacttccaacgaagttgcaatgcgccgcggtattccaatggccggtaacttcttacagcaggaaaacgtggttctgacaggggcttgtgaagctatcgtcgtagacgtacagtgtatcttcccggcacttggacctttaagcaaatgtttccatacaaagtttatcacaacttctccaatcgctcagatgccggattctgatttcatccgttttgatgcacatacagcattggaaaaagctacacagattgtaaaactggcaatcgagaacttcaaaaacagaaagccggaattggtatacattccacagatgaaacagaaagctaccgtaggttattctacagaagctatcgtaaaagttctggatggtgttaccaactcacaggttgatgaactgggaactacaaaaccattgttacagtgtattacctccggtgtacttcgcggtgctgttgctatggttggatgtaacaacccaagagttcgtcctgacctggctcatatcgaactgatgaagaaaatgctggcaaacgatatcatcgttatcgcttccggatgttctgcacaggctgctgcgaaagcaggtcttatggataaagctgccaaagatatctgcggcgacggtttgaagagagtctgtgaattggctgacattcctccggtactgcacatgggctcctgcgtggatatctcccgtatgctggttctggctgcaactcttgcaaaagatgcaggcctgcgtatttcccagcttccggttgtaggatgtgcacctgaatggatgtctgaaaaagcagtatctatcggtaactatgtaattggttccggtctggatactttcctgggtgttgacccatatgcttcaggttccagcgaaatggttgaaatcctcacaaacggcacaagacagtggtgtgaagcagcatttactgtagaaaaagatattgaaaaattaggcgatgccatgatggcaagaatcgaagagaagagagctgcccttggtatctaa

SEQ ID NO: 1264 - DNA, 1260 bp, Unknown
  Description of Unknown: Firmicutes sequence
atgatagaaattgtttatgaaaaggaaaaacaaaagcccgaagggaatgaaggatttttccgtattcccaataatatacgccagataggagaaatcagaggaacacagaaaatctatatagaagattatgcgtatacttacctttgtagaatctcttctgaaaattcgcacagaggaattgcggcgattctgctgggacaggccaattggaaagaaggaatctcctatttgttcattaaaagtgcggtagcgctgccggatatggaggtgacagaggagcatctgacctttacccaggaaatctggaatcatgtgtatgagaaaaacaaggaatattttccggaacaggaagtggtaggctggtttttgtccattcccggctgcgccatggaactgcatgaggtcatttgccagacccatctcaatcatttcggcggcaatgacaaagtgctctttgtgcaggaaccgctggaaaaagaagaggccttctaccgctatgaagaaggccggatgtcccgtcagcccggcttttacgtgtattatgagaaaaatgagcctatgcggaatttcctcattgcgcagaatgaaagggcagaacggaaaacagaggaagtggatgattctgcagtgtccacattccgcaaaaaggtggaaaaaaagacggcagaggaagaacaaaaacagaaatttccgcttttcagaaccgccagtgtctgtgcggcagcagcggtattggctgttggggtgctgtatctgaatgactatcagaaactgagaagcaccgagaaggttatggcgagcctggaagaacctcgggagaaggaagagcagcagaaagttacaccggtgaatggcacagcggacagtaccgggaaaagcgatgacgcgaaggaaaatgttgcggagacagagaaaaagacagaaactgaaacttctgcagagacatccggggaaacatctgcagctgatacagattccggtcagaaggaaaaaggggcagagagttctgacagcagtcatcaggaaaatactcccgatgatgcagaggacacagatacgccgtcagatacggctgtatcggataccgaaacaattgcggtgggaacccaccgttcctataccattcagcccggagataccattacgaaaatcagtatccgcaactatggcaatacaaaaaaaataggagaaatctgtgaactgaacagtctgtcggaaacagatttgatttatccgggacaaaaaattttactcccttaa

SEQ ID NO: 1265 - DNA, 1206 bp, Unknown
  Description of Unknown: Firmicutes sequence
atggagagtttaagacagcagggaaaatctgagtattttcaagacctcaggaataggctgctgcagcggctggaagaaaactgggaggattcggatacagaggtgttggaactcatcgatgaattgatggctggttattgtaaaacggtgtatatgtccatttcccagagacagagtcttaggaaagagctatttcaatctgtgagaaaaatggatattttggaggaacttttggaggacgacagtattaccgaaattatggtaaatggttggaatcgggtttttattgagcggggaggacgtatttttccctggaacaaaagtttttcttctccggaaaagctggaggatgtgattcagcagatggcagcccggtgcaacagggtgataaataccatgcagcccattgtggatgcaagactgaaaaacggagagcgggtcaatgcagtcattgctccggtggccctagatggaccggtgttgactattcgccgttttccaaaagatcctattaccatggaaaagctgattgagatggacagcctgagccgggatgcagcgcagtttttggagaaactggtgcaggcggggtacaccattttaatcggcggaggcacggggtcaggaaaaactacttttttaaatgccttgtctgagtacatccccaaagacgaaagagtgattaccattgaggacaatgcagaactgcagattcagggaattgcaaatctggtgcgtctggaatgcagacaggctaatattgagaaatctcaggagattaccattggggacttgctgaaaacgtgtctgcgcatgaggcccagccggattattgtgggggaggtacgttccaaagaggcagcggaacttctgcaggtggtgaatgtgggaaacgacggaagtttatctacgattcatgcaaatagctgcaaggatatgataagtcgcctggaaaccatggtattgatggggatggaacttcccattccggttatccggcggcagattgtttcgggctttgatattttcgttcatctgggaaggatgaaggataaaagcaggaaggttcaggaaatctctgaaattgacagaattgaggcaggtgaggtgattttaaatccgttgtatgtaagaacttctggtctggagaagacaggggagatgatacacagggaaaaatgcaggaaggcgggaattatgttatga

SEQ ID NO: 1266 - DNA, 915 bp, Unknown
  Description of Unknown: Firmicutes sequence
atgacagtaacggtgattgtgccaacctataagccggacggaaaattttttcagctgatgaacatgctgaaaagacaaacctgcaaggcagatcatattctcattatgaatacggaggagaggtactggaaaaacagttttatggaaggcctggacaactgggaggtacatcatctttcacgtgcagcgtttgaccatggaaaaacgagaggagaaggcgcaaagcttgcagacactgaaattttggtttactttacccaggatgcagtgcctgctgatgaaaaactgctggaaaatctattgaagccctttcacaatccacaggtaggagctgcttatgccaggcagcttcccgcagaagactgtaaaatcattgagcggtacaccagaagttttaactatccggatacaagccggataaagaccaaaaaagatattccggaactggggatcaagacctatttctgctccaatgtgtgtgcggcttaccgcagaggtgtctacgaagaaatgggaggatttgttaccagaacgatttttaacgaagatatgattatggcagcgcagatgatacaggcaggctacggggtggcttatgctgcagaagccagagttgtgcactctcataactatgggtatatgcagcagcttcggcgtaactttgatttggcagtgtcccaggaggaccatccggaaattttcgccgccatatcttcagaaagcgaggggattcgtctggtaaagagtacagcagcttatcttataaaacagggaaaaccatggctgatatcggatttgctgctcagcagcggatttaagtatctgggatacaaagcaggaagaaactacaaacatctgccgccgtcctgggtacatcggctgaccatgaatccggcttactgggaaaatagataa

SEQ ID NO: 1267 - DNA, 1248 bp, Unknown
  Description of Unknown: Firmicutes sequence
atggcagatatccgaccatttcgggcaattcgtcctattgcggcaaaggcggcagagattgcggctttgccttatgatgtgtacaacagagaagaggcggcagaggaaaccaagatacatccacactcctttcttgccatagaccgtccggagacgcagtttttgccggatatggatatgtacagcccggaagtttacgaaaaagcggcaaaacttctggaacagcgaatccgggaaggggattttatcgaagagaaggaaccttgtttttacatttatgaactgaaacggggcagccatgtacagacgggaattgcagcctgcgcttctgcggaagactatctgcagcaggttatccggcgtcatgagaacaccaaaccggaaaaggaagcagaccgtattcgccacatacaggcatgcggagcccagacagggccagtgtttctggtacaccgccccatagcggagcttcgcagactcctggaaatccgcaaacggacagcaccggtatatcaatttgtttccgaggatggaattggacacagagtctggattatccgtgaaaaactgactatagagaaaattcagcagctttttttgaaaacagaggctctgtatattgcagacggacaccacagagcagcttcggctgtaaagacggccctggaaatgcgaaaagcctgcccggataagaagggaaaggaagaataccagtattttctcagcgttttgtttccttccgatgaactggaaattctggattacaaccgtgtggtaagggatttaaacgggcttgaaagagaggactttctagaagcgctgaaacaatatttttctgtgacaaagacagcaggtccggtgaaaccaaggagaaaaggcagttttgggctttgtctgcccgatggctggtatcagctggaacttatggaagcatttcggcctcaggatgcggtagagggtctggatgtggctgtgctgcaaaatcttgtactggctcccatacttggcattgaaaagccgggagaagataagagaatttcttttatgggaggtatccgtgggctggaagaactggaagtacaggtgaaaaagcagggcggagcagccttttccctgtatccggttactatggaggaaatcatggaaacagcagatgaaggaaggctgatgccgccgaaatccacctggtttgagccaaagctgcgcagcggactccttatccataagatagctatggacggctgctga

SEQ ID NO: 1268 - DNA, 1371 bp, Unknown
  Description of Unknown: Firmicutes sequence
atggaaatcagcagtctggtagaaaaacagagagccttttttcaaaaaggcattacaaaaaccccgcaatttcgtcagaaagcactggaaaggctggaaaaaggaatcagacggtatgagaaggaaattcatcaggctctccgaaaagacctggggaaatcagagtttgaggcctatatgaccgaagtgggactgacgctttccgaactgacttatgtgaaaaaacacctttccgcctggatgcggccaaatggggtgccgactcctctggcccagtttccggcaaaaagttttgaaatgacagaaccatacggggtggtactgattatgtctccctggaattatccgtttatgctgtgtatggaaccgctgattggcgccattgccgcaggaaactgctgtattgtgaagccgtctgcctatgcgccccatgtatcggcagtgctgaaaaaaatgctttcggcagtgtttccaccggagtttgcagccgtggtagaggggggaagggaagagaacagccgccttttagagcagcgttttgactatattttcttcacaggcggaaaagcggtgggacagctggtactggaaaaagcagctgtccatctgacgccggtgaccttggaactgggtggaaaaagtccctgtatcgtagacgaaacggcggatttgaaactggcggccaggcgtctggtattcgggaaatatttgaacagcggtcagacttgtgtggctcccgattatcttctggtgcagaaaagtgtgaaagagcctttcctgaactatgtaaaaatgtggattcataaaatgctgggaaaaaatccactggagaatcccaattatcccaaaatgataaacgaaaagcattaccacagaatgttggaacttatcaaaggcgaggcaattctggaagggggatttggcgaggaagcgcgtctgcggattgcccctactgtactggattatgtttctccggattccccggttatgcaggaagaaattttcggtccggtgcttccggtgctgacttatgacaccatagaagaagcagaaacctttatccgtgacagagaaaagcccttggctctttacctttttacgaaaaatccggacacagagcagaggattttgaggaatctttcctttggcggcggttgtgtgaatgacaccattattcatctggctacttcccgcatgggctttggaggagtaggagccagcggtatgggaagttaccacggaaagaagagctttgacactttcagccataccaagagtatggtaaagaaagccggctggctggatttgcccattcgctatcagccttataccaaagggaaaaagcagcttttgcgtatgtttttaagatga

SEQ ID NO: 1269 - DNA, 516 bp, Unknown
  Description of Unknown: Firmicutes sequence
atgaacaaccagttattcgagcaggcaaaaaatgatgatattctgtcaaaggaattgatttcttttcttttggaaaccatggaatacaaccgtctgagtttcatcaatgacgcagtggaaattctgaaggtcctgaaaatccgtattgagcgcggcgacaaaatcacagacgcagtttctcatcggatttacaacctgccggacttcaaaaactttgtccgcgagcatttttcatcctacatttacagccaggtatttacggccttaaaggacgagaaaagttatttctccttagagccctgtgaaggcggttacgaactggtgctctcagacaaagaccaaaaagtatacaaatggatttccagtttgaacgaaaagttttctctggtttacatggcagccactaaggtcgtatacataaaaaatgtaagaaccaaaacctacaccccttttctttctgcgaacggcaaatactgccgatatgacgaaagtgtaggaaaacttctggaaatttaa

SEQ ID NO: 1270 - DNA, 1134 bp, Unknown
  Description of Unknown: Firmicutes sequence
atggagttgaataagaaaaacatgaagaatctgattcttctgattgtctttgcagtgttgttttatgtgggagtgcagagaatcgagaatctggcagcaggtattctctttgtgtgcagagtggtctttccttttattctgggcggcgcactggcgtttattttgaatatacccatgagttttctggaggagaagctgtttcacaaagtaaagaaaaagaagtttgtaagaccggtctgtctggtatgttccattctctttgtggtggctgtgattcaggttgtgctggtggttgtattgccggaggtggcaacaactttttccagtatcagcaagaatatagaagcctttcttccaaaactgcagagatgggcaatagatacgttccctgacagcaagcaagtaacttcctggattcagagtattgagtttaattgggataaaattatccagacagctattaattttctgaaaaacggtgcgggaaatgtgctgaactccacctttacggtggcaaaaacagtgattaattctctgatgaactttttcgtagcctttgtgtttgcctgttatatattgcttcagaaggaaaagctgtctgtgcaaatcaaaaaagtgctctacgcattccttcctttgaaggcagtggacaagactttagaggtggcgtctttaagctataaaaccttttccagttttgtcacaggacaatgtctggaggctgtgattctgggaaccatgttttttattgttatgagtattctaagattcccatatgctttgctggtaggcgtggtcattgcctttactgcactgattcctatctttggcgcttttatcggctgtgtgattggcacatttttgatgctggtgtccaatcccatgcaggctgtagcctttgtgattttgttcctggtattgcagcagatagaaggaaatctgatttatcctcatgtggtgggcggttctgtgggtcttccgtctatctgggtgctggtagccgtcactgtgggcggcagcctgatgggggttgtgggaatgctgatatttattccgctgtcctctgtagtttatgcactgtttcgggaagtggtatataagaggctgaaggagagaggcattcatgatatttga

SEQ ID NO: 1271 - DNA, 1326 bp, Unknown
  Description of Unknown: Firmicutes sequence
atggaaaaactaacaatgagacagatactgtctctgacgctgacattatttgccgtattctttggagcaggcaacatgatttttccgccggctatgggacagcttgcgggagaaaattatttgcaggcacttgccggttttatactgacagatgcaggtattgccttgctgggaatgattgcggtggtgttggtagggaacaaaattatggaccttggggatcttgtgagccggaggttttctttgcttttatccgtaatggtgtatttgctgatagggccgctttttgcgctgccgcgaacaggaagcgtatcgtatgagctggcggttcgcccgtatgtgccgcagcagtatgcgtggctggtctctctggcggtgacagccgtgttctttttgctgacctattatcttagtggaaatccaagcaaggttgtggatattatcggaaaatatatgacgccagtactgattataagcattgccctgctttatctggtatgcctgttttcagacaaatccgggaatacggtacaatatggtgctgttcagaaagctgcaggggaataccaggatattgcgttcttcaaaggtatgattgaagggtacaatgccctggacggtcctgcaggtcctgtatttgccattattattatcaatgccgtcaccggttttcaggtgaaaaaacggaaaaatgtagtgaaatatacgattatttccggaatcggagcggtgctgattctcagcggtatttactacatgttgacgtatatcggtgccattacgcatacaacctttgaaaacggaggagcgcttctgcatgctgtggctagtgatttgctgggccctgtgggaggaatcgtgctgggtgtttccgtttttctggcctgcatgacaacttctattggactgaccacttcctttgcagattattttcatgaattgctgccatcagtgtcctatcgcaaaataacggcagtggtgtgtctgttcagctttgcagtcagcaatgtaggtttgtcatatctgatagcagtttctcagccggtactgatgatgatttatccggtattaattgtgctgattgtactttcgtttggaagaaagtggattggggataagaaaatggtctatatactcagtatggccgcagcttttgttcttgcttttatcaatgctatggacagtgcaggcataagccttggcatactgactgtatggggacgaagccttcctttttatcatctgcacctgggctggatgctgccggcagtgtgcggagcagccgtgggctttcttccggtttggaaaagaaaaaaaagtatttag

SEQ ID NO: 1272 - DNA, 651 bp, Unknown
  Description of Unknown: Firmicutes sequence
atgaaacgagacccagtaagagctacagtccttgcatccaaaattatccccaatgtgagcccggatatggcgaaagaactgaatctggagccgggaatgaaatctctggccctgattacggcggacagtgatgatgttacctatacagctcttgatgaagcaacgaaaaaagcagatgtaaaagtggtttatgcaaagagtttctatgcaggcgctgcaaatgcaaataccaaactggcaggagaaatcatcggaattctggcaggtcccaaccctgcagaagtcagaagcggactggaagcctgcgtggacatgattgaaaatcaggcatatttcatttccgcaaacgaagatgattccattatttactatgcacagtgcatttccagaaccggttcttacctttccgaaggcgcaggcattcaggaaggagaggccctggcttatcttatcgccccgcctctggaagcgatgtacggcgtagatgccgctttaaaagcagcagacgtaaaaatgtgcgtactgtacgcaccgccatcagaaacgaacttcggcggcgcactgcttacaggaagccagtctgcgtgcaaggctgcctgtgacgcttttgcagcggcggtagaatttgtggctgagaatcctaaagaataa

SEQ ID NO: 1273 - DNA, 1464 bp, Unknown
  Description of Unknown: Firmicutes sequence
ttgttccagaataataaattgaatttcagaaaggaatataaaatgagagaaaagtatgattccctgtctctgggagcattaaaagaaattgcaaaggcaagaggtttaaaaggcatttccacgctgaaaaaaagtgaactggtagagcggatggttcaggaagacgaaaaggacaggaaagcagcagaacagaaaaaacaggaggaaaccggagcagaaaccacagtagagagaaaggcggagtccagaacagaggtaagagaggaaaggaaacctgcagtaagagaagatggacaggataatcgaaataacagagcgcccatggagcagtctgaactggacagcggcattacggtaaagggaattctggaggtactgccggacggatacggatttatccggagcgacaattatcttccgggggataatgacgtgtatgtttccccgtcccagattcgcagattcaatctgaaaacaggcgatattttaagaggaaacacaagggtgaaaagtcagaacgagaagttttccgctcttttgtatgtgacccacatcaacggaattaaggcaaatgaaatgcagcgtatgaattttgaggatatgaccccgattttcccaaatgagaggctgcatctggaacgtccgggcggaagtatggctatgcgcattacagaccttgtaagtcctatcggaaagggacagaggggaatgattgtatctccgcccaaagcaggtaagacaacccttttaaaggacgcggcaaaatccattcttcggaacaatccggaaatgcacctgattattctgctgattgatgagcgtccggaagaggttacagatataaaggaggccatcaaaggcaaaaacgtggaaattatttattctacttttgatgaactgccggagcatcacaagcgtgtgtctgaaatgaccattgagcgtgcaaaacgtctggtagaacacaaaaaagacgttacgattttcatcgacagtattacaagactggcaagggcatataacctgacagttcccccaagcggacgtaccctttccggtggtcttgacccggctgccctgcatatgcccaagcgtttcttcggtgcggccagaaacatgagagagggcggaagtctgaccattctggcaactgcactggtggatacaggaagcaagatggatgacgttgtgtacgaagaatttaaggggaccggtaatatggaactggtgctggacagaaaactccaggaaaagagggttttcccggctatcgacattgcaaaatccggaacaagaagggaagacctgcttttgaacagggaagaacaggaagccgtggacattatgcggaaagccttaaacggcatgaagtcagacgaagctacggaaaatattctgaatatgtttgccagaacaagggacaatgcagaatttgtacagatggtgaaaaagcagaggattctttaa

SEQ ID NO: 1274 - DNA, 1305 bp, Unknown
  Description of Unknown: Firmicutes sequence
atgaaatttcgttggaacaaaaaatatctgtactggggaatgacagcttttgcagtaatctgtgccagcctgttgttttattttgtcattttccgtatgcatgtgctgtttaacggaatccgaagatttataagcattatgatgcccgttatctgcggcgcagtgattgcctatcttctaattcccgtgctgaattttcaggagaggaaaatctttcggtattttacagagaaaaagaagatgactttggagccggggcacaaaaaaatggttcgatatctgtgtatcagtacgtcactgctttttgccctgctgattatctattctcttttgtccatgattgtaccaagtattctggacagtattatcagtattattaacgattcgccaagatatgtccagaatatccggcattggctggaagcccttttaaaggacaatccggagtggaagaccattgtctttgactatctgaaccgttattctcccaaagtggaagcctttttaaatgttgaagtgctgccgcaggcaaaggcggttctgcagtccctgaccacaggggtgttcggaactttggtctttatcaaaaacctgttaatcggtctgattatttccgtgtacctgatggccggaaaagaagcgtttgttacccagtctaaaatgctggtgtatgcatggttcgatacagaacgcgccaacagtattatcagagcctttcgttttacccacaaaacctttggcggttttatcagcggcaaaattgtggattccctcattatcgggattctgtgctatattggcacctccatgattggaaccccttacaaactcctggtcagcgttattgtaggcgtcaccaatgtgattccctttttcggaccttatcttggtgccatccccagcgcctttatcatccttatggtaaacccggtgcagtgtctgtatttcctgatttttattctggttttacagcaatttgacggaaacattctgggaccgaaaattctgggaaattccacgggactttccagcttcatggtgattgttgctattttgctgttcggcgggcttatgggaattcccggcatgattatcggggttcctctgtgggctgttatggtagcaggtgtaaggcatttccgcgaccatgagttacgaaaaaaatctatgccaacagacgagaaaatgtatgaaaaccttcagtatattgacccaaaaaccctgcagccggtagaattttcccaaaacaataattcagagcagaacagcagtaaagaaaatgaaagtgaggatacacatttatga

SEQ ID NO: 1275 - DNA, 1128 bp, Unknown
  Description of Unknown: Firmicutes sequence
atgaaagttacaaaaaagggattttttcttaccgtgttcgttcttcttctgggtgctttttttgttctggccccgccctttgcctgtgtactggtaagaaactatctggttgcttacgaaaacaggcaggaggccatgaaggaggaccactgggtttacaatgcaaccggtaaacgctatgtctaccatgacggctctgtgattcaaaatgacagcaaggtactggacaatgtgacctactattttgattccaaaggctatgtgaaaacaggctgggtgcaggataagggcaagctctattaccgcaattctgacggttccccggtttccggctggtttgaagacgaaaacgggaagtattacctgctagaagacggctctcccgccatcggctgggcagatattgaaaataaaaaatattattttcaaagcaatggcgtcatggctgtgggcatgacggaaatcgacggcgcacagcatctctttaatgaggacggctctgtatcctccggctgggcggaaaatgacggcaaaaaatactatcgtgatgataccggtgccctgactgtaggattcaaggatattgacggcaaaacttattacttccgggaggacggcactatggctacaggctggattaccaacggcaatgaccgctactatatggaccaggacggttccaaggtaaccaatgcctggattgaagaggaaggacaaaagcatttcgtagacaaagacggcaaagaattaaaaggctgggtaaccgtcagcgggaagaaatattttctcaatgaagaaggtattctggcatcttccggctggatgaaacaggacaataaatggtacttcattgacaaagacggcagcgccaaaaccggactgttccaggacagtggaaaatggtacttccttactgcagaaggcgaactgaaaaacggctgggtagaacaaaacggcaaaaaatattatcttgccaatgcacagcttatgacaggctggagaaaaatcgacaacaaacaatattattttaatgaagacggcaccatggccacaggctggattaccattgacggaaaatcctattttctgaaagaagacggcagtttggacgccactgcaaaaaaatga

SEQ ID NO: 1276 - DNA, 1149 bp, Clostridium paraputrificum
atggaaatttatttagataatgcagctactactaagccaaaagaagaagttattgaggcaatatgtgatggaatgaaaaaatattatgcaaatccatcatcttcacacaagttaggtatggaatcagaaaaaaaactagatgaatgcagagaagtaattgcaaaaacaataaattgcagtaatgatgaaatatattttacttcaggaggaagtgaaggaaacaactttataattaaaggattagtgaagacaggaacacatttaattacaactccttttgaacatagttcaataaagaatactgttgaagctcttgaaaaatctggggtaagagttacatatctttctgttaatgaatttggagaaattgatattgaagaactaagagaagctattactaaagatactgttttagtttcagttatgtttgttaacaatgaagttggaagcatacagaatttaaaagagataggtgaaactataaagtctataagtaatagagcaaagttccatgtagatggagtccaagggtatggtaaatttactatagatgttaagaaaatgaagattgatgcattaacagctagtgcacataaaattcatggacctaagggtgttggattctgctatttagctaaagggatgagtatagtacctcatattcatgggggaactcaagaaagaggattaagagctggaactgagaatatacatggaataatgggattaacagttgctgctaaagatattattaagaatatggatctaaactatgaaaaagttagtgaattaaaagaatatatgataaaaagattttctgagatagatgatattagaataaatagtccaatgaatgataagttttctccatacattttaaatgtttcatttagaggaattagaggagaagtattgctacatttattagaagatgctaatatttttgtatctacaggttcagcttgtacttctaaatctaagggtggagttataggaagtcatgttttggaagctatgaagctgactaagaaagaggttgagggagcaataagattttctttctccccagaaaatacaaaagaagagatagataagactattgatgccctaaaaaagggattagtattcttaaggaggattagaagatga

SEQ ID NO: 1277 - DNA, 1170 bp, Clostridium paraputrificum
atgaaaagagtagtacttatagttttagatagcgttggagtaggagagatgcctgatgctaaaatgtatggagataaaggaagtcatactttagaccatacttttgaagcttgcaagggacttaatataccaaacttaaagaagttaggtcttggtaatattgagggtgttaaggcattaggaaaagaagaaagtgttattggtgcctttggaaagagcagtgagaaatcaattggtaaagatactgtaacaggacactgggaaattggaggcgtaattcttgataagcctctaaatacctatcctgatggtttctcagataaaataataaatgattttaagaaaaaagcaaagatagatgggattttaggtaataaggttgcctctggaactgcaattattgaagagctaggagaagagcatgtaaagacaggatatccaataatatatacatcagctgatagtgtgttccaaatagctgcacatgaagaggttgttgggttgggtaacctttataagatgtgtgaaatagcaagagaaatgttagttggagaggatgttgttggtagagtaattgctagaccttttgttggagaagttggatcatttaaaagaacttcaaacagaagagattacgctttagatccatttggtaagacagctttagaatatataaaagaaaatggaatgagtgtagctgctgtcggaaaaatagaagatatatataatggaaaaggcgttacagaggctgttcacataaaaaataacatggatggagttgataagactctggaatatatggataagattgataatgggttaatattcacaaatttagtggattttgatatgctttatggtcatagaaatgatccgaaaggatatggaaaagctttagaggattttgatggcagacttgatgaaatatattcaaagctaagagatgaagatattttaattattacagctgaccatgggtgtgaccctacaacagaaagtacagatcattctagagagtacataccaatacttgtatatggtaaaaaagttaagggtggaactgaattaggaataagagattcctttacggatataggaaaaagtgttttggattacttaggaatagataataacttagaagggaaatcctttataaatgagattatctaa

SEQ ID NO: 1278 - DNA, 486 bp, Clostridium paraputrificum
atgaggagtagggctatgcaaaaaacaaacgcaatgagaattttagataaagctaaaataaaatataatacatatgaatacgaagctggagatggtcatattgacggtgtatctgttgcaaacaaactttcacaagatgtaagtatggtatttaaaacattagttgtacaaggaaactcaagagaattatacgtgtttgtaattcctgttagtgaagaattaaatttaaaaaaagctgcaaaggttgcaggtgaaaagaatgttgaaatgatacacgtaaaagatataaacaagtatacaggatatataagaggtggatgttcgccgataggaatgaaaaaattatataaaacatttatacatgagtctgctaaaggattagaaaaaattatttttagtggtggaaagataggaattcaaattgaagcaaatccagatgatatactaaatttaattaatggtaagtatgaagatttaataatgtaa

SEQ ID NO: 1279 - DNA, 1194 bp, Clostridium paraputrificum
atgggaataaggcgagatataccaattcaaattagagaagcctttactataaaaaagaagagaaaaaatgaaatattaaatgaattaatgaaatattttgatgaagtaataatattaacaacatgtaatagaacagaaatatatgtagatagtaagctaaataaagaagaagtgatagacgtaatctttaaaacaatagggtggaatgatgaattaaagccctttatattttatgtggaagaggaaaaagcatatagacatttatttaggcttgcttgtggctatcattcaagaatagtaggtgaggatcaaattttagggcaaattaaaaatgtctatattgaatccttagaagaaggtacatgtagtggagagttaggaagattatttcaagaaggaataacctgtggtaaaaagtttagaacagaagcaaaattgtttgagataccagtttcatctatttcagttgcaatttctattatgttaaaagaaaaatgtaaaaaagttatggttattggttatggagaaataggaagacttgctgttaaatatcttttatcacataaggtggaaaatatatatttagtagttagagagccgggaaaaattaaggatttacatgaggaaaatgtaaaaattataaatttcaaagaaaaaaatcaatttattcaagaagtagattctataatatcctgcactaatgctccacatgctgttgttttaaaagatgatattgtagaaagaagagagacattatctatatttgatatggcggtaccaagagatgttgaagtagaagttggattattaaataaagtaaaagtatataatattgatgaaataagtgaagttgatgacgaaaataaagcattaagagttcaaagaatgtcagaatataagtatatttatgaagaatatttaaaggaatatatggaatggaaggctcttcgagagatttcgccaattataaaagaattaaagatgaaaggcgaagaggtatactcaaaaagattaaatacttataaaaataaaagtagggatctaaaagatgaagggcttgtaaaaatgttattaaaaagtacctcagatgcttatattaatagagctattgaagtcataaaaaatgagacccttgaaggaagtgaagaagaatgtttaagaatagtgaggaagatattcttaacagaggaatag

SEQ ID NO: 1280 - DNA, 768 bp, Clostridium paraputrificum
atggataagaagactctattacaaagtttcaatgaagaggataggttagaagttttaaacttatatgaaaaatatgagttgtcctatgaaaaggatatacccttgtttggtaacaacttttatccacctaacatatggaagttttttgagaagtttacaagcactaatgattttaaagtaacatcatctggattttttgaagatgcagagagaagaatgatgtctttcaataatatttatgaaattccatttcctatgaaaatattaaaaataataaatacatctaagtttacaacacctagtcatagagattatttaggatcaattttagctctagggataaagagaaataaacttggagatttaattataaaaagtggtgaatgctatttacctgtatgtgaagagattgctgattatataataagtaatttagaaacagtaggtaaatcaccctgtaaggttattcttttagaagaagattttattccttttacacctgaatttaaggaagagattattttaataccatctttaaggctagattctatagtatctaaggtaatgaagttatctagaagcaaagcacaagatgtaatagaagcaggtaaagttttagttgattataataccattagagataaaagcaaagaggtattaagtggtgagagaataactataagaggagttggaaagtttattttgggagatatagttgggaatagtaaaagtggtaaatataaagtaattataaaaaaatatacataa

SEQ ID NO: 1281 - DNA, 1500 bp, Clostridium paraputrificum
atggagaaagaggtgatattagtgattttttctacacttaaaattaatgatagtgatccaatatatattcaattagaaagacatatcataggtggaataaaaaaaggtgacttaaaaaaggatagtaagttaccatcaacaagagaagtaagtaagtatctaaaaataagtagaaattcagtaatatctgcatatgaaaatctagaaagtaaagggtatattctaactaagagaggaaagggaacctttatagctgttgaaggagaaaaacaggtatatgaatataatgttgagtgggataacctggtaaataaatatggaaaagtattaagagataaagatattattaaaagtgaacctaaatttagaagaggcatgatatcatttaaatctattgcaccggaaggtgaacttttcaatttagaagattttaaaagagctttaatggattcgtggacttatgaagaggtgcacttattaaattatggatatgcgaaagggtatcaacctttaattgattatttgtttgaatatatgagagaaaagggtgttagtaaagagaataaggatatattaataaccaatggttttacagaaggatttgatattatattagcatcattaacttctccaggggatgttattttatgcgaagaaccaactaataatacagcacttaaagttatggaagcttatggattgaaagttgttggagtttcaatggataaggatggaatggtaatagaagatttaaagaagacattacagttatatacacctaaattagcatatttaattccttcatataataatccaacagggatagtaatgaattctgaaagaaggaaagaaatatataagatttttagggaacattccgttccaataatagaaaatgggtttaacgaggaattattgtattcaagttctcctttagagcctttagcagctttaagtggaaggggaaatggtgtggtttatataggaagtttatcaaaggttttatttcctgggttaagaattggttggataatgggagataagaagcttattgatatcttagaaagtgtgaaaagaggaagaactatacattcatcatttctagatcaaagtgccttctactactatttgaagagtggagcttttactagatatataaagaatattagaaaatattatagaagtaaatacaatttaataatggagatggttaataaacatattccatatgaatatgttacaggagaaggtggattatacgtatttattaagcttaaaaacaatattagctctagagagttactgaatctttgttatgaagatggagtattatttatgccaggagatttattctataataatgctaaaggggagtcttctttgaggttaggttttggaagagtaagtgatgatgatataagaattggaatagaaataataggtaagaatatagagagattaatgaagcagaaaggttatgaaggtgaattaggtgactga

SEQ ID NO: 1282 - DNA, 687 bp, Clostridium paraputrificum
atgaatattttattagttgaagatgatgttactttagcaatgggaatcgaatattctctaaaaaatgaaggatttaatgttaagacagtaggaaaaataaaagatgcaaaagaaaaaataagtaattcacatatagatattattttattagacgtaaatttaccggatggaaatggatatgagttatgtaaagaggttaggttagatagtgaggtcccaataatttttctaacggcttgtgacgaagaggttaacatagttatgggattagacttaggtgcagatgattatatagctaaaccagttagagttagggaattagtagctaggataaatgcagttgctagaagaaaaggtgtattatctaaagataaagaagataataaaattattgttaaagatattaaagtgttgcctttaaaatatgaagtttataaaggagaagaaaaacttcaattaacttcagtagaatataaattacttctattattgatagaaaactctggaaatgtattgactagaaagacattgttagaaaagctttgggatatagaaggagactttattgaagagagcacattaacagtatatataaaaagattaagagaaaaacttaaagaggataagataaatccttatattgaaactgttagaggaataggttataagtggataggtgaaaaataa

SEQ ID NO: 1283 - DNA, 981 bp, Clostridium paraputrificum
atgggtttattttcaaaacaattttcaaatgtagttgaatgggaagagtatagagatgatttgttattttggaaatgggataataaagaaattaaaaagggttcaagattaataattcgtccagggcaagatgccatatttatgtataatggaaaacttgaaggtgtatttaccgatgaaggaagctatgatattgaatctgaaattattccttttttatctacattaaaaggatttaaatttgggtttaatagtggaataagagctgaggtattatttattaataccaaagagtttactgtaagatggggaacaagacaagctataaatattcctaatcaagcattgccaggaggaatgcctgtaagagcaaatgggacatttaattgtaagctttcagaccatatggcttttattgataaaatagctggtataaagcatcagtattcaattgatgaaactaaagaaagagttttatcttttctcgaccaacttttaatgaagtggatagttaaagagggaaaagatatgtttaaccttcaagctaattcttttgatatatcaagaggaatttgtgaggatttagactatgaaatgagtaaaattggaatatccataactaattttaatatagcaagtttttcatatcctgaagaagttcaaaagatgattaataaaatagcttctcaaagtatggttggggatatgagtaagtatcaacaagttagtatggttgaaggaatgacatctggaaagatgaatggtggtaatgttgcatctgatatgttagcaatgcaaatgggtatgtcaatgggacaacaaatgatgaataatatgcaacaaaatagcaataataatactactcagaataataatattcaagattcaagtaatgggtcttatccaaagttctgcccaagttgtgggacaaagacttctggaggaaagttctgtagtgagtgtggtcaaaaactttcataa

SEQ ID NO: 1284 - DNA, 1293 bp, Clostridium paraputrificum
atgaacaagattgatgaaaaagtcattcaatataaggatgatatgataaaatccattgagagacttgtaaatattcctagcattgaaggagcatcttgtatagatgctccttttggagaatttagcaaaaaagctttacttgaagccttagatatatcaacggagataggctttaagactaaaaatatccaaaatgttatagggtatgcagagtatggagatggagaagattacgtaggtataattggacatgtagatgttgtacctgctaatgaagaagggtggataacaccaccttttaaaatggatataagagaaggaaagctttatggtagaggcgtattggataataaaggtcctataatatcttgtctatatgcattaaaagtagtaaaagatcttaatattccgctttctaaaagagttagaatcatatttggttcaaatgaagagactggttttaaagatattccatattatcttaataatgaagaaccaccaatttcaggttttactcctgattgcaagttccctgctgtttatggggaaaggggaattttagacgtaactatatgcagtaaaaaactaagtgatcctaatattaaatcaattaatggcgaatttagaagtaatgtggttccagattttattcaagttgattttaaagatggtaaatctattactaataggggtaaaacagctccaggaaatgcgcctgaaagtggtgttaatgctattacaagtttatgtaaaaatttaagagatgaaacatctttatgcaaagaagaaagagagtttttaaatttcatatataatgtatttcacaagaatcatgatttaagcaagataggtatagaatgtaaggatgaaatatcaggcagtctagtaactaacccttattctttaaagattgaggatggcatgcttaagttatcagttgtgtttagatatccaatgtcatatagctataaaagtataatggaaataataagtgtattatcagagtattctattatggaaaatagaagaatggattctgtattctttgataagaatgctcagatgctaaaagttatgaaggatgcttatgaagaggtaacaggagaagacggtacccctgttactactacaggtggaacttatgctaaggtaatgcctaatatagtagcttttggtccttctttcccaggtcaaaaaggaattgctcataattctaatgaatatatgataattgaagatcttataaatattacaaggatatatgttagagctataataggactagcaaactaa

SEQ ID NO: 1285 - DNA, 684 bp, Clostridium paraputrificum
atgagaattttaatagttgaagatgaggtacaattatcagaggcgcttggtgcaattttagaaaagaataattacatagttgatagagtttttgatggagaaagtggattagactatattttatcggatatatatgatggagttattttagatataatgctacctaaattaaatggaatagaagtattaaagaaggcaaggaaagaaagaatatcaacaccaattatccttttaacagctaagggggaagtggaggataggattattgggttagattgtggtgcagatgattatttgcctaagccattttatgttgaggagcttatggcaagaattagagccttaactagaagaaaaggtgaggtacaaagtgataacctattgtcttatggagatattaatttaaatataggtaatttagaattaggatcaaaagaaaatagtattaagcttactgcaaaggaatctggacttttagaattactaattaataggaaggatatgatttcaaataaagatgatattataagtaagctttggggatatgaatcagaagcagaacataataatgttgaagtatatgtatcatttttaagaaggaaactatcctatttaaaatctaaggtagctattaaagctataagaaatctaggttatattttagaatataaagatggagaataa

SEQ ID NO: 1286 - DNA, 576 bp, Clostridium paraputrificum
atgtttttaatagttggactaggaaatccagggaaagaatatgaaaatacaagacataatattggttttgatgctatagataaaattgctgaaaagtataatatagaattaaataggataaaatttaaaagtgtctatggagaaggattcataggcggtgaaaaggttatacttttaaagcctacaacatatatgaatttaagtggagaaagtttaagggcaataatggatttttataaactttctaatgaggatgttttagtgctttatgatgatataagtctagaagttggaagaataagaataagagaaaagggtagtgcaggtggacataatggtataaaaagcataattgctcatttaggttctgatattttctctagaataaaaataggggtaggacaacctaaatctgatctagttaatcatgtattaggaaagttctctaaagaagaaagagaagtgttggaagaaactttaaaggctgttgttgattcggtagaagttataattaagactgatactaaagaggcaatgaatagatttaatgggtttataccaaataagaagatttaa

SEQ ID NO: 1287 - DNA, 480 bp, Clostridium paraputrificum
gtgagaaatttggtaagaaaaaagaatagtaattccttagctgaaaatagaaaagcacgtcatgactactttattgaagaaactatggaggcaggattagctctagttggtacagaagttaaatcaattagaggaggtaagtgtaatttaaaggatagctatgcagatatagagaatggtgaaattcttataaagcaaatgcatgtaagcccatatgaacaaggaaacatttttaatgttgatcctatgagaaatagaaagttattgcttcataaggaagaaatttttagacttcaaggattagttcaaagggatggatatactttaattccattatcactttatctaaagaatggtagagttaaggttgctcttggggtttgtaaaggtaagaagaattatgataagagagattctatgctagaaaaagctgctaagagagatatggatagagctattaaaaatagtggcagatattag

SEQ ID NO: 1288 - DNA, 819 bp, Clostridium paraputrificum
atgaaaaatcaaaatttaaatactatctgcaaaacaattcgtacagatattataaaatctatcgcaagcgcttcatctggacatctaggtggttctctttcagcagtagaaatcctaacaactctatattttgaagaaatgaatatagtcccttataatcctaacaaacaagatagagatagatttgttctttcaaaaggacacgctgctcctgttttgtatgcaaccttaagtaatagaggattcttttcaagagaagaactaatcaatttacgttcattaggttcaaaactacaaggacatccaaatatgaattatgttcctggagtagatatgtctacaggttcccttggacaaggtatatcaacagctgtaggtatggctttaggaaacaaaatagataactcatccaatagagtatattgccttttaggtgatggagaactagaagaaggacaagtttgggaagcagctatgtgtgcaagccactataaattagacaatttattagcaattgttgactttaatggtcttcaaattgatggaaacattacagatgtaatgaatcctaccccaatagatgaaaaatttaaagcttttgggtggaatgtacttactgttgacggtcatgatatagatgctcttttagattgttatgaagaggcaaaaaactttaaaggagcgcctactgtaattattgcaagaactataaaaggaaaaggggtttcatttatggaaaaccaagctggatggcatggtgctgcccctaataaggagcaggttgaacttgcattaaaagaaatagaggaggctttataa

SEQ ID NO: 1289 - DNA, 324 bp, Clostridium paraputrificum
atggcagaatataaagttggagacgaattaataattgtaaatgatccaagtgaagagaaaggaaagcttcaagagttaagtaagttaactgtagaggatgattatgcacagttctcttggggagttaaaatattaaatgttgagtatgacaaaccgtatgttactctaacatatagaaatgttagaggagaaaaacacaaggtttttgctgaatgtaaagatatagaaaattttgatcaacaaaaggttttagaaaaagctttattaaaagcattccaaaatgagatcatagatatatcagtagttaaaaattcaggattatag

SEQ ID NO: 1290 - DNA, 501 bp, Clostridium paraputrificum
atgaaaatagcaattatctatgatagcataacaggaaatacaaagaagatagctgaagagataaaaaaagaaatagatgaatcaaatcttgtttattttggagaaccagaaaaagaaattgaagcagacttgtatattgtaggttcctggacagataaaggaatgtgttcaaaaaagattacagaatttttaaagcaattaaaaaataaaaaaattgcttattttggaacagctggctttggaggttcaattgaatattatgaaaaactatataatcgtgtaaaagaaataatagacagtagcaatactatactaggatatttttattgccaaggtaaaatgccaatgagtattcgtgatagatatgtgaagctaattactgaaaatcctgaagataagaatatacaagtatctatagaaaattttgatgaagcgctaatgcatccaaattatgaggatataattaacgttaaaaagtggatagaaggtataataaattaa

SEQ ID NO: 1291 - DNA, 453 bp, Clostridium paraputrificum
atggtcagagaaagaagtattattcaaaggtttcagaccttagagaaggaagtagaacctaaaccacagatagtaaaaaattgtataagagcatttttagttggaggcttaatatgtgatttaggtcaagttataatgactgttttaaaaaattatgatttttcaaaggatgaaataggagctataacgtcaatttgtatggttttcttaggagcactacttacaggtgttggaatatatgataaaattgcaacttatgctggtgctggaacagtagtgcctataactggattttctaatgctatagtagcacctgccattgaattcaaaaaggaaggttttgtttttggagttgctgcaaaaatgtttactattgctggaccagttctagtttatggaattggatcgtcggttattgtaggaattgtttattatatatttactaaactttaa

SEQ ID NO: 1292 - DNA, 456 bp, Clostridium paraputrificum
atgagtgatttatcattatttaaagcattcttggtagaagcaaaaaaaaattcttataatggtcgaaataaaaaggttcaatcttctaaaccaaactcagatgattttacttttaaaaaatacgattattactacctagatagccacataggcaaacagaggtttattggtcaagaagttatttggaaagatgaaaagtcttattggggaatgaattatgctggaaaattattaactaatgatattccaagtggtttttcagactttttatcagaagctttatctagagtttctgaagatgctccttatagaggaccaaagagttttagaaaatctgactttgaatatcaatgtctttggaagggagaagttgattcttttaaaggcgaagaatttatatcttataaaggttctccgatatttaaattagattttcatggtggaacaataaaatag

SEQ ID NO: 1293 - DNA, 669 bp, Clostridium paraputrificum
atggataagtttattggagatgacgatttcttttatactgacttctttattttgataaagacaaataactttcctcaaattttagagagattaaaaaagaaacatgaatatgaaaattcaatagataaggatatcttagaaaaaaaacatgaccttattatttggaatgcttttttatcaaaggaagtaattaaggataggataataaaaacagctcttcacgatatttataataaattttatttagaaatactaaaatgtacttcactaaaagatttgcaggagctagaaatagagatatttaaacaatatattactagaattatatctaatatggaggttacaaatagcttaactgttaaccgttccttaagatatatacacatgcatatagaaaactacttttccttaaataaaatggctaatgaacttaacgtttctgcttcatatattagtacattattcaaaaaaactatgggtatatccattaatgaatatgtacatgaagttaagataaatagagctaaaattctcttaaaaaccacctctaaaactatgattgaaatagctcaacagcttggatattcagattcaagtcatttttctaagaaatttaaagaaaaggaagggctatcacctatatcttatagaaataataatggtttttaa

SEQ ID NO: 1294 - DNA, 294 bp, Clostridium paraputrificum
atgagtagggtagaaaaggaaaaagaaattgtagaattaatgattaggctttactgtgaaaaaaaccataagtgtaaggatgaactttgtgatgattgtagggaacttttagaatatgctcataaaagattaagtttttgcaagtttggagataaaaagtcatcttgtagtaaatgtccaattcattgctataagaaagatatgaaggaaaaaataaaaaaggtaatgaggttttcaggaccaagacttttaatatatagaccatttgagtatgttagacatatattcaagtga

SEQ ID NO: 1295 - DNA, 705 bp, Clostridium paraputrificum
atgatagttttaagtatagactcttcatctaaggtagctactgttgcactacttaatgatgatactttattaggtgaatatgttattaatgataagagggaacattctgtgttattaatgcctatgattgaaaatcttttaaaggattgtgaattaacaataaatgatattgatggatttgttgtttctaaagggcctggttcatttacaggtttaagaataggtatggctacagttaagggattaagttttggagcaaacaagccttatataagtctttcttctcttgatgggttagcttataacctttcttactttagtggaataatttgtccaattatggatgcattaagggaaaatgtttatactgctctttataaaaatgaagatggcgaatttaaaaatataatggagccaacccctatggaacttccttatctattagaaattctaaaagaaaaaaatgaagaagtaatatttactggtgacggattacttaagcataaggaatatattaaggcaaacttccctaatgcaaaatttgcacctaaccatgtaagcttaactagagcttcatctataggtgagttaggtcttaatcttttaaaacaaggatttaaagatgatccaaactctgctcctgtttatttaaagaaacctcaagctgaaagagaattagaaaagaggatgagaatgagtgagtaa

SEQ ID NO: 1296 - DNA, 2151 bp, Clostridium paraputrificum
atgaaaaatgcattaaggatttttaaacgtgatctaaagaaggtattaacaaattgggttgcacttgtagtagttattgcactaataatattaccagcgctatatgcctggtttaatgtaaaggctatgtgggatccctatggaaatacaagagggataaaaattgctgtagttaatgaggatataggtgcatcattagatggtaaagaaattaatgtaggagaagagattgttaagaaacttgaagaaaatgaaaatataggttggcagttcgtagatagagaagatgctcaagaaggtgttaggacaggaaaatactatgctagtatgatagtgccagaggatttttcaaacaaacttttatctataacagaaaatagaataatagagccaacattagaatacacagttaatgaaaagagtaattctgtagcacctaagataacagataaaggtgtaggtactgttaaggatcaagtaagtgagcaggttgtggagacagttgatggaattatttttagtgtattaaacaaaattggtgttgaagtaacaaactcaaagccggaaataagaaaattaattgatgtaatttacaaattagatgaggaaatgccacaaattgaagaattaattaataaggcatatgatggaactataaccgtagatgaaatggtaaataagataaatggattaatgccaacaattgaagatactataaatacaagtcaagatgtattaggaacaagcaaggagtatttagataaggcaaaagcatcattgacacagttatcaccagttattaaacaagatttaatagttggtgaaaatgtagtaggaggaataaatagtttattacaatctattgatgaaaatacatcacctgaaaaagtaaaggaagttcttacagcaataaaaggtaaggttgaggggttaaacaattctgtagagtcattaattaagctattaaagtctataaataatttaattcataataaagatttagataatgctataggaaatttaactaaaataaaggatgaagtagataaggtattagatttaataaatacaggaattgagagcggtaataatgaagcttttaaagataaatttaaggaccttcaagaaagagtagaaagaatagattcaatattaacaagcatattggataattatgatggtaaaatagtaccagcattaaatactggtatagctcagttaactaaaatagcagataatacttcaatgctaatgaatgaagcagaaaaaagtatacctgatttaaaggatatactagcattaataggagaaggctctaaacttggtaatgagaagctaggagttttaaaagaaaagatgcctacctataaagaaaagcttcatggatatgtagaaaagataaaagaccttgatgatgaagagaaaatagataagatattagacttaattacaggagacgcaaatgctcaaagtaagttcttatcaagtcctatacaagtaaatgaaactaaggtattcccaattccaaactatggatcaggaatgtccccatttttctcagctctttctatgtggataggagcagtgctattattgtcattgtttactacacatgctaaagattttgaggatggtacacaattaaaaccttatgaagaatacttaggcaaatatttattcttcttaaccatgggagtacttcaatctgttgttataacattaggagatatctttatattaaaagcatatgttgtacatccaattctatttgttgtatatggagcttttataagcattgtatttgttacaatagtttatactttagtttctctgtttagaaatgtaggcaaagctttagctgtaattttacttgtattacagatagctgcttctggtggaacgtatccaatagaagttatgccagaatttttccaaagtatacatccattacttccatttaagtatgctattggtggtttaagggaagctgtaggaggaattgtaccagaattattatctagagatacaatagttttagctggatttttcttagtatttttagtaattggagtattagggaaaaaatatttaaataaagctttagataagttttcacgaaaattagaagaaagtgaaattgtaggtcactaa

SEQ ID NO: 1297 - DNA, 846 bp, Clostridium paraputrificum
ttgattttaagtaatgatgaaatagtaactaaggtatttaataataacattatattagtaaattcagaggatcatgaaaaaatattatttgctaagggaatagggtttggaaagaagcctggatatgttataccaaaaggaataaaagtagataagatatttactattgcagatagtgataatattgaaaatcttaatactatgatagaaaaagtggataatgacttctttgttgtatgtgaagaggctatatatgaaatatcggaaaaaataaatcaagagttaaatgaaagtattcatataggattaattgatcacctatattttgcagtaaaaagattgaaaaataatgaagagattgaaaatccttttttggttgagatagaaacactatattctaaggaatatatgttagcagatatggttgctaaaaaggtaggagcatattgcaatgtagatatacctgatggtgaaatcgcatttatagcactgcatatacattcggcaataaataatggaaagatatcaaatacattaaagaatagttatttaggaagtactatagtagaacatgttgaagataggttaaatatagaaatagatagaaagtcattagattatgctagattcttaacccatattaaatttgctattcaaagaattatggaaaatatacatatagacaatgaacttacaaaaattattaagtcaagttataaagaatcattttctgtagcagaagaggtggctaaaattatagaggatgaattaggtataaaggtcatggaagatgaagtgacatttttaacaattcatatagaaagatttagaatgtcaattagataa

SEQ ID NO: 1298 - DNA, 423 bp, Clostridium paraputrificum
atgatttataaagtatttggagacacaattgtaatgagattagaaaagggagaagaaataatttcagaaattacagaattatgcaaagaaaaagctataagtgcaggttctgtatcagctataggtgcagtagataatgtgattttaggcttgtataaagtaaaggaaaagaaatatttttctagtgagtataaagaggaaatggagatgacaagccttacagggaatatatcagtaaaagataatgaaccatatttacattttcatgcaaactttggtagagaagatggaatcgtagttggtggtcatttaaataaagctgtaattagtgctacttgtgaaataataatacatagaataaatggagttattggtagaaaatttgatgatgaaataggattgaatgtaatagagtttaattag

SEQ ID NO: 1299 - DNA, 1128 bp, Clostridium paraputrificum
atgaaaataggtattgattctagaggagtaaacttatactcaggatctggtataggtacttatacaaagaatttgattataaatatgataaataataatactaaagatacatttaatttaatttggactggaaaaaagaatgctaaatttataagagataacacaaagctcttttatacctctggaagatatggtggattttacgaaacatacttcacccctaacctaatgaaaaaggaagatatagacctattccacatcccacaaaatggcataggctacccttttaactgggacttagatgttgtagtaacaatacatgatttaattccatatacaatgccagaaactgttggaagaggttacttaaatagattcttaaaagatatgccaaatataatagaatcagctaaaggtatactaactgtatcagagtactctaagagagatattttaagattcttccctaatatatctcctgataaaatctacgtaaccccattagctactaatgaaaactttaaacctatacctaaggatgtatgcaaaaattatataagtaaaaacttaaaaataaatgacccctatattctctatctaggtggatttagtgccagaaaaaacgttaaggaattaatattatcctttggtaaaattataaaggacctgaagaagcctcataagcttttattagggggtgcaataagagatgagggtaatattttaagggatatagttctagaggaaggtctacaggagcacattttatttactggctatttagacgattcaatattaccaatattatatagtggtgctgaagcttttatatacccttccttgtatgaaggatttggattacctcctttagaagccatgagctgcaaaacccctgtaataacttcgaatttaacttctattcctgaagttactaatgatgcagctatattaattgatccctttaacaaagatgagcttagttataatttactaaaactattaaatgatgattctaaaaaagaggagctttctgaaaaagggtataaaagaagtctccaattttcatggagacaaactgctaatgctactttagaggcctatagagatatatttaaatcattgacctaa

SEQ ID NO: 1300 - DNA, 900 bp, Clostridium paraputrificum
atgataggtatggaaaaacgaagctttaaagagaggctatttaatgaatatataggaaaaacatttgcaacattatgtggaatgttaataatagcagttacattatcaataataatattcattggtcaaaaaggaattcaaacatttacaaaaggaaattatggaatagtagaatttctgtttacaaataattggaacccgagtgaaacaccagcctcttttggagctttggctttcatattaggatcaacctttgtatcaatgggtgcggtaataattagtgcacctattgctattacattagcggtttttgttaatgtgatttccaaagggttaggtaataaacttataaagccatcattagaaatactggttggtataccatctgttgtttacgggtgggtagggatatctgtattagtaccttttataaagaatcatataggtggaatgggattttcattgcttgcaggtatattagtattatccttaatgatattaccaactatagcaacattatctattgatgctattaagagcataccaagagagcatattgaagcttcttatggattaggggcaacaagatggcaaactataaaaaatgttattattccaggagctaaaagcggtattttaacaggagtggttttaggagtagcaagagcttttggtgaggcattagcagtacaaatggtaataggtaacgcagtaaagattcctaatggactattgtcttcatcatctacacttacgagtattttaacaatggatatggcaaatacagtaggtggtacggcttggaatgatgcattgtggagcctagcgttaatattacttgtgatatctttcttatttatacttgcaattagaaagattgaaaagaggagtgaaggatag

SEQ ID NO: 1301 - DNA, 3717 bp, Blautia sp.
atggctgaaacaaccaataaagaagtatatcaaccaatgacgttcgatgcgattaaaattggtctggcatctccggaaaagatccgtgaatggtctcatggtgaagttaaaaaaccagaaaccatcaactaccgtacattaaaaccggaaaaagatggtctgttttgcgagagaatcttcggaccaagcaaagactgggagtgtcattgtggtaaatataaaaagatccgttataaaggggttgtctgcgaccgctgtggtgtagaagttacaaaatcaagcgttcgtagagagcgtatgggacatattgaactggcagcgccggtatctcatatctggtacttcaagggaattccgtcccgtatgggtctgatcctggatctgtctccgagaacactggagagagttctgtattttgcaaattatattgtcctcgatccgggtgataccaatctgcagctgaaacaggtgctgacagagagagaataccaggaagcaagagaacagtttggagacaccttccgtgtaggtatgggcgcagaatctatcaaagagctgctgcaatccatagacctggaagcagaatccgtagaactgaaagccggactgaaagatgcaaccggacagaaacgtgcccgcatcatcaaacgtctggaagttgtagaagcattccgggaatccggtaacagaccggagtggatgatcatggatgttgtaccggttattccgccggatctgcgtcctatggtacagctggacggtggacgttttgctacatctgacctgaatgatctgtaccgtcgtatcatcaaccgtaacaaccgtctgaaaagactgctggagctgggagctccggatattatcgtaagaaatgaaaaacgtatgctgcaggaagctgtagatgcgctgatcgataacggtcgccgtggccgtccggtaaccggacctggtaacagagctctgaaatctctgtccgatatgctgaaaggtaaatccggacgtttccgtcagaaccttctgggtaaacgagttgactactccggacgttccgtaatcgtcgttggaccggaactgaagatttatcagtgtggtctgccgaaagagatggcaatcgagctgtttaaaccgttcgttatgaaagaactggttgcaaacggaaccgctcataacattaaaaatgcaaagaaaatggtcgagaaagtacagccggaagtatgggatgtattggaagacgttatcaaagagcatccggttatgctgaaccgtgctcctacattgcatcgtctgggtattcaggcatttgaaccgatcctggtagaaggtaaagcgatcaagctgcatcctctggtttgtaccgcgttcaatgccgatttcgatggtgaccagatggctgtccatcttccgctgtctgtagaagcacaggcagaatgccgtttcctgctgttgtctccgaacaacctgctgaaaccgtccgatggtggtccggtagccgttccttcacaggatatggtcctgggtatttattacctgacacaggaaagaccgggaagcaagggagaaggcggatactacaagagcctgaacgaagctatcctggcttacgaaaacggatacctgacactgcagacaagaattcacgttcgccgtgaaaaaactctgccgacaggagaagtcctggaaggaacagtagaatccactctgggtagattcctgttcaacgagatcctgccacaggatctgggatttgtagacagaagtgttccgggtaacgaactgtttctggaagttgatttccatgtaggaaagaaacagctgaaacagatccttgaaaaagttatcaatacccacggacagacaaagactgcggaagtactggatgatatcaaagctaccggttacaaatactctacgagagctgctatgactgtatccatttccgatatgactgtgccgcctcagaaaccacagatgatcgaacaggcgcaggaaactgtagataaaatcaccagaaacttcaaacgtggtctgatcacagaagaagagcgttacaaagaagtcgtagaaacctggaaacagaccgatgatgagctgacaaaagccctgctgaatggtctggataaatataacaacatcttcatgatggccgattccggagcccgtggatctgataaacagatcaaacagctggccggtatgcgaggattgatggccgatacaaccggtcacaccatcgagctgcctatcaagtcaaacttccgtgaaggtcttgatgtactggaatatttcatgtccgcccatggagctcgaaaaggtatgtccgataccgcccttcgtaccgccgattccggttacctgaccagacgtctggtagatgtatctcaggagctggttgttcgtgagatggattgtgcggaaggcagagatgagattccgggtatgtatgtgaaggaattcacagacggaaaagaagaaatcgaaagtctgcaggaacgtatcacaggacgtttctcctgcgagacaatcaaagataaagatggtaatgtgcttgtaaaagcaaaccacatgatcacaccgaaacgtgcagctaagatcatgagcgaaggtgtcaatgcagaaggcaaaccttacgacaagatcaagatccgtacgattctgagctgtaaatgtaaagttggtatctgtgcaaaatgttatggtgccaacatggcaacaggagaagctgttcaggttggtgagtctgtaggtatcatcgccgcacagtccatcggtgagcctggtacacagctgaccatgcgtactttccatagtggtggtgttgccggtggcgatatcacacagggtcttcctcgtgtcgaggagctgttcgaggcaagaaagccgaaaggacttgccattatcacagagatttctggtgaagttgcaatcaaagataccaagaagaaacgagaaatcgtaattaccgataaagaaagcggagaaaccaagacatacctgatcccttacggatccagaatcaaggttacagacggacagatgctggaagccggtgatgaactgacagaaggttctgttaacccacacgacattctgaaaatcaaaggtgtacgtgccgtacaggattatatgatccgtgaagtacagagagtataccgtctgcagggtgtagaaatcaacgataaacatatcgaggttatcgttcgtcagatgctgaaaaagatccgtatcgaagacaacggagatacagaacttcttccgggtacgatggttgatttccttgaatatgaagatatcaatgaaaagatggaagcagaaggaaaagctccggcggaaggaaaacaggttctgctgggtattaccaaagcttctctggcaaccgattcctttatgtcagcagcatccttccaggagacaacaaaagtcctgacagaagctgctatcaaaggaaaagttgaccacctggtaggtctgaaagaaaacgttatcatcggtaaactgattccggccggtactggtctgaagcgttacagcaacatcaaactttccacagatgatatgctgaaggaagaagaggacgatatcctgctggacgatgaagatctggaacttgtaccggaagatatcacagtagaggaagaagcttccgaaactgctgagacagatgaagaaacagatgaaatcgctgaagaactggtaactcttgaggatagcgaagagtaa

SEQ ID NO: 1302 - DNA, 3762 bp, Blautia sp.
atgagcagtgtaagacgtgtttatgtagaaaagaaacctgattttgcggtacaggcaaaagaattaaagcatgagatcagcagctaccttgggattaagactgtgacagcagttcatgtatatattcgttacgatgtggaaaatatttcagaggaagtgtttgagaaagcatgtacatgtgtattctcagagccaccggtagatgtgctgtataaagagcagattccgatggcagaaggagcaagagtattttccgtggaatacctgccgggtcagtttgaccagagagcagattctgcagtgcagtgtgtacagttcctgaaagaagatgagcagccgatcattaaatcagcaaccacatatgtgattgaaggaaatatcacggacgaagaattcgaagcaatcaaaaatcactgtatcaacccggtggattcccgcgagacaggaatggtaaaaccggagactctggtaacaaaatttgaagaaccggaagatgttaaaatctttgatggttttatcgatatggaagaagcagctctgaaagaactgtacgcttctttgaatctggctatgacatttaaggatttccagcatatccagaattattttaaaaacgaagagaaaagaaatccatccatgacagagatccgtgtgctggatacgtactggtccgatcactgccgtcatactaccttctccacagaactgaaaaatgtaacattcaaggatggcgattacaaagagccgatcgtgaaaacttatgaacagtatctggcagacagagaagttctctacaaaggaagagatgacaaatttatctgtctgatggacctggcgcttcttgctatgaaaaaactgaaatccgaaggaaaactgcaggatcaggaagaatccgatgagatcaatgcctgctccatcgtagttccggtagatgtagacggaaaagaagaagaatggctcatcaactttaagaatgaaacacataaccatccgaccgagatcgaacctttcggtggtgctgctacctgtctgggtggtgcgatccgtgatccgctgtcaggacgtacgtatgtatatcaggcaatgcgtgtgaccggtgctgcagatcctacagtttctgtaaaagagactctgaaaggaaaacttcctcagaagaaactggttcgtggtgcagcccatggctacagctcctatggtaaccagatcggtctggctaccggttatgtaaaagaaatctatcatccgaattatgtggcaaaacgtatggagatcggtgctgtcatgggtgcggctccgagacgtgctgtcaagagagagaattctgatccgggcgatatcatcatcctgttaggtggacgtaccggccgtgacggtatcggtggtgcaaccggttcttccaaagtacatacagaagcttctatcgaagtttgtggtgccgaggtacagaaaggtaacgctccgacagaacgtaagatccagcgtatgttccgtagagaagaagtcagcaaactgatcaaaaaatgtaatgactttggtgcaggcggtgtatctgtagcaatcggagaactggcaccgggactgcagatcaatctggataaggtaccgaaaaaatatgccggtctggatggaacagaaattgctatttccgagtctcaggaacgtatggctgttgttgtagatccgaaagacgttgacgaattcatgaaatatgccaacgaagaaaacctggaagctgttgtagtagctgttgttaccgaagaaccgcgtctggtattgaactggagaggaaaagaagttgttaatatttcccgtgctttcctggataccaacggtgcgcatcaggagacagaagttctggtagatattccgaataaagagggaaatgttctggagcgtgaagaaaaagctcctgcagataccaaagcggcatggttatctatgctggctgatctgaatacctgttctcagaagggactggtagagatgttcgacggatccatcggggccggaagtgtatttatgccatatggtggtaaatatcagctgacagaaactcaggctatggtcgctaaggttccggtaatgaacggaaaaacagatactgtgactatgatgagctacggatttgatccatatgtatccagctggagcccatatcacggtgcagtttatgcagttgtagaatctattgcacgcatcgtagcgaacggtggagattactccaagatccgtttcaccttccaggaatacttccgccgaatgacagaggatccggaacgttggagtcagccatttgcagcgttgctcggtgcatatgcggcacagatgggatttggccttccatctatcggtggaaaggacagtatgtccggaaccttcaacgatattgatgttccgccgacactggtttcctttgcggtagatgtggctaagaaacaggatattatcacaccggaactgaaaaaggcaggaagtaaactggtatggatccgtctgccgaaagacagctatgatctgccggattatgcagcaactatggatcagtacggaaaactgcatcaggatatcctggatggcaaagtgctttccgcttacgcactggatcgtcatggtatcgcagcagcagtcagcaagatggcattcggtaatcagctgggtgtgaagattgaacacaatctggacgagagagatctgtttgcaccgggatttggtgatatcatctgcgaagtaccggctgacaaagtcggagaactgtctgtaacctatactgttatcggtgaagtgacagacaatgcaaaattcacatacaaagatggaatggaaatctccatgaaagaagcactggatgcatggaccggaactctggagaaagtcttcaagaccaaaggaaccgataacatggagaaagtggaaagcccgctttacaaagcagacagcatccatgtgtgcaaacataaagtagcacgtccgaccgtattcatcccggtattcccgggtaccaactgtgagtacgacagtgcgaaagcatttgaacgtgccggtgcggacgtgatcacaagagtattcaagaatctgacggcggaagatatccgtgattctgtagcaatcttcgaggaagcaatcaatcaggcacagatcatcatgttcccaggcggattctccgccggtgatgaaccggatggttccgcaaaattctttgcaactgcttttcagaatgcgaagatcaaagaagccgtaacaaaactgttgaatgagagagatggtttggcacttggtatctgtaacggattccaggctctgatcaaactgggactggttccttatggcgaaatcgtaggacagactgcagattcaccgacactgacttacaataccatcggcagacatatttctaagatggtttacaccaaagtagtaactaacaaatccccatggctggcacaggcagaacttggcaaagtatatgtcaacccggcgtctcatggagagggtcgtttcgtggcaaacaaagagtggatcgataaactctttgcaaacggtcaggtagcaacccagtactgtgatctgaacggaaacgtatccatggatgaagaatggaacgtcaacggttcctacgcagctatcgaaggaatcacaagcccggatggtcgtgtacttggaaagatggctcacagcgaacgccgcggcgatgccgtagccatgaacatctacggagaacaggatatcaagatcttcgaatccggtgttgcttattttaaataa

SEQ ID NO: 1303 - DNA, 3633 bp, Blautia sp.
atgcaatcaaacagaacgggaagcttcatattccgtgtgaaccaatcagaaaaatgtaaaacacagttacgacccctgccggtaaaaagacaggggtcgaactgtcagagagaagaagacagacgaaaagatgctgagcgcaggcagaagcaggaacaaaaaaggaggaaaagatccatggcactgcaatttgtaccaggtaattcgggagctggaaaatcttttcagttatatcagaaaatcttacaggaagccggaacacatccggagagaaagtatctggtgatcgtaccggaacagtttacgatgcagacacagaaggaactggtagctttgagtccccatcatggaatcatgaacgtggatattttaagttttgaccgtctggcacaccgggtattcgcggaagtaggcggtgatcagacacctgttctggaagacgtggggaaaattcttgtactggaacgcgtggtgcaggaacagaagaaaaagctgggagttttgggtagcagtctggaaaaactgggaaccgtcagtgagatgaaatcactgttatctgagctgatgcagtacgatattcatccggaggaactggacgagatcggcaatatggcgaaagaaaaaccgttgctgtatcacaaattaaaggatgtgcaggccatttatcagggattttccgagtttttaagaaaacggtatatcacggcggaagaagttctggatctgttgtgtgagaaaatcggaagttcccgactggtgagagacagctggatcgctttggacggatttaccggatttactccggtacagaataaattactgcgggaactgctgaaactggcacagcaggtatgggtgacggtgacgctggaggaaaaggtgtccgtggcacagttaaaacgtccgcagcatctgtttcggatgagtggggagatgatggaatctctgaccagaatggcagcggaagaacgggtggaagtcttggatccctggtgggtgcgtccgggggaatatagccgtttttgcaaggcaccggcactggaatttctggaacagcatctgtttcggtatgataaacggcagtaccggaaggaacaggaagaggtacagatctttcaggctgcaaatccaaaagaagagatggaagagatcgccagaaggatccgcctgctggtgcggacaaagggctacaggtatggggactttgccgtgatcacaggggatatggcgacgtatggaagttatgccagacaggtcatggaacagtgtgagattccctgctttatcgatgaaaaacattctattctgatgaatccgtttgtggagtatatccgggcggctgtcaatctggtggtggagtatttttcctatgagagtatgttccgttatcttcgctgtgggctgtccgggattccggtttatcaggtggatcaactggaaaattactgtatcgctgtgggaatccgcggggaaaaacagtggaaggatcactgggtaagacggtaccgggggatggaagaaggcagtatcgaaggaatcaaccagatccgggaacaggtctgggaaaagatcggtccttttgcggagtatatgaaagaaaaagagcacacagtggaagaacggacacggatgctctatgagatgatcgtaaaagatgatattcaggaacggttatctgagaaagaacaggaattcgctacacagggcgatcaggcgatggtgaaagaatacagccagatttacggaatgatcatggaacttcttgataagatggtgcagatgcttggcagcgagacgatcacggcgaaggagtacggaaagcttctcgatgtgggattccaggagatgcgggtgggcatcattccaccgacggcagatcaggtactgatcggtgagatggagcgtaccagactgaaagacatcaaagtactgttctttgcaggcgtcaacgacggaatcatcccgaaacacggagggaaggcaggtctgctgtctgagtcagatcgggaatttctcgacagccgtcaggtagcactggcacctacagcaagagaatccatgtatatccagcgtttctatctgtatctgaatctgacgaaaccttcccggtgtctgtatctttcttacgctcagtcaaatgcacaggggcaggcacagagcccggcgtatctgatcgcgctgattcttcggatgtatccgaaactggtgattcaggataatccgaaagacgagatcagccagatgcagatggcacagcaggcaacggaaattcttctggcaggacttcgaaaggatggagaacagcagcagaacgatggctggagggaactgttttcctggtatctgcggtcaaaagagtggaaggagcagtgtcttcgctggatccaggcggcatacgagggcgcaccggagagcagcatcggaaaagcggcggcggtggcactttacgggaaagaactggaaaacagtgcgacggaactggaacggtttgcagcctgtgcctttgcacattttctgcagtatggtctgaagatcgaggaacggcaggaatacgaatttcgtcaggcggatctgggcaatgtgatccatcaggcactggaacagttttcacgaaatctcaaaaaaaaccagctgacatggcgtagtctgacggatcaggaacgggatcagctgattgatacgagtgtggaggaaaccattcacgactatggcaatacgattctggagagcagtgcaagaaaccagtatatgatcctgcgtgtaaaacggatcctgcggcggacggtctgggcactgcagcaacagctgaaagcaggaaaatatgaaccaagtcggtttgaaatctctttttctatggaggaagatctgaaagcatcgaattttcagttatcggaggatgagcgcctgcgcctgcgagggcggattgaccgggtggaccgctatgaggaggacgatacgatctatgtgaaagtcattgattataagtccggcaatacggctctggatcttacttcggtgtatcacggactgcaattgcagcttatcgtgtatctgaatgcagcactagagctggaagaaaagaatcatccgggaaaacatgcagaaccggcggggatgttttattatcatgtcaaagatccactggtggatggaaaacctggggatgaggaagaggagattgaacggaaactgctggaaaaattaaaggtggacgggctggttcgggcagaagaaaagatcttaaaggatctggatcgggaactggaagcagggaaaaaatcgctggtgatcccggcagcttacaataaaaacggcagcctttcaagtcgttccaaaacggcaagcaaagaacagttcgaagaactctgtacctatgtcaacgataagatccgtgaaaatggaacacggatccttggcggggagatggagaaaaatccatataaattaaaacaacggaccgcctgcgactattgcagctttaaggagatctgcggatttgatgaaaagcaggagggaaacagtttccggagacttccgacattttccgatgaggaactgtggaagaaaatgagagagaaaggggagaagaaagatggaaatgaagtggacaccggaacagcagaaggtcattga

SEQ ID NO: 1304 - DNA, 3096 bp, Blautia sp.
atgaaactgcaaaattattttcaggatccttcctctttacacatcggaacagaaccgcttcgtgcctactatgttccatgtagagaagaagcagaagccaacggcgcagacatgctgaaggcttcccgggcaatcattttaaatggtgaggactggaaatttaaattctatgaaagctatcaccaggttcctgaaggatgcactgaaaaagctgcggataccacaggctatgataccatcccggttccaagctgctggcagatccttggatacgatcagaatcagtataccaatgtccgctatccgattcctttcgatccgccttatgtgccggatgacaacccggcaggtgtctatgtgaaagaattttcactgactgaagaagaagcgacgcagaaaatttatctgaactttgacggcgtggactcctgctattctgtatggatcaatggagctttcgtcggctacagtcagatttcccattccggaagtgaatttgatattactgacaaagtaaccgccggcaataaccgcctgactgtcctggttttaaaatggtgtgacggaacctatctggaagatcaggataaacttcgttttaccggtatcttccgcgacgtttacctgctggttcgtccggtagatcatatccgtgattattttgtccatacaccggtaagcgaggatcttaccaaagctgagattctggtcgatctggaactttgtggttctccttccgtcactgtaaagctgtatgcaccagacggagatttcctggctgctaccactccttctgacggaaaagtgcggtttgccgtagatgatccggatctgtggaatgcagaacatccggcactgtatacgctgattctttccacaccggatgaagtgatcgctcagaaagtcggccttcgccggatcgatatcaaaggaaatgtcatctatatcaacggtgtgaacttcaagatcaaaggtaccaaccgccacgacagcaatccgtttaccggagctgcagtcacaagggaacagcttctgactgatctgaagctgatgaaggaacataacatcaatgcgatccgtaccagccattatccaaatgctccatgggccacacagatgtatgacaaatacggtttttatgttatggatgaagcagatctggaatcccacggatgtaccacactctacggaagtaagagtgaacatgtcgatatgggagaagtacagtacgaagaaagctatggctatctgatgcgcgatccttcttatgaaaacgctgtcgtagaccgtatccaacacctggtccacagagacaaaaactgctccagcgtcttctcctggtccatgggaaatgaaagtgcctacggtcctaatctggaaaaagccgccgcatggatcaaatcttacgacccagatcgtgttctgaactatgagaacagtatctggcagcagaccaatactgattatgtcaacgatgtacatgatctggatgtcttctcccggatgtatgcaccggtggaatttatcgatgagttctgctctaaaaaaggtaaaaaaccatttatcgaagtagaatactgccacgctatgggtaacggacctggagatctggaggcttattttgaacgtctctacaaatatcccggttatatcggtggtttcgtatgggaatggtgtgaccactccgtctatatgggtaagaccatcgaaggcaaagataaattcttctacggcggtgactggaacgaggaaatacatgacggaaacttctgtatggatggtctggtatacccggatcgtaccccacataccggtcttctggaacataaaaatgtagcccgcccaatccgtgccactctgctggatacttccaaaggactggtcgaactggataacaaactggattataccaatatcaaagatggatttacaatcacttacgatgtacagaaagacggtatgactgttctttccggtacactggatccggtagactgcccggcaaaagaaaaagtaacgattacattaccatttgctgtaactgtagaagccaataccatcgttaccctgcattatctgcaaaaagaagatgctctgctgaccccgtcaggatatgaagccggtcatgatcagctgatcttttctaccgatgccacaagtgctgtcgccgccgttgccaaagcttccggtgcttcgaccgcatctgctgcatctgctgtatctgtagaagatctggaaaacgaactggtagtcagcggctctgctttccgttacgtctataacaagtggaaaggaactttcactgctcttgtaaaagatcagaaaaacctgattgctcagccgatccagttaaatatctggcgtgcaccgatggataacgaccgccggatccgctgggaatgggaagctgcaggctacgacagagcacgcacaaaaatttatgctactgaatggacgcaggatgaaaatggtgtaacgatcacttccacctattctctggcggccgtatatctgcagaggatcatcgagggaactattacatggaaagttgccaaagacggtactctgaccgttaccgtagacggtgagcgaaaaccggttcacgtaccgcttgcaaaaactccgctgccaaagatgccgttcctgcctcgtttcggtctgcgcctatttctggaaccggcctttgccgatgttacttatttcggttatggaccgattgaaagttatccggacaaacatcacgatgcaaaacttgggctttatacctctgatgtagacagtctccatgaagattatctgcgtccgcaggaaaacggaagccattggaactgctccggactggcactgaccacttccgatcatcgttctctgctgatatccggcacacagaacttcagttttaatgcatcccggtacacacaggaggaactgactacaaaagcacacagcttcgaactggaaaaatctccgtacacagtgctgtgcctggatggatatatgtccggttgtggctctaacagctgtggtcctgctctggcaaaaaaatatcgggtagatcaggacaaactgacatttacctttactctgaatttctaa

SEQ ID NO: 1305 - DNA, 3438 bp, Blautia sp.
atgaaggaaatatatcaaaataagaaagaaaacttgcaaaataataaagacggaaggaacagggagatgacattcagagagcagatcagaaatcttgccggcagtcagtcatacagcagagggttgcagatttataacagaggaaaagtattgcgtttccatatagaagaagcagaagatgttcatgcggatgaaaatgtaattatcgaagcggatgtggaagggagtcgcagtacaccataccatgtgtatctgatgtggaatacggtctgggaggatcttgtagagtcggagtgcagctgtccggctttctgggagtatgatgggatatgtaagcattgtgtggcggttcttctgagatattactatgagacaaagaatcggacgggtcagatgaatttgatgcagataccgggtatacaaaagggaatggcaagaaaaacaacaggaagtatccagcagctgcttcaaaaaggtgcactggtgaaaagtcttcccatgattcagggggatatctgtggaaaagtccgtctggaaccgcatatggttgtggaaaacaccgggatcaccgtcagcttcaagcttggaatcaaccggatgtatgtactgaaagatgttttcggttttgcaagagcgatagaaaaccatgagaaagttttttatgggaaaaatctgcagtttatccatgctgttgaatcgttcgttccacagtcccgaccactggtatcttttcttgtgcagtgggcagagaaaaatgaatatcggtatggaggatatcacagctattattcggtttatgggaatgccagggaaaaacagattgatttgtctgccaatgatatggaaacttttctggagctgatgaagggacaggagatcctggcatccgtgttttacatggatgagaagccgtggaaaattgtggagcagataccggagagaacgctgaagattctgggaaaaacggatggaattgaagtaagtatcaatcgattgtcgggaataagaggaaacagatacaatatatttttttcgggtaatcagattatgatggaaccgatgaaaagaatggaaccggtaaaagaattcctggaatgcatggcggagatcccggaacggaagatttttgtggaaaagacagatgttccgttgttttgtatggaacttcttccggcgttggaacagtgttttgaatgtacaaaagaaaattttgatgaacagcagtatggtgtggcgattccggagttttcgatctatctggatgcaccacagacagatatgatcacctgcagaccgcaggtgcaatatgataaaaaagtatacagtctgtatgagaccagggatgtggcactgcgggatcttggaaaagaagcggcagtacgggaagtgattcagcggtacggggaagcatatgacgaacgacagaaagctatggtgatcacggatgaggataaaatatatgatctcctgacagaaggaattccggtatttcagcagctgggggaggtatatatatcagatacgctgaaaggaatgcaggtgcatccgtcaccgaaagttgcggtaggagtatcgattgaaagtggtctgatgcagctgaaaatgacagcgggagaaatgtcaaaagaggaactgatcgatattctgtcccgttataataaaaggaaaaaatattatcgcctgaaggatggaagcttcgttcagaaagaagacagtggtctggatatactggcagatctgaaggaaacgctgcagctgacagatcagcagctgatgcaggagagcgttccggtggatacctaccgggcgttgtatatagatcagcaattacgagacaatccggtgatttcttcggtgagggataagaattttcgttctctgatccgtaacatgaaaactgtagaagacaatgattttgagattccggcggaacttgaaccgatcctgcgcggatatcagaagacaggttttctgtggttaaaaacgctcagtgcgaatggatttggcggaatcctcgccgatgatatgggacttggaaaaacgttgcaggtgatctgctatctgctttccgagtatcaggaacgtgaaatacaggaaaacagtaagaaagagccggtggaaaaagagcagggtatcgagaatgagggacggcagcgggaaaagaagagctcagatgaccggctgcggcggaatgcgctgatcgttgccccggcttccctggtctacaactggaacagcgaactggaacgctttgctccggaactgaccggaaaaatgatcgtaggaaccgccgtccagcgtcacacacttctggaagaagcaggggagaatgatattctgatcacatcctatgatctgctccgcagagacagcgatttctataaaaagtaccgcttccgctgtcagatcatcgatgaagcacagtatatcaaaaaccacagcacccaggctgcaaaagctgtgaaaaagatccaggcagacactcggtttgccctcaccggaacaccggtagagaaccggctgagtgaactgtggagcatctttgattatctgatgcccggatttttatacagttattcccgcttccgtgaggaactggaagtacagattgtccagcatgagagcgaggaagccagtgaacggctgcgaaaaatgatccgaccttttgtgctgcgaagactgaagaaggatgtactgcgagatcttccggaaaaactggaagaaaatatgtatacccgtctggaaggagagcagcagaagttatacgatgcgcatgtaaaacggatgaaacttctgttagataaacagagcgaggaagaattcaatacttccaaaatcgttatcttatccgaactgaccaaactgcgtcagatctgctgtgacccggcattgctttttgaagaatataaaggagagtcggcaaaacttgagatgtgtgtggatctgattcgaaacgcggtggaaaacggacataagatccttgtattttcccagtttaccacgatgttgagccggctggcagaccggctggagaacgaagaaacggcgtactatatgctgaccggttcgaccggaaaggaaaagcgggcaaagctggtggaggagtttaataaagaagataacccaacagctgtttttctgatctctctgaaagccggaggcaccggtctgaatctgacggcggcggatattgtgatccactacgatccttggtggaacctggcagtccagaaccaggcgacagaccgtgcccaccggatcgggcagaaaaacgtagtcaatgtctacaaactgatcgcgaaagatacgatcgaagaaaatattgtaaagctgcaggagaaaaaacatgccctggcggatcagatactgagtggcgaggacatgggaagcggcagtttttccagagaagagattctggaactgctgggtggcaagtaa

SEQ ID NO: 1306 - DNA, 2142 bp, Blautia sp.
atgggggtggagcttatggatagttccgttatttggtacgcagtgttagctgtcgtagtagttgctctcgtttttgtcctttttaatttcaacaaagtaaagaaactgaaagagggaaacgacgagatggtagagatggccggtatcattcggagtggtgcgggtacatttttgaaagcagagtttaaggtgatcgcaatcataggagtcatcattgctctggtattcagtctgtttgtggaagccacaagtggaattacatttctgctaggcgggctgatgagcagtctggtctgtatcattggtatgaagagtgccacctatgccaatgtacgtacagcaaacaaggcaagagaatcactttctatcggagagaccgtaaaagtagcattgagcggtggaagtgtcagtggcattgctgtacaggcatttggtatgctgggactgttgctgttgctgatcatctggggtgtggatcctcacgcaacaggtcacggactagtggcaaacctggagtgcaatccttccatcatgagaatcactacatactctctgggatgttcaatcgtagccatgttcaacagggttgcaggtggtaactacacgaaggcggcagatatttcatctgatattcttgccaagattcgccatgatatgccggaggatgacagtcgtgtgccaaatgttattgcagactttatcggagataatgtcaatgatattgcaggtaactgttcagatcttctggagagcttcgttgcaaccatcgcagcttctattatgattgcagttaccttatttatcaatggaatcgtgaatgtatctgatgaaacctttatccgtatgatcattttcccggtgattcttgccggtgtcggcctgattggatgtctgatcggcctgagttacgcatttgtacggaagatgggagatgatccgtcaagagaactgaatcttgccacctggatttcagcaggaattacggttattctgggtctggctgcttcgtatatgatgtttggaaatgttccattatatgaagatatggtctgtggatggatatctccgtggatctcaagtatcctcggtatcgtcagcggaattgcgatcggaagtattacagaatattataccagtgacaaatacaagccgacgaaaaaactggcagagatggcaatcgagggtgaggctttcgttatcacaaaaggtgatgcgattggatcccgttccaccttactgcctatcctcatcattggtattgccctgtttatctccggaaaaatcagcggaacttatggaatagcaatttctgcactgggtatgctttctttcgtaggcgcaacggtatccatcgatgctttcggaccaatcgcagacaatgcaggtggtctggcagaatcctgtcatctggaacacaaagtccgtatcatcacggacaagctggattcggtaggcaatacaacagcggcgatcggaaaagggtttgctattggttctgctgcatttgcagctgtttccctgattgtggcttatgtaggaaactatacggcaaaaggagaagagccggtattaaatatcgcatcattcattgtggttgccggtggcctgatcggtggtgcactgatcgagtatttctctgcgatgctcactgataacactatcgagtcagccaaactgatggccgatgagggtgataagatgctttccacttccggtgtactggaaggaaaagtaaaaccggattataataaactgatcggaatggctgcaaaccaggctttgaaaaaaatggtagtaccgtctgtactggcactttgtatcccggtaatcggtggatttgtctttggggtacagtttgtaggcggtatcctgatcggtgccacgatcgtggcgattccgcgtgcactgtttatgggtaactccggtggagctttcgataatgcgaaaaaatacattgaaagtgaagctcttgaagggcacgggaaaggatcggctgctcacaaagcagcagttaccggtgacactgttggtgatacaagaaaagacgttgtcggcgtggcattggatatttttatcaagagtatgtctacagttgccaatacactggcatctctgttttcaacaattacattaattcattaa

SEQ ID NO: 1307 - DNA, 3537 bp, Blautia sp.
atggaacagttactaaacggaagatttgaatatgaagtaccaaagctgactctttccgatacacagattaaccttacgaccaatgaaggggagaatgttcggggagaattatatgtggcggcagaagataaccgcaggatcaagggaatgaccatgtcatccaatcgccgggtactgctggcaaaggaaaaattttcgggaacaaccgtatgtattccttacgggctggatgtgaagggactgtccgcaggtgagacggtagatgcagtgattacgatcaacagtaacctgggagaataccaggtgccggtacacgcagagatcacagacgacgggattcagacatcccgcggagcagtggataatctggaagcatttatcaaactggcggagagtgattatcgggaggcatttcgtctttatacaagcgagagctttctgaaagtgctgcagggagaagatccgggatacgaaagcctgtaccgggggatgtccagaaacccggtgacctatcagcatatggaagagtttctgatcggaaccggaaaaaaagagccggtgactctgcgtctggaaaagacagaacagacctgggatcatctggatactacagtcaaagattgtctgaatctgtataagagcacctgggggtatacccggatggaagtggaggttaccggagatttcctggaagtggaaaagaaagtgatcaccagtgaggatttcatcggaagtgtttatgggctggaatatctgatccgcaaagaaaaactgggaagcggaagaaaatacggacagatccggatcaaaaccgtatatggaacgtatatctatgaggtgaaggcttcgggcaatgcttcctatgaactgagcacaagaacttatgagaaaaaagggcaggcggcactggcaacactgtatgaaaaatatctgctgggcgagataaaacagcaggaatggaaagaagcatccttgaaagaactggaaaatctccggaatctcggatgttattatccgaaacaacagctgacagaggcatacatctatgaacagaccggagatgtggcaaatgccatgtctgtgctgtggcctctcagggaactgaaatttaccagggaacagatggaggaagaagcctggtatctggcgctggcagtgaagacctctgtggctactgaagaacagaagatgacagcacaggccaggatcgaaaatctctatcgtatgaatccgggcagttatccaatcctgaaagtgctgatggaaacttcggaagaatataagcaggcaccgggcagacagatgtatatgttggaagaattgtttgatctgggatgcagaagcccgtttctgtatctggcagcctatgagaaaatggaaacagaagcaggctatctgaaaaaactgtcaccgtttatggtacaggttcttcactatgcagcacgttatggaaaactgaatgaagagctgaccatgcggatcgggcatctctcagaatatgtgaagaatttccagccggtgatctaccgtctgctggtaaaatgttacgaggcttatcctggcaatgatctggtggatcatatctgcaaatacattatgaagggacagccggcgaagagcgagtatttccgctggtatcagctggcagtggaggcagatatccggatcactcgcttatatgaatattatattgaaactatgcctcagggcttccagagtgtactgccgcaggtgatccgtatgtattttgtatataacaatacactgagcagcagaaaacgggcatctgtgtatgccaatgtaatacgcaataaagaggcagataagacaacatatcagaattatcgtaaggcgatggaagcattcgcgcaggaagcattgatggagggaagaatcagtgaagattatgctaccatctatcaggaatgcatcgaagacattgcaacgccggctcttggagaagcgatggcgaaagttatgttttcttatcgggtgtactgtgatgatccgaagattcgcagcgtcatcgtgtgtcatggagaactgaaagaagaacaaagctatccgtgcacagacggtgctgcctatattcagctgtatacaccggatgcgagaatcctttttgaggatgagaaacggcggcgttatgcgacaacggtagattacaatatacagaaactgatggatgaaaaaccatatctgcagtcgtgcatgaatctggatatcgcaacacccggattgttacttgccgtatgtggcaatgacagccgcagacagatcgggctttccacccttggctgttaccagcatgtggtggaaatgtcagaattccaagagccataccgccatatggtatgcagaaaaattctggaatattatgcagaacacgcaggcgatgatacgctggatagttatctgaaaaaaatggatctggtgacatttgcaaaagtagataaggtattactctgcgagatcctgattgaaaaagggatgtatgccacggcattggacatgatcagccgttatggctatgaaggcataaaaacggaaagtctgatgaaactgaccagctatctgattctggattatgattttgtggaacaggaagaactggtgtatctggcgcagtatgtatttgaacagggactctacaatgaagtgattctgatttacctgagcgataatctgcttggatctgtggaacagatggcacttttatgggaacggatgcgcggattccagctggatacgtatgcgctggaggaagagattcttctactctccatgttcggacgtgtctatctgaggcagggagctgcgatgctggaacagtatgtggcacagaagggaaaagaacctgtgatcctggcatacatttctttctgggcatacggatattttctgggcaaaaaagaaacagatccatatattttccaatgcctggaacaatgttgcaggagaaagcaggaggtagaccggatctgtcacctggcactcctgaaatattatgcagaactggatgcttatacagaagagcaggaaaaactgatcgatgagattctcgaagaatgtacggaaaacagcctgcggtttgcattttaccggaagttcccggcaagattcacaaaaccataccagatggatgacaaacagtttatccaggttcagtacccggccggagcgcgggtgacaattcattatcgactgatccgtgacaaagataccggtgaaaactttaaaagtgaaccgatgaaaaatatgtaccagggcatttttgtaaaggaattcctgctgttttatgatgagatactggagtattacctgacagtggaactgccggatgatacccgacagacggaaaagaaacttctgacgatggaagagtctttacaggaaggaaacacaaaatatcagctgatcaatcagatgctggcaggccggaaactgggacggagagagcagacagaaaaagccatggaacagtacctacagagagaacattttgcaagaaaaatgtttccggtactccatgcgtaa

SEQ ID NO: 1308 - DNA, 4254 bp, Blautia sp.
gtggcagttattactgctacaacaaacaacacaccaaattataccctgggaatcgatatcggttccacaacggttaaaattgccattctggatgagtctcatcagattctgtttgctgactatgaacggcattttgccaatattcaggaaactctggcttcccttctgtcaaaagccattgataaactgggagagatgaccgtacatccggttatcaccggttccggcggactggctcttgccaatcatctggaagttccttttgtacaggaagtaattgcagtttcttcctcgttgcaggaacttgccccaaaaacagatgtagccatcgagcttggcggcgaggacgccaaaatcatttactttgagggcggcaacatcgaacagcgcatgaacggtatctgtgccggtggtacaggatccttcatcgaccagatggcttccctgttacagactgatgctaccggactgaacgaatatgcaaaaaactatcaggctctgtatccgatcgcagcccgctgcggcgtatttgcaaaatcagacatccagccgctgatcaacgacggtgctaccaaagaagacctgtctgcttctattttccaggcagttgtcaaccagaccatcagtggactggcctgcggaaaaccgatccgcggtcatatcgcatttcttggcggtccgctgcatttcctgtccgaattaaaacaggcctttatccgtactctgaaacttgatgaagagcataccatcgttccggaaaattctcatctgtttgcagcaatcggttccgcactgaatgccaaagaagaggtttccgtatctctgtctgctctgaaagaacggatggcacagtctatcaaactggattttgaagttgcacgtatggaaccgctgttcgcttcccaggaagcctatgatgcgtttaacgaacgccagagtcagtacaacgtagtcaccggtgatctggcttcctatgaaggcaactgtttccttggtatcgatgcaggatccaccacaacaaaagctgctctggtcggtgaagatggttccctgctgtattcgttctatgacaacaacaacgggaatccactggcaaccaccatccgtgccgtgcaggaaatctattcccagatgccggacactgcccggatcgcctactcctgctccaccggttacggtgaagcactgatcaaagctgctctgatgcttgacgagggcgaggttgaaactgtatctcactattatgcagccgctttctttgatccgaaggtcgactgtatcctcgatatcggcggtcaggatatgaaatgtatcaagatcaagaatcacaccgtagacagcgtacagttaaatgaagcctgttcctccggatgcggttccttcatcgagacctttgcaaaatccctgaactacagtgtacaggattttgcaaaagcagctttattcgcagagaatccgatcgacctcggtaccagatgtaccgtattcatgaactccaaagtaaaacaggctcagaaagaaggcgcttccgttgcagatatctccgccggtctcgcttactctgttatcaagaatgcgttatataaagtaatcaaagtttctgatgcttctgagcttggtaaaaatattgtcgtacagggtggtacattctataacgatgcggtactgcgaagctttgaaaaaatcgccaactgtgaagcgatccgcccggacattgcaggtatcatgggtgctttcggtgccgctctgatcgcaagagaacgtttcgaagatggcaaagatacaaccatgctctccatcgacaaaatcaatgatctgaaatacacaaccagcatggcaaactgtaagggatgtaccaacagctgccgtctgactatcaaccgtttctccggtggtcgtcagtatatcagcggtaaccgctgtgagcgtggtatcggaaaacagaaaaataaagaaaatatcccgaacctgtttgattataaatacaaaaaaatcttcggttacacaccgcttgatgccgatcaggctgtccgcggtaaagtaggtatcccgagagtcctgaatatgtttgagaactatccgttctggttcaccttctttacaaagctgaaatatcaggtggtactctctcctacttccaaccgtaagatctatgaacttggtatcgaatccatcccaagtgaatctgaatgttatccggcaaagctggcacacggtcacgtgacctggctgcttcgtcagggtgtgaagtttatcttctatccatgtattccatatgaacgtaccgagttcccagaagcaattaaccattacaactgcccgattgtaacctcttatgcagaaaacatcaaaaataatgtagatgaattaaatgatccatccatcaccttccgcaacccgttcctggctctgacgaatgaagagacagccacaaagcgcctggtggaggaattctccgatcttccgaaagaagaagttctggaagcggcacatgctgcgtgggcagaactggaacatatgagaaacgatatccgcagaaagggagaagaaacccttcgctatatggaagaaaccggaagacgcggcatcgttctggcaggtcgtccgtaccacattgatccggagatccatcatggtatcccggatatgattaattcctacggaatcgccgtactgaccgaagactctgtgtctcatctggcaccacttgagcgtccgcttcgtgtcaatgaccagtggatgtatcatacccgattatatgctgctgcaaactttgtcaaagaacgtgacgatctggatctgatccagttaaactccttcggctgtggtctggatgccgtaaccaccgacgaggtacaggaaattctctccaacagcggaaaaatctatacctgcctgaagattgatgaggtcaacaacctcggtgccgcacgtatccgtgtccgttctctgctggctgccatccgcaccagacagaaacagcaggaaaaacgtgtgatccggccgtcttccatcaaacgtgtaccgtttaccgaagagatgcgaaaagactacactatcctctgcccacagatgtctccgatgcattttaatatcctggaggcaggtttcaatgccagcggctatcatctggaagtccttccgaatgataacaaagaggccgtcgatgtaggactgaaatatgtaaataacgatgcctgctacccgtctctgatggttgtcggacagatcatgcaggcactgttatccggcaaatacgacctgcacaaagtagcgatcatcatgtcacagaccggtggtggatgccgtgcttcgaactatatcggattcatccgccgtgcattgaataaagcggatatgggacatatcccggtaatctccatcaacctgagcggtctggagagcaaccccggcttcaagattacccccggcctggcacgcagactggcttacggatgtatcttcggtgatattctgatgaaatgtgtataccgcatgcgtccttatgaaatcaaaaaaggatccaccgaccgcttacatagaaaatgggaaaaaatctgtatcgattttgtatccggcaaacatctgagccatacccggttcaaacagatctgccgtacgatcatccacgattttgaccgtctgccgattgatgagaacttaaagaaaccgaaagtcggtatcgtaggtgagatcctggtaaaattccttcctgctgccaacaatcatctggctgagcttctggaacaggaaggtgccgaagctgtcgttccggatctgactgacttcatgtgctactgcttctacaaccagaacttcaaacatgagaaactgggctttaagaagacttccgctatcaccggcaatgccggtatcgccgctatcaactggctgcgcagtgctgctaccgaagaattcaagaagagccgtcactttgatccgccggcaaatatctcggatctcgcccgcatggcttcaccgatcgtatccatgggtaaccagaccggtgaaggatggtttctgaccggtgagatgatggaactgatccacggtggtacacagaatattgtgtgtacgcagccattcggatgcctgccgaaccacatcgttggtaagggtgttatcaaagcgatccgcagaagccatccggaggcaaatatcgtagctatcgactatgatccgggcgcttctgaagtaaaccagctgaaccgtatcaaactgatgctgtctacggctgtaaagaatatgaagtaa

SEQ ID NO: 1309 - DNA, 2286 bp, Blautia sp.
tacgaaaaaatgtatttccggaaatatttcgagatacatgtaagagatggagaggaaaatatgagtaaatatgatagtttgaatgcgatgcagcaggaagcggtattccataccgaaggtccggttttgattcttgccggtgccggatctggaaaaacccgtgtcctgacacaccgaatcgcatatttgatagaagaaaaagggattaatccgtggaatatcatggcaatcacttttactaataaggcagcacaggagatgcgggaaagagtggatcagattgtgggatttggttccgaaagtatctgggtcagtacctttcattccagctgtgtgcggatgcttcgcagatatatcgatcgactggggtacgataataattttacaatctacgatacagatgatcagaaaacagtaatcaaagagatctgcaagcggttaaacatcgataccaagcagtttaaagagcgaacattgatggcagcaatttcttccgccaaagacgaactggtatctccggcagaatataaactgcaggcttcgactgcttccggctatggtgcgcagacgattgcccgtgtgtatgaagcgtatcagaagcagcttcgtcagaacaacgcgctggactttgatgatctgattgtaaaaacagtggaactgtttcagtcatgcccggatgtgcttgactattatcaggaacggttccgttatatcatggtagacgagtatcaggacaccaatactgcccagttcaaatttgtaagtctgttggcagagaaatataaaaatctctgtgtagtcggtgacgatgatcagtccatttacaagtttcgtggtgccaatatcggaaacattctgggatacgaaaaagtatttccacaggcaaaagtcatcaaactggaacagaattaccgttctacccagaatattctgagtgcggcgaacgaagtgattaaaaataatgaggggagaaaagacaagaccttatggacggcaaatgaagaaggagctcccattcatttccgtcagtttcagaatgggtatgaagaagcagaatatattgcaggtgcgatcagccagaaagtccgggaaggaatctatgattacaaggactgtgcgattttgtatcgtaccaacgcccagtcccgtctgtttgaggaaaaattcctgattgcaaatattccgtataagatcgtaggcggtgtaaacttctatgcgagaaaagaaattaaggatctgctcgcttatatgaagaccattgataatgcgaaagacgatgtagcagtcaaaaggatcatcaatgtaccaaaacgtggtatcggtgcggcaactctcggaaaggtgcaggattatgcggatgcttatggtatcagtttttatcaggcacttcgacaggcggaagagatcccgacacttggtcgtggaagtgcaaaagtacgtccgttcgtggaattcattcagaaattccgtagccagatagagtatctgtcggtaaaagagttgctggaaaagctgattgaagagacaggttatgtgaaagaacttgaagcagaagatacggatgaagcaaaagcacgtatcgaaaatatcgatgagttgatatccaaagcagcgtcttacgaggatgaggcagaagatccaagtctgtccggatttctggaggaagtggcactgatagcagatatcgattcggtggaagagagtgataaccgtgtacttttgatgactctgcacagcgcgaaaggtcttgaatttccgaatgtctatctggcgggtatggaagatggtattttcccggggtatatgacaattgtgggagatgatccgcaggatatggaagaagaaagacgtctctgctacgtgggaattacaagagcaatgaaggaactgacgttgagtgcggcacagcaacgtatgatccgtggagaaacacagtataacaaggtatcccgttttatccgggagataccacgggaactggtagaacttggaagagagccgaaagcgcgaaggattacaaagatgccggaaccatccagcagttatgcaaagatgcgtcagacctaccagaagaccagcttttccccaaaacagtttgaagttaaaaaatcacagggacttgcttatggtgtgggagacacagtacgccatatcaaattcggaaccggaacggtgcaggcgattgttgatgggggcaaggactatgaggttacagtagattttgataaagccggaacaaagaaaatgtttgcgtcctttgcaaaattaaagaaaataacagaataa

SEQ ID NO: 1310 - DNA, 1914 bp, Blautia sp.
atgagtacagaatacggagcagatcaaatccagatattggaagggttggaagcggtcagaaaaagacccggtatgtacatcggaagtacatcgatccgcggacttcatcatctggtctatgagattgtagataatgcagttgatgaggcactggctggattttgtgatgtaatcgatgtcaaaattcaggaagataattccattaccgtcatagataacggaaggggtatccctgtgggaatcaatcacaaagcggggattccggccgtggaagttgtattcaccatccttcatgcaggaggaaaatttggcggtggaggatacaaggtatccggaggacttcatggggtaggtgcatctgtagtcaatgcactttccgagtggctggaagttacgatctaccatgagggcaaggtataccgtcagagatatgaacggggaaaaaccatatacaaattaaaagtcatcggagagtgtgagcaggaaaaaacaggaactatggtatcgtttctgccggataaagagatttttgaagaaacggtgtttgattttgataccttgaaacagagattccgtgagatggcatttttgaccaaaggattaaaaatccgtcttactgatgagcgtggagaaaaggaactggtcaaagagtttcattacgagggcggaatcaaagaattcgttacgtacttaaatcgtagtaaggaagcgttatatccggaaattatctactgtgagggaaccaaagacggcgtggcggtggaagtggcgatgcagcataacgattcctacaatgaaaccacctatggatttgttaataacatcaccacaccggaaggcggaacccatgtagttggatttcgtaatgcactgacaaagacttttaatgagtatgccaggaaaaacaaactgttaaaagaaaacgaaaaactggcaggggaagatatccgtgagggtctgaccgccatcatcagtgtaaaaattgaagaaccgcagtttgaaggacagacgaaacagaagctgggtaacagtgaggcgagaggtgcagtggatgctgtggtaagcagaacgctggagatttttctggagcagaatccgtctgtggcaaaaaccatcgtggacaaatctgtactggcacaacgtgccagagatgcggcgagaaaagcccgtgatctgaccagacgaaaatctgcactggaaggattgtctcttccgggaaaactggcagactgtacggataaagatcccaaaaactgtgagatctacatcgtagagggggattctgccggcggttctgccaagacagcgagaagccgtgcaacccaggcgatcctgccgcttcgtggaaagatcctgaatgtggagaaagcccgcctggatcgaatctacggcaatgcggagatcaaagccatgatcactgcatttggtaccggtatccatgaagattttgatatttccaaactgcggtatcacaagatcatcatcatgaccgatgccgatgtggacggtgcacatattgctaccctgatgttgacgttcctgtatcgttttatgccggaactgatcaaacagggatatgtgtatctggcacagccaccgctgtataaaattgagaaaaataagaaaatctggtatgcatacgacgataaggaactggataatatcctgactgagatcggaagagacggtaacaacaagatccagcgatacaaaggtctgggtgagatggatgcggatcagctgtgggagaccaccatggatccggagcgaagagtgcttcttcgtgtgaccatggacgatgagacttcatcggaacttgaccttacttttaccactctgatgggagataaagtagaaccgcgtcgtgagttcatagaggaaaatgcattaaaagttaaaaatcttgatatttaa

SEQ ID NO: 1311 - DNA, 2472 bp, Blautia sp.
atgaaaaaggggttattaaaagcgggagtactgttgctgctgtttgcggcagcgctgggaggaacagcagcactcatcaatcgggaaaagatcgtgggaacgagacagatggaggatgcaagtcttccgattctgtatatggaagttgcggatacaaaggtgaatccgatgtatggatatgccagtgaaatggaagaacagtatatgcgcgacagtctgacaccacttccgacggacagaagtctgacgatggcgatagatccgaagaatgcatcggtaaagacggtgagctaccgtgtatcgacggcagacggaacggaagttgtggagacaagcaagatcagcaagctgaagaagaaggacggggagatcagggcagaatttcagctggaaacaccgattctgatgaaccaggaatacacgcttcggtttgatgtgacactggataacggggaaacgtattattattacacccgtctgttgcagcgggcaggaaccaatatttcagaatatctggaatttgcagacagcttttatcagacatgtctggatcccgagaatgcatccacgctggcggcttatctggaaccggatgagacacagaccaacagcacctatgagaatctgaatatacattccagctttgaacggatcacctggggaaccctggatatgaagctggaaaaaaaggcagtgccggtgatcaaagatatgaatgagaccacctgcagtatctatctgacgtatgtgttgtcagatactcctgaggatgagacgacagattattataatgtgaccgatttttaccgaatgcgctatgcacagtcccgcgtgatgcttctggattttgaccggaatacacaggagttgtatgacggaaaacatacggaactgaccagcaaagggatcaatctgggagttgtggccaaagatgttcagtatcagtctaataaaagttcggatattgtggcatttgttcaggaaggagagctgtggagttataaccgcagtgccaataagacaacacagattttcagtttccgggatggtgatctggatgagcgggagaacctgcaggaacatggagttaaaatcgtccgggtggaagaatccggagatattgattttgttgtatacggctatatgaaccgggatgtacatgaaggagaagtggggatcgcggtttaccattacggggcagagctgaatcaggtggaagaagagctctttattccgatgaagagttcttatgaatatctgaaagaagacatggaacttctgtcttatgtgacccgggatgatatgctgtatgtcattctggaagatgatctgtaccagatcgatatcaagcagaagagttttcagattgtaaaagaaaaactgatcaaagaccgatatgtggtctcaaagtctcaggcgagccttgcctggatggatcaggaagaggaaaatgcatgcacacagatcacggtgatgagcctggagcagggagatacctatacgatccaggcacagtccggacagaagatcaaggcactgggatttatgaatgaggatctggtgtacggaattgccaatgacagtgatattgtgacagataatgcgggcaatacggtatttgccatgaacactgtccgaatcgaacagtttggcggcgaagtggtcaaggaacatcatgaggataatatctgggtcagcaatgtgaaactgcaggaaggtctgctggaactggaacgggtacagtgggagaacggtgcatatgtggcgatcagcagcgatcatatcatgaataatcttcagatcagggaagagcagataaccctgcgtctgatcactacagaacggaaagccacacagatcggtcttgatttcgaaaagagcgtgaccagtaagaatgtactgtatctggcatcgaatctggaagatcaggagacgtataatatactttctatggaactgacgagaacggattccaatatttactatgtatatgccaaaggtgtactggacagtacctggagcagagtctgtgatgccattaaccgggcagacggacagatgggtgtggtactgaaccggcagcagcagtatgtctgggagcgaggcaaccgccaggaaagttatcaggcaaatctggatgaagtgccggatgtggttctgagcggaactattgatgaaaataccctgcagcagtctctgggcgcggattatacggtgatgaaccttaccggatgttctctggacagcgtgctgtatcaggtcagcaaaggaaatccggtaattgcaaaggtatctgatacggtaaatgtggtaatcataggatataacagcaaaaatacgatcctgtactatccggcaacccaggaacagggttatttcggtatgcaggacagcaccagcctgtttgaaagcgccggtaacgtatttgtcggctatatggacaatcttggtgcggcgagcaaaagcgaataa

SEQ ID NO: 1312 - DNA, 2850 bp, Blautia sp.
ttgatagaaaaagcagaggtgagtacagtggataagacagaataccatttgaaattggaggaaatcaacagacttgtggatgcacaggattatgaaggggctcttacggtagcggattctatcgactggcgtagagtgaagagtgtgcggaccttgtgtatggtagcagatatctacgaagtgaatggtgaactggaaaagagtatgcagatgctgcagctggcgcataaacgttcatctatcggcaagatgattctgtaccgtcaggtggaactggctttgaagatggggttatatgatgatgctgtaaaatattataatgaatatctggagaccgcttccaacgatacttccaaatatattctgaaatataagatttacaaagcacagaaagcgcctctggaaaatcagattgcgattctggaggaatataaagagcgggaatacacagaacgctgggtatatgaactggcaaaactgtataaaaaagcaggacaggaaaagaaatgtgttgaaacctgtgatgatctggttctgtggtttggtgaaggcaaatatgtaaccaaagcgatggaacttaagatgacatacacgccactgtcaccgtctcagaaagaaaaatatgagaaagcgaaggcggcaggaaaggttgcaaaaccaacagcaggaccgaaactgacagaagaagtaaaaaatacaattctgccgggtgtgtcagcagctgcaatggcgggtcttcagaaagtggaagaagagaaagaacaggctcaggaagaagtggcagtaacagcagagattccgcaggaatctgcaggaacaactgtggaagaaactccggcgacggaggaagagccggtgaaaccggaaacagagattccgcatatcgataccgaaaaacttcaggaacgtctttccagaagttttcaggagattctttccggttttaaccgtaccaaggcagtagatgcttttgaggcactgggaagagcagcaggagcagaagttccgcaggaacctgaagcacaagaagaaaatatggaagactatcacgtacaggatctggagccggaagctgtaaatgaaggcatcatctctgcggacagcggagttgccggggtgagcagaaccgagatggatgaactggaaatgatggaaaaaccgaaggtggaaaaaccggaggataaagaaatcatcagtgttcaggaagtggatctggatgcattatttgcagagacttcgtcttccctggcgaaagaagcaggcgaggatgccgcagaaaaagctgaggaagaaccggctgtggaggaagtaacagcagaagaaatcatcggtgaaccggaagaagtagttgcagaagaaacagtagatacagccggtgatgtactggaagaaagggttgagggagcggttgagacagtaacggaagaaaaagagccggcagaaactctgacggatgcggcggatgaagcgatggcagcttttgaagcaagtctttccggactttctctggattttgcagaagaaacatcgtctgatgcaccggaagccgtggaaccggaaactgaaacttcggcggaattgacagaagagcaggaaacagaagaagatattaccggatcagaagcagcaccggtgattgagatggaatatccggaagaaacggaggaaacagaaccggaaatcgaagatctggacgcgacaagagcgattccggatgtgacaaagcaggatgcatggcatgcgacaccgggagatacacaggaatttaatttggaagaagaactcaaagctgctctgagcggtatggatgagctcagggaacaggaagaagcagaacggtctgcgagcctggatccggagacagcatctgaggaagaaattgcttttgaagaaaagacagagccgattacagaagagaatactacagaggaatctgttgtggaagaaggttctgaaacggaggcagaggaaccggaaggtgaccatatcgataagatgctggaagaagcagagatacagccggatatcagcgagatgactttggaacgggagacacccgaagaaaaacgccagaggatcctgaacaataccagaccggaacgtctgacggcagaacagaaacagctgttttcgtactttgctaaagtgccgggcatggatgatcagattctggatgcgattcacggggcatatgaatatgccagtgagaaaacatctcatcgtggaaatatcgcaatcatgggaagtcacggaacaggaaaaaccagactgagtgaagggcttgtaaaagcaatctgcaaagaactgggactgaaagctgtcaagtatgcaaatctggatgcatcggatattaacagaaaagatccggcaacaattatcagcaagatggcaggaggcttccttctgatcgagagagcaagttttatgacgccggagacgatcgaaaaacttgctcaggcgatggatttccgtacagacagtatgattcttctgattgaagatgataaagcaaatatgcgtaagatgctggcggattatccggaatttgcagaaaaattcgaaaccgttatttcgattccggtctttaccaatgacgagctggtaacatttgcaagaacgtatgcgagagaaaatggtttccgcatggatgagatgggtgtgcttgctctgtataccatgatcggagataaccagaaagaggatgaaccgattactatcggaaaagtaaaagagatggtagacggtgcgatccgtaaggcaagtggcgtaaagctgggaagaaaactttccaaacgtcatacagatgcagacggtcgaattcttctttatgaaaaggattttgatttataa

SEQ ID NO: 1313 - DNA, 2910 bp, Blautia sp.
atgagacgaccaaaaaaaagacataaaaaatttattattccacggactacagtgctgatttttattttcgcagctctgagtatggtattgattcaccgcctgttttctctgcagatcatccatggacaggaatatgcggacaatttcagtattatgacgacaaaaacgagaacactgaaaagcacccgaggaaatatctacgatcgaaacggtcaggttcttgcttccaatgaactgtcttattcgatcacactggaagacagtggtgactatgcaaataatacagaaagaaaccgtagcctgaatggagaaatctacaagattatccagattatcgaaagcaacggagatgctgtcagcagtgatttccgtattagtgtcgacagttccggaaactacagttatgatgtggagggtacaacactgtcacgttttaaagcggacgtgtatggacacagttatattgacgatctgacaacagaggaggcaaatgcttccgctcagcagatggtagaagatatgctgaaacgatatgaaattccatatgatcacagtgactataaggcttcggaactgaaaaaagcgcaggaagccggtcttccggagcagctgacaaaagaagagacattgaagattatatcggtaagatatgcactttccacaaccagtttccgaaaatatattccggtaacgatcgcaaccgatgcttctgaaaatacggtagctgcgatccaggaaaacaagagtctgctggaaggtgtggatgtgcaggaagattccgtgcgtgtctataccgacagtatttattttgcaccgcttcttggatataccggaaagatttcttcggacgaacttgcagatctgcggacagagaatccggatgcaggttacagcactacttctattgtaggaaaatccggtctggagaaggttatggagtcgacgcttcagggaaaagacggatcggaaaaagtatatgtagattattacggaaaagtgttacagatcggtgaagattccaaagaagatccggtacagggcaataatgtatatcttactatcgataaagatctgcagattgcctgctacaaggtgcttgaacagaagattgccggtgtgctggtagccaatatccagaacatcaagactttcaaagcagatgaaaataccgatgcatccacgatcccgatcccaatctatgatgtgtattatgcgctgttaaataattccgtaatcgatatcgatcattttacggcagcagatgcctctgagactgagcagaagattgcggcagcattggaacggaagcaggaagaaatcttccggaaagtggacgaacagctgaccggaagtgatacaaaaccatataaagacctcagcgaggagatgaagggatatgtcagctatattgtcaatgatttgctgatggacaaaacaggtattctttctgagacatccatcgataagaatgatgagatgtacaaggcatggacgaaagatgagacaatttctcttcaggaatatcttacctatgcggcaagccagaactggatcgatatttccaagttttcagataaaaacacatatctggattccacagaagtataccaggaactatctgcatatatttcagattatctgtctacggatcaggacttcagtaagatgttatacaaatatctgcttctggacgatgagattacaggaaagcagctgtgtacagtactgtatgaacagggagtcctttccaccgatgatgaggactatcagaacttcaaagccggaaatctttctgcgatggatctgatgcttcataagatcagttctctggaaatcacaccggcgcagctggcgctggatccttgttccggttctgttgttatcacagatccgtccaccggagagacactggcatgtgtatcttatccgggatatgataataatcgtcttgctaacaatatggatacagattattacagaaaactgaataaagatttgtctacaccattttataataaggcgacacaggaacgtacggcaccaggttctacatttaaaccggtaacagcgattgccggtctgtcagaaggagttattacagataatgactacatttactgtggcggccgatttgataaactgcagggagcaccactgaactgctggttgctgagcggacatggtgcactttctatcagggatggtattgccaattcctgtaacgtatttttcagtgaaaccgcttatcgtcttggacagaatgcagaaggaacatttaatgataatacagcgatgcagcagctgattaagtatgcgaatctgcttgggctggataaaaagtccgggctggagatttctgaagcatcgccacaggtttccaacgaactgccaatcccgtccgctatcggacagggtactcacagttataccacatctcagcttgccaggtatgcaacggttctggcgagcagtggtaatgtatataatctttcactgttagataaatcaacagattccgatggaaatctgattgaagattatactccggaaatgattgatcatgtggaactgagtcaggggatctgggatgatgtccatgtcggtatggaaggcgttatcaccaaatccaactggggtattttccaggatctgaacgttacacttgcaggtaaaaccggtacagcacagcagagtaaaaaccgtgcaaaccacagtttatttatcggttatgcaccggcagataaaccacagattgcgtgggcaatccgtattgcaaacggttatgcgtcaacaaactccgaactggtggcaaaggatattctgaactattacttcggactgaaagatgaaacagagattcttaccggacaggcaagtacagccagcaattccaacgcaggtacagactga

SEQ ID NO: 1314 - DNA, 3558 bp, Blautia sp.
atgtatttaaagagtatcgaagtacagggattcaaatcctttgccaataagatcgtatttgaattccataacggtatcaccggcattgtaggccctaacggcagtggaaagagcaacgttggtgatgctgtccgctgggtactgggtgaacagagtgcaaaacagctgcgtggcggaaatatgcaggatgtcattttttccggtacagagaccagaaaaccgctgggatttgcatcggtagccattactctggataattccgatcacaaactggacatcgagtatgaagaggtgactgtcaccagacgactgtatcgttccggagaaagcgagtacctgttaaatggaaccggctgccgactgaaagatatcaacgaactgttttacgataccggtatcggtaaagaaggatattccattatcggtcagggacagatcgataagatcctgagcggaaaaccggaagaacgaagagaacttttcgacgaggcagcaggtattgtaaagttcaaacggagaaaagcaactgcattaaagaaactggatgaggaacagcagaacctggttcgtgtgacagacattctgtcggaacttaccaggcagctgggtcctctggaacgacagtcagaaacggccagagtctatctgaagaagaaagaagaactgaagatcctggatgtgaacatgtatctggcggagagtgctcatatcaaagaacagttaaaagaaacagaagaaaaatatcagatttctcagaatgagctgcaacagacgcagacacagtttgatcagacaaaagcagagtatgaacgtctggaaaaggaactggaagaactggatacgaagattcaggaagcgagaactcaggcgagcgagaatgccctgaaaaagcagcaactggaaaacagtgtggaactgttaaaagaacagatccgcgcagcccagcagaatcatcagcactacgaagaacgtatccagacgatccgtcaggaacttgaccgccgacagcaggaagcagccggacatgaacaggaacaggaagccctgaaagaaagcctgggcgaagcagctgtcagaaagaaaaaagcagaagaaaaactggcgattctgcatcagaatatagaagaaacaaatcagagcatagaggatggtaagagtgaaatcatcgagatcctgaatcagcgggcatccaccaaaggtaagatgcagcgttatgatgcgatgcttgaacagatcggtatacggaaagcggctctcagccagcgtgtcctgaaactgaaaagcgatgagtcacagcagcaggagatcattcagggacatcaggaaaaatgcaaagagatcggcgctcagatggatggtatacagatggaataccggaaagtggagcgggaagtcggctctctgcgaagccagatggaggaacagaataagaaactggaacagggacagacagcctatcacagggaggcatcccgtctggagtccctgcgaaatattgcagaacgttatgaaggatatggcaacagtatccggcgtgttatggaacagaaggatcgccagccggggatccacggtgttgttgcagacctgatcaaggtagagaaagcatatgaaacagcggtggaaacagctctgggcggaagtatccagaatatcgttacggataacgaacagaccgcgaaggtcatgatcgaatatctgaagaaaaaccggtatggccgggcaacgtttctgccactgaccaatatgcgaagcagcagtttccagaattccgcagcactgaaagaagaaggtgtgatcgggatcgccgatacgctggtaactgccgaaagtacgtatcgaactctgctgtcacagcttcttggaaggacactggtggtggataccattgatcacgccatcgtcattgcaagaaaataccgccataccttgcggattgttacgttagagggagaatccttaagtcccggcggttccatgaccggtggagcgttccgaaacagcagcaatcttctgggacgtcgtcgggaaatagaggaactggaaggaaaagtggcagcactgaaagaagagctgcaaaagatacagaaaatcatcctggataaacgggagcgtagaaatacactgcgggatgacctggcagagatgaccaggcagttacagcagctgcagatcagtcagaatacagaaaaggtgggaatcacccaggcagaggcacgcatccgtgaagtgcggatcggctatggacagttaaaagcagagggacgcgagattgaaggacagattgcagagatcaaggaaagcagttcatccatccgggaagaaatgaaacattccacagccagagagcaggaacaggaagcactggtgaacagtcagcaggaaattctggaaaaattgcaggaacaggaagcttcttacagtcaggaactgaaccagatccaggtggcttatgcttcgctggaacagaaagtgagctttacaggagaaaatctcagccgtatccatcaggaagaagcggcaatgagagatgaactgcaacagatgcaagaatctctggaagagggtggcaaggaaaaagaagaaaaagaacacaatattctgtctattcagaaaacaattcaggaagccagccgaatccgtgaggaagacgaggcgcagatgcagcagtatctggaaaagaaagaagaactgaacagtcagcataagacattcttcagccgccgggatgaactgtctgcacatatcagccggatggacaaggaatgtttccgactgaacagccagaaagaaaaactggaagaacggcaggataaccagattaattatctctgggaagagtatgaggtcacaccgggacaggcgaatacctatcggatggaagacatgccggagcgcagtgtgatccggcagcagatcgcagaattaaaagatgcgatccgaaaactgggtaatgtcaatgtcaatgcgattgaggaatataaagagattctggaacgtcacacgttcttaagcgcacagcataccgatctggtggaggcagcagagacactgaaaggaatcattgcagaactggatgagggaatgcgtaaacagtttacagaaaagttccaggagatccgcgtggaattcgataaagtattcaaacagcttttcgggggcggaaagggtactctggagctgatggaagatgaggatgtactggaagccggtatcaggatcatctctcagccaccgggaaagaagttgcagaatatgatgcagttatccggtggggaaaaggcactgacagccattgcactgctttttgccatacagaacctgaaaccgtcacccttctgtctgctggatgagatcgaggcggcactggatgattccaacgttacccgttttgcacagtatctgcacaaacttacaaaaaacacacagtttattgtgatcacccatcgacggggtacaatgaacgcggcagaccgcctctacggtatcaccatgcaggaaaaaggtgtttccacgctggtatcggtcaacctgattgagaatcagctggacgagtag

SEQ ID NO: 1315 - DNA, 3126 bp, Blautia sp.
atgaagttaatgcattcagaatggcaggacagagtaaagcactgggttcgtacattgagagatgatttttatgaaccgttgggggaaattcgatgggaagcttttcgaaccatggatcatctatctccggaagaagcattacaggggcactttatgtcgacagaaccaggctttatatgggggaaaacctgggaatactgttggtttaaaggcactgtgatccttcctaaagcagcagaaggaaagagaatcgtgatgaacctggatgccggaggagaatccaccgtatttgtcaatggaaaggcattcggaaattaccgtgcggcatgggtggatgaaccacatcagtttattgaagataactgtctggcagtcagcggaaaagaaggcgacacctatgagatcctgatggaaacatatgcaggtcatttttatccggaggcaccaacggggggctgcgcgacgggaccggtgttgccgggggcatatacagatccgaaaaaagaaggggcaagatgtgttctgggtacttccacttttggagtgtggaacgaagatgcatatcagctgtttatggatgtggatacactgggacgtcttctggaaacgatggattccacaacactgcgtgctgcgaaaattgcaaaagcattagagaaatttacactgatcgtggattttgaacagccgcgggaagcacggatcgcatcttataaagaagcgagagaagcattaagaccgctgatggaagcaaagaacggttctacgatgccggtattctatgcgattggtaatgcgcatctggacctggcatggttatggccgatggaagagacacatcggaaaacagagcgtacctttgcggcacagctgcgtctgatcgagcagtatccggaatataaatatgtgcagagtcagcctgcagcatatgagatgtgccggaagtattatccggagttgtttgaacggatcaaagaagcgatcaaaggtggccagtggatcgctgatggagctatgtgggtagagccggataccaatatggccagcggtgaggcactgatccgtcagttggttcacggaaaacgctactataaagaagagctgggagtggacagtgaagtattatggcttccggatacatttggctatacggcagcactgccacagattctgaaaggctgtggcgtgaattatctggtaacacagaaaattttctggtcttataacgaaggagaacagttcccgtatcattacttcacctggcagggtatggacggcagtgagattgattctttcttaccgaccagttatacctatcggacacatccgagtgaagtaaataaaatctggaagaatcgtgtgcaggtgcaggatctggatgctttcctgcttccgttcggatatggagatggtggcggcggcccggcaagagattttatcgaatctgcaaaacgtcaggaagatctggaaggcggcgtaaaagtaaaaatggcaggtccgctggaattcttccacgatatggaagcgcagggcggcccggcaaatacttatgttggagaattgtatttcagcgcccacagaggaacgtatacttctcaggcgatggtaaaacagaacaacagaagatgcgaactggcactgcgtgagatggagatgtggagtactctggcaatgaataaaggcatggcctatgatttttccaaagcagatgctttatggaaaaaacttctgttacatcagttccatgatattcttccgggttccagtattgcaaaagtttatgtggatgcagaaaaagcgtttcatgagattctggatggtgtggaagaattgcaggcagatgcactgagtgagctgaccgatcagaaagaatctcaggcagtgaccgtatttaactctttaagttttccgagaaagatgctggtagagcttccggctgcatttgcaaacggagcgaaaacagtggatggaaccgctgtacaggtacagaagatcggtgatactgtgaaagcttccgtagaagtaccgtcctgtggagcagtttctctgattccggcagaaggtcagggggaagaaaaggcagttgcagtagaaacatgtgatggtggatttaccatggaaaacagccaggtaaaagcagtcataaacgaaaaaggcgaggtgatttctttcgtactgaaagagtccggaagagagttcgcagcagatgccatgaaccgcttccatctgtacaaagatgtaccacgtatgtttgatgcatgggatattgattccaattatatcgatcaggaaattgaggcggcaaaaaatgttgcggtttccatggaagcagatggtctggaaggcgtgctgaaagtaaccggagagatcagcaattccacctttacacagtatatccgtctggcggcagacagccgaagaatcgagtttgagacagaggttgactggaaagaaatgcatcgtctgttaaaggcaggattcccggtaaatgtttatgcggaaaatggtatcaatgagatgcagttcggattcgtggaacatccgacacatcgttccagagcttatgacaaagatcggtttgaagtatgcaatcaccgttacagtgcacttgctgacggcgcacatggtgcagcggtgttgaatgactgtaaatacggaatcagtatgaatggaaatgctctggagctgacactgcttcgtgcaggtacctgcccggaaatgtgtgcagataacagagttcatcacttcacctatgcatttaccgcatgggagggaagttttgcagagagtgatgtggcaagacaggggtacgaactgaatgtaaaaccggtagttgccggcggtgcagtaccgacgttcagtgcactcaccattgataaagagaatgttattctggataccatgaaaccggcagaagacggaagtggagatattattcttcgtctgtatgaatccaagaaggctgcggttttggcaacagttactttatcggatctgttacagggagagaaggtttatctttgcgatatgctggagaactgtaaggaagagattttggtggaaaacggagagatttcgttgaacttccgggcgtttgaggttaagacggttcggattaagaagtaa

SEQ ID NO: 1316 - DNA, 2730 bp, Blautia sp.
ttgaactcaaaaatatcaacaaatgtatttgaagaggctggaataacaccggaaacccttataaaactgggacttccgcaagacagcaggtcattatcgccgatgatggtccattactgtcagacaaaatgtgcgtataaagattcgattcttttttatcgtcttggggacttttatgaaatgttttttgaggatgcgaaaactgtctcccgtgaactggaacttacacttaccggcaaagactgtggtctttctgaacgggctccgatgtgcgggattccgtatcacgcagcagaaacatatatcaatcgtctgatcgataaagggtataaagtagccatctgcgaacaggtagaggatccgaaaacggcaaagggaatcgtaaaaagagaagtgacccgtgttgtgacaccgggaacgaatcttaatatgcaggaactggatgaaggaaagaataattatctgatggccatcgtatgtgtgggagatcattttggggtatccactgcagatatcacaaccggtgattgctatgtgacagagattgatgaggagcggaaactctgggatgagatcaataagttccttccggcagaaatcatctgtaatgatgcttttctggtctccggtgtggatgtggacgacctgaggaaccgtctgcatatctctgtgtttgcactggaatcctggtattttggagatgatctgtgtaagcagacattactggagcattttaagatttcctctcttgaggggctgggactggctgattatgacagcggtgtgatcgcagccggttccctgttccggtatcttctggatacccagaaaaataccatggagcatatgaataaaattatcccgtatactacagaccgctatatggttatcgacagttcttcgagaagaaatctggaactggtggagaccctgcgggaaaaacagaaacgcggctctcttttgtgggtgttggataagacgaaaactgccatgggagcccgtatgctgcgaagctttgtggaacagccattgatcgatgcagatgcgatcaacgaacgactggatgcggtaacggaactgaacatgcaggcgatgcttcgcgaggagatccgggaatacctgaatccggtatatgacctggaacgtctggtcagtcggatcagttatcgttctgcgaacccgagagatctgctggcatttaaaatgtctctggaaatgattcctcatattaagaatctgctggcgaactttaccagtccgctgctggtacgcattaacgaacagatggatggcctggaagatctgtatagactgttagaagcctccattacggaagatccaccactggcagtcaaagaaggcgggatcatccgggaaggctataatgaacaggtagatacctatcggaattccaaaactcagggaaaatcctggctggcacagctggaagcagaagagaaagaaaaaaccggtatccggaatctgaagatcaaatataataaagtatttggctattatcttgaagtgacgaacagttttaaaaatctggtgccggaatactatacaagaaaacagacgttgaccaatgccgagcgctatatcacaccgaagctaaaagaactggaagatatgatcctcggcgcggaagataaattatttgccctggaatacgatctgttctgtcaggtgagagaagaactggctgcacagattccgcgaatccaggagacagcgaaagccatcgcgcagctggatgtctatgcatcgttatccgtggtcgcccagcgcaataactatgtacgcccaacggtcaataccaaaggtgtgatcgacatcaaaaatggccgccacccggttgttgaaaagatgatcaacaacgatatgtttattgcaaatgatacctatctggacaacggcagtaagcgtgtctccgtgatcaccggaccgaacatggcaggaaaatccacctatatgcggcagactgccctgatcgttttgatggcgcagattggttcttttgttccggcagaaaaagcaaagattggtgtggtagaccggattttcacccgtgtcggagcttcggacgacctggccagcggacagagtacgttcatggtggagatgacagaggtggccaatattcttcgcaatgcgactgcgaaaagtctgttgatcctggatgagattggccgtggaaccagtacctttgacggactgtccattgcctgggcagttatcgaacacatcagtaatacaaaacttctgggggcaaagactctgtttgctacccactatcacgaactgacagagctggaaggaaagattccgggcgttaataattattgtatcgcggtgaaagaacggggcgatgatatcgtatttttacgaaaaatcgtaaaaggtggtgccgataaaagttatggtatccaggtggcaaagcttgcaggtgttccggacagtgttctggatcgtgcaaaagaactggtggatgaactggtacatacggatattaccagtacatttaaagatctggcagagaattccagaaagacaaaaccgaaagccgtacattatgatgaagtggatctggaacagatttccctgtttgatacggtacaggatcaggatatcatagaggaactgaaaaatctggatattacgatgctgacaccgatggatgcgatgaataccttatatcggttacagaataaattaaaaaatcgctggtaa

SEQ ID NO: 1317 - DNA, 2283 bp, Blautia sp.
atgatgattcaattactggaaggcggtacctacctggtcaatgggaccgaactggtagaaccggcaaaagcagcagcacagggacttcctgcgccggaagaagcagcaaaacagaccatggcctacaacatattaagagaccataatacgtctggaaacatggaaaaacttcagatcaaatttgacaagctgacatcccatgatatcactttcgtaggaattattcagacagcaagagcctcaggactggaaaagttcccggtaccgtatgtactgaccaactgccacaactctctgtgtgctgttggaggaaccatcaatgaagatgaccatatgtttggccttacctgtgcgaaaaaatatggtggtgtctatgttccgcctcatcaggcagttattcatcagtttgcaagagagatgcttgccggcggtggcaagatgatcctgggatctgacagccataccagatatggtgcactgggtaccatggctatgggcgaaggaggaccggaactggtaaaacagctgctgtccaaaacgtatgatatcaatatgcctggtgttgttggcgtatatatgaccggagcaccgattcccggtgtgggtcctcaggatgtggcgctggcaatcatcggagctgtatttaaaaatggttttgtaaagaataaagtcatggaattcgtaggaccgggtgtgtcaaacttaagtgcagattttagaatcggtgtggatgttatgactacagagactacctgtctgtcctctatctggagaaccgatgataagatcgaagagttctatgcgatccacggcagaagcgaagattataaagaactgaatccgggaccggttgcatattatgatggtatgctggtggtagaactggacaagatccgtccgatgatcgccatgccattccatccgagcaatacttacaccattgatgagttaaatgccaacttgatggatattctggatgacgtggagaaaaaagcacagatcagcctggatggaaagattgatttcacactgaaagataaggtacacgatggaaaactgtatgtggaacagggaattatcgcaggatgtgccggtggtggatttgagaacatctgtgcagccgcagatattctgaaaggtgcaagcatcggagcagacgcattcacactgagtgtttatccggcaagtacaccgatttatatggaacttgcaaagaacggaacactggcaactctcattgagacaggtgccattgtaaaaacagcattctgcggtccgtgctttggcgctggtgatacaccggcaaataatgctttcagtatccgccattctacaagaaacttcccgaaccgtgaaggttccaagatccagaatggacagatctcttccgtagctctgatggatgcacgttctatcgcggcgaccgcagcaaacaagggacgcctcactccggctactgaatatgcgggaacatacagcaatccgaaatattactttgacggaaccatctataaaaacagagtattcgacagtaagggtgttgcggatccgtctgtggagattcagttcggaccgaacatcaaagactggccacagatgcctgcactggctgagaacctgatcctgaaagtcgtatctgagattcacgatccggttactacaacggatgaactgattccgtccggcgagacttcttctttccgttccaacccactgggactggcagaatttaccctgtccagaaaagacccggcttatgtgggacgtgccaaagaagtccaggtggcagaaaaagccatccagaacggtgaatgtccggcagaagcacttcctgaactgaaaccggtattcgaagctgttcatacaaagtacccacaggtggataagaccaatgttggtgtcggttctaccatctttgccgtaaaaccgggtgacggttccgcgcgggaacaggctgcatcctgccagaaagttcttggcggatgggcaaacattgccaatgaatatgcaacaaaacgttatcgttccaacctgatcaactggggtatgctgccattcctgattccggaaggagatctgccgtttgccaatggcgattatctctttatcccggatgtacggaaagcagtggaagaaaaatgggacagcatcaccgcttataaagtgggagaagaactgacaccgtttaccctgacgctgggcgaactgaccgacgatgaacgtgagatcatcctgaaaggttgtctgatcaactactatagaaatgaaggaaacattcagtag

SEQ ID NO: 1318 - DNA, 2322 bp, Blautia sp.
aaaacaggcggtgaatctatggaagatggaaaaataaaaacggaagaggaacggatgcaggagatcgaggcggtagaggccaatgtaaaatgtatgaaagattttacgagtccggaacagctgtatgaagaattaatccgcagtattcgcaaatatcatccgtccaccgatatttctatgattaaaaaggcctatcagactgcttctaaagcacatgaaggtcagaaaagaaagtctggggaaccttatattattcatccgctgtgcgtggcgatcattctggcagatctggagttggataaagaaacaattgttgccggacttttacatgatgtagtggaagatacggtgatgacgacagaagacctcactcgtgaatttggcagtgaggtagcacttctggtagatggcgttactaaactgggtcagctgaattattctgcggacaaggtggaggtgcaggcggaaaacttaagaaaaatgtttctcgccatggcaaaggatatccgtgtgattctggtaaaactggcagacagactgcataatatgcgtaccgcacagtactggtcggcaccaaagcagaaagaaaaagccagagaaaccatggatatttatgcgccgatagcacagcgtcttggtatttccaagatcaagattgaactggatgacctttctttaaaatatctgaaaccggaagtgtattatgatcttgtggaaaagatcaatctccgaaaaggagaacgggaggcctttgtgcagtctattgtggatgaggtcaaaacccgcatggaagaggcagatatcgaagcagaagtcaatggacgtgtaaagcatttcttcagtatttataaaaagatggtcaatcaggacaagacactggatcagatttatgatctgtttgcggtacgtatcattgtagatacggtaaaagactgttatgctgccctcggtgtgatccacgaaatgtatacaccgattccgggaagattcaaagattacatcgccatgccgaaaccaaatatgtatcagtcgcttcatacgactctgatcggaccgaaaggacgtccttttgagatccagattcgaacatttgagatgcatcgtactgcggaatatggtattgcagctcactggaagtataaagaggcttcggatggcaagaaaccggtagaacagcaggaagaagaaaagttaagctggcttcgtcagatccttgaatggcagcgggatatgtcggataataaagagttcctgagcctgttaaaaagcgatctggatctgtttaacgaaaatgtctattgtttcagtccggcgggagatgtgaaaacccttccacgtggttccagcaccgtagattttgcatacagtgtgcacagtgctgtgggaaataaaatggttggagccagagtcaacggaaaactggttccgatcgaatatgaaatcaaaaatggtgaccgtgtggaaattatcacatcacagaattccaaaggaccaagccgtgactggttaaaaattgtaaagagtacacaggcaaaaaataagatcaatcagtggttcaagcaggagcggaaagaggataatatcctcaagggaaaagagatgcttgcaaattatgccaaattaaaaggcagaacactgggagaactgaccaagccgaaatatctggaagctgtgatgcgaaaatacggattccgtgactgggaaagtgtacttgccgcgctgggccatggaggcttaaaagagggacagattctcaataagctgattgaagcatatgagaaagaacataaaaaagagattaccgatgagaaagttctggaggcagctgcggaagcaaaagaaaaactgccgatcgtaaaaaaagaaaaaggtggcatcgtcgtaaaaggtatcgacgatgtagcggtacgatttgcaaaatgctgcagtcccattccaggggatgagattgtcggttttgtaacgagaggccgtggagttacgattcacagaacagactgtgtaaacgtcatgaatctttctgaatcagaacgtgtgcgtttgatcgatgcggagtggcagggcagtaatctgaccagtggactttatacggcagaaatcaatgtgtatgccaataacagaacaggtctgctggtggatatctcgaagatctttacagagcgcaagattgatctgacaacgatcaacagccggaccagcaaacaggggcgtgcgacgatatccatgacttttgatgtacacagtacggaagaactgaacagtattgtagaaaagatccgtcaggtagagagcgtaattgatattgaacgtactaccggctga

SEQ ID NO: 1319 - DNA, 2532 bp, Blautia sp.
atggagggttttacaacgaaaaaacagcagtttgcaacggtatggaagatgcatactgcaggcgatgcacagtggtatccggcgcaggttccgggaactgtgtatacagatctgttaagaaacggacagatggaagatccgttctggaaggacaatgaatacagagcactggatctgatggaaaaagattatgagtatgagaccgcgtttgagggaaccgaagcacaggaaggcgagagacagtggcttcgctttgaaggtttggatacgatctgtgatatctatctgaatgaagaaaaaatcggcaatacatataacatgcacagaacctgggagcttgatgtaacaggaaaggtgaaagcaggagagaatatcctgcgtgtgtatttccattctccgctggagtatattaaagaagcttacgaaaaacagccgacacacggaagtgaagatgcgatggatggctttgtgcatatccgcaaagcacactgcatgttcggatgggactggggtgctcatctgccggatgcgggaatctttcgtccagtatatctgctgacgatgaccgaaggcagaatagacagcgtgtatatccgtcaggaacacgaagagggaaaagtaaccctgcattttgatgtgagcagaaacccgaaagaggatctcagaaaagagatcccggtgggaaaagaggcagatggctatacctatgaagtaactgtgacagcaccggatggtacaaagatcattgcaaaagataccccggaggatctggtgatcgaacagccgaagctctggtggccaaacggtgtgggcgaacagccattatatgaagtgaacgtaacgctggcaaaagacggacagccggtggacagatggacaagaaagattggtcttcgcacgatgacgatggatattcatccggatgagtggggcgagagttttgctcatcaggtgaacggaaaggatatctttgccatgggtgcagactatatcccggaagatcatctcctgggtcgtgtgacaccggaaactacaagaaaactgttggaacagtgtaaggcagccaactttaacgcagtccgcgtatggggcggcggttactatccggaagactggttctatgatctgtgtgatgaactgggactgatggtatggcaggactttatgtttgcatgtgcagtctatgatttgacaccggactttgaggcgaatatccgggaagaatttattgataatgtaaaaagattacgtcatcacgcatccctgggactgtggtgtggtaacaatgagatggaaatgtttgtaaaacagggcgagtgggtaaccaaaccgagcgaggtgcgcgattatctcttcatgtacgagcgcgtgattccggagattctgaagaaatacgatccggaaaccttctactggcctgcaagtccgtcttccggcggatgcttcgatgatccgtcagatccgaaccgtggagatgtgcattactgggatgtatggcatggaaacaagccgttctcggattaccggaattactatttccgctatgcaagtgaatttggattccagtccttcccgtcttttgagacaatcaaaacctttaccgatgatccggcagactggaacattttctcttatgttatggaaaaacatcagagaaatgcaggcgcaaacggaaagatcctgaattatctgcagcagacattccgctatccaaccgaatttcccacgttattatatgcttcccagatgttgcaggcagaagctatcaagtacggggtggaacatttccgaagaaacaggggcagatgtatgggtgcgatctactggcagttaaatgactgctggccggtagcctcctgggcatcggtagattatgagggaagatggaaagccctgcattattatgcaaaacggttctttgcaccggtgatggtatcctgtgaagaacagaactggatgactgcggaagcgaatatgaaccgtgaacattttgtatatgaaaaatctatccgcctgaatgtgaccaacgagacactggaagataagaaagttctggtaaaatgggcacttcgaaacgccgatgcatctgttgtgaaagcagaggagcgagaagtaacggtgccggcactttccagtgtatggctggataaagaagaatacccggatgtggatgtattcggccagtatgtaagctatgaggcatgggagggtgatacctgcatctctgagggcagcgtgatcttctcttatccgaagtacttccattatctggatccgcagctgtcatatcggatcgagggagacgagatcgtagtcagcgcgaaagcctacgcgaaaggcgtggagatcctgaatgcgtccgaagatctgatcctgtcggacaactattttgatatgagtgcgggagaaaagagagtaaagattcttggcaaagcatcaagaaaagtggaagatcctgcagactgggagaaccagataaaagagcagcttgcggacggtctgaaactgcgaagcgtttacgatattcggtaa

SEQ ID NO: 1320 - DNA, 2673 bp, Blautia sp.
ttgaattttgaaatttgctataataagcaggataaaggaggtacacaaatgaattttggaaaaaattccacccagaaaaagcgaaaacaactgtcttccgcctcctcgaaaagaggaaaacgggcgggtgtcacttttctgcgcattctgtttctgagttttgctgcagtatgtgtgatcttctgttgcatggggattggcgccttccgtgctattctcgatactgctccggatatctctgatgtaaacatcatgcccagtggaaatgccaccttcgtgtatgatgcagatggtaatcagcttcagaaactgtccgctcccaatgccaaccgtatgtcggtatcgatcagcaagattccgctgaatatgcagcatgcaatcgttgccatcgaggatgaacgtttttacgaacataatggaattgatattcagggaattttacgtgcttttgtaaacggtgtctcccatggatttcattttaatgagggcgccagtactctgacacagcagcttctgaaaaataatgtatttaccaactggaccaacgaaggtaagatcgaacgtttcaagcgtaagatccaggaacagtatctggcacttcagctggaagcttccctgactgccgaaggaatggacaccaaaagtgtaattctggaaaattatctgaataccatcaatctgtctgcgggaacttatggtgttcaggccgcggctcagcgctattttggaaaaaacagtgaagatctgacactttccgaatgtgccgtacttgctgcaatcccccagaatccttatgcatataatccgattcgttttccggaagaaaatgcaaaacgtcgcaaaaaggtactgaccaatatgcggaatcagggatatatttccgaagcagaatatcaggaagcgcttgctgacaacgtctatgaacggatccaggaaacagattcttcccaggaaaccgctaccccgtactcttatttcattgatgaactgacctcacagatcattaccgatctgcaggaacagaaaggctatacaaaagtacaggcacaaaatgcactttacagtggtggtcttcggatctataccacacaggatcctgcaattcagtctattctagatgaagaatatcaaaatgaagaaaacttcccggctcatatacagctcggtatcgactgggccctgacagtgcagaaagcagacggaaccatccagaactatagtaaagaaatgatgaaactatatttcaaagatcatggagaagataattttgatcttttatttgactccgaagaagaagcacaacactatgtggatgaatataaagcagccgtcgttggtgaaggtgaaactattcttgccgaacgaatcagctttgctcctcagccacaatcttctatggttatcattgaccagcacaccggatatgtcaaagctctggtcggaggacgtggtgaaaagactgccagtcttactctgaaccgggcaaccgatacctaccgccagcctggttctactttcaaaccgctggctgtttacggacctgctatcaatgatctgggacttactctggcagacacttatgtggatcaggccatcacttatgagaatacaaaccgcccggttaaaaatgcctacagcggttatcgcggtaccatgacgatccgtgatgctctcaagtattcctgtaataccattgccgtacagtgcttccgtgatgtgaccccacgacttggatatacgtatctgaaagatctggggttcgaaaaagttaccgatcacgaaataatcaacggtcaggttttcgatgacgccagagaacctactgccctgggcggtatcaccaacggtgtttccacattggaactgactgctgcctacgctgcaatcgctaacggtggtacttacaccaaaccggtattttataccaagattctggatcagaacggggatgtggtactggaaaacaaaccaaaaacaaccgaagtcttccgtgaaagcaccgcctatctgctcacaagtgctctcgaaagtgttgtcaacgatgagggtggtaccggtaacggtctgaaactggataatatgccggtagcaggtaagacaggtacaacttctgcaacccgtgacgtgtggtttgcaggttttacaccatattacacctgtgccgtatgggcaggttatgacaccaacgaatttctggaagatgactgcaaatctttccataaaaacttgtggaaaaaggttatgggccggattcatgcggatcttccttatgtggatttcgagattccttccactgtaaagcaggctacgatctgtacctccagcggactgctggcaggttccggatgcccaacccgtacagaatattttgaaacttctacaattccttctgtgcggtgcacccgccattatgtggctcctacaccacctccattgccctcaccggaagcaggtccttccgactctgagagcaatacagatggtgataccactaccggagaaaccacagattctgcgaccggagatggcacaacaacggatgccggtgctggcgcaacaccgtcggataccggtggcaccgatgctgcaccaccggatgcttctgctccggctgcaggcggtgatcctgccactccggataccggcggacaggatgcagctccggtcgcctga

SEQ ID NO: 1321 - DNA, 2466 bp, Blautia sp.
atggaaaagcggaaaggagaagacggtttgaaaatatggaaaagaaaagtaatcgggcatggtgtactgggaatcttactttctttcgtcattgtcggcaacgcaaccggaatctacggagccgacatcgacgatacagtaccggtagaggcagaaagtgaaatgacagatagcgggaaagaagaacagcaggagattacgcaggaaaaaacacaggattcagatgatccggaaccgtcggcagaagaatcgcaggagatcagtcacgaaagtgaggagaaagagaatccggaaaaggatgaagcagacaaaataccggagacagaagatgggctgttctatcgggaaaacagcgaggaagagatagatacatattcttttgacaacagcagcgaacagccggtagcaaatgttcgatatgacaaatttttatggccatccggtggaaaaggttctgcatcctgcccgaaccttggcatgggaatgaaatatattgtcggggatgatcagaacgttgacgggggtggaaaatggagatatgtctattgtgtggaatatcaaaaggactgcccaatcggaggacttaagatgcagtttaaaggctggagtaaccgaaaagttgcctatgcactgtattacggtgcgctgtattatggatatccatgccgttatgagccatattctaccggtgactggcagatggactactttgtaacgcaggtagctgtgcacattctgaatggagaatttacccttgcagcggcgagaaacgggatgaacaaaagtaatgccacaacagcagaaaaaaatctcgcctatgaccggatcagtaaaattgtggcagcagccaatgaaacaagtaattatggtgggtttactgctgacggatggctggatatggaaagctgtacgttttctctgaatggttataataacagctggagcctgcaaaatggaaggtacctttcaggagggaactttcatgggaactttcagtcctattatgggtatgattttcgcgaacagttgacaggttatgagatcagtgctccacagggcgttcagattgaaaaaaacggtaatcagacatacgcagattttcgggcagcgattccacaggcacagtacagaaaatggcagctgacaggcatgcagataccgatcacggtgacagcttctctgccaagatactggggtggaggaatctataaaagcaattcagcttcaaatttccagagtatctgcttgctgacctgggatgcttccggaggtacgacaagaaaacaggcaagagccgatttgaatattgaaaaagtgacaaggaatctgacaatctacaaaaaggatcaggagacacagagaactttaaaaggtgcactgttttcgttgtgggcatatgacggaaatggatacagcaaaaagatcggcaatttccaggatatgcaggatggaagttaccagataaaaaacatttcttatacacagacaaaagatggctggtttctgatcaaagaagagcgtgcgccggaaaactataaaaagacataccagctggcaaacagtttggatgaagaaaactaccgccagtatggagggcgtgaaatacgtatgaatgagaatggtttttattctgaccgtgtggaacagccgtgtatcttttatgatgagaaagaagaaccgaaggcaaaggtatatgtaaaaaaatatgatatcaaatccagaaaattacttacaggagcacaattccagatttatccgtggatacaagaggaggaaaagtacagtgatcaggcacttcagacattatcttataacagtcagaaacaacagtatgagacagaaaaagaagtgattgcagataaagcgaatcagggaaagttcctgatccgggagacaaagttgccacagcattactgtggaatctggcagcaggaaattaccgtaacggaaccgggaacgacgacactggaacttgaagcatggaactatccagaacgaaaatttacgatctataaaaaaatccggacagatgagctggtatgggcacacggtaatcccacgttctttttcaaaatttcagggaaagatctgaatggagaagaacactggtatcaaagtgtgatattatttacaaaagaaatggaaaaacaacaggaatacatcatcggaaaagccgagatcatcggaattcctgcaggaatttaccagatagaagaactgcctctgacggcacggtatattctgacaggtgttacctcggaggatgacaatgtgactgtggtcaatactccgatagatacagtgaatggagttcaaaagatcaggtcgcaagtgacggcagatctgacgatggaagatggaagtgtaacttttgaaaacaggaaagtgttcttcgacgaatactctcacgatgatgtagaagtcaatcatctgaaagtatcagaagagaaaagcagtaaacagtaa

SEQ ID NO: 1322 - DNA, 2451 bp, Blautia sp.
atgagtacacaatatacgaatcaggcaaagacagcggtaaaatatgcggaaaagacagcacgcagatacaaacatagttatatcggaaccgaacatttactggcaggtcttttacacgaagaagagggaacggccggtatggttctacgcgacatgggaatcagtgaagaacggctgatggaaatgatccggaaactgattgcaccggaagagagtaatgtgctgaatgcggaccgggcaggatataccccacgggcgacaagaatgctggaaggagctgtggaagaagcagatgatcttcgcagtgaaaagataggaacagaacatcttctgcttgcgatgctgcgggaagttgactgtatgggaacccgtctgctgcacacgatgggagtaaatatccgaaaactacagaatgaagttctggcagcgatgggagaagaagttgccaatccaagagataacggcaatgcacgatccagaaatgaagcggctacaggcacgccgacgctggatcagtacagcagagatctgactgagatggctcgtcagggagttatggatccggtggtcggaagagaagatgagattggtcgagtaatccagattttgagccgccggacgaaaaacaatccctgtctgatcggagaaccgggtgttggaaaaacagcggtagtagaaggacttgcccagcggatcacgcaggggctggtgccggaaaaaatgaaaaacagacggctggttgttctggatctgtccggtatggtggcaggatcaaaataccgcggtgaattcgaagaaagaatcaaaaaagtaattgcagaagtgatggaacatccgggaattctgctgttcattgacgaattgcatacaattatcggagcaggcggtgcggaaggagcactggatgcatccaatattttaaaaccttctctttcgagaggagagatccagattatcggtgcgaccacgattgaagaatacagaaaacatatcgaaaaagatgcggcactggaacgaagatttcagccggttacggtagaagaaccgacgcaagagcaggcagttgagattctgaagggattgcgcccttattatgaaaaacatcatggagtcaccattaccgatgaggcgctggaggcagcagtcaagatgtctatccgttatattgcagaccgacatctgccggacaaagccattgatttgatggatgaagcatcttcacgggtacagttgacaggtattacagtgcctccgcagttaaaagaggtggagcagaatctgcatgcacttgccgaaaaaaaagaggaagcgatcagggaaggcaatttttcaagagcgcgggagttgcaggaaggacaaaaagagctggaagaatcctacgaaaaattgaaaaaacgtcaggaacagcgctataaaaataaaaaaatgcaggtaaccgaagaaaatattgcccagatcgtatccaactggacgaagatcccggtacagaaacttgcccagaaagagtccaaacgtctggcaagcctggaaaaagaactgcacaaacgggtgatcggtcaggaagaagcggtggaagcggtggcaaaagcaatcaagcgtggacgcgtggggctgaaagatccgtcaaggccgatcggttctttcctgtttctaggaccgaccggtgttggtaagacagaactgtctaaagcactggcagagacagtctttggctccgagcaggcgatgatccgtgtggatatgtcggaatacatggaaaaacacagtgtatcaaaactgatcggctcaccgccgggatacgtgggatatgaagaaggtggtcagctttctgagaagatacggagaaatccatacagtgtgattctgttcgatgagattgaaaaagcacatccggatgtatttaacattttattacaggtgctggatgacggtcatatcacagatgcgcagggcagaaaagtggattttaaacagacctgtatcatcatgacatcaaacgccggtgcacagtcaatcgtagaaccaaaacgtcttggattttctcagggagaagacaagaaaaaagactacgaagatatgaaacgcggtgttatggaagaagtgagaagaatctttaagccggaattcttaaatcgtgtcgatgagatcctggtcttccatatgctggataaacaggaaattcgccagattgttaacattctggtaaaaaaactggagaaacgatgcaaagaacagctggatatcgaactggttgtccgaaacagtgtaaaagactatctggcagaaaacggatttgacagcaaatatggtgcacgacctctgaaaagagcgatccagaacaaattggaagacaggatggcagaggagatactggatggaaagattcacagaggggatcgggttattgtgtctgtatctaaaaaagttattaaattttcagtcaatgactag

SEQ ID NO: 1323 - DNA, 2571 bp, Blautia sp.
atgaaattatctgaaaagatctttggaacgcacagttccagagagttgaaaagaattatgccattggtggataagattgaggagctgcggccgactatgcaggcgatgacggacgaggagctgaaggatcagaccagaaagttcaaggagagactggcagagggagagacgctggatgatctgcttccggaggcattcgctacggtgcgtgaggcttccaagcgtgtgctgaatatggagcattaccgggtacagctgatcggtggtattattctgcatcaggggcgtatcgcggagatgagaacaggtgaaggtaagactttggtttctacctgtccggcttatctgaacgcgctggaaggtaaaggcgtgcatatcgtaaccgtcaacgattacctggccaaacgagatgcggagtggatgggtaaagtccatgagtttctgggactgaaagtcggtgtgatcctgaactctatgaaaaatgacgagagacgggaacagtatgcatgtgatattacgtatgttaccaataatgaggatggttttgactatctgcgagacaacatggttatttataaagagcagctggtacaaagagagttgcattatgcgatcatcgatgaggttgactctgtattgatcgatgaggcgagaactcctctgatcatttccggacagagcggaaagtccaccaagctgtatgaagtctgtgatattctggcaagacagctgcagcgtggtgaagccagtggtgagatgaccaagatgacagctatcatgggcgaggaaattatcgagaccggtgattttatcgtcaatgaaaaagataaagtagtaaacctgaccgaggaaggtgtgaagaaagtagagaagttcttccatattgaaaacctggcagatccggagaatctggagatccagcacaatataatccttgcactgcgtgcccataacctgatgttccgtgaccaggattatgtcgtaaaggacgatcaggtactgatcgttgatgagtttaccggacgtatcatgccgggaagaagatattccgacggtctgcatcaggcgattgaggcgaaagagcatgtaaaggtacgccgtgagagcaaaacactggccaccattacattccagaacttctttaacaaatatgcgaaaaaagcaggtatgactggtacggctctgacagaggaacaggagttccgtgagatctatggtatggacgttatcgagattccgacaaaccgtccggttcagcgtgtcgacctggatgacgcggtatatatgaccaagaaagaaaaattccgtgcggtcgtggaagaaatcaaaaaagcacatgcaaagaatcagccggtactggtaggtacgatcacgatcgagacctccgaactgctgagcaacatgcttcggagagagggaatcgcacatcaggtactgaatgcgaagttccatgagctggaagctgagatcgttgcacaggccggtgtggcaggtgcagttaccatcgcgaccaatatggcaggtcgtggtaccgatatcaaactggacgaggaagcgagagcagccggtggtctgaagatcatcggtacggagcgtcatgagtcccgccgtatcgataatcagttgcgtggccgttccggtcgtcagggagatccgggagaatcccgcttctatatttcactggaagatgatctgatgcgtctgttcggttctgaaaaactgatgtccgtattcagcagtctcggtgttgcggaaaacgaacagatcgagcataagatgctttccagcgctattgagaaagcacagaggaagattgaaagtaataactacggtatccgtaaaaatctgcttgagtatgatcaggtaaacaacgaacagagagagatcatttataaagagagacgtcgcgtactcgacggagacaatatgcgtgatgcaatctgtaagatgatcaccgataccgtggaaaatacggtagatatgtgtatcagtgacgaggtggattctgatgaatgggatctgatcgaactgaatacgattctgcagccgatcattccggtgaagacaatcaccaaagaggatgtcaaagggatccgtaagaatcagttaaaacagaacctgaaagaagaagctattaaactgtacgaagtaaaagaagctgagtttgcagagccggagcagatccgtgaactggaacgtgtggtacttctgaaggtcattgacagaaaatggatggatcatatcgatgatatggaacagctgcgtcagggtatcggcctgcaggcttacggacagagggatccgaaggttgagtacaagatgagtgcattcgagatgtttgacgagatgatcgcaggcatccagcaggatactgttcgcctgctgtatcatgttagaatcgagcagaaagtagaacgtgagcaggtagcggaagtaaccggaaccaacaaagatgaagaagtcaaaggtccggttcgccgtgcccagcagaaagtatacccgaatgatccgtgtccatgcggaagcggtaagaaatacaaacagtgctgcggacgtaagaacaaagcctga

SEQ ID NO: 1324 - DNA, 4563 bp, Blautia sp.
gtgagaggagaaaatgtgatgaaagaaaatcaaggtttatatcgacagcaatttgagcatgataactgtggtatcggagcggtcatcaacagcaaaggtatcaaaagccacactactgtagagaatgctctgaaaatcgtagaaaatctggaacatcgtgcaggaaaagatgcagaaggaaaaaccggagacggtgtaggtatcctcctgcagatctcccataagtttttcaaaaaagaatgtgaaaaactgggaatcgagatcggagaggagagagaatatggtatcgcccagctcttcttcccgcaggatgaactgaagtgcaaccaggcaaagaagatgtttgagatcatcgtggaaaaagaaggcctggaactgcttggttatcgtgaagttccggtttatccggaagttctcggacacaaagccagagtctgtatgccacacatcatgcaggcatttatcaaaaaacctgtccgtgtggaaaaaggtctggaatttgaccggaaactgtacatcgcccgccgcgtctttgaacagagtaatgaaaatacgtatgtagtatctatgtccagccgtacgattgtatacaaaggtatgtttctggtaggacagttgcgcaccttcttcggcgatctgcaggataaagattatgaatcagccatcgccatggtacactcccgtttcagtaccaacacgaatccaagctgggagagagcacatccgaaccgctttattgtacacaacggtgagatcaacactattcgcggtaatgccgacaagatgctggcacgtgaggaaacaatggaatcctcccatctgaaaaatcagctgcataagatcctgccggttgtagataccagaggatctgattctgccatgcttgacaatacactggaatttctggtcatgagtggtatgccgcttccactggcagttatgatcaccattccggaaccatggacgaacaataaaacactggatcaggatgagagagatttctatcaatattatgcaactatgatggagccgtgggacggtcctgcctccattgtattttctgacggtgatctggtcggtgcggttcttgaccgtaacggtctgcgtccatcccgttactatgtattaaagagcggggatgtgatcctggcttccgaggtcggcgttctggaagtaccggaagaagaaatcgtgttaaaagagcgtctgcaccctggaaagatgctgttagtcgatactgtaaaaggaaaaatctatcaggatgaagaactgaaagaaatctatgcgaccaaacagccgtacggcgaatggctcgacagcaatctggtagaattgaaagaactgaagatcccgaacaaacatgtggaagaatacggtaaagagcagagaaaacagctgcagaaagcattcggctatacctatgaagaatataagaattctatccgtaccatggcattgaacggcggagagtcaattgcagccatgggtgtggatacaccactggcagtactttctgaaaaacagagaccgttatttgattacttcaaacagttttttgcccaggtaaccaacccgccgatcgatgcgatacgtgaggaaatcgtcaccagcaccacaatctatgtaggtaaaaagggtaatctgctggaggaaaaaccggaaaactgccaggtattaaagatcaacaatccgatcctgaccaatacggatatgctgaagatcaaacagatgcacaaaccgggattcaaggtggcagttgttccgattacctattataagagtacgaaactggaacgcgcgatcgaccgtctgtttgtggaagtggataaagcatacaaagacggtgccaatattctggttctttccgaccgaggtgtggatgaaaaccatgtgccgattccgtccctgttagcggtatctgccgtacatcagcatctggtcaatacaaagaaacagacatctctggccctgatcctggagtccggggaaccgagagaagtccatcattttgcaacactgttaggttatggtgcctgtgcagtcaacccatatctggcccaggacagtatccgggaactgatcgaagaaggactgcttgacaaagattattatgccgcagtggatgattacaatgcagcaatcctgcatggtatcgtaaagattgcttccaagatgggtatttccactattcagtcttaccagggtgcgaagatttttgaagccatcggtatctctcagaaagttatcgacaaatatttctccggaaccgtcagccgcgtgggtggtatcactatggaagatatcgcaaaacaggtggatgagaaacattcccaggcatttgatccgctgggactggccagtgatctgacactggacagccttggaaaacataaaagaagaagcggtggagaagaacaccgttacaatccacagaccattcatatgctgcagcagtccacctggaccggaagctatgatatgttcaaacagtatactgcaatggtagacgaagaacagagcggctatctgagaagtctgatggactttaattatccggaaaacggtgtgccgatcgacgaagtagaaagcgtggatgagatcgtaaaacgattcaaaaccggtgccatgtcctatggttctatttctcaggaagcccatgagacactggcaattgccatgaatcatctccatggaaaatccaataccggtgaaggcggtgaaagtgatgacagactagattccgcaggaagcgataatgacagatgttctgcaatcaaacaggtagcatccggtcgttttggtgttaccagccgatatctggtaagtgcaagagagattcagatcaagatggcgcagggtgcaaaacccggtgaaggtggacatcttccggcgaaaaaagtatatccgtggatcgcaaagaccagacattccacaccgggtgtgagtctgatctccccgccaccacatcatgatatttattcgattgaagacctggcacagctgatctacgacctgaaaaacgcaaataaatacgcaggaatctccgtaaaactggtttcagaagcaggtgttggtacggttgcggcaggtgttgccaaagccggtgcacaggttatcctgatctccggatatgacggaggtaccggagccgctccggaaagttctatccacaacgcaggtcttccatgggagatgggacttgcagagacccatcagactctgttacagaatggtctgagaaaccgtgtccggatcgagacagacggtaaactgatgagcggccgtgatgtggctatcgcagcactgctcggtgcggaagagttcggttttgcaaccgctccgctagtaaccatgggctgcgtgatgatgagagtctgcaacctggatacctgcccggtaggtgtggctacccagaatccggaactgagaaaacgcttcaaaggaaaaccggaatacgtagagaacttcatgcgctttatcgctcaggagctgcgggaatatatggcaaaactgggtgttcgaacgatcgatgagatggtaggaagaagtgaccttctgaaagtaaaagaagacgcaaaaacaccgatggcagcaaagatggatctgtctcagatcctgtacaacccatatgcgggagaaaaagagtgtgttacgttcagtccggaaaaagtatacgatttccagctggaaaaaacgctggatgagaaagtactgttaaagaaactggagaaatccgtagagaagggaacgaaagcttctctggatctgaaagtcggcaacaccgaccgttccttcggtacgatcctcggtgcagagatcacccgtcagcacaaagacggactgccggaagacactattaccatcaactgtaccggagccggcggacagagcttcggggcatttatcccgaaaggactgacactgcgcctgtgcggtgataccaacgattattatggaaaaggactttccggtggaaaactggttgtcttcccgccgaagaacagaggatacaaagcagaagagaatatcatcgccggtaacgtagccctgtatggagccaccagcggtaaagtatttatcaatggtgtggcaggggaacgttttgcagtccgtaactccggagcctacgcagttgtagagggtgtgggagaacatggatgtgaatatatgaccggtggccgtgtggtcgttcttggtaagacaggaaagaactttgcagcaggtatgagcggtggtatcgcttatgtactcgatgagaacagccatctgtatcggaatctgaacaaagatatgatttccattgaaaaagtggaaaacaaatacgatatcaaagaactgaaagaactgatcgaggaacatgtggaagccacaggatccgagagaggtgcgttgattctggagcatttccaggagtatctgcccaaattcaaaaagatcatcccgaatgatttcaagaagatgatcgctctttctgcaaagctggaagagaaaggaatgagcacagagcaggcacagatggaagcattctatgaaagtttccagaccaaatcgacggaggagtaa

SEQ ID NO: 1325 - DNA, 2226 bp, Blautia sp.
atgacaaagacatatgcggatattattgtagatattaccagcgaaaaactggatagatcctttcagtatctggttccacagcatcttgagggcaggttacaaccggggatgcaggtgcaggttcctttcggaaatggaggaaggatgatcaaaggatacgtgatccgggtgacggatcagccttcttttgatgtcagccgcatgaaagagattcggggagtggagacaggaagcaattccattgaatcccgcctgattgcacttgctgcctggatgagggagcagtatggcgccacgatgatccaggcgttaaagacggtacttccggtaaaacagaagatgaaacagaaagaagaacgctggatccgtctgctgctcgaaaaagaagaagcagaaaatcagctggaactgtgccgtaaaaaacattatgtggccaggcagagacttctcgaggcactgcttgagaatgatacgatctcttatatattggcaatggataaactgcatctgacagcaagtgtgataaaggccatggagaatacagggatgattcgggtacaggctacggaagtgtatcgtaatcccatccggactacggaatgtgagcagacaaaagcactactgtcaccggcacagagagaagtggcggatgggattctgaacggctggagagaaaacgattttcgcccggtggtgattcacggggtaaccgggagcggaaaaacccaggtatatatggaactgatggaagaagtgcttaaccagggaaagcaggtgatcctgttgatcccggagattgcgctgacttatcagacagtgcagcgtttctatcggcggttcggagacagaatctctgttttacattcccggctttctcccggtgagcgttccgatcagtttgaacgggcaaaaaaaggggaactgcaggtgatgatcggaccgcgatctgcactatttaccccgtttccgaatctcgggttgatcgtgatcgatgaggaacacgaaacttcgtaccagagtgagacggtgccatgttatcatgccagagagacagcgattgaaagaggaaatctggaacactgtccggtggtactgggaagtgccacaccatcggtagatgcgtattatcaggcacagaatggaacgtatcggctgtttgaactaaacagccgatatgaaaacaggcagatgccgaaggtttattctgtagatctgaggaaagaattaaaacaggggaaccggtcgatcttgagcagtattttacaggaaaaaattgaagaacggttaaaaaagaaagagcagatcatgttgtttttgaatcgtcgcggatatgcgggatttttctcctgccgttcctgtggaacagtgatgaaatgtccccactgtgatgtttctctgtcacaacaccggaacggaaaactggtgtgccactattgcgggtatgagacgagacaaccacagcagtgtccggtgtgcggatcaccctatatcggaggatttcgtgcgggaacgcagcagatcgaagaaatcgtaaaaaagcggtttccacaggcaaaggttttgcggatggatctggatacaaccagaaaaaaagaaggacatgcaaatattctggctgcatttgcaaaccaggaggcagatatcctgatcggtacgcagatgatcgtcaagggacatgattttccgaaagtgacgctggtcggagtgctggcggcggatctttcactgaatatcagtgattaccgggcaagtgagcggacttttcagttactgacgcaggcagcgggaagagcaggaagaggagaaaagcccggagaagcgattatccagacatatcaaccggaacattacagtattcaggcagcgatgcatcaggattaccgggcattttatgaagaagagatcggttatcggaaacttctgggttatccaccggtatccaatctactggcgatccatggaagctgtggtaatgaggaactactggagacaggaatgcaatatataaaaaaattcctgaaccgggtggacagtcacggacagctgcagatcatcggacctgcagatgaaaccgtatcgaagatcgccgatatgtatcgaaaagtaatttatataaagcaggaggatcaccagctgctgctgcgggcaaagagcagactggaacaatatatagaagtaaacagcggattcagggaaattcggattcagctggattttaaccactga

SEQ ID NO: 1326 - DNA, 813 bp, Clostridium sp.
atgagcagaaatatgataaaatccatgtctgaatgggataaagtagttacagcaagacataaggatagaccaacaggggaattttatatagaaaatatctttaaacattttattgaatttcatggagatagatattttggagatgatgcagcaattattggaggaataggttttttagagaaaactccagtaacagttatttctattacaaagggaagtaatacaaaagaaaatataaagagaaattttggaatgccaaagccagaaggatatagaaaagcattaagacttatgaaacaagcagaaaagtttaaaagacctattatatgttttatagatactccaggagctttttgtggagttgatgcagaggaaagaggtcaaggagaagctattgctaaaaatttatttgaaatgagtaagttaaaaactcctatagtttctgttcttatgggagaaggaggaagtggaggagctttagctttagctgttgcagatagaattttaatgcttgaaaattctatatactctattttatctcctgaaggatttgcttcaattttgtggaaagatggaagtcgtgtaaaggaagctgcagaagcaatgaaaataactgctcaagacttaaaagagtttaaaataatagataaaataataaaagaaccttatggaggggcacatagaaatccattaaggatggcaatgtttttaaagaaaaaccttatagaagaggtaaactctttaaaagaaaaggatatatgtgaacttacagaggaaagatataataaatttagaagctttggaagagaatag

SEQ ID NO: 1327 - DNA, 519 bp, Clostridium sp.
atgtttgagtttataaaaaaatcagattatgaaatattaaaatacataaataaacatatgaaatgtaagtttttagataagattatgcctgttataacaggtcttggaaatggtggacttgcatggatacttatagctataattatgctaaaaagaggaaaatataaatttggcttagcaatacttttagcaatagccacttcagcaggtatagttgaaggagtaataaaaccaattgtaagaagaagtaggcctttttttagagaatctaaagaagcagaacttttaataaaaaaacctatagggtattcattcccttcaggacattcagcgtcctcctttgcagtagcaactgtatgtatatttggaggaattccttttgcatatttatttttcattttagctatattaatttcattttcaagaatgtatttatttgtacattatccaacagatgtaatctgtggtggaatttttggaagtataataggatatataatttcactttatattatataa

SEQ ID NO: 1328 - DNA, 384 bp, Clostridium sp.
atgttttatacaggagggaaaaatagtactcttgctttatataaaatgatagaaaagggatatgaaccattagaactattagtaatgcttgaagaaggaaaggaagttacttggtttaataaagtaaatgaagatttaataagtaaagcttcttttgcattaaatgtaaatatatgtttagttgaaacttcaattgaagattatgatgaactttttgaggaacaacttatctatttaaaagaacaaggagcagaagcttgtgtttttggagatattgataatatagagcataaaaattggtgccttaaaagatgtaaaaaagctaatatagaagcaatttttcctttatggaatgaggaaagagaaagtcttacagaagaattt

SEQ ID NO: 1329 - DNA, 711 bp, Clostridium sp.
gtggaagaaagattacaaaagtttatggcaagttgtggaatagcttctagaagaaaatgtgaagagcttattttatcaggaaaagttaaagttaatggagttgttgtaacagaacttggagtaaaggttaatggaaataaagataaaattgaatataatgggaaaataataaaaccagaagaaaaaaaggtttatatactccttaataaaccagaaggttatataacctctgtaaaggatgaaaaaaatagaaaaactgttttagatatagttaaagtagaagaaagaatatatcctatagggcgacttgattatgacagttcaggtcttcttttattaacaaatgatggagatatatataataagataattcatcctagagtagaaataacaaaaaaatatatagctgttgtacagggtgaatttaaaaagcaggaattagaaaagtttaaaaagggagtagatataggagggtatattacagctaaagcagaaattaaggttttaaagtatgaagatgataagactacagtagagataggaatacatgaaggaaaaaacagacagataagaaaaatgtgtgcagctttaaatcataatgttttagctttaaagagaatttctattggaaagataaaattaggaaatcttaaaagaggggaatatagagatttaacaagggaagagcttaattatataaatagtttatag

SEQ ID NO: 1330 - DNA, 1416 bp, Clostridium sp.
ggaccatgcatattatcaaaatatgcatgtgcctcttcactagcttctttacatcttgcttgtcaaagcttattaaattatgaatgtgatatggcagtagctggtggagttagtatagagccagagcaagaaggattctttactatagaagggacagtgtcaagaagtggttatacaaaatcctttgatgcagaagcagatggatttgtaggagggtctgcattagggcttgtggttataaaaagactagaagatgctataaaagaccatgataatataatagcagttattaaaggaactagtgtaaataatgatggaagaagaaaggtaggttttccagcgccaagtattaaaggccaagaagaggctatattagatgcactatttgtttctggaattgaaccagaggatgtagggtatattgaaactcatggaacaggaactgttttaggagatgctgtagaaataagagcattaaaagatgtatttaatgatatagaagaacctttatatataggctcaattaagcctaatataggacatactaatgcagcagctggaatatcaaatgtaattaaggcaacattaattttaagagataaaattttaccacctagtataaattgtaataagttaaatgatgaacttttagaagatggatgcaaaatagttttaaatcaaaacttaagaaattgggaaagtaataaaaagagaattgttggtgtaagtgcttttggaatgggaggagcaaatgcaatagcttttcttgaagaatataaaaataaagagcataaagaaattaatagagatgagcttattattgtaagtggaaaatcagaaaaggcattaaaaaataattgcttaaatcttgcagattatttagaaaaaaataatgttaatattcaagatttagcatatacccttcaagaaggaagaggtgactttgagtataaattctttacagcttcacaggataaaaaatcattaataagtgaattaaaaaatgtatgtgacaaaaagattaaaccttcaaaaaatgatgttacaaaaaaagttgtatttgtattctcaggttctggaagcattgtagatactataggaagagaatgttatgacacaaataccacatttaaagaagaaatggatagatgtttttctatagtagaaaaaacattaaaaatagatttgaaagaaaagtatattaattatgaaaaatataaggaagaattaaaaaaggatacttccttaggaatgataattacattctctattgggtattcaattgcaaaaatgtggatgtctttaggtgttaaaccagatttaattacaggacatagcttaggagaatatataggagcatgtattgcaggagtatttacaattgaagaagctgtagagttgataacaaaaagatct

SEQ ID NO: 1331 - DNA, 402 bp, Clostridium sp.
aaaaatatagaagaaggaaatgaaattgtatatatagctcatgtactagataatacttttatttcaagaaagttatttagatatgctattagtggaacagaaggagcacaattatatagtaaattaacaataaataatgaggattatcattattttgaaaagaaacataaaaatgcattcactgttaaagagttaaaatttttcttggaaaatcataatattaatataatacaaatttgtggaattgatgaaggtggatgtgtttcaaaaactgctaagggagcagttaaattaggattaaaggtagaaatgcttaaagattcaatagacacagtatttcctataaaaaaggttataaagattagagcagaattaaagaaaaagggagttagttatatatag

SEQ ID NO: 1332 - DNA, 1038 bp, Clostridium sp.
atggaggaacatgtaggagattatttaattgaaggagaaggagaaaaaacctatagagattttgtagagtataaactaggaggaaaaaatttaagtgatataaagggtttatattatagagaaaataatgaaataatatttaatggattaagacctttaatgaatatggatgaaatagtatttccttatgaaggggatgaggatttaaataataaaatagtgtactacgaaggtagtcgaggatgcccttttaattgtaaatattgcttatcttcaactactcatggagtaagatttcatagtatagaaagaacattagaagagttagacttttttattaaaaagggagttaggcttgttaaatttgtagacagaacctttaattgtaatcataaatattcaatggctgtttgggattttttaattaaagcagatacaaacacaaaatttcattttgaaatatcagcagatattttaaaaaatgaagaaatagaacttttaagaaaagcaccaaagggaagatttcaatttgaagttggtgttcaaacaactaatgatgatgttcttaaaaatataaatagatttgttaattttagtgatataaaagagaaggttgtagagcttttatctataaataatataaatcaacacttagatttaatagcaggacttccaggagaagattataactcctttgtaaaatcttttaatgatgtacatagtataaaaccagaagaaattcaattaggttttttaaagcttttaaaaggttcagatatgagaagggattctagtctttataatatgaagtattcaccatatccaccatatgaaatcttaagtacagataaaatatcctatgatgaaattcaaatactaaaaagtgtagaagctgtagttgataaatattataatagtcaaaaatttaatacaacattagaatttttctataaaaagtttgaaacaccatatgaatttttctatgaattaggaaattattttgaaaataaaggatacttcaataaaaatataggaaat

SEQ ID NO: 1333 - DNA, 1827 bp, Clostridium sp.
ggatattttgactttttaggtgaatgtattgaaggtatgagagctgtagatacagcaataattactgtatgtggagtatcaggagttcaagttggtacagaaaaagcatgggattattgtaacaaaataaagcttccaagaaccttttttatcaataaattagatagagaaaattctagctttgaaaaagttttagctgatattaaagaacactttggtaaatgtgcagtacctattcaataccctattggagagcaagatgattttaaaggtgttgtaaacgttataacaaagagggctcgtatatataatcctaaaactaaaaagatggaagtaggcgaaattccacctgaattagtagataaaatagatgaatgtaagaaaatgataactgaagcagttgctgaaactgatgaggttttacttgataagtattttaatgatgaagaaataactgatttagaaatctatgaaggattaataaatggatgtacatcaggtgatattgcaccagtaatgtgtggttctgctagtaaagcaataggtattaatactttacttgaagatatagttgaatgtttcccttcacctaaatatgcaattccacaaaaagcaaagaatttaagtacaaatgaagaggtatttttaaaactaaatgaaaaagacccattctcagcatttgtatttaaaacaatagctgatccttttgtaggtaaaatttcattatttagagttattacaggaaaattaaatggtgaagttgatgttataaattcaaataaagataaacctgaaaaacttgcaaatgtattttttatgagaggaaaaaatcaaattcctacaaaagaaatagttgcaggggatataggagctgttgctaaattgcaatatacttctacaggagatactttgtgtgatggtaattttaaagttatatttgataaaataaatttccctaaggctaatttatcaatggttgcaattcctaaaaataaaggagatgaagaaaagatatctttaggaatgactaagttattagaagaagatcctgttttatcattatcaagagatactgaaaatgcagaaataataatatctggtttaggagaaactcacttagaagtagttgcatctaaattaaaatctaaatttggtgtagatgttaatttacaagttccaaaagttccatatagagaaactataaaaggaaaagcagatgttcaaggaaaacataaaaaacaatctggtggacatggtcaatatggagatgtaaaaatattatttgaagctagaaatgatggagaacaagatttagaatttgtagataaggtagtaggaggagttgttcctagaaactttataccagctgttgaaaaaggtttaaaggaatgtatgaataagggggttcttgctggatatcctgttattggtttaaaggctactttacatgatggttcttatcacccagttgactcttctgaaatggcttttaaagtagcagcctcacttgcatataaaaaaggtatggaagaagcaaatccaatattattagagcctataatgcatgcagaaatagtagttcctaatgattatatgggagatataattacagatataaataagaaaagaggaagagttataggaatggaaccagaaggagaagttaatcaaaaggtaatagttgaagttcctatggcagagatgtttaaatatgctactgatttaaggtcaataactcaaggaagaggaaattttgatatgacctttgaaagatatgaagaggttccacctaatgaagctagcaagataattgaaaatagtaaataa

SEQ ID NO: 1334 - DNA, 552 bp, Clostridium sp.
gtgatagattttataacaaatattgataaagaaattttgtattttattcaagaatttttaagatataattttcttaatggaatattttcttttataactaagttgggaaatggaggatttatttggattttaataacaataatacttcttatccctaagaaaacaagaaaagtagggatattatcattatgttctttgctattatgtcatgtggtaaataatttaatgataaaaaatttagttatgagagagagaccttttaatcaattttcagaacttattcccttagtaaaaaaaccaactgacttttcattcccttcagggcacactgcaatttcctttgcagtatcaggaattttagttagatatttagataaaaaatatggaatgacagcaatagtttttgcagttcttattgctttttcaagattatatgttggagttcattttttaagtgatgtaattgtgggaatgattataggacttttaagtagttttattgtatcaaaagtggataagcatctatgttcaaaaaataaaaaggaaatataa

SEQ ID NO: 1335 - DNA, 462 bp, Clostridium sp.
gtttttgtaaatagaggaacaatgtttggaccttggctacctatatatggggttggaggttgtatgatattatttttatttaaaccttttagggaaaaacattggttaatatttcttttatcctttgttttatgtggcataattgaatattctactgcttggtatcttgaaacctttaaacatatgaaatggtgggattacagtggatactttttaaatataaagggtagaatatgtatggaaggacttcttgtttttgggcttggaggatgtatttttacttatatattagctcctatatttgataatttatatgaaaaaattaaacctaaaataaaaattgttctttgtattttattaatattttgttttgcaatagattttttatattcatcaaagcatcctaatacaggagaaggaattacaaatcctataacatatatagatataattaaaatataa

SEQ ID NO: 1336 - DNA, 921 bp, Clostridium sp.
gtggaaaatgtaataggtgtaataaaaaatgcaataaagaaatatgtaaataaattctgggagggaaatattttggctaagcctagtatattcagtagagattatgaaagaaaaatgaaaaaaagaaaaagaagagtaatcttaactgttgttattatatctataatagttatttttgctggatttaagtttgtaatatcagatttagattttagtaatgtaagagcaaaacttcaagcttgggtagatagtggaaagtcccaagaagatttagataaagaagctcttgtagataataaagataaaaataacaaagaagatataaaaaaatcagaaacaactacagcttcagcagaaacaaatgttgctaaagttaaggaacttgaattaaaaatatcagataaagttacattaaaagcctcttatgaagagaaaaatggaaaaaaacaatttaccaatatagaaaaaaaagaaggatatgattttgatataagtccttcaaaagaaaaagttatagtaagcactccaacacaagatttaaaactatttaatgtagatggaagtgaaaaagaaataactaaaaaagttcacacaagcactaaaggaacacaatttttaaaagacaatatacttgagcaaatgccagattttatttggtgtgaacaagctaaatttattgatgataaaatggtagtatatataagtgaaatgccttattttggctcaggattaacagataaatatatatggataaagaacacagaaaactttgaaagccctgaaaatcctaatgatactcaaatttatggggtagtaggaactgatgttaaagttggaaatataaaagataaaaaaggtattgaaattactgttgatggtaatgtttattatgttaattcaaatggtgaaatttcaaattaa

SEQ ID NO: 1337 - DNA, 297 bp, Clostridium sp.
gaaattagaacagttaaagaagatatagaaatggaagctatagcaaagaatttaatagatatgaaaatatcttctaagtatattgcagaagcaacaggattagccataagcagaattatgaagcttaaaggaaatgatgacataattcaaatagcaaaaaatttattacaaatgggattggcacaagaagaagtttcagaaattgtaaatttaccaatggatgttatatctgttatagaaatagaaccattaaaaaagacagatgttatatctatagactttggagctataaaatag

SEQ ID NO: 1338 - DNA, 834 bp, Clostridium sp.
gttaaatttgcaaaggaaaatcatatttatcttacagttgttggaccagaagacccattaactaaaggaataactgataaatttaaggcagaaggtttaagaatttttggaccagataaaagaggagctgaacttgaaggaagtaagagtttttctaaagcctttatgaaaaaatatggagtaaaaactgctgaatatgaagttttcacaaagatagaaccagcattaaaatatgtggaaaactgtgcatatcctgttgttattaaagcagatggactagcagcaggtaaaggtgttgctatatgccaaacaaaggaagaggcagtaaatgctttaaaatcttatatgatagatgatatatttaaaggggctggacaaaaggttgttatagaagaatttttagatggtgtagaagcttcaattctttcaataacagatggaaagacaataattccatttatatcagcaaaagaccataagcaaatatttgatggaggaaaaggaccaaatactggtggtatgggagttcttgccccaaatccatatgtaactgaaagtgttatgaaagattttgaagaaaatataatgaataatactttaaaaggaattcaaaaagaaggctttgattttaagggtattatattctttggtcttatgatttgtgaaaagggaacttatcttcttgaatacaatgtaagaatgggagaccctgaaactcaatcagttttaagtttaatggatagtgatttatttgaacttatagaagctgctatggatgaaaaactttctgaaactaaagttctttggaaagatgaagtatgtataaatgtagtt

SEQ ID NO: 1339 - DNA, 1047 bp, Clostridium sp.
atgcttgttgatttttatgaacttacaatgggaaatggttacttcaatgaaaatttaataaataaagttgcttgttttgatatgttctttagaagagttccagatggtggtggctattgtataatggctggtgttgaacaactaatagagtatttaagcaatttaaaatttactgaagaagatatagaatttttaagaaataaaaatatgttttctgaagactttttaaattatcttaaaaattttcagttttgttgtgatgtttgggcagttccagaaggaaatcctgtatttccaaatgaacctttagtaactgtaaaaggacctattattcaagcacaatttattgaaacaatgatacttcttacaataaatcatcaaactttaatagctactaaagctaatagaatatgtaatgctgcaaatggaagacctgttatggaatttggttcaagacgtgctcaaggatatgatggtgccatttatggtgctagagctgctgtaataggtggatgtagctctacagcctgcacaatttctgaccaaagatttaatattcctgcagttggtacaatggctcatagttgggtacaactatttgacactgaatatgaagcctttaaagcttggtgtgaaatatatcctgataacgctgttttattaattgatacttataatgttttaaaatctggtcttcctaatgccattaaagcctttgatgaagttttaaaaccaatgggaataagaccaaagggaataagaattgattctggagatataacataccttacaaaaaaatgtagaaaaatattagataatgcaggatatgaagattgtggaattgttatatcaaattcccttgatgaatacataataagagatgttttagaacaaggagcttgtattgattcttttggtgttggagaaagattaattactgcaaaatctgaacctgtttttggaggggtttataaactttctgctgttgaaaaagataacactttaattccaaaaataaaaattagtgaaaatgaagaaaaaattact

SEQ ID NO: 1340 - DNA, 600 bp, Clostridium sp.
atggcattagttcctacagtcattgaacaaacaggaagaggagaaagagcttacgatatattctcaagattattaaaggatagaatagttatgttaagtggagaggttacagatgatactgcaagccttatagtttctcaattactatttttagaaagtgaagatccagataaagatatttatctatatataaatagtccaggtggttctgttacagctggtatggctatatatgatacaatgaactatataaaaccagatgtatcaactatatgtatgggaatggcagcatcaatgggtgcatttttattatcaagtggagctaaaggaaaaagaatagctcttcctaatgcagaagttatgatacatcaaccattaggtggtttccaaggtcaagcaactgatatagatattcatgcaagatggatattagaaactaaaaaaagacttaacactatattaagtaaaaatacaggaaagccatatgaacaaatttgtcaagatacagaaagagacaatttcttccatgcagaagaagcagtagaatatggattagtagataaagttataactaatagtgaaattgggaaagataaatag

SEQ ID NO: 1341 - DNA, 846 bp, Clostridium sp.
gaaaagattccagaaggacaaatgattaatgttcctctttcacaagaagaagtagaagaaattcttactgaaaaagttgaaataggtgctataaatggagaaaaaagaacaatgatttctggagaaaaggaatatatggataagtttgtagaaaaattagaccaaaaaaatattaagtatacatatcttccagttaacagagcaggtcattgttatagtgttgataatataagtaaagagtataaagaaattttagataaggttaattataataatagcaatataccaatcttttcaacttatacagcatccttattaaaagaggatggaatgagtaattcagaatattggataaatcaaatgaaaagcacagtaaaattttatccttcaataaaagaattaagtaaagatgataatgtgatttttatagaaattggtgcttcaaagcaaatgacatctttaattagtaaaataataaaaagaaataataattcaagtgcaatttcttcatttaaggaaggaaacgaaattaactctagaagaggatttttattagcattaggaaaaggatatagtaatggcttaaaaatagattggaatggattatatgaaagtactccatatagagtttcacttccaacatatgcttttgatagaaaagcttattggaaatattctaaaagaataaataatggttttaatgaagctgagttaatttctcaaaaaccatctaatgatatagataattttgaaacaatagaaaatgaaacaaataaatatagaaatgatacagacaaaatagtttcagaaatttttattgaagttttaggattagatgaagttgat

SEQ ID NO: 1342 - DNA, 981 bp, Clostridium sp.
attagctatactcaaaatagagaactttcttggcttaaatttgaccaaagagtattagaagaaggtagagataaaaatgttccactttatgaaagattaaaatttatatctatatttacaagtaatttagatgagttttttatgataagagtaggaagtttatatgatatatctttaatagattcagagcattatgataataaaagtaaaatgactgcaggagagcaacttaaagcaatctttaaatcagtagttccattatatgaacaaaaggataaaacctttgaaaaagttgaagaagaattaagagaatataatataaagaatttaaatataaaagagcttaacaaacaagaaaaaaagtttttagatgattattttaaagattatatattacctgtgttatcaccacaaatagtagataatcttcatccttttcctcatcttcaaaatttatcattaaacttaacagtattaataagaaacaatggaaatactttagttggaatagtacctattccaagttcagttccaagagttatttatattccaggagaagaaataaaatatgtattaatagaaaaagttattttagaatatgcagatatgatatttaacatgggaactatagaagatagaactatagtacgtgttactagaaatgcagatattaatccagatgatgaaaactatgatattgatgatgattacagacttcatatgaagaagatattaaaaaaacgtggacgtttagctccagtaagattagaggttttatataagataaagccagaacttgaaacatatttaatagatagacttaatataaaaaaggagcaagtatttaaatgtaagtctccactagatatgtcttttgtattttctataatagataaaataccagtacatataaaaaagaaaattacatatgaagactttgcaccacaaattcctcttggaattaataataatgaaagtatt

SEQ ID NO: 1343 - DNA, 399 bp, Clostridium sp.
atggttatgacagatcctatagcagatttgctaactcgtataagaaatgcaaatgctgtgagacacgaagtagtagaggtaccttcttcaaatgttaagaaggatattgtaaatatattattacaagaaggatacatcaaagaaatagaagaatataacgatggtgttgtaccaatgttaagaataactcttaagtatggtgcaggaaaagaaagagttataactggtataaagagaatatctaagccaggtttaagagtttattgtaagaaggatgaaactccaaaggttcttaatggactaggaattgctttaatatcaacttctaaaggacttatggttgatagagaagctagaaagttaggattaggtggagaagtagtttgttacgtttggtaa

SEQ ID NO: 1344 - DNA, 699 bp, Clostridium sp.
atgaaaaaagtaagtaataaacaaatgtcagaatcattaaaaattggagttatattagcaattactggaggctttttagatgcatatacctttctctcaaggggaaaggtctttgctaatgcccaaactggaaacattgtacttttaggaacaaatttatttcaaggggaatataaaaaagcattaacttatttaattcctgtttcttcatttatagttggagtatttatttctgagtttataaaacttaagtttaaaaataacgagaaaattcattggagacaaattattgtttttatagaaatattccttttagttttagttgcttttatgcctgaaaatttaaataaccttgcaaatattatagtttcttttatatgtgcaatgcaggttgaaagttttagaaaaataaatggtatttcctgtgcaacaactatgtgtactggaaatttaagaagtggaactgaattattatttaaatacataaaaacaaaagaacctgatttaaaagaaaaatgtataaattattatggaatagatttattatttattttaggtgcagggcttggtgctttatttacaaatacctttaaagaaaaagcagtactcttttgctgtgtaactctttttattggttttattgtaatgtttataaaagaagatattcttatatttaaaagtaaggaaactgaaaaataa

SEQ ID NO: 1345 - DNA, 693 bp, Clostridium sp.
atgtttaaaagcaagaaaggcaatgtgaaaaattcacaagatgatgattttcaattagatatggaaagaattccagagcatattggaattattatggatggaaatggaagatgggcaaaagctaaaggatatccaagaacaataggtcataaagcaggagttgaaactataagaagagttcttaaagaagctgaaaggcttggagtaaaatacttaacactatatgccttctcaactgaaaattggaaaagacctaaagaggaagttggagctttaatgaaacttttagttcaatattttagatcagagcttaatgaacttcatgaaaatggggttgttgttaacactattggagatatatctaaattaccaaaggaatgtatacaagaaatagaaagagccaaggaaaaaacaaaaaataatactggagtagttatgaatttagctttaaattatggaggaagagatgaaatagtaagagctgtaaaatatctagcaaaagacgcaatagaaggaaaaatattaccagaagaaatagatgaaaaatctatagaaagatatttatacactgcaaaaatgccagatccagatatgataataagaccttcaggggaacaaaggcttagtaacttccttttatggcaatgtgcctattcagaattttggtattcagatataaattggccagatttt

SEQ ID NO: 1346 - DNA, 708 bp, Clostridium sp.
atggtaaataaaatttcaaaatttattcaaagattttacttaattataatatttgcttttctctacactccaattataaccttaatgatattttcatttaataattcaaagtcaatggctcattggaatggctttactttaaaatggtatgagaaattatttcataatgatgggttaatggaagctttatattatactttgcttattgcagttttagcttctgtaattgcaactattataggtacaattactgcaataggaattcataatatgaaaaaaggaagctttaaaaaacttcttcttaatgtaaattatcttccaatattaaatccagatatagtaactggtatatctttaatgtgtttatttttatttgtaggattagattttggatttttaacaatgcttttagcacatataacttttaacattccttatgtaattttatctgtccttccaaagttaagacaacttcctgcaaatactacagaagctgcattagaccttggagctactcctttttatgctttaagaaaaataatattacctcaaattgcacctggaatattttctggacttcttatggcatttactatgtctatagatgactttgctatttcattctttacaacaggtcctggagttacaaatttatctatagaaatttactctatggcaagaagaggaataaaaccagaaattaatgca

SEQ ID NO: 1347 - DNA, 606 bp, Clostridium sp.
ggtggtatttgtattcataatggccaagagatacaaattcatgcaaaatgtacaatccttgcaacaggtggcttaggaggactttttaaatctactactaactttccatttttaactggtgatggtattgctatagctcttaaacataatgttgctattaaagatataaactatttacaactacaccctacagttctttatgaaccagattgtattggaaaaagacttcttctttcagaatctttaagaggtgaaggtggaaagcttaaaaacttagataatgaggaatttgtagattcattaaaacctagagatgttgtttctaaagcaattttagaagaaattaaaaaacatccagataagccatatgtttatttagacttaactcatttagataaaaacttcttaatgaatagattcccattcctttataatgcttgtgcagaaagaggatattacatggaaaaagaccttcttcctgtatctcctgctcaccactatgctatgggtggaatcaaaattaatttatatggtgaaacaagcctaaattcattatatgccctaggagaagctgcttgcacaggagttcatggaaacaatagactt

SEQ ID NO: 1348 - DNA, 933 bp, Clostridium sp.
atgagaaaaattttatttttagagccagtgtttaaagaagttatttggggtggcaataagcttgccaatgattatggatataaaattccaagtgatacaacaggagaatgttgggctgtaagtgctcataaatctggagattgtacatttaaaaatgaggaacttaaaggaaaaactttaagctggttatgggataatcatagagaagtttttggaaatgctaaaggagatatttttcctttattaataaaaataatagatgcaaaaaaagatttaagtatacaagttcatccaaatgatgaatatgcaaaggctaatgaaaatggagctcttggaaaaactgaatgttggtacattttagattgtgaagaaggtgctactataattataggtcataatgcaaaatcaaaggaagaattaaaacaaatgatagaagaaaaaagatggaaggatttaataagagagattcctattaaaaagggagatttttttcaaatcactccaggaacagtacatgcaataaagggtggtacagtaattttagaaactcaacaaaatagtgatattacttatcgtctttatgattatgaccgtctttcaaatggaaaaccaagagaacttcacattaaaaaaagtattgatgttataaaatgcccttacatagaagaaaaacaagattttaaaatcataaaaaaggataattatgatgaaaaagaccttgttaagtgtgaattttatgaagttaaaaaaatagatatacatggagaagaaacttttattcaaaataaaccttttgaaattgtaagtgtaattgaaggaaaaggatttattaatgattttgaaataaaaaaaggagatcattttattataccttttaattatggagaatataaacttaaaggaaatatggaacttataatttcaaatatttaa

SEQ ID NO: 1349 - DNA, 948 bp, Clostridium sp.
atgtcattttcagcgaaggtaaaaggagagttaggtagatatacagaaatgagcagagaagaggccttagctcaaatttcagctatgatgaaagtaagtggaactataggatttaatggaaaagggttatcttttaagataactacagaaaatcctacaagtgcaagacttgtatttacacttttaaaagaacactttcaaatacattcaaaacttatggttaaaaagagtaattctttaaaaaagaataatatttatatggttgttattgacgaagaaatgggagttagagggcttcttaaagacacaggaatatttaaagaagttgatggtggaattactcttgattatagaattgatgaaaaaatggtagaaacagatgatgaaaaaagggcatatataagaggtgcctttttaggtggaggaagtgtaacaaatcctgaaaaaaactatcatcttgaatttgttactcatagtgaagaatatgcacaggatttgtgtgaattaattaatagttgtggattaaattctaaggttattcaaagaaagaattcttttattgtttatataaaagaaggagagcaaattgtggatatattaaacataatgggagctcattcttgtcttttagaacttgaaaacataagaattatgaaagagatgcgaaataatgtaaatagacttgtaaattgtgaaacagctaatctttctaaaactgttaatgcagcagtaagacaagttgaaagtattaaatttattcaatctaaaataggactaaaaagacttcctcaaaatcttagagaaattgcagaacttagacttgaatatcctgatgaatctttaaaggaattaggtgaaatgcttgatcctccagttggaaaatctggagttaatcatagattaagaaaaattgaaaaaatagcagaagaattaagaagtgaaatttaa

SEQ ID NO: 1350 - DNA, 834 bp, Clostridium sp.
atgaataataaaataggctttttaagagaaaactttagattatttcatttaatagataaaaggactttagaatttaatcttcactatcataattttaataaaataattatatttatttcaggaaatgttacctaccatattgaaggtaaatcttatattttaaaaccttgggatatccttttaataaataagggggatgtacataagcctataattgatttttcttccacttatgaaagaattattctttggattgatacaaattttattgaaaagcatatatatgataattgtaatttaaatacttgttttgagctttcaaaagaaaagaaatttagtttagttagattaaatgaagatttaaaaactaatcttatatctataatttcaaatttagaaaaagctactaaagataatcattttggaaatacaattttaagtaattctctcttttttcaacttttagtatatataaatagaatctatatagaaaataaatatttaacagaaaaaaactcctataaatatgattcaaccattgaagaaattataaattatataaatagaaatttaagtaaagatttatcaattgatactttatcatcaaagtattttataagtaaatattatcttatgagaaagtttaaagaaaatacaggaatgactcttcataattatatacttcaaaaaagacttttgtatggaagggatttaatacaaaatggaacccctattacaaaagcctcaattgaatgtggttttaatgattattcaagttttttaagagcctttaaaaaccattttaaatgctctccaaaatattttagcaattaa

SEQ ID NO: 1351 - DNA, 549 bp, Cloacibacillus porcorum
gccggagcggatgacgatataacccccgacgccgctcagcttgcgcaggctactgagagcgagtcctgtgccgatgaagctccggaagaaaaaaatgaagatatcgagattgaaaaagagatagaggccgcctcggaaacagaggacggggccgaagcatgtgacgaaggcaccgtggaaaacagaaatcttcccgtagtagactcacagaagaacgacagaggacagatacgccaccagcatcccaaacttggattcaaccaactcgcgggacagactctcgcagagctgcgcaagattgcgaaagagatcggcgtgacctcgataacgacacgccgcaaggacgatctgatcaacgatatcctgaagacgcaggctgaagccctcggctaccgcttcaacggcggcacccttgagtgcatgagcgagggatacggcttcctgcgcccctccggacttctcccgagcagcaacgatatctatgtatcggcctcgcagataagacgtttcggcctgcgcaacggcgatgtggtctggggcatcatccgc

SEQ ID NO: 1352 - DNA, 978 bp, Cloacibacillus porcorum
atggatcgcgcactgcttctttttgaagacaaatttccctgctgggatgaggagacctttgcccttgtcggagagaatgtttcctctctgtcggaacttgccggagacggcctgttggttaaggacggcgaaggctatgtccttacagaaaagggagaaaaaagacgtcaggagtgcgcgaagctccattatctttccgccctgccgattggtgaatttgacgctgaaaaggccctctggaacaaccgtctctaccttttgatggagagggcctttatcggccagttcggcataaaagaatattcggtcaacgaggcgctgccatctgtgccgaaattggcgcgggaggctctctggggaatcgaaaatggccgtgtcaaatacaggtggccggagtccccgctggtccgctccttttacgaggcttttcctaaatggggcgtggggacgagggggactacgcctcccggagaggccggaatgcgcagatggatggaggaaaacggcgccgaggccgacgaggtgcgcttcaacctcatattgagaagcaggtatgattttgagctctatcgcaaagaggctcatctccccgacgacctttactatatgaaggatgccgaccgcctcttcttcctgcgcgctgccggagacaactacgacgaaatatacgacgctataggaaagctgcacctctttctgctgggacagaggcgggtctatatccccggttatgccgacatcgattcgcagcagcaggaaaactggacgatggtcgtcatagccgctgataatgaaagggagcttgagggcgtatacgagcgcctttcgcacgacggcaggaatctaatcgatccggccaatccgctctttatcgtcggaacgagcatcgagcgcctgcgtttgcagcctaagcctgaatataccgtttacgactggttctgcgaccgcagcgtacacattgtcaggccggatgtataa

SEQ ID NO: 1353 - DNA, 1353 bp, Cloacibacillus porcorum
atgatgacgggtattcctttaattattgtctttgttctggcaatcattgtgatggtggcggcgatatcgaagtataagatacatcctttcctgtcgataatggcggtgtccctgatcttcggcgtgatcgccggaattccgctcaaggacatcccgggagtgatcggtgcgggattttccggaacattcaccagtatcggcatcgtgataatcttcggcgcgcttgtcgggaccctgcttgaaaagacgggggcggcgctcaagatggccgatgtggtggtaacgctggtggggaagaagaaccccgagctcgcgatcatcataatggggtggattgtctcaataccggttttctgcgacagcggatttgttgtgctcaacccgataagaaaggcgcttgtaaagaggacgggggcctccagcgtcgcgatgacggtggctctctcaatggggctttacatatcccactgcttcataccgccgacgccaggaccgatcgccgcggccaacgccctcggtatcggcgataacatcctgctggtcattgggctcggcgcgctgctctccattcctccgcttattgcagggtatctcttcgcgaaatatattggaaaacgtgtctcggcgcgcgacgataacgccgacatggatctggtgaagagctacgaggagcttatcgctgaatatggcaggctcccgagcggcgtgatgtcgtttgccccgataatcgttcctatcttcctcatgggactggcctcggccttctcgatggcgaaggtgagcatctccgccattatcttcctcggcaccccgatcatcgcgcttgcggtcggcgtcatcctcggcgtaatcctgctggtccagtccggcaaggcgaaggacttctacgagatcacgaacgacaccctgaagaccgtcggcccgatacttttcattaccgccgccggcggcgtgctcggcaaggtgatcagcgtctcggggatggtgcagtacatcacggaaaattccagcgtcctttcgacgatcggcatattcttccccttcgtgctggccgcgatactgaaaacggcgcagggctcctctacggtggcgatcaccactaccgcgggtatgctcgcccccgtacttcccgcgctggggctcaacacaccgtcgctctcggccctctgcgttatcgcgatcggcgcgggagcgatgacggtctcgcacgcgaacgactcctatttctgggtcgtcacgaatttcggtgagatggagacggagcagggctacaagacccagacaatgggtaccctgataatcggcctcgcctcgatggtcggcgtattcatcgcctatctggtgctgaaataa

SEQ ID NO: 1354 - DNA, 825 bp, Cloacibacillus porcorum
atgagccttctgacggtctttaccgccatgtccgtctttttcgtgatcggggcgacgatgctctttatcctcaacataagaaatgtgatcggcacgatggaaaatcagctctcaatacaggcctacatgaagcctgacaccgaccttgaggctgcctcaaagagaataaaagcgatgcgcaacgtaaaaagtgtaaaaataatcaccaaagaaactgccctggaacgactgcgcgcacgtcttggaaaccaggcgaacgcggtaacgctgctaggttccaaccccctgcccgcgagcattgaggtgcgcgtgagccgcgccgccgaggtctcggagaccgcccgcatgctgatggcgatccccgatgtggacgatatagtatacgcgggacatgttgcggagaagctgacgcgcctttcgaccttcgttgagcgcttttctttagtgatgctcatcgtcgcgctggcagctagcggcgtggtcctcttcaacactatcaggatagcggtctactcgcgcgccgaggagatagacgtgatgatgaaggttggagcgacctccacctacgtcgcctttccctttgtcatccaggggttcatcctggggctgactggcgcgcttgtcgcctcagcggctctgggatattcctacttcagcgcagtggcccgcctgaaagatatgctgccgtttctctcatttattgaatcgccgcggcttctcgcgaagctgagcctcgtgcttatctgctgcgggacggtggtgagcctcttcgcgagccttatcgctgtggagaaatttatcaggaaggcggccaagccgctttaa

SEQ ID NO: 1355 - DNA, 669 bp, Cloacibacillus porcorum
atgcggatgagatcagatacgcccaacaacctggtaaacgacatttatatttccctcaagcaggacatcctctggctgcggctcaagccgaagactatgctgacggaaacctatctggccgagatatacaagaccagcaagacgccgatacgggaggcgctgtcaatgctcgtgcgcgacgaactcgtaagcgtctttccgcgcaaggggtacatggtcaccgacgtctctatgagcgatatgcgcgacatgcaccagtaccgctacatactggaaaacgccaacctcgtccacgccgtgaagtacgccaccaaagaacagctcgcccaccttgacgagctcgcggagatggacagttattatacggaggacgatccgcacttttccaaagaggtggtctgcaacaacgcctttcatttttatctcgcggagatgaccggcaaccgtatccttctcaaacagctgaccgacactctggaaaaattgcagcgcataatgtactttgtcgcggagaaagattacatgttccgcggctgcgaggaacatcatcagcttgtgcggcacatcgccgacaaggagctggaaaaggcgcagatcatcctccaccaccatataagcgaggtgctggaacacatctcgaagatgcgcggcatctccaaactattctaa

SEQ ID NO: 1356 - DNA, 984 bp, Cloacibacillus porcorum
gatatggcgaagatcgagagcggcgagttcgcgctttatccctcgcgctatgaatataaggagttcgcgggcgcgatcgacgcgatgatacgccccctctgccgccagaagggcgtcgagttcgtctttgacagcaagtggcccgttgccgccgtgtgggttgacaaggtgcgcctgaatcagatatttctcaatctcctctcaaacgccgtgaagttcacgcccaccggcggcagggtggaatacctgatgccggaggcggaggtccgcggagaccgtatatgctgtgactttatcgtcagggataacggtatcgggatgagcgaggagttccagaggcatctcttcgagccttttgtgcaggagaacgccgccgagggcgggaactgcggcacggggctggggctcgcgatctccaagagcatcgttgataagatgggcggctgctttgagataaggagcgaagagggtaagggcactgagattctgctgcatctggagctggagatcgcgggtgatgagagaccggccgcggcgcagacggaatgcgcggcccgcggcggcgtgaaggcgcttaagggacgccgtgtgctgctcgcggaggatcatcctctcaacactgagatagcccgcaaattgctggcgaaggtggggacgaccgttatctccgccgccaacggagtgatcgccgtcaagactttcaccgcttcacccgtgggttattttgacgccgtgctgatggatatccgtatgccggagatggacggcctgacggcggcgcgaaagatccgagagctgccgcgcgcggacgcgaaggtggtgccgatcatcgcgatgacggcgaacgcctttgacgacgaccgccggaagtccgaagaggccggcatgaacggccatctggcaaagccgatagagcccgagctgctttacagtacgctggccggggcggtctcgcccctggaaaagccggatgcggaaatgtaa

SEQ ID NO: 1357 - DNA, 723 bp, Cloacibacillus porcorum
atgaagacagtagaagagaatgtcaatcctttggaattccctatcctgcatatgatgcgtgatgccgggtcgccgttgggggcgggcgcgatcggcgaggttttggagagtcagggcatctcgataagcgaagccggcattggcagggcgctccgctcttttcgccaaagggggctgcttgaacgccgtggattccaggggcatgtcataactgatacgggcattgaaagactcgcggatcttgaagcggctaaaaggtacggagagacgctgaaaaagttgatggaaaagggcctcacgcaaaactataacgtcgtcgatatcctgacggcgagacgcgccctcgaacgtgaggcggcctatctggcggcgctcaaggctacgccggaggatatcgccgagctggaaaatatagttaaggcccagtacagcgggatggagaaaaacgagaattacgcggaccattccgcggccttccacaagacgatcatgaagatggcccgcagctcgatactcagcaacctttatgacctgataggcctctcggtccagtggcaggacttttttatcgggacattcaaaatgtataaccagcccgtcaacgtatcacatgagaaggtcctgcaggcgataaaggaccgcgatcccgagagggcttcgatgctgatgggaaaacacctcaccgacgtcgttgataacgccaaaaagctttatctggagtga

SEQ ID NO: 1358 - DNA, 699 bp, Cloacibacillus porcorum
tcggtagacagcaggggccgcgagcgcccggaggagccatgcgcgatacgcacctgttttcagcgcgacagagaccggataatacactgcaaatcattccgccgccttaaatacaaaacgcaggtactgctgctgccggagggagaccactaccgcacacggctcacccatacccttgaggtatcgcagatcgcgcgtaccatatcgcgcgcgctgcgcctcaacgaagacctcacggaagccatcgcgctggggcatgaccttggacatacccccttcggacacatgggcgaaacggtgcttgacaggcttgcgaagcaaaacggcctgccaggattccaccacgcggcacaaagcctgcgggtcgtcgaccatattgagaaagatggccgtgggctcaatctcagctgggaggtgcgtatgggcatcatccagcactccaagggacaggtggacgtccgttccggctatgacctaaccaatcctacgacaatggaggcctgggtcgtccgtgtctccgactctctggcctaccttaaccacgacattgacgacgccctgcgcgccagcctcatagcggatgacgagatgacgcctgagatgcgggaggtaatctccataccgaactccaaaagaataaacggcatgatcatggatgtgatagaaaacagcactccggaggcggtccgattcagcgac

SEQ ID NO: 1359 - DNA, 810 bp, Cloacibacillus porcorum
atggcttcagaaaataagaatcagaattttatcgaggagataataaccaaagaccttgaaaacggtacggtcaacgaggtggtcacgagattcccaccggagcctaacggctatctccacatcgggcacgcgaaatccatctgcctcaactttggcatggccgcgcagtttggcggcaggtgcaaccttcgctttgacgacacaaacccagcgaaagaggagacggagtatgtcgaggcgatcatggaggacgtcaagtggctgggtttcgagtgggccgagctgcgctacgcctccgactattttgaacagttttataagtgggcgctcgacctcataaaggccggcaaagcctatgtcgacgaccagaacgcggaggagatacgcgccaaccgcggcacgcttacgaagcccggagccaactcgccttacagagaccgcagtgtggaagagaaccttgaactcttcgcaaagatgacggcgggagaatttgaagagggcagccacgtcctgcgcgcgaagatcgacatggcgagcagcaacctgaatctgcgcgaccccgttatctaccgcattctcaaacgcgagcaccaccgtacgggcgctaaatggtgcgtctacccgatgtacgactttgctcacggctacgaggacgccatcgagggcgtcacccattccatctgcacccttgaattccaggacccccggccactctacgactggttcatcgccaacgtggacgttccgcatgtgccgcaccagtatgaatttgcgcgtctcaacctcacctacacggtgatgagcaaacgc

SEQ ID NO: 1360 - DNA, 690 bp, Cloacibacillus porcorum
gtggcaataaaactggatgcggagctggatatagcgccaagcagcaccctgagggcggaggtcgccaatctgctgcgcaagcagatactcgacggagacatccccagcggcgagcggctgatagagacggagatagccgaccagcttggcgtgagccgcatgcccgtacgcgaagcgctgagaatgcttgagagcgaggggctcatcaaccagataccgcgcaagggacttatcgtcgccgaatatacggaaaacgacatccgcgaatactatacgatacgcgaagcgctcgaggtctgcgcgataaagatagtgatcgataaaatctcaaaagaagagctcgaagagcttaagatgtactgccgcaaagccgaggaggcccataccgcgggcgacatcgagatggtctgccgctggacggcgaagttcaacgaacgcatctatgacagctgcgagatgccgcggctcaaggaacagataaaaacaacgcagaagtatctgcgcaccttccgcttcacctcttttaaggaggcctcgcgtaccgaacaggcgcttaaagaacatgccgagataatccgcctcgtggagaaaaaagactacgaaggcgcggcgcacgccacctccgtacacctgcgcgatgcgatgcgcgcctatctcaagctttggaaacagagaaagggacgcatatag

SEQ ID NO: 1361 - DNA, 840 bp, Cloacibacillus porcorum
atgatggcggcgacgatcgaaagttactataacattacggaaaagaaagacaggcttcgcgccttttacaataaatacggcgggaaggcgctgtttatcgtaccctccggcctcgaccgggatgcgctgctcgacatcatctgcggcggcgacccctatttcggagaccgcccgacggtctggaccgtaggcgacctgtataaagatctgcagcgtatcaccggctcatctgtgcgggtcatcgacccgccagaccacaacctgattctgcgctggctgctggaagaatttctctccgagatggagagggagggcgtcgcgctggctcccggcctctaccataaagggtttgtcacagttctgggggacaacataaaggagctgctcgccgaggaggtctcctgcgaagggctttcgcaggcgctctttgacgaggaggaacccgatccggcgctgcccgaggcggtccttatcactttatatgaacggtatacggactatcttgcggagtacggcctcgccgacgcggcgcagattgccactctgacgcggctgaagctgaacgcgccggaggcgctggaattcgtcgccggtaaaaagctggtgctcgccggtttcctctccttcacgggggcgcagctgaaacttgtccgcgcgctctgcgatatcgccgaggtgctgatgctgcagcccgaaacggggctggacggtttccatgacggtatcagccagctggggagcgaatattacgggcgtcccgagtggaacgttcccatcgtgaagctcgaagcgagcaacgcctatctcgagctggaggcgctggcgcgcgagacggcgctc

SEQ ID NO: 1362 - DNA, 1125 bp, Cloacibacillus porcorum
atggcaaaagatctcgtatccttccagctggtcaagtttctcgaatcacgcggcgtggaaaatatcttcggtctctgcggccacacggtgatcggtttccttgacgccctcaaggacagcaatatccgctacatctcggtgcgccatgagcagatcgcggcgcacgccgccgacggctatgcccgcggcaaggactgccgggttcccggcgtcctcatgacgcatctcggccccggacttacgaacgccaccaccggtgtcgctgaggctggcctcaactcgattccgatggtcgtcatcgctggcgacgtgccctcctgctacttcggccgccatccccatcaggaggtcaatatgcacgccgacgcaagccagtatgagatataccgtccctttgtgaagcgcgcctggcgcgtcgaccgcccggagcttcttcccgaggtgatggacaaggccttccgcctcgccgtcaccggacgtcccggcccggtcctcgtctcgattccgatggacatcttctcgatggagcttgacacacgcttcttcgaacagcgcatgaacaacttccccgagctcccgaagcccggcctctcggaggccgccgcggaggagatcgcgacgatgctcgcggaggccaagaccccgatcctctatcccggaggcggcgttatctcctccggagccgcaaaggcgctcaccgagcttgccgagcatcttgagatccccgtgctctatacgcttatgggcaagggctcgatccccgatgacagccccctcgccgtcggtatgaccggcttctggggtacggagttcaacaacacgacggcgatgaaggccgacgttatgatggcggtcggcacgcgtctctcggaggcggactgcagctcatggtatatgggcgagacctttgacgtgcccccgacgaagctgatccacatagacatcaaccaggaggagatcgggcgcaacttcccgaccgccatcggtgcgatctgcgacgcgaaggaggcccttgaggcgatcctcgcggcggctaagaggaagtaccccaacggcgtgaaacgtcccgagatcgtcaaggcgatcgccgaggcaaaggcagcctataaggcgacgctcgtcgag

SEQ ID NO: 1363 - DNA, 1077 bp, Cloacibacillus porcorum
atgaaaaagacaaatatctgcttgttgttcatgttttgtgccgttattttctccgctcttcccgccaacgccgcggagatcattgaaagtttccgcagcacgatagcgatccgtgaggacagctcccttgaggtcaaggagaagctgttggtaaatattgagcataagagtataaagcgcggcatcatccgtaacttcccgataaggtataaggacaggagcgggcgctccttcgatgtcggctttgacgtggagtccgtcaagcttgacggcgaagacatcccctacaatatctcttatgacggcgcttacgcctatgtgaagatcggcgacccaaactcgatgataccgctggggctccatacttttacgataaagtatacgacgacgcgtcaggtgggtttctttgaaaattacgacgaactttactggaacgtcaccggcaacggctggtcatggccgataatgacggccgcctgcagcgtctctctgccgcaaaaatacgcgggcgaaccatttcgttcaatagaatggtacgtcggaggctacggtgagcgcggagttaaggaagacgccaagctggccgataggaatacggtggtcacgacgcacccgctgtcgcctggagaggggctcaccgtcgtatatacgtggaagaaagggctcatctccccgccgccgtcaccgttcggagacgaacgcaggcagagctggatcgccttcgcgactttagccttttcctgcgcgtggttcgcctttgcagtcctaaaacgcaggggcggaggggaaccaccggcggtgatcccacgtttctatccgccgaaggattcttctcccgccttcgttcgctatataaaggagatgaaggtcgatcgcgtctcaatgacggcaaatatcatcgggctggcggtcaaaggggcgctgaagattgaggagagcgacgaaccgccctcgttctttgggcataaacataatatcttcacgctcgtgaagaaaaacagcaatgtcgaactgacacgagacgaggacgcgatgatgatgcggctcttccccggagaccgggagagcatcacgctg

SEQ ID NO: 1364 - DNA, 1140 bp, Cloacibacillus porcorum
atgatgctcgccgaccagggagcggaggtcattaaggtcgaacgccccggaagcggagacaccgcgcgcgagatggcgccgatgctcaagaatgacaaaggagaggcgcagagcggatacttcgcgcgcttcaaccgcagcaaaaagagcgtgacgatcgatatgcagtcgccggaaggacaggccgttctctgggaccttatcaaagataccgaaataataatcgagaacgtgaagccgggtctgatggacaagctgggcttcacctacgagaagatcaaagaggtcaatcccggcgtcatctacgtagccatcagcggcttcggacgttcaaagaagtacgaggggccctatgcgaagcgtctagcctatgacatcatcgcccaggcgatggcgggactcatgcacacctgcggcagcgatccccagggaccgccgacctggctcggcttcgccctcggtgactccggcaccggcgtctacgcggcttatgcggcgatgctcggatacatcaacaagctgcgtaccggcaagggtgaatacttcgacgtttcgatgtacgactgcatggttgccctcgccgagcgttcgcataacgtttacgccttcaccggcaacgtcgtgtcgcgcggcccggacaagcttatcgccccctggggccccttcaagtgcaaggacggctacgtggcgatcatcgtccccacggagtcgatgtggaagaagttcctcaccgccatcggccacctggagctgctcgacaaccccgacattcagtccggtcccggacgcggcgctcatatggagacccttatccgtccggtcatcaacgaatggcttgccgataagacgaagatagaggcctgcgagatattcatggcccagggacttccctgcggaccggtacagaacgccgaggacgtcgcccatgacgagcacaccaaaaagcgcgagatgctcgttaaaatacccgatcccgtcgtcggagagctcaccgtcgtcggctgcccgatcaagatggaagagcatgagacatcctaccgcgcgctgccggatcttggcgccgatacggacgaagtgctgaaaaaacttggatactcggacgagcgcatcgccgagctgcacgacaaaaaggtcatataa

SEQ ID NO: 1365 - DNA, 1569 bp, Cloacibacillus porcorum
atgaaagggagataccttatgaggaataacctgcgaacgctgtttttatctgtaatgatcctcttattctgttccgtcgcctacggagccgactatgtggagaacgaggtcattgtgcttacacgcgactcgaatatgaccggctcagccttgagcgccgcggctagagagggctccgcggcgaaggccgcggcgcttgcgaagagcgtgggcgcggtttcacggaggagctatccagcgctgaccgccggaagcggacggagcatcgtccttctatcttcgcagacgaagacggcggacgaattgattttgtcgctcaaggggaaccccgacgtgatcggcgtaatgaaaaactacaggatgaaggcgcttggcaaaacgccggatgacgcgctgtggaacaggcagtgggggcctaagcggataaaggcgccggaggtgtgggagaatgcctcggtaggttccgaggatgtgtatgtcgcggtgctcgatacgggagctatctacgatcatccagacctcgcggctaacatcagcggcatactgccggatggtacatatggaaaaatgtttcacagcaacgggagcgtcactaagattgtcagaagcggaacgccctcttgcgacgtcacgatcaaaggtccgcgcgaggttgattatgcgacggtcggcgacgttggcggtcacggcacgcatgtatccgggatcatcggcgcggtgggaaacaacgaaataggcgtaacgggcgtcaactggagggtgaaaatactgccggtgggagttttcaccgtgggggagctatgcgataaagataacaaaaaatcttttgccacggctgctattgttgccgataccattggggcgctcaactatatagtgacgcttaaaaggatttacggcctcaatatccgtgtcgcgaatatgtctataggcagctggaaggaaattgtggaccaggatactaatccgtacgcgcagtcgataaaactggtaagcgacgccgggataatcgtctgtatggcggcggggaacgaagatcaggacatagataaccccataaattccgattacgagggaatgcggccttatcccgcctgcttccggtttgaaaatacgataacagtcggtgcttcgaacgagcatgacggattggggataacttctggttccaattacagctccagcggcaaatgggtggatatcatggcccccggcgacaatataatgagcacgacccccatgtacagctacgccggcagcagggaatataacagaaccggatacgacagctggagcggcacctcgatggcgactccgatggtggcgggcgcggcggcgctgctttgcgccgtctatcccgataaatccgcgaacgagataaaaatgatgctgatgagtggcgcggaaaacgtgctgcgtaagggctattcaaaatatggcctgctgaatgtatataacgccagccggactagtagcggaggttccggtggcggcggctgttctgccggctttgcgctgctcgcgctgatagctttagtaccgctcgccgcctggaaacgaaaaaagtaa

SEQ ID NO: 1366 - DNA, 663 bp, Cloacibacillus porcorum
aagaacccgcagtattttgttgaaaaccagcgtcacggcaagaacatccacgacagcctgccgccgacgctctccgggcagctgctgatatcgcatgtgaaggaggggcttgacatcgccgcgcagaccaacctgccaaagtccctgcgccgcttcatcagcgaacatcacggcaccacctcgcagaggtatttctacgaaaaggcgaaggcgctcggcgagaatgtcaccgaggcccagttccgctatccggggccgcggccgcagtcgcgcgagacggcgctcgtaatgcttgccgattccgtggaggccgcggtcaaggcgcgcaacaagccttttgagaataacagggagctttcagacttcataaatcaggtcattcgcagtaagatcgagagcaatcaactcaacgacgttgactttacgatgaaggagatgtcgctgatcacggaggccttcatggaggtattccaggcgacctaccattcccgcgaggtaaagaatatcaacgagataatcaaagaggccaagctcaagggcggagaacataaagagatgcccgccggcacgatcgaaaccgccgtcgttcctgtcgccgatatcggcgagacagagaaaaaagaggaggatgaaaaggatgaaaaccacgatacactgcggtga

SEQ ID NO: 1367 - DNA, 1422 bp, Cloacibacillus porcorum
gggctggcacagggccaccgggggatgtcctattctcttcccagccgtgaggtgatcgccgactcgatagagataatgctgaaggctcactgtttcgacggggcggtattcctcggcagctgcgacaagataattcccggcatgctgatggctgcgcttcgtgtcaacatcccctcgatctttgtacagagcggccccatgcagaacggctgctacaaggggcagaagctatccatgccctcgctgcgcgagtatacgggaaagtacttcgaggctgagatcaccagggcggagctggaaaagatcgaaagatgcacgatgcccacgcagggcagctgcgcgatgctgggaacggcaaactcgatgagctgcgtcgttgaaacgctggggctgggcctgccgatgacggcgacgaccccgccatttacctcgcagaaacggcaggaggcggttacggcgggcagaataatcgtcggtttgacgcgtgagggaaggcggcctcgggactatgtcaataaaaattccatagaaaacgccctgaaggttggcttcgctatcggctcttcgacaaacctcgtactgcatatgagcgagatagcgagagaggccggcatcgacatctccctcgctgagatggacgagataagcgccgccaccccctacatatcaaaggtgcatccctccggcacggtccccttcaacgaccttaacgcggccggtggtgtgcccgcgatcctgcagtcgctgggagacctgctgcacggcgaagagcgcaccgtgagcggaaagagcataaaggagatcgcggaggccgccgactgggaggataagaatatcatccgtccacgtgaaaatccctttcacagcagcggttcgttaaaggtcctctggggcagtctggcaccagacggcgcggtggtgaagcagtccggcgtagcggaaaatatgcgcgtacatcgggggccggccgtcgtctttgaaaacatggaagaggcggtggaggccgtcgaacacggtcggatagagaggggctccgtcgtcgtgattcgcaacgaaggccccatcggcggtcccggcatgagagagatgcagctggtgacgacgctaatggtgggtacggggctatctgacacgacggccctggtcacggacgggcggttttccggggcgacgaggggcccctgcatcggacacatatccccggaggcggctctcggcggccctatcgcctatgtccgcgatggagatataatatcaattgatttgaacaaagggacgctggatatagaggttgacggggacgaactgcggcagagggcctccgcgtccgcgcgcaaaagccgccctgccgccgacggcgtattgggaagcttcgttgaacattatctgagaaaaagtgaggagaaagaaagatgcctatag

SEQ ID NO: 1368 - DNA, 885 bp, Cloacibacillus porcorum
atgaaaaataactacacacgcggcgtgatgatggctctgggcaccgccgtgctatggggcggtatgagcccgctcgcgaagtttatcggtacgcagggggtcagcatggtctcggtaatgtgttaccgtgcggtgctcgtcgtgatcctgatgtccctctacctcagatacagcctcgggccggggtggtacaggatcggacgcagcctcatgcgcacctatgtttttctcggctttctgacggtggtgatgaacgcctgcggctttatggtctcctgcttttacctcaccgtgccccaggcgcttatgctgcactataccttcccgctggtgacgatggccggttcatacttcataacgcatgaaaagccctccaagatgcagatagccgcgggcttcatgatcgttggcggcctctatgtcggatttatggggcaggagggcggcatgttctccgtctcgcctgccggtctgctgtgggcgcttgcctcgctgatcggcctctccgggcagacgctcgtctcccgccggatactgatgggcggcgcgacgaacccgctgatacagctcttttacgtgcatcttttcggcggcgcgatgctcatcgccggaaagtccgtgctgatgggctggggcgacctcagggcaatcgacggggccgtattcgcgctgatgcagtactcggcgctcggcgcggggctgctgggcttcggattcatgttcaacgcgctgaaacgcatccccgcctcgctggtcagcctcatatgcacgcttgagctggtcttcgcgctcatcataacgccgctcgtcctcggcctctatcccactgggtacgagcttgctggctgcgcgataataatggccgcggtggcctgcgcgacggta

SEQ ID NO: 1369 - DNA, 1137 bp, Cloacibacillus porcorum
gtgaatgagaataaatatctgcttctgacgccggggccgcttacgaccaccgccggtgtgaaggaggccatgcttcgcgactggtgcacctgggacagggattataacgacgtcgtggaggagctgcggcgcgggcttgtggagatggcgctgcgtgaccgcgccgaatgcgccaattatacctccgtgctgatgcagggcagcggtacctttgccgtggagtcggtgatcggcagcgtgattccgcggggcggcaaattggcggtgctctcgaacggcgcctacggcaggaggatagcggagatcgcgggaattttgaagataccagccgtcgagctgcgttttgacgaatgcgagcgccccgacgcggcgatgctgtccgagatgctggcggacgatccggcggggacgcatatcgcggggggtcactgcgagaccacgaccggtatcctgaacgacatcgagagcgttggccgcgtcgcgaagagctgcggtaaaaagtttatcgttgacgcgatgagcagcttcggcggcatttcgctctatatggacgaccttgacatagattttctgatcagcagcgccaataagtgtatcgagggcgtgcccggcttcgccttcgtcatcgcgaagcgcgcggagctggccgaatgcgggggacgcgcccgctccctttcgcttgacctctacagccagtggaagacgatggaggagcaccgcggcaagtggcgtttcacctcgccgacgcacgtcgtcgtcgccttcgcggaggcgatgcgcgaactcaaagaggagggcggcgtcgtcgcgcgcaatatgcgctataccgccaatcgggacatgctcatccgtggaatggaggagctgggtttccgggcgcttcttcccgatgagctgcgctcgccggtgataacctctttcctttacccggagggagtcggttttgattttactgacttctatgagtccctcaaacgggacggttatgtgatctaccccggaaagctctccgagcgcaacaccttccgcatcggaaacatcggggatatccgggaggagcagataacgggacttctcgccgccgtcgaaaggtacgtcaagcggctggaaaatgaagccccgtcgctctgcgcttag

SEQ ID NO: 1370 - DNA, 621 bp, Cloacibacillus porcorum
atggcggcggacctcacaattcctaataagacgctgcgcgaattcgcgcgccttgtggaagaggaagcggtaaatccgtgggagggtgagctcaaggtcggagtggaccttggcacggcgaacatccttgtctccgtcactgattccgcgggttgtccggtggccggcgtcagcacgccgtcatgcgtagtacgcgacggcatcgtggttgattacgtcggagccatccgtaccgtgcgctcgatgaaggcgaggcttgaggagaagctcggagtccggctgaccaaagcggcctgcgcgatccctcccggaatctcaccgggcaacaccaaggccatcggcaacgtggtggaggcggctgatttcgagcttacggcgataatcgacgaaccgacggcggccgccaccgtgctgggaataaaagagggcgcggtggtggacgtcggcggaggcacgactggcatcagcgtcatccgtaacggcgaggttgtgctcaccgccgacgaaccgaccggcggaacgcacatgacgctggtgctcgcaggcttccaccggacgacgaccgaagaggccgaatgcctcaagaaggaccccgcccaggaatccagcgtatttccggtc

SEQ ID NO: 1371 - DNA, 819 bp, Cloacibacillus porcorum
gtcgtcaacatctgtatgggttacttcggctggagccgcgcctatgcgctgataaacaaaacctccgacatgcttttgaacaccgccaacttcggcgcgcgccgcgagatatggctcacgagctggaatgtggtcaaggaacatccaatcgcgggcgtggggctcggccattataagtggcattacctcgacgggcagcgagatgccttcaaagaccatccggagatgaagtggcagtttacctactgggcccacaacgagtatctgcagtggatggcggaattcggcctcttcgggacgctgatcctgctgggggcggctctctggtggatatggagctttatccgcgcgctgacgcggaaaaaggatctctcctatgccgcgatgtggggctgcgccttcgtctatctgatttggttcgacgctatattcagccgtccgttccaccggatagagaatgtcatttggctgtcgctggcctttgcggtcgccaaccggcagctgctgcctctctcggctaaattcagcgagatcagccacggcttcatctatcggcttcttggattttttatggcggcggtcgccgtgatggggatgatcttcctctattcgggctgccgcgccgataagtatctgcgcgctgcctcgctgacgaacagcgcttctctgcagcgctaccgcatagacgaggcgcggcagagcctgatgggcagggacgaggcaaacgaacagctggcctatcatctgcttgccgtggcaaacgtcacgaagaagccggaggaccttgccgccggcatcgagcagctctatcggagcttt

SEQ ID NO: 1372 - DNA, 813 bp, Cloacibacillus porcorum
cctctgaaacatgaattcaaatggacgacggagcagaaacatcttatgggtcaggcgttgcttctaggacatttactggaatgttgttctcaggtaaccggaggtttttacgccgaccctggacacaaagacgtagaagggcttgaaagagtaggattccctatagctgaaatagacgaaaccggcgacttttttataaccaaggttgagggggccggtgggattgtgtgcgaaggcaactgccgagagcagctgctttatgagatatgcgatccgggatactatataacgcctgacggcatagccgatttttcacaggtgacatttaaaactatcggacctgataaggttcttgcgcaaaacgcatcctccaagggagaaccggtcaattataaagtgaatatcggctacagcgactgttatataggagaggcctctataagctttggagggagtagcgcgcttgcgcgggcggagctatgtgccgatatagtacgaaagcggttaaaaattataggagtggcgccggatgaattcagagtggacttcatcggatataattcgctttataaagactcgatatcaaggtttatcacaccggacgttcacagtgaaatacgcctccgtgtcagcgcgcggaccaaaacttttgaagatgcccaggcggtggcgcgtgaggtacaatgtatgtatatcaacggtccggctggcagttcaggcattgattatgacataagaaaggtactctctgtagataatattttagttcctagagaagatgtctcttggactgtaagttactgcgaggtgtaa

SEQ ID NO: 1373 - DNA, 933 bp, Cloacibacillus porcorum
aacacccgccgccacatcctcggcgccgaggccgtcctgccctccggcgaaataatcaatctcggcggccgtttccgcaaggacacctggggttacagcctcataaacctgctagccggcagcgaggggacccttgccgtcgtcaccaagctcatcgtcaacctggagcctaagccgggcaggacggtaaacctgctcgcctgctatccgacgctggaagagctcgtagagagcgtcgccaaggtgatcggctcgggcaagcgtatcatctcctgcgaatttatggacaaaaacctcgtcaaatacaccaccgaatacctcggctgcaccctgcccgaacaggacaggagcgagggctacctgctgatacaggtcgagggcgacacggaggcgcagcttgaagatgggtacgagaccgtcggtaagatctgcctcgactgcggcgccttcgaggtcttcgtcgccgaaagccgcaccgactcggcggcgatgtggaacgtgcgccagaacgggctggagggaatgcgcgcgcgcgatccgcacgcctgcgcctcgggcgacctcatggtgccgctctcctcagtgcccgagatgatacgcaggataaaagagataagcgccgaatggaacatcgagatcggcatcatctcgcacatcggcgacggcaacatccacccgataccgcttaaaccggcggatatgacccccgaacactgggcgcgctacgccgaggaattcttcaccgccctcatccgcgaggcgatctccctcggcggcgtcggcagcggcgagcacggcgtcggccacgtcaagcaaaaggtgctgatggacagcaaatcaccagcggagatagaactccttcagggcatcaaacgggcctttgacccgtacaacatcatgaaccccggcaagatgttctcgccgcttgactga

SEQ ID NO: 1374 - DNA, 927 bp, Cloacibacillus porcorum
gcacggatgccatggtggggcctcggacgcctcgcagacgaaatacgcggcctgatcgccccgtcgcttccagagacaaaaaaacttccctgcggcactgagcttcccttcggagagagaatgctgctgatggggatcataaacctcacggacgactcattcttcgccggaagcagaagcggcgcggagaccactgagaccgtaaaaagggcgctgcgcatggccgaagagggggccgacattctcgatctcggagcggaatccacgaggccgggagcgggaagggttcccgaagaacaggagatatcacgcatggaggcggcggtgagggcgatacgaaatgaacttccgcatatgcccctttcgatagataccacgcgctcctccgtagcgcgtgccgcgcttgccgcgggcgcggacataataaacgacgtttccgggctgcagttcgatgaggatatcgcgcgcgccgcggccgagtatggagcgatgctcgtcgttatgcatatgcgcggcaccccaggagatatgcagtcgatgtgcggatacgataatctcatcgccgaggtctgctctttcctccgggaaaaggcaaagagggccgaggagctgggcgtgccgaaaaaaaatattataatagatccgggcgtcgggttcgcaaaggactacaaccaaaacttgctgctgatgcgccactgcgaaagcttcaaagcccttggctatccgctgctggtcggagcctcgcgaaagggcgtcgtcggcgccgccacgcagacaaaaaaagcggaggagcggctctgcggcacgcttgccctgacctccgtctgctgttggcagcgtgcggacatcatccgcgtccacgatgtgaaagagaataaagaggtcatcatgatgacagaggcggtacggggagcaaaatatgtctga

SEQ ID NO: 1375 - DNA, 813 bp, Cloacibacillus porcorum
atgtgtgagaaacaatctaccttgagaacggcaagaatcaaggatatcgcagagcggctttttaaggccgaaactaccaaacagccgatcgctcccattcacgacgaattcccggaccttacactggaggaggcatatgccgtccagatggccgcggcggaaaataagctcgcctccggctggaaggtcgtcggcaaaaaggtcggactgaccaataaagaggttcaaaaacagcgcggaatccttgagccggactacggacatatcttcgaccataacatcatccccgagggagaccccatcagtatcgcgtcgctgatggtccatccggtcattgaagtcgagctggcctttgtcatgcgccgtgacctgatcggccccggcgtcaccgtagcgaaggcgtatcacgcggtggaggggatcctgccggcctttgagatagtggaacgccgtatgtatccgctctccaaaactatagaagaaagcgtatgcgacaacgccgcctgcgggaagatcgtcctcggaagcaagctcactcccatagaaaatcttaatttaaagagcatcggcgtctatttggagaagaatgggagcctgatcgacagcgcctgctgcgcgaccgttttagggacgcccatcatgtccgtcgcgtggctcgcaaataaactggcgcagttcggagtaggcctctatgagggcgaagtaataatgacaggttcgatatgcctcatgcatcccatcgcccccggtgagaattatcacgcggtattcagcgacaatatcggagatcttatggtctcgttcgtatcctga

SEQ ID NO: 1376 - DNA, 2568 bp, Parabacteroides distasonis
ttgcagtcgcaaataaatataataattgtggatcgtaaaacttacacttttgacgaagcgtttaaggcttcattggattactttaccggtgacgagctcgccgctaaagtatgggtaaataaatatgccttgaaggatgcgtttggaaatatctatgaggaatctccgaatgatatgcatcatcgcttggcaagtgagattgcccgtgtggaaaaaaagtatccgaatccgttgtcggaacaagaacttttcgacctgtttgatcatttccgctacatcgttccgcaaggaagtccgatgacgggaattggcaatgattatcaaattgcctcactctctaattgttttgttatcggattggacgggcaagcggattcgtatggtgcgattattcgtattgacgaagaacaggtacaattaatgaagcgccgtggtggtgtaggccatgatctttcgcatattcgcccgaaaggttctccggttaagaattctgcgttgacttctaccgggttggttccgtttatggaacgttattcgaattccacccgtgaggtggcccaagatggccgtcgtggagctttgatgctgagcgtttctattaaacatccggactcggaggcgtttatcgacgctaagatgacggaaggtaaggttacaggtgcaaatgtatctgtgaagattgatgatgatttcatgaatgccgcggttaatggcggtacctataagcaacaatatccaattgattcggattctcccgtttatgtgaaggatatcgatgcttctggcttatggaaaaaaattattcataacgcttggaaatccgctgaaccgggtgtgctattctgggacacgatcttacgtgagtctgtaccagactgctatgcggatctggggttccgtacggtttccacgaatccttgtggcgagatacctctttgtccgtatgatagttgccgtttgttagcgatcaatttatattcatatgtggtaaatccgttcactccggacgcttatttcgattatgatttgttcaagaagcatgtaggtttggcccagcggattatggatgatattattgatttggagtcggagaagatcgagatgatcttggctaagatcgactcggatccggaatccatggaggtaagacaaacagagcgtcatttgtgggaaaagatccaacgaaagactttgcaaggacgccgtacaggtgtgggcatcacggcggaaggcgatatgattgccgctttaggtttgcgttatggaacagaagaagcaaccgattgtgcggaacttatacaaaagacattagctttggccgcttatcgttcatccgtaatgttggcgaaagaacgtggtgcctttgagatattcgatgcgaagcgtgaggaaaaaaatccgttcatcaaccgtttgcgtgaggctgatcctgctttatatgaggatatgttgaaatacggccgtcgtaatatcgcttgcttaacaatcgctccgacgggaacgactagcttgatgacacaaaccacttccggtatagagccggtattcttgccggtatataagcgccgccgcaaagtaaacccgaacgattccgaggctcgtgtggatttcgtggatgagacaggcgacgctttcgaggagtatatcgtattccatcataagtttgtaacgtggatgcaagcgaatggttattcggcaagtaagaaatatacacaagaagaagtggaggagctagttgctaagtctccttattataaagcgacttccaatgatgtcgattggttacaaaaagtccgtatgcaaggacgcattcagaaatgggtggaccattctatcagcgtaacgatcaatttgccgaacgatgtaagtgaggagttggtagattctttgtatgttgaggcatggagatgcggatgtaaaggatgtactgtttatcgagatggttctcgttccggtgtcttgattgcgacagataaaaagaagaaaaaagaggattgcaactgcatgcaaccaccggttatcgtatctacccgtcctcgtgaattggatgcggatgtggtaaaattccagaataaccgtgagaaatggatcgctttcgtcggcttgttgaatggccgtccgtatgagatctttaccggtttggccgatgatgacgagggtatcatgttacctaaaaacgtttctaaaggtacgatcatcaagagctatgatgaggatggtaataagcattacgacttccagttcaagaataaacgcggttataaaatgacaatcgaaggcttggatggcaagtttaatccggaatattggaactatgctaaattgatttccggtgtgctccgttacggaatgcctatcgatcaggttataaaactggtacagggtatggagttgaatagcgagtctatcaatacttggaagaatggcgtggaacgggccttgaagaaatatttaccgaacggcatggaagcgaaagggcagaaatgtccgaactgtgggttggagaccttaatttatcaagaaggttgtttgatctgcacgaattgcggagcctctaaatgcggttaa

SEQ ID NO: 1377 - DNA, 2871 bp, Parabacteroides distasonis
atgaaccatgtctatcttttcgtaattgtaaacaatgtaatccatatagttatgaaatcgggaaagtgccttttgatgttgttgatgatccttttttcaccgatggctttcgcacagcaaagcggtgttaatgttaccggatctgtcgttgagcaaggtagtgatacccccatcgagcaagcaacggtacgattgctgaacgtaaaagacagtgccatggtacgaggtgtggtgagcgcccgtaatggtagttttaccttgaaaaacgtaaagaaaggaagttatttactacacatcacattcatcggatacgatccattgtaccaacccttgcaaatcaccggaaagaaaaaccccgtaaacgtaggtaaacttgaattaagcgacggagcgatcgagttgggagaagccgtagttataggtaaggcacccgaggttaccgttcgcaacgacactgtggaatacaacgcggattcttataaagtaaccgaaggctccgttttggaggatttattgaaaaagatgcccggtgtggaggtagatagcgaaggcaagatcaccgtcaatggaaaagaggtgaaaaaggtaatggtggacggaaaggagttcttctccgatgacccgaaagtggcctccaagaatcttccagccaagatgatcgataaattacaggtacttgataagaaaagcgatatggcccaaatgaccggcttcgacgatggagaggaagagaccgtcatcaacctaaccgtgaaacccggcatgaagcaaggttggtttggcaacgcatatggtggatacggaagtaaagatcggtatgaaggcaacgccatggtcaatcgtttcgtgaataatgaccagatcacgttcatggggggagcgaataacacgaataatatgggcttttccgatctagcctcaacaatgttctccggtatgggaggcggtggaggccgacgaggaggtttcggagcgggtagcggtatcacctcttccggaaacgcaggtttgaacttcagcaaggaattcaagccggataaactaactcttgggggaaatactcgttattcccattccgacaatgatgctcgcagcaagagtgatcggcagaatatccttcccggagatagttcctcctatgataatagcgaggcgatgagccgtacgaagagcgataactttggcgtagactttcgcttggaatggaaaccggatacgatgactcaacttatcttccgcccgagtttcagcttcagccacagcatgaacgacaatttcagtgatgctaccaccttggataacgaacgggatacggtcaataccaacaaatccagtaattactcggaaagtaacgggtacaacctaaatgccagcatcgatttcagccgtaagctgaataacaaaggacgtgtgttcagcgccaccctttctggaggcaatagcgattcgtacagtgacggcatgaaccgttccgacatcgtttatttcaaccagactgatgccttgaagaatagcattatcgaccagcgctcacgttacgacaacaaaggtttcaattaccgggcctacgtatcgtgggtagaaccgatcgggcataataatttcatccaagccacttatagcatcagccaacggaaacaagaagccttgaagaatgtttacaaccaagacgctgatggtatatataatgtattagattccgcctacagccaaagctatcgcaataactttatcagccagcgggccagcttgagcttcaagtctcaacgggcaaagttcaactacacgatcggcttgaatctggacccatcctattccagcagcgagaatttcgttggcgacacgaccttatccaagataacccgtaaggtggtcaacctctccccgatggctcaattcaactatatgttcgataagcgtacgaatcttcgtatcatgtataatggccgtaccagccaaccgagcatgactcaattacaaccggtagcggatatctcggacccgacgaatatcacgatcggtaacccggatttgaatccccgctatacgaacaacgtatttattcgtttccaacagttcacaccggagaaacaacgggcctttatgatcatggcaaacggtagttatatcatcaacgatatcgtaagttatacctcttataaccaagagacaggtgtaaagaccaccacttacaaaaacgtaaatggcaactatagtggcaacgtccgtatgatgttgaatacccccttgaagaataagaaattctccatcaactccatgacaatggcctcgttcgctaatagcaacggatatatcaacgaggagaagaatacgaaccggaatctcatattgtccgaacgtggtggtatcgacttccgctcctcttatctggatctgggcgtaaacgggaatattcgttacaatgccaccagcaactccctgcaaaaggaaaataaccaaaacaccttcaattacggagccggcggttacacgacaatctatctgcccctcaatttcaagatagagagtgacgtgaactggtctaccaactctggctacggggacggattcaaacagaacgaagtcctatggaatgcctcagcctccaagtctttcttaaagaataaccaagggacgctccgtttcaagatctacgatatcctgcaacaacgaagcaatatctcccgttccattaccgctagctatatacaagactcagaatataacacgctaggcagttatttcatggtacacttcatctatcggttcagcatcttcaaaggcggagccagtgccagcgacgtgaaaacgccgggtagaagcggacggggaagaggtccgatgggtcctcctccgggacatcgattttaa

SEQ ID NO: 1378 - DNA, 2322 bp, Parabacteroides distasonis
gtggctatacagtataaaaatgggaggtgtaaaaccatggacgatacaaaggacacaaaagatataaaagaaacgggcgaggctgcgtccgttctctctgcggacgaacagatgatacaagatgggttcaatgcgttgttgaacgattatttgaagtcaaaccaccgccgtaaggtcgaacgaatcacgaaagcttttaatttcgccaatcaagcgcacgccggagtgaaacggcgttccggcgaaccttatataatgcatcctatcgccgtggctcgtatcgtatgccgggagatgggtttgggctctacctctatttgctctgcgttattgcatgatgtcgtggaagataccgagtatacggtggaggatatccgggatatgttcggagacaagatcgcccagatcgtggatggcttgacgaagatatccggtggcatttttggggaacaggcctcggctcaagccgagaacttccgtaagttgctgctgactatgagtgacgatatacgggtgattctaatcaagatcgcagaccgtcttcataatatgaggactttgggttccatgcttcccgccaagcaatttaagatcgcgggtgagactctttatctgtatgctcctctggcgcatcgtctgggtctcttctcgatcaagacggaactggaggatttgagttttaaatatgagcatccgcaagaatatgacttcatcagcgctaagttgaaagcgacagaagagagccgtaataaattattcgagcgtttcgccgcccctgtggacgagaagctgaaatcgatgggacttcagtatgagatgcgtgcccgtgtgaaatcggtctattccatttggaataagatggaaagcaagggtgtcgctttcgaggatatttatgatatttatgcggtccgcattatttttgacccgcttcccggtgtggacgagaaaaaccaatgttgggatatctactcggctattacggatatttaccggattcgtcccgaccgtatccgtgattgggtgagccgtccgaaagcgaacggttatcaagcgcttcatctgaccgttatgggaccggatggacaatgggtagagatccagatccgtagccgccgtatggatgatatcgcagagaaaggcttcgctgcccattggaaatacaaggaatccaacgtggaggaggatacggaattggataaatggatacaaaccattaccgagatcttggagagtccggacccgaatgcgctggatttcttggatacgatcaaactgaacttatttacttccgagatatttgttttcactccgaaaggagatataaagacattgccccaaggggctaccgccttggatttcgcttatgcgcttcactccgatatcggtaataaatgtattggcgctaaggtaaaccatcgtttggtgccattgagtcatccgctgtccagtggagatcaggtggaggtcttgacttcccgttctcaggagccgcaaccggagtggttgaacttcgtgactaccgctaaggctcgtgcgaagattgatgccgtattaaagcgtgtccgtaaagaggtcgctaagtatggagagataaaagttcttgatgccttcaagcgttcggagcttgaggcgagtacatccaatctggataaattaggcatgtactttggattctcgaaacgcgaggaattcttttatgcggtagagaagggggatgtggttttgcccgagaatttaaagaagctgttgaaggagaagacggataatgtcttgtttaagtatgtgaaacaggcgttgggtgtcgcttccaagaaggtgaaacaacccgaagaggaggaagccaagaaagagaagcctaaatatgataagaaaaagccttatttattgaaagaggaggcttttgagcgtaattatgtaattgccgaatgttgtaagccgattccgggagatgactctttaggttttatcaatgatgatggaaatgtagtagttcataaacgttcctgcccgatcgccatgcgcttgaaaagtagctttggcgaacgtatcttgaatacggtttggagcagccatatgaacgcttcttttgaggccacgctagaggtgaaaggtatagactcgataggcgtattgaatacgatcacgaaaacgatttccgaggatttcaacgtgaacatcatgcgcttgctgatcgaggcgaaagacggcgtgttcgaaggtaagataaagatgaaagttcatgacgtagaagatatccagaaaatgtgcgtgactttgtcgaagatacagaatattaaatctgtcggacgtgtagcggattaa

SEQ ID NO: 1379 - DNA, 2382 bp, Parabacteroides distasonis
atgatgatgaagaaaatcagagggcttttcctctcctttttactgttgcttatttccatctcggctttttctcaacataaaacaatgatatcgggtaaagtcctgtccacggaaaaaacaaccgtggatttcgctaccgtttatctaaaaggtacgaattacggcgggactacgaatgaggaaggtatctatcatcttcaagctcccgcgggagaatatacattagtagtatcggctatcggatataagacggtagagaaacccgtgaaactgatgcgtggggaacggacaaagatgaatgtggtaatcagccctcaagctacggagttggatgaggtggttgtcgtttctaatggcgtgacccggctcaagcgttctgcgttcaatgccgtggccctcgatacgaaagccttgcaaaattcaacccagaacttgagtgaagccttggctcaagcgcccggaatgaagatccgggagtccggcggtgtcggctcggatatgcaactgatgatggatggatttaccggcaagcatatcaagatctttatcgatggggttccgcaagaaggtgtcggcagttctttcggactgaataacattccggtgaattatgccgagcgtatagaggtctataagggtgtggtaccggtgggtttcggaacagacgctatcggaggtgttatcaatatcatcaccaagaagaaccggaacaaatggttcttggatgcttcttattcatacgggtctttcaatacgcataaatcttatgtgaacttcggacaaactttccggagcggactcacgtatgagatcaacgttttccagaattattcggataataattactatgtggatactccggtgaaggactttacgaccggagcgatcaataagaaaaagatcgagcatgtgaagcgttttcatgatacgtatcataacgaggccgttatcgggaaaataggtttcgtggataagaaatgggcggatcgtttgatgtttgggtttacctattcacatatgtataaagatatacagacgggcgtacgccaagaagtggtgtttggcggcaaatatcggaagggatactcgatcatgccgtcgttggactatcgcaagcgtgatttcttcgttaggggcttggatgtggtattgacggcgaattataataagaacatgacgaacaatgtagatacctcttcctatgaatataattggcgtggcgagatgcgtccgctccggatgcccggtgagcaatcttatcagaacacccggtcggataataataactggaacggaaccttaacagctaactaccgtatcggtaaggcgcatacgttcacgttcaatcacgtgatcaacgcgttccggcgttcgaatcagtctcttttgaacgaggactcggaagcgaacgctatcccgaaggaaacccgtaaaaatatcagcggtctttcgtatcgcttgatgccgacggaacattggaacttgtctgtgttcggtaaatattacaaccagtttatcgcggggcctgtcgctacttcctcggctcaagatgactatatacgtacgaccaattcggtaagcgcgatgggatatggggccgcgggaacttactttatcttgaaaagcttgcaagcgaaattgtcctatgagaaagcctatcgcctgccgaccaatgaggagatgtttggcgatgaggaccttgagaccggcgatatttccttgagaccggagaacagcgataacgtgaatctgaatttaagctacaacgagacattcggtaagcattccgtatatgtggaaggcggattgatctaccgaaatacgaaagattatatccaacggaatatatcggatttgagcggcggtaaatatggcgctacctatgtgaatcatggtcgtgtagagaccaagggttacaatatctcggttcgctacggtttcgctaactgggtaagcgtaggaggaaactttacgcagatgaatgtaagggataacgtgaagacggttaccagcgggacgaaccaagagagcttgacatatggcgcacgtatgccgaatcttccttatcagtttgccaactcggatgtgaccttctactggcgtaatttgtggaagaaaggcaatacgctaagtgtcacttacgataatttatatatgcatagtttcccgctgtattcggaggcagtaggcagtgaatccgaatttgtggtaccaactcaattctcgcataacctgacactctcttatggtatacagaacgggcgttacaatatctctttcgagtgcaggaatctcacgaacgagaaattatacgataacttcagcttgcagaaggctggcagggctttctatggtaaggtgagggtttatttcggtaattaa

SEQ ID NO: 1380 - DNA, 2271 bp, Parabacteroides distasonis
atgtctcagatacctgcgctaatatcagatcttgcggtcatactcatatccgccgggttggttaccctgttattcaaaaagttaaagcaaccggtcgtattggggtatatcgtagccggaatactcgccggaccttccatcgagcaaataccgacagttacagatgtggaaagtatccgtatctgggctgatataggcgttatcttcctgttattcgctttggggctcgatttcagtttcaagaagttgatgaaggtgggaggaaccgccgtcattggagccataaccgttgttataggtatgatgacagcgggatatatcacgggcttatcactgggttggggacatatgaacagtcttttcctcggaggtatgttatcgatgtcttccacgacgattatcttcaaggcattcgacgacatgggattgcgtaaccaacgattcgccggtgtcgtattcggtatcttggtggtggaggatctattcgccgtattattaatggtattactttctaccgtagcggtaagtaaacacgtggaaggcatggagatgctggatagcgtggtcaaattaggcattttccttttattctgtttcgttgtcgggatctatttgatcccctcttttctgaaaaaggcaaaaagcttcctaaatgaggagactctgttgatcgtgagcatcgggctatgccttggtatggttatgatcgccacaaaagccggattctcatcggctctcggagcttttgtcatgggttctattttggccgagaccattgacgctgaacggatcgagcatttggtaaaacccgtaaaagacttatttggagcgattttcttcgtgtctgtaggcatgttaatcgatcctcagatgctctgggagtacaaaatcccgattttcattatcacgctcgtagtcatggccggacagatttgtttcgccagtttcggagtattactgtccggacaaccgataaaaatagccatccagtctggtttctcgttagcgcagatcggagaattcgccttcatcatcgcaggtttgggactatcattaaacgtgacggatcaatatctgtatccgatcgttgtcgccgtatccgtgatcacgacattcttcacaccttatatgatccggctagcggaacctacctacaaatgggcggagcggatcataccggagaattggaaacagttcttggagcgatattcatccggttccaatacgatccgtcaaaaaagcgcatggaataagttactaaaagccttggtccgcatcgtcggtacttataccgccgtctgcctagtacttatctttttatggctacaaatcgtgactccgttcatctgtaaacatttgcccggcatccaaggaagtctaatctccttgatcttaatcctagctctgatctccccgatgttgcgggcgatcatgatgaaaaagaatcattccgtggagttccagcaattatggaacgataataaatataaccggggtcccctagtatcactcgtgatcctcagaatcctgctctgtatcggtctcgtcatgcttcctgtcgcacggttattgaatgctgcgctaggaattatgctggcggtcgcctccgctgttatcgtattaatgatattctccaaacggctaaagaggcagtcgatcttgatggaacggcattttttcagtaaccttgtagcgagagaaatggagcaagagcgaaaagccccgattaaccagcgtttcgcgaaccacttattagaacgagatctccatttagcagatttcgaggtgaagcagaattcccccagtatgggaaaaagcctgaaagaattaaacttcaggcaaaagtgcaacgtaaatatcgtaacgattatccggggagagaagcgaatcaacataccgggaggagacgagcggctctacccgttcgataaactggtagtagttggcgcagatgatgatctggagcactttaggaaatatctggaggaacgctacaagaaatcatacgccgagcaatcgaacacaagaaaggaagagatgaatatggagcaaatcattatctcggaaggttcccgattgatcggccgctccatcatagagtccggtatccgtgataaagccgcttgcttggtaatcggtatcgaacgtggaagtagctcgatcaagaatccgcctcctagtacggttttcgaggaaggagatatcgtatggatcgtaggcgaacgggataagttgatccagttaagcgaaggaaaagtagtaaccagttaa

SEQ ID NO: 1381 - DNA, 3312 bp, Parabacteroides distasonis
atggtacgaataagaaagatattgctggttgttgtgtctgcgttggtcgggatctttttcatacttcccttgatcggggttggtatactgaaatgggcggtcttacctccggaaaagctgacaccgctggtcgtagaaaaaacaaacgaattcatagaggcgcacttggaatgtgagcgggtggagttgacttatttcgagacgtatccttatctgggagtgaagttgacaaatgggcgtttgatctcacatcaggctgaggattctatagaacatcaggaggatttgatgattccttcggattctttgctgtctttcaaaaaagcgatcgtcgtatttaaccctacggattatctgtttagcgggaaagtgacgattcctcgggttatcatggatagtatccgtttttatggttatgtgaatgaggagggaaaggcgaattgggagatttatcaaagtgagatggattcggtagacgaatcatcgtcatctccattgcctaaaatagatttgcagcaagtgcatattacgaatgggcattttgtctatgatgaccgccagcaggatttatatacggcgatcgatggtttctttttacatatagacggccttttgacccaacgaggaaataagttggatgtggagaccggttcttcctcgatcgtattccgtagcccgtcttattctttggcgaataagttagcgttacgcttcaagggacgtttgttgttggctgacggacttcgtcggattgggttgagggacgcggagttgctggtgaataacctgccttttacggcggatggctttatggtgccggctaccgaggataatccgtcacggatcgatatgactttcgggttgaaggtttccgatatgaatgatctcttacattttattccggatgaatattttaaggatcgggataaaacacttgctgagggacgtattattttggaaggggatatccgtggagaattaggggatagtattgttccgaccgtgaacttatgctgcaagatagaggatggttcttatcatgtaaaaggtattgaacaggggatcgataccttgcgcatggacatggatttacatttgaatggcgcttacccagattcttcttatgtctctttggaggagctgacattgatcgggttgaatacctcgctgaccatgagtggcgaggttagggatatctggaggaatcccgcgattcgggcggagatgaaagggcaggtcgattttacccgtttggctaaagagttcttgaatcccgacacactgctgctggagggtaccatgatggctgatttatctacggtgtttaaggtggatgatatcgtgaatagccgcttcgccaaggtcaaatcatccggcaatttgacggttgatcgcttcaaggcgtttagtaagccgttaggcgtggatatgtatatcgctggggcgaatctgtttgtaggatctacggaaaatgaaagtaaatatctgaatgcgaaaggattgttgagcgctaatctatcggtggataccttgaatataaagtataaggatgagatcagtacgaatatcggtggattgaagatggtagccaatacgacgccggttattgatacaacggctgttatccctatgaccgcagggttggaatttgatcatttacgcaccaagttgccggattctacctggatggtggccggtaagaccgtgttgaaagggggcatcaaggcttcttctacagataagcggatccctatggcgggagctacgatctcggtggacaccttaaaatatattcttatccctttacggacgggtatggttctgacggaaagccagttctctttggaagcattaccttatcggcaagcgatccgtcaacaacgtgaacgccgtattgccgccggtgataccttgcgcaggcgcacgcagaccacccgaagggcgaatagacagcggtcgcaagtggattcggtcgcttcctcaaacagtgtcttacgccaatgggaggctcggggacaagtgaggtttaagcaattgaggggctttagccgcttattccccattccgatgtatattgatgagacaagcgtgaaattcaatactaacaatatgacgttgagtggtgcccgcctgcatttaggaaagagcgatcttactttgagcggagagcttagcgacatccggcgggccatgctacggggaggaaagctgaaagcgaatttcgagttggaatccgatctgatcgattgtaaccagttgatgctagctataggtaaaggtttgcagttttctgatcaattggcatccaattcggttggggccttctcggaagacagtatctccgtactggagacggatcatctattagcgaataccgtggatagtgtcgctacggattcgatctctcaactatttgtcgttccgaaattcttggatctgacgcttcatacaaatgctaaaaaaatagattttaaggatctgaagttggaggatgtgaaaggtgaggttgtaatccgggatcaaagtatcaatctgagcgatttatgtatgagctcgaatatcggttccggagatctgacgatggtttatacgaccaaaacagatcaagaggcgactatgggatttgagttgtccttaaatgatattttagtggaacggttaatcagtttattcccggatatcgacacattggtccctatgcttcgttcgttcgaaggcatggtagattgccagatgacggcgacttgcaaggcggattctacgatgtccgtgttgctgccgtctgtaaatgcctcttgctacctgagcggaaagaatatggtgctgctggatggtgagacatttaccgagatatcgaagacgctgatgttcaagaataaaaaacggaatatgattgatagtatagcggtagatttagcgatccatgataacaagatcgaggtattcccattcttggtggagatggaccggtataaagtagccgtaggagggacgcataatttggatatgacgttcgattaccatctctcggttttaaaatcgccggtaccgtttaagttgggtatcgatataaaagggaatctggatgatttcaagttcaagatagtgaaatgtaaatataaagatttcttgaaacctgccaagcaagcggaactggatagtacccgcaggaatgtgcgtgaggagatacgcgagacgatccggaaacaaataagagaggccgctcccgaattaggaaacagcctctctgagattcatccacatacacacggtcacgttgaggaatcaacggatccatacatttgctcgtaa

SEQ ID NO: 1382 - DNA, 2187 bp, Parabacteroides distasonis
atggcaaagaaggatcatttaacagaagagctaaatcggcactttggcttcggtacctttaaggggaaccagaaggctattattgagaacgtgctggccgggaaggatacttttgtattaatgccgacggggggaggtaaatctctttgttatcaattaccatccatactaatggaaggaaccgcgatcgtgatatctccgttgatcgctttgatgaagaatcaggtggacgcgatgcggaatttcagtgaggaagatggggtcgcccattttatcaattcctctttgaataagtcggctatcgaccaggtgaaatcggatatattatcaggacgtaccaagttgctgtatgtagcaccggagtccttgaccaaggaagagaacgtggattttctgcgtcaggtaaagatctctttctatgcggtggacgaggcgcattgtatctcggaatggggacatgatttccgtccggaatatcgaagaatccgtctgattatcaatgagatcggtaaacgtccgttaatcgctctgaccgctaccgctacacctaaggtgcagcacgatatccagaagaatctgggtatgatagacgctacagtctttaaatcatccttcaaccgctctaatttgtattatgaggttcgtccgaaaggaacgaatatagaccgcgagatcattaagtatattaaagccaacgagggtaaatcgggtatcgtatattgtttgagccgtaaaaaggtggaggaatttgccgacatcttgaaagccaacgggataaaggcgttgccttaccatgcgggaatggattcgcaagtacgttccgccaatcaggatgccttcctgatggaacaggcggatgtgatcgtggctacgatcgctttcggtatgggtatcgacaagccggatgtccgttatgtgattcattacgatatcccgaagagcctagaaggttattaccaggaaaccggtcgtgccggtagggatggcggagaaggccaatgtatcgctttctatgcttataaggacttgcaaaaattggagaaattcatgcaaggaaagcccgtggccgaacaggaaatcggcaaacagttgcttttagagactgcagcctatgccgagacttccgtctgccggagaaaagtgctattgcattatttcggtgaggaatacctggaagataattgtggtaattgtgataattgtttgaacccaaagaagcaggtggaagcgaaggaattgttaagtgcggtactggaggttatcagtacgttgaaagaaaagtttaaggcagattatatcgtaaatattttggtaggtaacgaaacctccgaaatccaaaattacaagcacaatgaattagaggtcttcggttccggacaggacgaggatgataaaacttggaacgccgttattcgtcaggctttaatcgctggctatttagcgaaggatattgagaattatggtttgctgaaaatcacggaaaaaggtaaggagttcatgaagaagccggtatcgttcaagattaccgaggacaatgaattcgaggaagaggaagaggaagaggaagttccggttcgtgggggcgcctcttgtgcggtagacccggttctttattccatgatgaaggatttgcgtaagaaattatccaagcggttggaagttccgcctttcgtgattttccaagatccctctttggaggctatggctactacttatccgatcacgttggacgagttgcagaatatcccgggagtgggcgctggtaaggcgaaacgttatggcaaggagttcattgagttgatcaagaaacatgtagaggagaacgagattgagcgtccggaggatttgcgcgtacgtacggtcgctaataagtccaagttgaaggtctcaatcattcagcggatcgaccgtaaggtggcgctggacgagatcgcgttgactaacggacttgagttcaccgagcttttggatgagatcgaggcgatcgtatattccggtacacgtatcaatatcgattatttcttgaatgatgtgatggatgaggatcatatcgaggatatttacgagtatttcaaggattcggagaccgacggtctggaagacgccattgaggaattaggcggtgactatacggaagaggagattcgcttggtccgtatcaagttcttgtctgaaatggcaaactaa

SEQ ID NO: 1383 - DNA, 2145 bp, Parabacteroides distasonis
atgatgcagacgaatttacaattggaccttgccttcaactatctggaaaataccggaaccaacatcttccttaccggaaaagcgggaacaggaaagaccacattcttgaaaaaacttaaagagacttccccaaaacggatgattgtggtagcacctaccggagtggcggcgattaatgcgggaggggtaaccattcactccttctttcagctacctttcggaccgtatataccgggtagcgaaatggcctccgggcaaaataaatcctattctcataaattcagccgggataagatcaatatcatccgtagtatggacctgctcgtgattgatgaggtcagtatggtacgtgccgatttgctggatgctatcagtgatatgctacgtcgttatcgggataggaataaaccctttgggggcgttcaattattattgatcggagatttacaacaattagcccccgtagcgaaggaggacgaatggaatttgttgagagaacattacgcctctcccttcttttttgacagtaaggctctttccgaaagtgattatctttgcatcgaattaactcaagtatatcgccaagcggacgatacgttcgtacgcttattgaacaatatccgggaaaaccgcttcgacgagaatacgctacacaccttaaaccaacgttatatccccaattttaaaccaaatgacaaagcaggttatatcacgctgacaacccataattatcaagcccagcaaatcaataaccggaagttgcaagaattacccggcccggcttatacgtacaaggcggagatcaaggatgactttccagcttactcctacccgaccgacgaggtattggagctaaagcaagacgctcaagtcatgttcgtaaaaaacgactcttccggcgaaaggcgatattataacggaaagatcggccgaattgtcttcatcagcccgagcaagattatcgtatccgacgaattaggaaacgatatcaccgtagaccgggagacatggacaaacgtgaaatatacgatcgacgagaacacgaaggatatcacggagacaatcgccggctctttcagccaatacccactgaaaaccgcttgggcgatcacgatccataaaagccaaggcttgactttcgagcatgccatcatcgacgcatccgccgccttctcacacggacaagtctacgttgctttgagccgttgcaagacattggaaggaatggtattaagtagcccgatcactcgaaacgccatgattagcgatgagaagatattaagttatacctcttccctctcggagcgtcaaccgtgtgaagaccaactgcgtcaagcccaacaacagtattatttgagattggcaaccgagctattcgacttcaatcccgtacaacaaaagttgcaatatacatcttacgcggcatacacccatctgcaaaaactatacccggaattaagcaaccaatatccccgggtacgggattatttccgttcggatatagtagaagtaggcgaacgtttctgccagcaactcacccgtatgatctccagcacgaatctctatgatacggacgagcatatacaagaccgcatccgaaaaggttgcgcttactttctggaaaagatcgagacctattgcctccctttgatagaggcttccgatgtagagatcgacaataaagaggcccgtaaggcatttacatccgcattaaaagctttcagcgatgagcttacgatcaaggtcgctacattaaaagcctgccaagatggttttcgtctcatcgactatctatccgccaaggctaaagcgaacattgaggagtcggctgttgccagcaagcagaaatcgacgcggaaatcgacggaagcggaaaagatccccgtctccacggatgtcttacatcctgagctatatgcccgtttgaaacaatggagatacgagcttgccgtagaaaaggagttgcctccttacacgatcttgcaacagaaagccttaattggcgtttgcaacactttgcccacgaactcgaaagaactgttgaagatacccggaatcggcaaaaagatcatagagaactacggtgagaccctattagaaatcgtatcttcctactcaccttccacgcatgggaacgggctgtga

SEQ ID NO: 1384 - DNA, 2559 bp, Parabacteroides distasonis
atggggaagagaattgtttttatatggcttttattggcgttcgcttgggtagcgaagagccagaactacatgataaaaggaatcgtgactgattccattacgggagaacctttgccttatgtggctgtgattttgaagggaactacgataggtgctacgacagatctggatggggcttttacgctttcctcttcatctaaggtacgtactttacaggtctcttatttgggttatacggagaaagaattgaaattcgttccgggtaaagcggaacatttgaagattcagctagctccgacaagtattaatttgtcggaggtgatcatcaagccgggaaaggaaagatatcggaagaaggataatcctgcggttacctttatcaaaaacgctatcgcacgtcgggagagcaacgatcctcgtaatcatgattattttcggtatgatcaatacgagaagatggtcttcgctatgaacgattaccaaccgaaaccgaaaaaggatggaaaggcgggaaagtttgacttcttgactgagtttatcgatacgttggaggtgggaaagacgatcttgccggtatccgaacgtgagaaaatccagaccgtttattatcgtaaagacccgaagacggaaaagagggtcgttcaggctacgaaagcggctggtgtggatgaggtcttctcacgagacggtatgcaacagttcttgaatgaggtattccgggaagtgaatatcttccagaatgatattcctttgttcttgaaccgtttcgtaagccctatgtctacgatgggacctaacttctataaatattatttgctagacacggtggaggtcgccggacagaagtgtgtggatttgggtttcgctccgtttactccggagacgttcggctttacgggacatctttttatcacgttggattctacttatttcgtgcagaaggttaagttgaatgtcccgaagaagatcaacttgaattttgtcggtggaatgacgatcgagcagactttcgaccgtgccccggatgggactcgtatcattacgaaagatgatatcaacgtggacttcaaattgacggagaaatcgaaaggaatgtatgcccgccgtttgaatatctattcgaatcaagcgtttgagggacccgatgatcctaaagtattcgaggagagcgcacctattattataccgatggaagcttatcgccgttcggcggatttctgggaggagaatcgtcctactgaggcgggaactcgcaagcagaataacgtggagttgctaatggcgaaacttcgttccgttcctattttctatgtgacggagaaggttgtttcgatccttacctccggttatatcgcgacgaataagattccggcgaagagcaagttcgagtttggcccgatgaacacctatatcagtggtaacgcgattgagggggcccgcttccgtgtcggtggaaccacgacaacggcgttcagtaaacgtcttttcttggatggttatttggcttatggatcgaaagaccgcaagttgaaatatgatggtatcgtagaatattcttttatcgataagaaggattatcggaaagaatttcccgtgcattctattcgcttcgagtacctatatgatatcaaccagttaggtcagcagtatatgtataccaacaaggataatatgttcttagccttgaagcggcagaaggatacacgtgccacctatttaaggaatatggaactgacctattaccgtgaacattataacggctgggcttatggggcggtacttcggaattttaaggaatactcaaccggttacgccgcgttcgaccgtatcggtccggatggccagatcacggctaccgattcctaccggatgtcggaagtggagtttaagttccgttttgccccgaatgagaaattctaccagactcgtaattaccgttatccgattacgcttgacgcaccggtattcaccttgaaccatacgatggctttccaagatgtattaggtagttcgtatgattatcagaagacggagatcggtatccagaaacgcttctggttctctgctttcggttatgtggatattctcgctaaagcaggtaaagtttggacaaaagccccttatcctttgttgatcttgccaaacgcaaacttgtcgtatttggtgcaaccggaatcttatacgaatatgaatgcgatggagttcatcaacgatgagtacgcttcgtgggatattacttatttcatgaacggagccttgttgaaccgtatcccgcttatcaagaagttaaaatggagagaggtcttttctttccggggtatgttcggacacttgacggataagaataatccgtatatcagtgagcagaatgagggcttgttcttattcccgcagggctcttacctgatggacccgtctactccttatatggaggcgggtgtcggtatcgagaatatctttaagttcttgcgtttggattatgtatggcgtctgacctataaggatcatccgggcatccagacaaagggtatacgttttatgatgaagctatccttctag

SEQ ID NO: 1385 - DNA, 2361 bp, Parabacteroides distasonis
gtgaaatataaaaagatggcatcaaagattacaaaaggtatccttatttcttgttgggtagtatacctcgctatattaggggcggtggtaatggtgtttatggcgatagcgaatggttcaattggttatatgcctccggtggaacaattggagaacccgattgataaatatgcttcccaagttatctcttcggatggaaaggcgttgggagcctatgcgcatagcaaagacaatcgtatttacgtgaattatgaggatctttcgccggatttggtgaaagccttgatcgctaccgaggatatccggttcgccgaacatagcggtatcgatgcgcagggtttgtttcgtgctatcgtgaagcggggtatcttgatgcaaaaaagcggtggtggcggtagtaccattacccagcaattagcgaagcaattattctcgccgagtgccgataatatgatggaacgtcttttccagaaaccgatcgaatgggtgatcgcggttcaattggaacgttattacacaaaggaagagattataaatatgtatctgaataagtttgacttcttgtacaatgccgtgggaatccaatctgcgtctcgtgtgtattttggaaagacccctaaaaccttgaagatcgaggaagccgccacgttggtaggcatgtgcaagaacccttcttatttcaatccggttcgccataacaagcgtaccatcggccgtcgtaatacggttttggagcagatggaaaaggccgggtacataaccaaggcggaatgtgattcgttgaaggctttacccttggtcgtacattttacccgtatggaccataaagacggtttggctccttacttccgtgaataccttcgtctgacaatgaccgcgaagaaaccggagcgtaaggattacgcctcttggcaatctcagaaattcagtgaggactcattatcttgggcgacgaatccattatatggatggtgtaacaaaaataaaaaagccgacggagaatactataatctttatacggatggcttgaaaatctatacgagcatcgattcccgtatgcagaaatatgcggaagacgctgtccgtgaacatatgagtaaagatcttcaaccggctttcttccgggaaaagaagggacgtagctatgctccgttctcaagagacgtaagtgtcggtcaagtagacacgatgttgatgcgtgcgatgcaccagacagatcgttaccgggcgatgaaaaagagtggaatggctgaggccgatatgcgcaaggagtttgagaagcctgtcgatatgcgtgtgtttagttgggatggtccgatcgatacgatcatgtctcccttggattcgattcgttatcataagagtttcttgcgtacggcgtttatgtcgatggaccctcgcaccgggcaggtcaaggcttatgtaggtggtattgactataatgacttccaatatgatatggtgaatggcggtcgccgtcagatcggttctaccatgaaaccgttcctttattcgttggcgatgatcgaggggatcagcccttgcgaccagatgttacatgtgcagcagcagttgatggacgagaacggtcgtttgtgggttccccgtaacgccagcgcgaagcgaatcggcgagatggttacgatcaagtggggattacagaactcggataactgggtaaccgcttatctgatgagccagctctcaccttatacgtttgttcgtttgcttcattctttcggcttgaagaatcatatcgatcctgttatctcggtctgtctgggtactccggatgtatcggtgggtgagatggtcggggcctatacggtatttgccaacaagggcatccgggtagaacctttattcgtgacccgtatagaagattcatatggaaatacaatcgcgaactttaccccacagatgagtgaggtgctgacggaagatgcttcctataagatgctacatatgttgaaaagcgtaatcgacggtggtaccggaggacgtgtacgtttccgctacggtatcaaggcggagatgggtggtaagaccggaacgacccagaataactccgacggttggttcatgggatttacgcctagcttggtttccggctgctgggtaggcggcgaggaccgttccatccatttcgaccgcttggcggaagggcagggagcgagtatggcgttaccgatttacgccctttatatgcaaaaggtttataaagataaaacgttaggctactcggaagacgagactttcgagatccccgagaaatacgcaaacccatgtagcgaaggtggggaggaagatagccccacgaccccaccggatacgggaggcatcgataagatgtttgagtga

SEQ ID NO: 1386 - DNA, 1959 bp, Parabacteroides distasonis
cagaacaatactattatatatgccgtttattctgtatttttgccagaaaaattagcagacatggctgaaagcaaagttgaacacctattggatagcattcattttccggaagacctgagacatttgtcacaggataagttggagcaggtatgtgccgatttgcgtcaatatattatcgatgttttgtctgagaatcccggtcacctaggtgcaagccttggtacggtagagctgacagtcgcccttcattatgtattcaataccccctatgaccgtattgtctgggatgtcgggcatcaagcttacggacataaaatacttacaggaaggaaagatattttccatacgctccgtaagtttaaaggaattagcggattccctaatcctgcggaaagtgagtatgacgcttttatcgccggacacgcctcaaattcaatctctgcggcgatgggtatgtcggtagcctcggccttgaagaaggaactggatcgccatgtgatcgccgtgatcggggatggcgctatgaccggaggactcgccttcgaggggttgaataatgcgtctgccaaccctaataatttgttgattatcctgaatgataacgatatggcgatagatcatagcgtaggtggtcttagccagtatttagtggatataacgacgagtcaagcctataataaaatgagatacgatgtgtatcgaggcttaaagaagatcaagctcatcaataacgatcgccgggaaaacatcttacgttttaacaatagccttaaagcattgcttacccagcaacataatttatttgaaggcttcagcatccgttacttcggtccggtggatgggcatgatgtaaattatctggtgaaggtattgaatgatataaaagatatgcaaggccctaagctgttgcatatcaaaacgaaaaaaggaaaaggctttaaacctgcggaagagtccgctacggaatggcatgctcccggaaagttcaataaggaaactggccagcgtattatcgttcgtaaattagatgaacctcaattatatcaagacgtattcggtcatacattggtagagcttgcggagaaagatgagcgtattgtaggcgtaactccggctatgccttccggttgctcgatgacttatatgatgaaagccttcccggatcgtgcgtttgatgtgggaattgcggaaggacattccgtaactttctctgccggattagctaaggagggaatgatacctttctgcaacgtgtattcttcgtttatgcagcgtgcgtatgatatggttatccatgatgtagctttgcaaaaactacatatggtgatctgtctggatcgtgcgggattagtgggagaggatggagctacacatcatggcgtgtttgatttagcatatcttcgtccgataccgaatttggtaatcgcttccccattgaatgagttggatttacggaatttgatgtatacaggctatgccgcttttaatggcccgttcgtaatccgttaccctagaggtaagggggagatgaaagattggcgtaacgagatgcaagtattgcctataggaaaagggaaaaagttgcgtgacggggatgatatcgccgtactttctatcggaccgatcggaaacgaggtgatcaaagccatcgagatggtgaaagaagagggggtatcgatagcccattacgatatgatctacttgaaaccgttggatgaggagctgttgcatgagatcgggcggaaatataaccgtattattacggtagagaatggagtgataaaaggtggttttggtagcgctgtccttgagtttatggcagacaatggttatacgcctcatgtaaagcgtatcggagtgccggatgcgtttatcgagcatggttctataccggaactgtatcaattatgtggtatggatgccgagagcattgcgaaacagttgaaaaaggagaattga

SEQ ID NO: 1387 - DNA, 2745 bp, Parabacteroides distasonis
atgtttttgatatatagagtcctaatcattctattcgttttcctcttgggaggcttgggcgtgcaagcgcaggagattgtcgctcctgccgatagcttggcgcagactgattctctcttggtggctcctacggatagtacaacgttagcgggagattcgattccagaaaagcagaccgggctagatgctccggtcagttatcaagcgaccgattctatcgtgatgacagctggcaactgggcatatctttacggggaaggcgatgtcaaataccagaatatcgagctgcaatccgaattgatcgagatgaatatggatagtagcatcgtgttcgctaagtttggactcgactctatcgggcaggagtttggctatccgttgtttaaggagggcgaccagcaatatgagtcgaagacgatgcggtataatttcggtaccaagaaaggatatatcacggacgtgattacccagcagggcgaagggtatgttactgccgggcgaacgaaaaagatggaaggggatatcttgaacatggtgggtggtaagtatacgacctgcgacgagcatgagcatcctcacttttacatccagatgacgaaagcgaaggtgcgcccgaaaaagaatatcgtaacgggtccggtctatctggtcttggaggacgtgccgttgtatccgatcgggttacctttctgtttcttcccgttctcgagtacatattcatccggtattattatgccgactttcggagacgagtctaccagaggtttcttcttgcgtgacggtggatattatttcgccttgagcgattatatggacttggctttattgggagagatttatacgaaaggatcttggggattgtcggctaagtcggcttaccgtaaacgttataaattctcgggcagttttaatgcttcttatttggtgacgaaattgggcgataagggattgcccgactataatttatccaaggacttcaaggttaactggacgcatacgcaagaccctaaggcgaatccttatctgtctttttcggcgagcgtaaacttctcgacctcttcgtatgaccgcaataatcagaacagtttatatccgaacgcaagcgggtatgccgacgtgaaccagaatacgaagagttcatccatcaacataacgaaacgtttcccgaataacccgttcacgatctccggtacgatgagtataaaccagacgacccgtgattcttctatcgccgtaaccttgcctagcatgacggttacgatgagccgtatcttccctttcaagcggaagcatccggtcgggaaggagcgttggtacgagaagatctccatgagttattccggtacgttcagtaatagtatcacgacaaaggaaaacttattattcaaatcgaatttgatcaaagattggcagaatgctatgcagcactcgattccggtaagcgctacattctccgtgctcaagtacttgaatatttctccctctttcaattataaggaacgttggtacaccagcaagatcgaacaggaatatgatacgcagaaacaggctttggtagcccgcgacactacgtatggtttttatcgtatttacgattttaacgcttctatctctgcgtctacgaccttgtatggtttttataaaccgttgccattcttgggtaataaggttgagatgatccgtcaccgcttcgagccgtctattacggtaagcgcccagccggacttcgcttcttctcgttttggtttttatgagacttatgtatatcaagacgcgaatggtgaggatcgtgaatatacgtattctccgtttgctcataatatgtatggcgttccgggaacgggaaaacaaggaaatatcagttttgacgtaaataacaatatcgagatgaaggtgcgttcggataaggactctactggattcaagaaaattagtctgatcgataagctgtcgttaggcatgagttataatatggcggcggattcatttaagtggagtgacttgagtgtcggtttacgtttgaaattatccaagagttatacgttgaacttgaatggtcagttcgatacctatacgtacgatgagaatgggcatcgtgtcgatattccccgttggaaagcaggcaagggtattggccgtttgagagggactagcaccagtttttcttatacatttaataatgatacgtttaagaagttgtttggaggaggtgatagttcatcggataaatctgggaatcaatcggcttctacggatccgaatgcagatccggatggcttgaacccggatggagaaggagagggcgagaataaggaaagtggtggccgtctgttgggcaaaaagaaagagaccggtgagacagatgccgatggctatttaatttccaagattccttggagcctctcgtttagttatggtttgagtttgcggtatggtgattttaatcgttctaaactggagtatgattacgccttgactcactctttgagctttaacggaaatatccagccgacaaagaactggcgttttaactttaacgctacttatgattttgacgctaagaagatctcttatatgacttgtaacgtaactcgtaacttgcactgctggcaaatgacggctagtttcgttccggttggtccttataaatcctatacattcagtatcgctgtaagctctgctttattgaaagatttgaagtatgataagagaagtaattatagggatggacagcagtggtattaa

SEQ ID NO: 1388 - DNA, 3156 bp, Parabacteroides distasonis
tgttatttttctatctatttatttgggtgggaaactttagtatttaataaacaaaaaacgattcttatgttgaaaattgtaagacctgtcagttttgttctattgtctgcagcgttttgttccgggggtgtggttcatgcttctgatcgtgcggcgataactccgagggtaggtatttcccagcaagaaggtagtttgaagggaacggttagtgacagttttggccctgtggctggagcgtcaatagttgtaaaaggtactacgaatggtactgtaaccgacatgaatggtaatttcgtgttggatgtgaagaaaggggatgtgatccaagtatcctttatcggttatctaactcaagaattcaaatataatggagagccttccatcaatgtgtccttgcaggaagatacccagaaattagatgaggtgatcgttgttggttatggtacgcaacagaaggcgaacttgtcgggagcggtagcccaattggatagcaaggagttgacaagccgtcctatctctaacgtgtcttccggtcttcaaggtatgatgccgggtgtaaccgttacctcgggtcaaggccgtccgggacaggatggtagtacgatccgtatccgtggtgtcggtactttgaactctgccagcccatatatcttgatcgatggtatcgagagtggctccatgaatgatatcgatccgaatgatattgagagtatttctgtattgaaagacgcttcttccgccgctatttacggttcgaaggcttctaatggtgttatcttgatcacgacaaaacgtggtaagacgggtgctcctcgtatttcttataacggatatgtgggtgcctcgaaagctacttccatgattgatcgtgtcagctcagccgattacgcacgtttgtggaatcgtttcgagccgggacgttatagtgacgaggacatccggatgtttgaggatggctctgatccttacggacatcctaatacggactggaatgatgaggcttatcggacaggtttgttgcataagcacaatgttagtattacaggaggtgcggagaacgtgaagtatatggcttcggccggatatttagggcagacgggtatccttcctaactcagatcgtaaacagtttaacggacgtacgaatctggatatgcagttgacgaagaaactggctgttcggatgaacatgtcttttattaagaatgacttctcggatccgaatgctagctattatggtggttcttccgaccagattatccgtcaattgaatattattagcccgatgatcccagtcaaggataaggatggcaaatacggacaaactaacgatggtaaccctatcgcatggttggattccgggcagacggtggataattgtaaccagaattttacgggggcactttctgttgattatgatattattgatgggttgaaggctactgtgacgggtgcctacgtgaacgaggaccaacgtcatacggagcgagtcctgagcataccggatgatccggcatctgcgtctcgtaccacttccttggttgaacgtttcgtgaattggaaacgttataatttcgatgctttgctgaattacagcaagaactttggtcagcatggcttgaaagtgatggtaggttatcatgcggagaagtatgaggttagcaagaatcagatgcagaggaataatttcccgagtaatagcctgaatgatatggatgccggtggggcttctacacaaacaaatgatggtttgagccgagagcttgccatgctttcctattttgggcgtattaattatgattttgcgggaaaatatttattagaggcaaacttccgtgcggatgcttcctctcgttttgctccgggacatcgttggggatatttcccttctttctccggtgcttggcgtatcagcgaggaggagtttatggaaagtacgcatgattggttgagcagtttgaagattcgtgcttcttggggtatgttaggtaatcaagacgccttaaataaatcgaatccttgggagaatcaatattatccttggatgcagacttataatttggatggtaattatcctatgggaggcaacttgacgacgggatattatcagaaagcctatcgtatcgaggatttgtcatgggagaaatctacgacttggggtattggcttggatgcggttattaatcatgtgactttcacgtttgattactatgatcgcaagactacggatatcatcatggaggtaccggtcccgactgagtttggcttggatccttatttcgataacgtgggttctatgcgtaaccgaggtgtcgaggtacagctaggttataacaataagtggaatgactggtcattgaatgtgatgggaaatatggcctataataagaacaagatcgaggatttaggaggtgtagaccgtatgacaaatcctgatgacggtgatttgtggcgttttgttggaaagccaatcgattcttactatgtatataaggctgatggctttttccaatctgacgcagaggcacagcaatggatggatacctataaaggaaaagacggctacccgttcggacaggatttccaagccggtgatttacgttatgtagatacgaatggagatggaaagctggatgcggatgaccgtgtattgtctaagactatcaatccagttgttacatttggtttgaacttgaatgtaggctataaagcatttgacttgactttgaacttcaccggtgcggctaatgtaggccgtgcgtttacgaaagaagcgtttggtgagttctcgggtagtgccggacatccttctactgcatggctggatagctggacaccggaaaataccaatgcaagtatgccgcgtgtagcggagtctagaaaatctccgagtgaggcttctaacgtgatgtctgatttctgggtaattaataccagttacctgcgtctgaagacattgcaattaggatatacgcttccaaagagtgtgctgaacgctatcggtttgtcgaatgtacgtgtttattattctgcggagaatttgtttacgatagattctatgccattgaacgtagacccggagactgttagttcccgtttgtctagctacccattagtgatgacaaattcttttggcgtaaatgtgacattctaa

SEQ ID NO: 1389 - DNA, 2313 bp, Parabacteroides distasonis
atgaaattccttaaaagttcagttttatttatttcaatggcatgtatagtgcctgtttgttcgatagcgagagaaaaaagtgagagaatcacaagagctgagattgaacagaaaagtgcggatgaatttataaatggtctgatgagtcgaatgaccgttgatgagaaaattggccaattgaatcttcctagttatggaaacgtaatgccaaatcctaaaaagagtgagatagccagtcgtattgtacgaggagaggttggtggtatatttaatatattcggtgtcgatgcgatccggcagttacaagaagtcgcggttaaagaaagtcggttggggattcctataattgttggtgctgatatttgtaatggttataaaactgtttttcccattcctctaggtctttcgtgtagttggaaaccggagaatatagaagaggtcgctcgaatttccgcaaaggaagttggtgctgatggtatctgttggacatatagcccgatggtcgatatatctcatgatgcccggtggggacgagtaaaggaaggagcgggcgaggatccgtttcttggaggtataatggctcaagcatgggtgcgtggttatcaaggcaatgatttatcggctgatacgactcttatggcatgtgtaaagcattatgcgctttatggagcggccgaggctggtcgggattataatacggtagatatgagccgtgtgactgccatgaattattacatgcgtccttatcaggctgctgtagaagcaggagtaggaagtatcatgacttcattcaacgaatttgaaagtatccccgcgaccggaaatacttggcttcttaatgacgtgttgcgtaaacaatggggatttaacggctttgtcgtgtctgattttacggcaatagcggagatggtaaaccatggaataggtaatagtcaggaagtcggagtcaaggcgctaaaggcgggtgtcgatatggatatgatagcggactgttatcatgccgtattaaagaaatcattggaagaagggaaaataacagaggctgagattgactctgcttgccggagaatactaatcgcaaaataccaattgggattgttccatgatccatataaatattgtaatccgaaaagagccgccaaagagttcttgtcggtaaataacgtatccgcggcccgtcgtattgcggcggagtctttcgtgttacttaaaaatgacaataatctgcttccacttaaaggatgtcgtaaggtcgctgtagtcggtcctttagcggatagcaaggcgaatatggctggatcgtggaaatatgatgagcagactaaatcttatcatggattggtagaggatttacaggaatctttgggaaatggagtagaggttgtttttgcaaaaggcagcaatctagtcgatgattccgtctatgaagcaaactttacggatcaaaatcgttcaacccgggatgatagaagcgatgaacaattaatcgccgaggccctaaaagtggcggaaggcgctgatgtgattatcgctgctttgggtgaatcgatagatatgagtggagaaggcgctagtagagccatccttgaaatgccgcaaacgcagaaaaaattactggatgctatccaaaagacaggaaagccgatcgtaatggtactttttaccggaagacctttggcattacaatccgaggaaaagcaggtgaatgcgatcttgaacgtatggttcggtggtacggaagcaggagcggctattgccgatgtcttgaccggaaaggtttctccgacggggaagttaaccatgtcttttcctcgtgtaacaggccaatgtccgatctattacaatcataagatgacaggacgtcctatgtctcctgatgcttggtacactcgttatgtctccaattatatagatgtgttaaatgagcctctttatccatttggttacggtttgagttatacgacttatacgtatggcgatgtatctttgaatacgaattctatggatgcaaatggaaaaattcaagcatccgtgattgttaccaataccggggctcaggatggagaggaaatcgtacagctttatttacgtgatatcgtacgcagcataacccctccggtccaagaattgaaaggattcaagcgagttgcgttaaaagcgggagaaagcaagaaagtaacctttgatattgatgtggatatgttgaaattctacgattcaaccttagattatgtcgctgagccgggtgagtttcaggtaatgatcggtggaaatagtaaagaggtgaaaacagcttcgtttacattaaaataa

SEQ ID NO: 1390 - DNA, 2415 bp, Parabacteroides distasonis
atgaatgtaaaaacacttttttatgcggtagccttcttgagtttgtcgtgggcgtctttcacctatgcgcaagatgtcctgccggaatatacgcaagcacgccgtttcgccccgtcgaatgcggaacagttacttttctcttatacccttacccccaattattttaataatagtgacaaattctggtatgagtataagacgagcgaggggacaaactggtatctggtggaccccgattcgagaaataaacgattattattcgatcgggatgagttggcggcacagataagcgagatcgtgagagagccttttaccggacaacaacttcctatcgaagatttacgcttaaaggaagatgatcgcacgtttactttctcgataaagggtacgaacgggaactattttttctcgtatgattatccgtcctcccggttgactcggattacgaaagacgagattcctgctaaaatccgttgggcgaatatatcgccggataaaaagcgggtcgtcttcgcgaaagatttgaacctgtatgtcatgagttatgaggattatgagaaggccgtgaaggacccggaggataagacgatatccgagatcgccttgactacggatggcgaaaaagattttggctttggtattccccggactttcttgaataccgatactttatgtgaccataagcggaaatatgtaatggggaactggtctcccgatggtcgttatttcgtcgcgaccttgtcggatcaacgtgaggtacaagatttatgggtgattaactcgatcgccaaacctcgtcctacacttgagacctataaatatcagatgccgggagaggcgggttctccaatcgttcatttatatctctttgatttggaaaatgccggaaagcggaaagaaatccgggtggattgttttaaagatcaaataatcaatctagcctccaagccggataaggagcgtatgggactcactcggaactcgatctggttgggagataaccagaccttctatttgacccgtgtcagccgggatatgaaacgggtggatatctgttcgtatacgatcggggaggattcggtaaaagcgatcattgaggaacgtctaaatacttctatggaaacccgcccgctagcgatgaccgataatggtaaggaattgatccattggagcgaacgggatggttgggcgcatctgtatctatatgacgcgcaaggaaatttgaaaaaccgtatcaccaaaggaccttggcatgtggacgccatcgtagacgtggacagtaggaatcgtgtcgtttacttcaaggcgaatgcccgggaaaagggagatacgactccttattacgagcatttgtaccgggtgaatctggatggttcgggcttaaagctgattactccgggcgattatttccacctggtctctatggataaatccatgcgatatatcgtggataactattctcgtgtcaatacgatcccggctacggcattgtatgataaccaaggtaaccgattgatgaccttggaggagagtgacttctcccaattattcatggcaggttataaattccctgagcctttttcggtaaaggcggccgacggggtgaccgatttgtatggtgtcatgtataagccttttgattttgattccacgaaagtatatccggtcattaactatgtataccccggaccgcaacaggagggaactttctttcgctacatcccgatgaatcctcgttcggatcgtttggcgcaagccggatttgtcgtggtgtgcatgggacataggggagggcatcccagtcgctccaagtggtatcataattatggatatggaaatttgcgtgattatccgatggcggatcataaagtggctatcgagcagttgtgcgctcgttataaattcatggatatcaaccgggtcggcatacacggacactccggtggcggtttcatgtctacagcggctatgctgctttatccggatttctttaaggtggcggtatcttgtgccggcaatcatgacaataacatttataaccggtggtggggagagaaacatcatggggtaaaggagatcacggatgatatgggaaatatctcgttcgatattcgcatcccgaccaatcaggaattggcgaggaacttgaaaggccatctgttattgatccatggcgatatcgataataatgtgcatccggcgaataccattgttgtcgtggacgagttgatcaaggcaggcaaacgctttgatatgttgatcgtaccgggaaaacgtcatcattttgatgactataatgagtattattattggcggatggtcgattacttctctgagtatttgagaggcgaacgggaaacaggtgcggatataaaagatttgaaactgggcaattggtttcaggggtatcagtga

SEQ ID NO: 1391 - DNA, 1713 bp, Parabacteroides distasonis
atgaacgcaatggaacaaaaaaacaagatggtaatttatcaggtattcccgcgttggtttgggaatctgcgaccatctcctgtaatgaatggtagtttagccgagaatggagtgggtaagttttcggcttttactcctttggctttatccaaaatcaaagaactaggtgttactcatgtatggtatacaggggtgatagagcacgctacaaaaaccgattacaccatgtttggcatccggaaagaccattctgccgtagtaaaaggtaaggccggatctccatatgctataaaagattactatgatatagatccggatttggcggataatatccagaaccgtatgagtgagttcgaggatttggtgaaacgtacgcatgaggctgggatgaaggttattatcgattttgtacccaaccatgtagcacgtcaatatttctcggacgcacgggaacctttcgtggaggacttaggtcaaacggataatgtgtccaaggcttttgatgtgaataataacttttattatcttccggggcaaaccttgacgcttcgttttgatccgcagcgtgaggaggattttgcctatagtgagtttccggcgaaggtgaccggtaacaatcatttcgatgcctatccaagccagaacgattggtatgagacggtgaagctgaactacggcgtggattatatgcacggtggtgcttgccatttcaataccattcccaatacgtgggagaaaatgttggagatcttgttgttctgggctgataagggggtggatggttttcgttgtgatatggctgagatggtcccggtagagttttggaactgggtgattcctcaggtgaagaaggtgcgtgatgtgatctttatagcggaggtgtataatccggatgagtataggaattatatttatacgggacactttgattatttgtatgacaaggttggtctttatgatacggttcgtgcggtgatgtgcggacaggctccggctagtaatatatcgcattgttggcaatcgttggagggaatccagaaaaatatgttaaatttcttggagaatcacgatgaacagcgtgtcgcttctgatttctttgcgggggatgctcgtccgggtattccgggcatgattgtctccgctgccatgaatacaaatccggttatgatctatagtggtcaggaacttggcgaaagaggaatggatgcggaaggtttcagtggacgtgatggccgtacgtccatcttcgattattggagcgtcgagagtttgcggaactggaataataatggactctttgatggggctaaattaacgccggcagaacgctcgttgcgtgagatgtacgctaagttattgaatgtggtacgatccgagccggttattgtcgagggagcgttttatgatttgatgtacgcgaactccggtaatccttatttcaatccgaaccgtcagtatgcgttcttgcgcaaatggaagaacgaggtacttctggttgtcgtgaatttcgaccgtgccgaccaatgtgtatgggtaaatatcccggtcgaggcattcaaggctcttgattttgaggataacaaaccggctgaattgaccgacttgttaaccggggaaacgactatcagtacgctaacagacgcttatccttatcaagtgaaactccctgcttattccggtaagatgctaaagttctcttttctccataaataa

SEQ ID NO: 1392 - DNA, 3345 bp, Parabacteroides distasonis
atgaatatgaactctatcaaaaaaatgatgctttccggagcattaggttgccttatttccggaatggcttatgcggacggttcttcaccccaacccgtaaaaccttattggcaagacattcaagtcgtagccgtaaacaaggaaaaacccagaagctccttcatgagttatgcggaccgggaaaccgccctcacctctcgatttgagaaaagcccgtactattccctattaaacggtacttggaaatttttctttgtcgactcttacaaagatcttcctcaaaatatcacagatccttccgttaatacctcttcatgggatgatataaccgttcccggaaactgggaagtacaaggacatggcgtagccatttatacgaatcatggttacgagtttaaaccaagaaatccccaacctccattattgccggaagcgaatccggttggcgtataccgcagagacatcgagatacccgcaagttgggataaccgggatatttatttacacatcggcggagctaaatccggcctttacgtatatttaaacgggaaagaagtgggttatagcgaggattccaaaaatcccgccgagttcctgatcaataaatacctgcaacccggaaagaatgtgcttacattaaagatattccgttggagcaccggttcttatttggaatgtcaggatttctggagaatgagcggtatcgaacgtgacgtattcctttggtctcaacccaaggccagtattcaagatttccgtgtcgtctcaaccttggacgatacgtatacgaatggaatcttcaaactggcggtagacttaaagaatcatacccaagaaacgaaaaatttaaatgtcggatatgagcttttggacgcaaaaggtaatcttgtgacctccgaggctaatgatatatgggtaagtcctgcaagtcctcaaacagcatctttcgagtatgatttaaagaacgtagccccttggagtgccgagcatccgaatctatacaaattattgatgacgataaaagaagagggtaaggtaatcgaggtagttccattcaacgttggtttccgccggttcgagatgaagcaaattgaccaagtaacggaagacggaaaaccttatacggtcttattgttcaatgggcaaccggttaagttcaagggtgtcaatatccatgagcataacccggaaaccggacattacgtaaccgaggaactcatgcgtaaggatttcgagctgatgaagcaaaacaatatcaacgctgtccgcctatgccactatccgcaagaccgtaaattctatgaactctgcgacgaatacggattgtatgtttacgatgaggcgaatatcgagtctcacggtatgtattacagcctgaaaaaaggcggcactttgggtaataatccggaatggctgatcccgcatatggaccgtacgatgaatatgtacgaacgaaacaagaattatccgagcgttactttctggtcactcggaaacgaggctggaaacggatacaacttctatcaaacttatttatatctgaaagacaaggaaataaatagcatgaatcgtccggtgaactacgaacgtgccctttgggaatggaatacggatatgtacgtacctcaatacccgagcgctgaatggctagaggaaatcgggcgtaagggtagtgatcgtccggtagctccttcggagtattcacatgcgatgggaaactcttccggtaacttatgggatcaatggaaagctatctataaatacccgaacctgcaaggcggattcatctgggactgggtggaccaaggtatcttggaaaaagataagaatggacgtgaatattatacctatggtggtgactatggagtaaacgcccctagtgacggaaacttcctttgcaacggtatagtaaacccggatcgtaccccgcatcccgctatggcagaggttaaatacgcccatcaaaatatcgggtttgaggcgatcgatttagcgaacggtttattccgcgtcacgaaccgtttttatttcacaaacctaaagaaatatatggtccactatagcgtaacagccaataataaagttgtacgctccggtaaagtctctttggacatagaaccgcaagcttctaaggaatttacggttcccgtaggcaacttaaagccacaagcaggtacggaatatttcgtaaacttcaacgtaacgaccgtagaaaaagagccgttaatccctatcggacacgaaatcgcttgcgatcaattccgcttaccgatcgaaagcaccaagaaggcgtttaagaccagcggccctaaattaacggtttcaaccaatggagataacttatcggcatcctcctcaaaggtaaacttcgtgtttaacaggaagacaggaatcgttacttcttataaagtggatggtacggaatatttcagcgagggttttggtatccaaccgaacttctggcgtgcgccgaccgataacgattacggaaatggtatgccaaaacgcttacaagtatggaaggaaagcagcaagaacttcaacgtgacagacgctaccgtcactatggatggcaataacgccgtggttaacgtgaactatttattgccggcaggaaatctatacattgttaattatacgatctatccaagcggagctgtaaatgtggccgcccgtttcacatccacggatatggatgccgcccaaaccgaggtatcggaatctactcgcacggcaactttcactccgggacgtgacgccgcccgtaaagaggcttccaaattgaatgttccccgtatcggtgttcgcttccgcttaccggcaagcatgaatcaagtggaatatttcggacgaggacctgctgagaactacttggatagaaacgccggtagtatggtcggcttatataaatctacagccgaggaattatatttcccatatgtacgcccgcaggaaaacggtcatcataccgacactcgttgggtatcacttagtaccggcaagaaaggcttgttgatccaagcggataatacgattggatttaacgctttgcgtaattccatagaggatttcgatgacgaggaagcaactgggctaccccgtcaatggagtaatttcacaccagagcaagtagcgaaccatgatgaagccgcagcaaagagcgtattacgtcgccagcatcatatcaacgatatcacgcctcgcgacttcgttgaggtttgcgtcgacttgaaacaacaaggtgtagcaggttatgatagctggggttcacgtccggaaccagcttatacattacccgcaaaccgggaatacaactggggctttacccttattccgcttaaataa

SEQ ID NO: 1393 - DNA, 2613 bp, Parabacteroides distasonis
atggttgatcaagacagaattattaagattaacatcgaagaggaaatgaaatcggcatacattgattattcaatgtctgtcattgtttcacgtgctcttcctgatgttagggatggctttaagccggttcaccgccgtattttatttggaatgaatgaactgggtaacacatccgacaaaccttataaaaaatctgcgagaatagttggtgaagttttaggtaaatatcatccacatggcgactcgtctgtatatttcgccatggttcgtatggcccagacatggtctatgcgttatccgttagtagacggacaaggtaacttcggttcagtggacggtgatagtcctgccgctatgcgttatacagaggcacgactgagtaaactcgccgaagaaatgctccgggatatcgataaggacacggtagatttccagctcaacttcgatgatacgttgaaggagccaaccgtattgccgactcgtgttcctaacttacttgtaaatggtggatcgggtatcgccgttggtatggctacgaatatgccgactcataacttgagcgaggtattagatggttgtatcgcttatatcgatgccaagggagatatcgaggtagagggcttaatgcaatatatcaaggctccggacttccctacaggcgctacaatttatggctacgcaggcgtgaaagacgcttttgagacgggtaggggacgtatcatccttcgcggtaaagccgagattgaggtggagaataatcatgagaagattattattaccgagattccttatttggtaaataaggctgagttgatcaagtatatcgctgacctggtaaacgagaagcgtatcgatggcatttccaatgtcaatgacgagtccgaccgtagcggtatgcgtatcgtagttgacgtgaaacgtgatgcgaactcgagtgtcgtactgaataaattgtataagcttacggctctgcaatcctcattcagcgtcaataatatcgctttggtgaacggccgtccgaggttgcttaacttaaaagacttaatcaaggcgtttgttgagcaccgtcatgaggtcgttatccggcgtacaaaatatgaattgaggaaagcggaagagagagcccatatattggaaggcttgatcatcgcttccgataatatagacgaggtaatcgcgattatcaagtcttccaagagtccgcaagaggctatcgagcgtttgatcgaacgtttctctttatctgagcttcaagcacgtgcgattgtcgagatgagacttcgtcagttgacaggtctggaacaagacaaattgcgtgcggaatatgaggagatcgagaagttgatcgcttatttgaatgagattctggagaatgaggacctttgcatgaaggttatcaaagatgaattattggaaatcaaggataaatttggcgacgaacgtaagacggatatcgtttacgcctctgaggaattaaatccggaggatttctatgcggatgatgagatgatcattaccgtatctcatatgggatatatcaaacgtaccccgttaagcgagttccgtgcccaaggccgtggtggcgtaggagcgaagggttccgagactagagacgaggatttcgttgagtatatctatccggcatccatgcacgcgaccttattattcttcacggcaaaaggtaaatgttattggttgaaggtattcgagattccggaaggagctaagaacgctaaagggcgtgcgatccagaatcttctgaatatcgagccggatgataaggtacaagcctttatacgtgttaagaaattaaccaccgatacggaattcattaattctcattacctattattctgtacgaagaaaggcgtgatcaaaaagactttgttggaggcctattcccgtcctcgtcaaaacggtgtgaacgctattacattgcgtgaagacgatggcttgatccaagtatgtatgacgaatggcaacaacgaggtgatcatagcgaaccgtaacggccgggcgatccgtttccatgaaagcgcagtacgtgtaatgggccgtacggcttccggagtgaaaggtatgactttggacgaggataataccgatgaagtcgttggtatgatctgtatcaaggacaaggaaaaagagaccgtactcgtcgtatcagagcagggatatggaaaacgttcctctatcgaggattatcgtataacgaatcgtggcggtaaaggcgtaaaaaccattaatatcacggagaagaccggtaaattagttgccatcaagaatgttacggacgagaacgatttaatgattatcaataagtcgggtatcgctatccgtatgaaagtggccgatttaaacgtaataggacgtgctactcaaggtgttcgtttgattaatctagaaaagcgcaacgacgaaatcgcttctgtatgtaaagtattgtctgagagtgaagaggagatagccgagcaaaaagcggaacaagaagccagacaagagaatgagggaagagagttcagtgagaatcaagctagtctaggtactgatgttgatctaccggaatcagaggaggataacgaacaaaatgataacgaagaaataactgaataa

SEQ ID NO: 1394 - DNA, 2148 bp, Parabacteroides distasonis
atgcaaagttggcgtaaacgctgcaatctccgcaaattcttattatttttgtttcaaattataacgaaaaaaattacgcatatggtattagcctcgacaatagatttcacattgcccttagcggacccggtattaaaatttctcttgattcttttaattatcctggccgctccccttttattaaacaagctgagaatccctcacctgcttggactgatcattgccggcgcaattatcggaccgcatggctttaatctcgtattacgggatagcagcattatcttgtccgggacggcgggattgctttatatcatgtttctcgccggattggaaatcgatatggcggattttaagagaaatagtacgaaaagcctagctttcggcatgtacacattcctcattccgatgatcctaggaacggttgtcgggatatgggtcctgcaattcaacgtattgacctccgttttactcgccagtatgttcgcctcccatacattgatcgcctatccgattatcagtaaactgggtatcagcaaaaacaaagctgtcagtatcaccgtaggaggaacgatgatcactgataccttggcattgctcgtcctaacgatcattgtcggcatggccaccggacaggtcaacgatatgttttggattcgtctgggggtttccatcttgatattcgcgttaatcgtattattcggtttccctttcattgggcgttggttctttaagcatgtacacgataatatatcacagtatatattcgtgctggtgatggtatttctgggatctttcctagctcaggtagcgggcatggaggcgatcatcggggcgttcttatccggactagccctaaatcgccttatcccgcaaagctcacccttgatgaatcgtgtcgagttcgtaggaaatgccatattcatcccattcttcttgttgggcgtaggtatgttaatagattatcgtacgttctttaccagtttcgagaccattaaagtaggacttatcatgattatcgtagctacggccgccaaatacatagccgcttggatgacccaaaagactttccatctgtccacggatcagcgaagcgttattttcggcctaagtaacgcacaagccgccgctacattggccgccgtgatggtcggatataacgtaatcaccggaacagacgctaatggggaaccaatccggttattaaatgagagcgtgttgaacggtacgatcctgatgatacttgtcacttgcaccatcgcctctttcgccgcccaaaaaggcgctcataacatagcggcccaagatatatccgataaggaggaaaacaaaaaagaatcagagcatatcttgataccagtcagcaatgaagagaccgtggaagagctggtcaacctcagcttggcgatcaaatctccccaaaacaagaacggcttgtttgccctaaaagtgatagataaccatcattcagacgagaaagcgttaaaacaatcccgcagggttctacagaccgcagtcaatacggctgccgccacggatacccggatgaaggatttattaagatatgacttaagcgtatcgaatgctatcgccagcgtggtaaaagagcgggagatcacagatctggtagtgggattgcacaaggaaaaagatataccggcggccttccttggccatatcgtggaaagcgtattggcggaaagtagtgtaagcacattcatatacaagcccgcacaacccatctctactgttagacggcatctgatcatcatcccggaattggccgaaaaagaaatcggtttcaaccaaatcatcttccggctacgaaacgtgacccagaacacaggtgcagcgacagtcttttacggttcggaagcgaccttgaatgccttaaagaaattattagccaagaaaagcggagaagccagttatatcgaattcaacgactgggatgacttcctgatcgttttccgggatataaaatcggacgacacgatgtggattatccttagccgcaaggaaggactttcctacgctcccgccatggcccgtatccccaagtacctcaacaaatactttcaggcaaacagtttcgtcttggcatatcccgtgcaagctggcatgaacgagggcactcgctatctgacttaa

SEQ ID NO: 1395 - DNA, 2523 bp, Parabacteroides distasonis
atgagattatcagaacttcgcacaggcgataaaggtgttatagtaaaggtaatgggtcgcggagctttccgcaaacgcattatcgagatgggatttatcagagggaaagaagtgatcgttatacaaaacgctccgctcaaagaccctattcactatcgtgtaatgggatatgatgtctcattgcgacgctcggacgccgcattgatcgaagtcgttagcgcggcggatttcgaaaaggaacaagctacctcggtacaagatacgaacaggagcgcagactcttttatcctgccttccggcaatgaattgcaagccatcgcattacataaaggaaaaacaattaacgtagccttggttggtaatccgaactgcggaaagacctctcttttcaattttgcgtctggagcacatgagcatgtgggtaattatagcggcgtgaccgtagatgccaaggaaggaaccttccaacagaatggctatacattccgcatcgtagatttaccgggtacttactccctatccgcttacacgccggaagaattatacgtgcgcaagcatttgaatgaagagcaaccagacgtggtgatcaatgttatcgacgcatccaatctggagcgaaacctatatttgaccacccaactgatcgatatggacgttcgcatggtaatcgccttaaacatgtatgatgagctggaacgccatggtaataaattcgatcatgagtccttagcgaaaatgatcggggcaccgattatcccgaccgtaagtaaaacaggctttggcatagaagatttgttcaaccgtgtaatcaaggtatacgaagaagaagatcctgtcatccgtcatatccatattaattacggagagtctttagagaaagggatcagcaatgttaggaagaccttgaaaaatagcgtggatatacccaaaagcttgtcaaagcgctatctatctatcaagctattagagggagaccgggagatagagacatttataaaaacgctgcccggtgctgaaacgatcttccaagaaagagaccgtaatacagccctaatagaaaagttattgcaagaggattgtgagaccgcattcacgaacgcacgctatggctttatttccggagcgttgcgtgagacttacgagcaaaatacgatcaaagaggcaacgaatacgcagatcatcgatctattcgtcacgcataaagtcttaggcttccctatctttatcctattcatgtggatcatgttcgaggccactttccgtttgggaggctatccgatggaatggatagaggcattggtcgaggtgatcggtaatttcgtgcgcggccatatgtcggaaggacctttgaaggatcttctcgtggatggtatcatcggtggcgtgggaggtgttatcgtgttcctgccgaatatcttgattctgtatatgttcatatcgttcatggaagactccggatatatggcacgtgcggcttttatcatggataagatcatgcataagatgggactgcatggaaagtcgttcatccctttagtgatgggattcggttgtaacgttcctgctatcatggcctcccgtacgatagagagccgtaatagccggatgataacgatgttggtaaatccgttgatgagctgtagcgcccgcctgccggtttatgtattgctgaccggggcgtttttcccgaagaacgccagctttgtgttattagctttatatgtatccggaatcttgctggcagttatcatggcccgtcttttcaaacgcttcctgtttaacgaggaggatgttcctttcgtaatggaactccccccctaccggatgcctaccggcaaatccatcatgatccatatgtgggagaaagcgaaacaatacttgcacaagatgggaggtatcatcttggtcgcttctatcgtcatctggttccttgggtatttccccagacattcggagagcggagatcagtttgatcgccagatagcggagatcgaaaatacggagttggattctcaagaaaaaacagatacgatagaggagttagaacgcttgaaggcaatcgaccaccaacaaaattcgtacatcgggcgtatcggccagacgattcaaccggtcttggctcccttaggattcgactggaaaatgagtgtaagcttacttaccggtatggcggcgaaagaagttgttgtcagcacgttaagcgtattatacacggggaatgccgatgataacagccaagccctgtcggagcgtttgaagcaagaccgtaacgcagaagataatttggtattcacaccgctcatagcgattagcttaatgcttttcgtcttgatttattttccgtgcatagcaactatatcggctattgtcaacgagtctggctcatggaaatggggtatattcgttatcatttatacttgtgtcctagcatggatcgtttctttcattgtttatcaaacgggaaatttctttgtgggtttattcagccaagaactttcctatgttttatttagttatatatag

SEQ ID NO: 1396 - DNA, 2256 bp, Parabacteroides distasonis
atggaaacattttatttgttcttggtcatatttttgtttgtattggccatcgtagatttatcggtcggtgttagtaatgacgccgtgaatttcttgaattcagctatcggcgcaagagccgcatcctttaaagttattatcgctatcgctgccgtgggagtctttgttggtgcggcgttatccaatggtatgatggatattgcccggcatggtatttatcaaccccagcatttttatttctcggagatcatgtgtatccttgcggccgttatgcttacggatgtggtgttactggatatttttaactcgttaggtatgccgacctcgacaacggtttccatggtgtttgagttggtgggtggaacggtagcgattgccttggtaaagatcgctagttcttcaggcgctttgcaattgggggatctgctgaatacagagaaggcttttaccgtgattctgggtatctttctttctgtggcgatcgcttttttctttggtgtgatcgtgcagtatctgtcccggatcttgttctcatttaattataagaaaagttctaaatattttattggtctgttcggaggtttagcggccacttccatcatttactttatgctgataaagggactgaagacaagttcttttatgacgggtgagttcaaggatatggtgtatgccaatacggggatgatcgttttgggatgtatggtattttttacgatcttgatgcaggtattgcattggttgaaggtgaatgtattcaaggtggtcattttgatgggtacgtttgccttggcgttggcttttgccgggaatgacttggtgaactttatcggagtccccttggctggctattcctcttatatggacttgatggcgcagggagggaccactaccacggatacatttttgatgacctccttgttgggaccggcccagacaccttggtatttcttggtggggtccgggatcgtgatggtaatcgccttggctacctccaaaaaggctcagaacgtggtgaagacttccttggatctgtctcgtcaatcggatggagaggagtctttcggtacatcgcctgtcgcacgggtattggtacggaattgcagtaatatatccgctacgatattaagtatcgtgcccactccggttaagaactggattgatagccgtttcgaccaaagcgagatgatcatggatgacaaggctagcttcgacttggtacgtgcctcggttaacgtggttttgtccggcttgctgatcgctttgggaacctccttgaaattgcctttatctacgacgtatgtggctttcatggtcgctatgggtacttcgttggcagaccgtgcttgggggcgtgagagcgccgtatatcgcatcacaggcgtattgtccgtgataggtggttggttcattacggcaggggctgcttttacgatctgtttcatcgtcgctcttttgatttattggggaggtattccagctttggtcgctatgattggtttggcgatctattcgttggttcgtagccacttcgcttataaggctaaattgcggaaagaggcattgaaggaggaggtgaattctacggtgtctaaacttcgtaaggctacggatacccgtgaggctttggccctgttccgcgagcatagccgtgaggaattacaatccgatctggattttacggcggaagtattcggcaaggcggtaaatggattcatgaatgagaacctccgtgagttgcgcaaggtcttgactgccgtggaggagaagaagattcacttgaaacaagtgaaacgtgtcggtacgcttggcgttacccaattggatcacgatatcgccgtggagaaggggctttattattatcaaggaaatgacttcgccagcgagatcatattcagtatccgtcgcttggcagaaccgatgaaagatcatatcgataataatttcagcccgttgagtccggtacagaaagatgattttggtaaggtatctgaacaaatcatctccttcttgagaaattgcgctactatgatccgtaaaaacgattatattggctttgaggagctgatcgctgagtcgattaccttgatgaaccaacttaccgccttgaagaaaggggagttgaagcgtatccaagggcagtccggcagcacgaaggtgagcatggtttatttgaacatggtacaagaggcccagaacgtggtttcttttacggcgaaccttttgaaggtgagtaggaagttccagaaggaataa

SEQ ID NO: 1397 - DNA, 2193 bp, Parabacteroides distasonis
atgatatttattgttaaactcaaattacctgatatcatgaaagtataccaaacaaacgaaattaagaacatctctatcttgggaagttcgggctctgggaaaaccactctcgctgaagctatgctttacgagggtggagttataaaacgccgcggctccgttgaggcaggaaatacggtgtccgattatttcccggttgagaaagagtatggatactcagttttctcaaccgttttcagtgttgagtggcaggatcggaagctgaatttcatcgattgtccgggttcggatgatttcgttggaggagctgtttccgctctgaatgtcacggatacggcactgatggtattgaatgcccagtacggtgttgaggttggaaccattaaccagttccggtatactgaacaatttcataaaccggtgattttcgttgtcaatcagcttgataatgataaagccgactatgagggaactatcgcccagttgaaagaccgttggggcagtaagatcgttccgatccaatatccgattagctgcggctcttctttcaatgccgtggtggatgtattaaaaatgaagatgtatcgttggaaaccggaaggtggagttcctgatgtattggaaatccccgccgaggaaatggataaggcgatggagttgcatcaagccttggtggaagccgccgctgagaacgatgatactttgatggagaaattctttgaggaaggtgccttgagcgaggatgatatgcgtgccggtatccgtgcgggcttggttactcgcggtatgttcccggtattctgcgtatgtgccggtcgtgatatgtgtgttcgtcgtacgttggagttcttgggtaacgtggttccttgtaccgacaagatgcctcgtctgattactacggaaggcgtagaggtgactccggactcgaatggtcctactagcttgttcttcttcaagactaccgtggaacctcatattggtcaggtttcctattttaaagtgatatcaggaaaagtaaaagaaggtgacgatttgatgaatgccgatcgtggttctaaggagcgtatcgcacagttatttgcggtagccggacaaactcgtaccccggttacggaaatggtggcgggtgatattggagcgaccgttaagttaaaggatgttcgccgtggtaatacattgaacggaaagggttgtgattatcgtttcgacttcattaaatatccggatccgaaatatcgtcgtgctatcaagccggtgaatgaggctgacgccgagaagatgatggaaatcttgatacgtatgcgcgaggaagacccgacatgggtaatcgagcagtccaaggaattgaagcagacaatcgtttccggtcaaggtgagttccatcttcgtacattgaaatggagaatcgagaataatgataaattgccgatcgaatatctggagccgaagatcccgtatcgtgagacgattacgaaagcggcccgtgcggattaccgccataagaaacaatctggtggcgcaggccagttcggtgaagttcacttgattatcgagccttattatgaaggtatgcctgctccggatacctaccgtttcggcggacaggagtataagatgaatgttcgtgatactcaaataattgatttggattggggtggtaaagtcgtgttcgtaaactgtatcgttggtggtgctatcgacgctcgtttcttgccggctatcctaaaaggtatcatggctcgtatggagcaagggccgttgacgggttcgtatgctcgcgatgtgcgtatttgcgtatacgatggtaagatgcacccggtagacagtaatgaaatctctttcatgcttgccggacgcaatgcgttcagtaccgctttcaaggaggctggccctaagatcttggagcctgtttacgatgtcgaggtttccgttcctgctgattatctgggagatgtgatgagtgacttgcaaggacgccgtgccttgattatgggtatgaatagcgagaagggatttgagaaactattggcgaaagttcctttgaaagagatgtctaactattctacttcactaagctccattacgggcggacgtgcttcctttacgatgaagttcgctagttacgagttagttcctgccgatgtacaagagaagttgttaaaggcttacgaggctactcaatcagaagaatag

SEQ ID NO: 1398 - DNA, 2412 bp, Parabacteroides distasonis
atgaagattcgtgcgatagctgcgctgctatttatacttatttccgtgagtgcctttggcgagggccgcataaaaatcactggttatgtccgtgacgccgacggtaaccctctggaattagtgaatgtccgggttaagaacacgttgatcggctccatgaccaacgagaagggatattattccttttccatatcgccgggggattctatctccgttatttactcttgtctgggatataataaggctgagcgtatcattccctcggcacaagcggatatgcgcctgaacgtacagatgaacaatacctcatttgatttaggggaagtatccgttactgccatccgcaagcagaccacgaccatggagtccctaaatgcggacaaaattaagttattgcccgatccctccggaggtagtatagagagcttggtcgttacgtttgccggagtatcgtccaataacgagttaagttcccagtattccgtacgtggaggtagttatgatgaaaatatcgtttatgtgaatgggatcgaggtattccgtccgcttctgattcgctcgggacaacaagagggccttagttttatcaatccggacctgagggaggcggtcaatttcgccgccggtggcttcgaggctcgttacggagacaagatgagttccgtgctggatattacctataaaaagcctaagatattcgaaggctcggcttccgcgagcttgttgggagcgaatgcttatgtaggcagttctatcggtaaatttacccaagtaacgggtttccgctttaaaagcggtcggtctattttgggtaccatggatacagacgcagaatacgaccctaaatttatcgatttgcaaacttacatcacgtaccaattggcccctaaatgggaaatcaatttcttaggaaacctcgctaacaataattataaattcaccccttatagccgggaaacctctttcggtacagccgagcatcccaagaacttcaaagtctatttcgacggaagggaaagagaccgtttccaaaccttattcggtgcgcttacattgaaacacaaccccaatgagaacacagagttgggacttcaagcctccgctttcaaaagcaaggaagaagagggatacgatatcgccggagaatattggctgagcgagaacggagcggaaaatccggatgacgacgcgtcagccgccatgtccgtaggccgttatcacgagcacgcacgaaaccgtttgaactccaccgtcatgaatgtcgggcactatgggatggcccgccttttaaacaatacgttgaaatggggagccacggtacaaatggagaaaatcaatgataagatcagtgaatgggaaaaaagggattcctcaggttattctttgccccaaaccggtaataacgtaagtgtatattcgaacctcttttctgataatcagatagaaagcacacgcttttccgcttatgcgcaagacgcattcaaattcaggaccaagcaaggtctgttcacgttagtcgcaggggttagaggtagttattggacttataataaggagttccttttcagtccccgtgcctcattgggctttatcccgaacttcgaccaagacttgacgctccgtttcgccaccggactgtattatcaatcgcccttctacaaggaattacgtagagtagacaaagataagaacggcaataatatcacggtattgaacaaagatctaaagtcacaacgctccatccatttcatattgggaggagattatacgttccgtgccgtagaccggaatttcaaggtgaccgccgagatgtactataaaaagctggacaatctgaatccctacaccgtagataacgtcaagatccgctattacggtgagaactgcgccaaaggttacgccatgggactcgatgtcaaattcttcggagaattcgtaccgggtaccgactcatggatcagcttctccttgatgaaagcccagcaaaccatccgggaaacaacgaccgttcctatggccaatagccaaggctacaacatctcactcttcttccaagattatttcccgggctataaacgagtcaagctaaatctgaaaggagttctatccggaggacttccccagacaatcccgggcaaaggatacgaagccggctatttccgtacgcccgcctacaaacgtgtagatatcggcctctcctatcaattggcaggaggcacggacgctatcatggacaggggcttcttccgccatttgaaaaacatttggctaggtctggatgtatttaacatattagacatcaaaaacgttagttcctactattggataacagatgtatataatgtccaatacgcagttccaaactatctgaccggacgtcaattgaacgttcgtctgattgtcgatttttaa

SEQ ID NO: 1399 - DNA, 2568 bp, Parabacteroides distasonis
atgaaaaattattcgaaaagattgattgacgtgattgagtatagccgtgaagaagcggctaggctccagaatagctatatcgggccggaacatttgatgctaggcatcatccgggaaggcgaaggcgaggcaatgcgtgtcttgcgagagctacataccgatccgatggatattaaacgcaagattgagcaagaaataaagaatacattcgattctgaggattctgtccagcatgagatcgctataagtaagactacagaacgtgtcttgcgtatgagtatgctggaatctcgtttattcaaggaagatgagaccgatacggaacatcttctattggcgatattgaaagaggagtttaacgtagccgccaaggtgttgaacgacgcgggtattacttatcgttccgcatataatatattagtaagcggaaccggtttgaacaatatggaggaattcgacgagatcagcgacggatatacggatgatgacgaagatgacgaggacgaaggtttctcctctcgtcgtgaggcatctcgcccctcttccggtgctggagcgggagccgctcaaccgaaatcccctaatgatacacctgttctggataacttcggaacggatatgacacgtgccgccgcagaaaaccgtctagacccgattgtgggacgtgagaaggagatcgagcgtttggcccagatattaagccgtaggaagaaaaataatccggtattgattggtgagccgggtgtgggtaagtcggctatcgtagagggattggctttacgcattattcagcgtaaggtttcccgggtgttattcgataagcgtgtgattagcttggatatggcttctattgtcgccggtacgaaataccgcggacaattcgaggaacgtattaaggctatcttgaatgagttatcgaagaacccgaatatcatcctctttatcgatgagattcatacgattgttggcgctggttccgcttccgggtctatggatgcggcgaatatgctgaaacctgcgttggctcgtggtgagattcaatgcattggcgctactactttggatgaatatcgtaagaatatcgagaaagacggtgcgttggaacgtcgtttccagaaagtgatcgttgatccgactacggcggaagaaactttgcagatcttgcgtaatatcaaacctcgttatgaggagcaccataacgtgatctatactgaagatgctttacaagcgtgtgtaaaattgacagaaagatatatcagtgaccgtaatttcccggataaggcgatcgatgctttagacgaggccggttcccgtgtacatatatctaatatcattgttccgaaaagtatcgaagagcttgaggcaaagatcgaggatacgaagaatgagaaattagcggccgtgaaatctcagaactttgaattagccgcaagtttccgcgataaggagcgtcagtatttattgcaactagaggccgcgaaagctaaatgggaacaagagcttcaagaacatcgggagaccgttgatgaagagaaggtcgctgaagttgttgccatgatgtccggtgtacctgttcaacgtatcgctaaggcagagaatgtcaagcttctggaaatggcggacgtattgaaaagtaaggtggtcgggcaggatgatgctgttcaaaagatcgtaaaggcaattcaacgtaaccgtgttggcttgaaagatccgaataagccgatcggaacttttatgttcctaggaccgacgggtgtaggtaaaactcacttggccaagaagcttgctgaatatctatttgattcggcggattctttggtacgtatcgatatgagtgaatacttggagaaattcgctgtttcccgtttgatcggagcgcctcccggatacgttggttacgaggaaggtggccagttaacagagaaagtacgtcgcaagccttattcggtggtcttattggacgagatcgagaaggcgcatccggatgtatttaacttgctgctgcaagtcttggatgaaggccgtttgacggatagtttgggtagacgtattgatttcaagaatacgatcttgatcatgacttccaatattggtacccggcaattgaaagatttcggccgtggcgttggtttcaatacccagatggctggtgagccggataaggatttctcccgtagcgtgatccagaaagcgttgaataaagcatttgctccagagttcttgaatcgtgtggatgatatcattatgttcgatcagcttgataaagccgctattcataagattatcgatattgagttgcagggtctgtatcagcgtgtatcaaatctgggctatgagttgtcgatcacagacgaggcaaaagatttcattgcgacaaaaggctacgatatccaattcggtgcccgtccgttgaagcgtgcgatccagaagtatctggaagatgagatggcggagatgattatccgtgcctcagtaggagaaggcgatacgattatcgtagactttgataaagaagagcagaaaatcacgacttcgataaaaaagaaagatgctgaagatgctgaataa

SEQ ID NO: 1400 - DNA, 2955 bp, Parabacteroides distasonis
aataatatttataaaaatatgcgagaaaaactctcctatcctgttaggatcatcatattcttactatccatttttctctggagctttccggcagaagggcaggatagtgaaagcttaaaaaagcaattggatcaaaagctaaactctttcgcaaggcaatatgtgtcttcacgcaccattaagattgactccatcctcatacagaagaagaaagtcacgcttttcgccaatgaagctttggaggacatcccttttcgggaatacaacgtttctgagctttacgcaagtatagctcccctattccccaatgcctccaagatcgtcatcttgacccgaggtacagacattgagagcctgattcccgaatacgacagaaaaggacgtcccaacaaaaagaggctatactccattaaagagagtaaatacccgctaacccgtagcctatccacccctcatgagataaaaaacggattacaaaaccgtcatatcgccctttggcaaagccatggtttatattacgcccagaccgcccatcgctgggaatggcaacgggctcgcatgttcggcaccgtggaggacttatttacgcagagttttgttcttccttatctgaccccgatgcttgaaaacgcaggagcgactattcttatcccccgggaaagggacactcaaatacacgaaatcattatcgacaatgatcgctctactccgggatccgagtataaggaattggatggagagaaagcttggtcggatggggagaaagccggatttgggcatattcaagctacttatacgaatggggagaacccttttacgcaaggtacctatcggcagacggtcacacagaggaaaggaaaagaaagtctcatcgagtggattcccgaaattccggaatcggggaattacgcggtctatgcctcctatcaatcttttccgaacagcacagagcaggcactgtataccatccatcatgccggaggggaaaccacaatcgccgtcaatcaaacaatggggggtgggacttggatctatctgggaaacttcaaattcacggcacatgaacaagcccatgagagaatcgtattaacgaatcaaagcaataaatcgggaaagattatcacggcagatgcgatcaagatcggtggcggcatggggaacatcgcacgtagcccgctagaaagtccctatccgatagaagcagagacaagtgggtatccacggtttaccgaggcggcccgatattggctacaatgggcgggaatgccagatagtatctattcgaaaagcgctttccacaatgattatcaagacgacatttacgcacgtccccgatgggttaattatttaaaagaacaagcccatatccctatcgacatggccttcgcattccattccgacgcaggaaccaccccggatgactcaattatagggacactcggcatctatatgtctaaaagcaacgacggaatctacaccaaccggaaaagccgggagatcgccagagacctaaccgacatgatccaaacacagatcctgtccgatgtccgcaaggtttacaatcctcaatggagccgccgtggcatgtggaatcaatcttatatagaggcacgtattcccgatgtcccaacgatgctattagaattactatcccatcaaaacttcgccgatatgcgttacgggttagacccacgcttccgtttccttatctgtagggcgatctataaagggatgctccgttatatctgtttccagaataaacaggagcctatcgtacaaccgctcccacccgatcgtctgtatacggagctcgtagaaacgaataaagtgagaatcggctggaaagccgtacaggatactcttgaggagagtgcctcaccaaccgcctatatcctttatagtcgaaaagacagcggtggattcgataacgggacgctcgtaaaaggagaagaaatcattcttccaattgaggcgggtattatccatagttataaggtagctgccgtaaataagggaggcatcagtttcccttccgagatcgtaagtgtttaccggtctcctaaaggtgaaaaggataagacggtattaatcgtcaatggattcgacaggatcagtggtccagccagtttcgagagtgcggcggatagtttagccggctttctttatgccgtcgaccggggagtgccttatctgaatgatatcgcatttatcggggatcaattcgaattccgccgtaccgccacatggaacagcaatgataataacgggcatggggatagttacaacaattacgcaggccaagtcatagcgggcaataccttcgattatcctttcatacatgggcaggccatggccgaaaccggttattcctttgtttcatgtagccataaatctttggccgagggagtcgtaaagccggatacgtatccgattattgacttgattttaggaaaacagcgccaaccggttatcactcccgttttacaggatacgcttcgcagctaccttgcccaaggcggcaacttgcttgtaagcgggacgaatcttttctccgacagctggggcaacgcacaagaccgtacgttcgtcgaggaggtactaaaagggaagttggctagccgtaatgccagcaaggagggaatcgtaaacagttgcgcatccccttacggatatataaacggcagatacacgttccggacacgtccgaaccctatttgctactcgatcgagtcggtagacggtgtacttccggcggataagctcgcccataccatcttgagatatccggagaacaatatcggggcgggaatcgtttatgaagggaaatatcggacttgtttgctcagtttcccgtttgaggcgcttcaaacaccgtcggaacgaaatcgactcatggagtccatcttacgctttttctccattcaacaacaaaataaaatacagtatatacaatga

SEQ ID NO: 1401 - DNA, 1272 bp, Bacteroides clarus
atggaaaaggaaagagtagcacgatatatcagccagaaaaagcttttcatgcctgcggacaaaatactcgtcgccctaagcggcggtgcagactccgttgctctattgtgcttactgcaaacgttgggttatgaatgcgaagccgcacattgcaatttccaccttcgcagtgaagaatccgacagagatgaaacatttgtccgccaattatgcgcaaagcgacaagttccgctacacaccgtccacttcgatactttacgtaccgccgaagaacgacacatctccatcgaaatggcggcaagggaactgcgttacgaatggttcgagaaaatacggacaaaaagtaatgccaacgttatcgccgtagctcaccatcaggacgacagtgtggaaacccttttgctgaatttaatccgtggcacaggtatcaacggactacggggaatacgccccaagaacggacacatcgtacgccccttactctgcctggaccgtaacgaaatcatcaactacctgaaccgtataggacaggattacgtaacggacagcaccaatctgcaagacgaatatacccgcaataaaatacgcctaaacctgctgccgatgatgcaggaaatcaatccgtccgtcaaagaaagtattctcaacaccgccgaacatctgaacgaagcgtccgccatatataaaaaaggaatagaagaaggaatacaacgggtacggacagcaaagggaatacacatcggtgccctgatgcatgaacccgcccccaaaacattattgtttgaaatcttatatccgctcggcttcaacgcaactcaagttgaagatatatgccgggcgttggaaggacaaccgggaaaagttttcacctcagggcattggcgtgtagtgaaagaccgtgaatatctgctgattgaaacctgtcagcaagccacacaacccactttaaccatggaagagcatattcttaccccggacttcatcattccccgagacaaaacagtcgcctgcttcgatgcggataaactcatgcttcccctatctctgcggctttggcagaaaggagactattttatcccgttcggtatgaaaggccgaagaaaaataagcgactacatgaccgaccgcaaattctccctcctccgcaaagagcagcaatgggtattatgttgcggcaacgacattatctggctggtaggcgaaaggacagacaacagattccggatagacgaaaacacccggaaagcgttaatcataaaagtgactgcttaa

SEQ ID NO: 1402 - DNA, 1368 bp, Bacteroides clarus
atgaagaagtgtatgaactttaagtttgtagttttatttgccttgacgctgttagccggttctaccgtttatggacaagacaatgtgattgacgaggttgtgtgggtagtaggcgacgaggctatattaaagtccgaagtggaagaggcgcgtatgagcgctttgtacgaagggcgtaagttcgaccgagacccttactgtgtgataccggaagaaattgccgtacaaaagttgtttctgcatcaggccgcactcgacagtattgaagtttccgaagctgaagttatccagcgtgtggactatatgacgaatatgtatatcaccaacatcggttcccgcgaaaaaatggaggagtatttcaataagacctctagccagattcgtgaaaccttgcgtgacaatgcgcgtgagggtttgaaagtacagaaaatgcagcagaaactggtcggtgaaatcaagataacgcctgccgaggtgcgccgttacttcaaagaccttccgcaagacagtattccttatattccgacccaggtagaggtacagataatcactcagcagccgaaagttcctttggaagaaatagagaacgtaaagaaacgtttgcgcgactttaccgatcgtattacgaagggcgaaaccagcttttccacgttggcgcgtatgtattcggaagaccgcggaacggctatcaacggcggcgaaatgccgtttacgggacgcggatatctggaccctgctttcgcaaacgtggcgttcaatctgcaagaccccaataaagtatctaagattgtagagtctgagttcggtttccatattatccagttgatggagaagcggggcgaccgtattaaagtgcgtcatattttgctgaagccgcatatacccgaagaagcgttagtttcaggtatggcgcgtctggattccatcgccgatgatatccgtaatggaaaattctcttttgaggaagcggcatcggtactttcgcaagacaaggatacgcgcaacaatcatggtttgctgcctaatcccaataccaacacttccaaattcgagatgcaggagttgccgcccgaaatcgccaaagtggtagacaaaatgaaagtaggggaaatctctgaagccttcaccatgattccgcagaaaacaggtaaggaggaatgtgttatcgtgaaactgaaaagccgtacaaacggtcataaggcaaccgttgccgacgattatcagaacttgaaggaaatcgtattggagaaacgtcgtgatgaaatgctggacaagtggattcgtgaaaaacagaaacacacttacgttcgcatcaacgaaaattggagaaactgtacattcaagtatccgggatggataaaagactga

SEQ ID NO: 1403 - DNA, 1230 bp, Bacteroides clarus
atgaaaataccattttctcccccttacattgatgacactgtcatcaatgaagtggttgattccttacgctccggttggataaccaccggacctaaagtaaaagcgttggaagaagaaataaagtctttttccggtgcaaaagaagtgctttgtgtaaactcctggacttcgggagccattatgatgcttcgttggctgggagtgaaagccggggatgaagttatcgttccggcttatacatatagcgctacggcgttggcagtgctgcatgcaggcgctaaacccgttatggtggactccggtgcggatttcaatatttcggtagatgccattcgtagagccgttactccgcgaacgaaagctattatccctgtagatattgcaggttttccgtgtgactacgattgtatcatgaagctagtaaacacatctgaaatacagaaaatgttcaaagcggaaagtccggtacaagaaaagttggggcgtatccttgtaatgaatgatgcggcccattcactgggagcgcaatacagtaagaatcagcgtaccggttgtgaaacggatgttgccattttctctcttcacgcagtaaagaacgtgacaacagccgaaggcggtgccatttgtttgaatctgcccatgccctttgacaatgccgggttgtacaaagaacttcgtatgatgagtttgaactgccagactaaagacgctttctccaaatctaaagcgggtggttggcgttatgacattgttggcttagggatgaaaattaatatggcggatgtaaatgctgccatcggtctcgcacagatacgggaataccctaaactgctcgaagagagaaaaagagtattcaatacttacacccaagcttttgaaaactgtaattgggctattgtgcccccttcgatagagggcgataaagaaagttcctaccacatctacgccctacgtatcaaggattttacagaagaacagcgcgatcggatgattgatgaaatagccaaaagtgaagtggctgtaaatgttcactttatcccgatgccaatgttatcattcttcaattctttggggtatgatataaaggattatcctcaagcttacgagaactttaagggagaaatatctttgcctatatatccgcaattggatgaagaaaagttggcttttattattgataccgtaaaagcggcatatcgcaaggtggcaggtgataaagctgtaaagtga

SEQ ID NO: 1404 - DNA, 786 bp, Bacteroides clarus
atgaaaaagtatcattttatttgcatcatagccgttctgctggcaatggttaccggcgtacaggcacaagaagaaagaaacaaaagtcttatcaactcctatctgcatggttgggaatacggtataaaggccggattcaacatcggcggtacatcccccatccctctgcctaaagagatacgtaaaatagacagttacgcaccgggtatagccattgccatcgagggtaatgccaccaagtggtttgacaaagacaagaagtggggacttacattaggcctgcggttagagaataaaaatatgaccaccgaagccaccgtaaagaactacggtatgaaaatcatcaacaccaacggtggagaattggcaggtctttggacaggcggtgtcaagaccaaagtgaaaaactcttatctgacgattcctattttggcaaactaccatatcagcaaacgctggatattgtccgccggtccctatttctcctatctgctggaaggtaacttctccggacacgtttacgaaggacatctgcgtactcctgaccagacaggttcaaaagtggaattcacaggtgaaagtattgcgacttatgacttctccaatgatttaagaaaattccaatggggcttacaactcggtggagaatggaaagcattcaaacaccttaccgtccatgccgacctgacatggggactgaataatatcttccagaaagattttgatacaataacgtttaacatgtaccccatttatctgaatttaggattcggatatgcattctaa

SEQ ID NO: 1405 - DNA, 1791 bp, Bacteroides clarus
atggctggagaagaaagaggttggctgcaacgctttatcatttggcgtgagaagaatgttaaggagaaacggtttattctggttcttagctttctagtcggtatctttacggcatttgccgcattgatattgaaaatgctgatacactggatacagaactttcttacggagaacttcgatacgacagaggctaattaccagtatttgatatatccggtggtgggaatctttttggcagggctgtttgtacgctatgtcgtaaaggatgatatcagtcatggggttacgaaaattctatatgccatatcccgcaggcagggacgtatcaaacggcataatacgtggtcgtccattatcgccagttccataacaatcgggttcggtggttcggtcggagcggaggcgccgattgtgcttacaggctcggccatcggctctaatctgggaagtctgttcaagatggagcaccgtacgcttatgttactggtgggatgtggcgccgccggtgctgtggcgggtattttcaaagctccgattgcggggcttgtgtttacgttggaggtgctgatgatagacttgaccatgtcctcgctgcttccattgctgatttcggcagtgacggcggcgaccgtttcttatatcgtgacgggtacggaagccatgtttaagtttcatcttgaccaagcctttgaactggagcgtattccctatgtgattatgctgggtattttctgcggactggtttctctttattttacccgcgccatgaattcggtggagggtatgttcggtaaactgaaagttccttataagaaactgctggtgggcggttccatgttgagtattctgatattccttttcccgccgctttacggtgagggctatgatacgatagaattgctgcttaacggtacaagcaaaatagagtgggatacggtaatgaataactctttcttctacggtcatagccagttgctgctgttgtacctgatgctgataatcctgtttaaggttttcgcttcgagcgcaacgaatggcggtggcgggtgcggtggtatttttgcgccttctctttatttgggatgtattgccggattcgtattctcccacttcagcaatgagtttgagaccaccgcttttctgcccgaaaagaattttgccctgatggggatggcgggagtgatgagcggtgtcatgcacgcgccgctgacgggcgtattcctgattgccgagttgacgggagggtacgacttgttcctgccgttgatgatagtttcggtcagctcttatttgacgattatcgtttttgagccgcatagcatttactccatgcgtttggcaaagaagggagaactgctgacgcatcataaggataaggcggtgctgacgttgatgaaagtggaaaatgtagtagagaaagattttatcgcagtgcatccggaaatggaacttgccgaattagtgaaggctatctccgcttctcaccgcaatatatttccggtaacggataatgagggtaaactaatcggtattgtcttgctggacgatatacgcaatatcatgttccgccaggaactgtatcatcgttttacggtgggtaaattgatgacttccgctccggcgcgtctttataatacggacagcatggagcaggtaatgcgtactttcgacgatacgaaagcatggaatctgccggtagtggatgaagagggcaagtacctcggtttcgtttccaaatcgaagatattcaactcgtaccgtcaggtattggtacatttctcggaagattaa

SEQ ID NO: 1406 - DNA, 2268 bp, Bacteroides clarus
atgtcacatttagctcccttgattgccgatttggcattgatactgatttgcgccggagtaatgacgctgctatttaagaagttgaaacaaccgttggttttaggatatgttgtggcgggctttttagccagtccccacatggcctatacgccttcggtaatggatacggcgaatatacagacttgggcggatatcggcgttattttcctactgtttgctttggggctggagtttagttttaagaaaatagtgaaggtgggcggtgccgccattattgctgcttgcacgattatattttgtatgatattattgggtgtagcggtaggtacggcgttcggatggaagcggatggactgcatctttctgggcggtatgatcgccatgtcgtctactactattatatataaggcttttgatgatttgggcatgcgcaagaaacagtttacgggtttggtgctcagcgttctgattctggaagatattctggctatcgtcctgatggttatgctgtccaccatggcagtcagccataattttgagggtacggaaatgctgggcagcatagcgaagctgctgttcttccttatattgtggtttgtggtcggtatttacttgattcctgtcctgctgaaaaaatgccgcaaactgatgagtgaggaaacgttgttgattgtatcgctcggcctttgtttcggtatggttgtgctggctgcccatacgggattttcagcggcattcggcgcttttattatggggtctattctggctgaaacggtagaagcggagagtatcgagcgtctggttaaaccggtgaaggatttgttcggcgccatatttttcgtatccgtaggtatgatggtagaccctttgatgatagtggagtatgccggacctattgttgtcattacgttggcggttattgccggacagtccttgttcggaacgttgggggtattgcttgccgggcagccgctgaagacggctatgcaatgcggctttagtttgacgcagattggcgagttcgcctttatcatcgcctctttgggagtgtctttgcacgtgacaagtcattttctgtatcctatcgtagtagccgtatcggttatcactacttttcttactccttatatgattcgttttgccgagccggcttccaattttgtcgatacgcatctgccggaaaggtggcagaagtttttgttgcattacgcttccggttcgcaaacggtgaaccatgaaagcttatggaagaaactgatacttgctttgttgcgtattacggtggtttattccattgtaagcgtggcggtgatagctattgcattccgttttcttgtaccgtttttcaaggaaagcttgccgggcgtttggggacctttgctgtccgctctggttattattctgtttatcgctccttttctgcgggccattatgattaagaaaaaccattcggtggaatttgttactttgtggcgcgacagtcggggaaaccgtgctccgttggtggctactattgtgctgcgaatcctgttggcggtttctttcgtgatgtttgtcattgccggactgtttaagttgtcggtcggccttgtttttggcgttgcggtgctgctggttacagtgatgatactttcccggcagttgaagcggcagtctatcatgattgagcgtactttcttccagaatctgcgctcgcgggatatgcgggcggaatatttgggtgagaagaaaccggaatatgcaggccgtttgctttcccgtgatttacatctgacggattatgaaatacccggcgaatcggcatgggcgggtaagacgttggcggagttgaacttcggtaaacgctatggagtgcatgtggtttctattcttcgcgggcgtaagcggataaatattcccggagcttcggtacgtctttttcctctggataagatacaggttatcgctaccgatgaggagttgaatgtatttggcgaagagatggatagactttcaacggtagctacggacgttgtggaaaaaagcgagatgatattacgtcagttgcgcatcgacgctaattctccttttctgggtaaaacattgaaagacgcgggcatacgtgaaaagtaccactgtctgattgtaggtgtggagcggggagaggagactttgcacgctcccgacgtgcacgagccttttgtagcaggggatgtagtgtggattgtcggcgaaaatgttgatgtgtataaattagtcggcgaaaatgatgaaaatgtagacctgtaa

SEQ ID NO: 1407 - DNA, 1188 bp, Bacteroides clarus
atgagaaaagttctatcgttttcggccttcctgatggcaggcctgttcgtttcccaatatctccctgtgtgggcgggcggaaactataatgcggtaaaggccgtatcgaatgtattgctctatgtctgcttgagttttataatgattaatgtgggacgtgagtttgaagtcgataaatcacgttggcagacatacgcgaaagattatggcgttgcaatggctaccgccgccatgccttggttcctgattgctatttattatgtttttgtcctgcttccgcccgaatactggaatagttgggaagcgtggaaagagaatctcctgttgagccgttttgcggctcccacttccgccggtattttgtttaccatgctggccgccatcggcttaaagacaagctgggtttacaagaaaattcaagtgctggctatctttgatgatttggataccatccttctgatgattccgcttcagattatgatgatcggcctgcgctggcagcttctggtgattgttttcattgtatttcttttgctctctttcggttggaaacaactgggaaaatacgactggcggcaggattggaaagccattctggtatattcggccgtagtgtttgcgtgtacgcaggctgtatatctcatcagcaagcatttgtatggtgaggcgggcagtattcatatagaggtgctgctgcccgctttcgtcttgggaatggtgatgaagcacaaggagcatgacacaccggcggaacgtaaagtttccacggggatttctttcctctttatgtttctggttggaatgagcatgccacggtttctgggtgtggattttgcggaggcgtcgttgggacagcactcggttacgggttcgcaggagatgatgtcgtggggaatgattatgcttcatgtactgatagtgtcgttattgtctaatatcggtaagctgtttccggtattcttttacaaagaccgtaagttcagcgagcgtctggcgctctctatcggtatgtttacccgcggtgaagtaggggcgggggtaatctttatcgctcttggatatagtttgggcggcccggcattgataatttccgtattaaccatagtgcttaatttaattttaacgggtatctttgttctgtgggtaaagaagctggcgttgttgagttatggaagtgtgacggaatga

SEQ ID NO: 1408 - DNA, 1119 bp, Bacteroides clarus
atgaataatgacgaacgtctttgctgtatagctcttacgctttgccccggtataggacatatcggggcaaagcgtttaatggacggcataggcagtgccgttgacgttttcgggcggcgtaaagagttgccggagctcctgcccggtgtgaatccttccatcattacggctcttgattgtcctgccgcttttcttcgcgccgagcgcgaaatggaatttgtggaaaagaaccgcctgacctgccttactttgcaggatgaggcctacccttcccgcctgcgggagtgtgaggatgctccgattgtcctgttcttcaagggaaacgttgattttaatcgtttacatgtcatcaatatggtaggtacgcgtcgtgcaacggagtacggcaaacagttttgtgcggacttcgtacacgatttgtctgtacttcttcccgatgttctgatagtgagcggccttgcttacggcattgatattcatgcgcatcgtgccgcacttgccgataatatttccactgttgccgttttggcgcatggcttggaccgtatttacccctttgtacatcgtaaaacggctgtcgatatgctggcaaatggcggtttgcttaccgagtttctcacagaaactaatccgggcaagcataacttcgtcagccgtaaccgcattgtggcaggtatgtgcgacgcgacgattgtagtggaatccgccgctaaaggcggttctttgattacggcggatttagccgacggttaccatcgcgattgctttgccgtacccggacgggtggcggatgccgcttccatcggctgtaaccggttgatacgggataataaggcggcgcttgtgcaaactgccggggaatttgtaaaaacaatggagtggggcggtacggagccgtcatccaaggcggagggtattcagcgcaatctgtttccggaattgacggatgaggaggggacgatagtgcgtatactggctcgtcaaggagatttgcatatcaatgcgcttgtagtagaagcggatatacctgtgaaccgtatgagtgcgctgctttttgaactggagatgaaaggagtggtaaagacgctggtcggagggatgtatcacttattggcataa

SEQ ID NO: 1409 - DNA, 2031 bp, Bacteroides clarus
atgaaatataggttattgggctgtttgctgttgcttccgttattgcttatggcgcaagagcgtccgaaagttgccattgtgctgagcggaggcggagcgaagggtacggctcatatcggtgccttgaaagtgatagagaaagcgggtattccgatagattatgtggtgggcaccagtatgggggctattgttggaggcttatatgccatagggtatactccggagcaattggacagtatggtgaatgcgcagaactggaagttcgttttgtcggacgctcccaatcctaaagatgtattgctcgacgatcgtttgcggtcggagcgttatgtgctgtctattccttttacgttgaagtcggcggacatttcggatgcgggaattattaagggaaagaatattgcacagttgttttcggtattgacagagggttatcaggattctgtaaactttagccggctgcctattccgttcgcatgtgtctccgaaaatctggtggatgggagcgaggttgtgtttcacagaggtgtgttggctacggccatgcgctccagtatgtcgatacccggggtatttgcacctgtcaatctgaatggcagggtcttggtagatggaggtatggtgaataattatccggtagatgtggccttgcagatgggggctgatattattatcggagtggatgtacaaagtcctttgctggatgccgggcaactgaaatcggtgaaagatatattcgggcaaatcattaatctgcagggagagaaaaaatatcaagagaatcttcgcaagaccgatttacatattaaagtggatgtatcgggctattctgcggcaagtttcaccaaagaagcgattgataccttgatagtgcgtggagaacaggcggctatggccgattgggataaactgcttacattaaaaaagaagatggggctaagagaagattatcagccccgtcgcccgggaccttttcctatccctgacgcagaaaagagcaagactattcccgttgatccacagatagccgctcctgccatacgggaaaacaagctgaatgtcggtatccgttttgatacggaagagctggcagccttgcaggcgaatacggatatttatctgggaaaacaaaaagaatcgcaagtgagccttaccgcccgtttaggaaaacggacgatggcaagaatcggttataattatcagtggagtaagggctggcagacgggaattaattaccggtttgattacaaggatattaatatttataatgagggaaagcgtacacttgatttgacttttacccatcagcagcttaccgccggagtcgcaaaggattggaataagattcaagtgagtgcaggtcttaatttcgagcactacaactaccatgatttgctgtcgttggagccggtggatgcacttatgtttggaaataagtcgctgtttacctattttgccgggctgttgtataataatctgaatgggagaagcgtacccaccaaaggtttgtcatggtccgtaatgtatcatctgtatacggataatctgtttcaatacgaagataacagccctatttcggccttctcggcgcattggcaagggtgtttcactccgttaaagaattttacgattattccgtctattgacgggcgtattcttaccggaggtgataactattcttttgctgttactaatatgttgggtggaaatattgccggacgttatatgccccaacaaataccttttgtagggattaaccgtgcggagttggcttccggttcattgattgttgccggtttgaagcttcgtcagcggatatttaagaatcagtatgtatcggtgacgggaaactacggacgcagctccgataagttgcatgagttatttgaggattcccactcttacgacttggtaggaacgggcattggctatatgtataatagttttttgggaccgttgggaatagagttgaattggtctaatcagacgaagaagctcggctggtacgccggcttcggattcgtcttttag

SEQ ID NO: 1410 - DNA, 756 bp, Bacteroides clarus
aaggaagataaaacaaaattctgtatgaagaaagattatgaaacaatgacagtcggcgagattgttgccgacaatttcggtaatgccgaagtattcgataagtatggcatcgacttttgctgccacggttctattcttttgcccgaagccagccaaaaagcgggagcggatatggatgagattatcaaagacattgagaaccttgctccgataactaccgaaaacatcgacttcaagaattggccgctggacttactcgcagattacattttgaagatacatcaccgcaacatccgcaagaacggaccgaagatacaggaactgctcgacaaagtatgtaaggtacatggcgaaaatcatcctgcactatacaatgtgcaagtgttgctccggcaatcgctttccgatctcaaccaacacctcgacaaggaagagctggtattgtttccatacatctacgaaatggtgaaagccaaacttgacggtgccacaatccctgaatttcactgcggcagcatccaggatcccatatccgtaatgatgtccgagcatgataccgaaggtgaacgtttccgccacatcgagaaactaacaaacggatattctgctccggaagatgcctgcaacagctaccaattggtattacaacaactcaaagcgtttgaagccgccctgcatcagcacatccatttggaaaacaacatcgttttcccgcgtaccatacaactggaaacggaattacaagagcatccatga

SEQ ID NO: 1411 - DNA, 1155 bp, Bacteroides clarus
atgtataggatgatattgaacgaaacctcttatttcggagcaggctgccgggagacaatcgcggtagaagctattcgcagaggttttaagaaggccttctttgtgacagataaggacttgattcgttttaaggtcgcagacaagataattgaagtgtttgaaaagaatcatattccttatgaacttttcagtgatgtaaaagcaaatcctactattgccaatgtacaacatggcgtagccgcttttaaagagtccggcgcggattttattgtggcgttgggaggcggttcttccattgatacggcaaaaggtatcggtattgtggtgaataatccggattttgcagatgtgaagtcgttggaaggcgtagctgcgacccgttacaaggctgttcccacttttgctttgcctacaacggccggcactgctgctgaagtaaccattaattatgtgataattgatgaggacgcaaaaaagaagatggtttgcgtagaccccaatgacattccggttgttgcgattgtagacccggaactgatgtactccatgccgaagggattgactgccgcaacaggaatggatgccctgacacatgccattgaaagctatataacaccgggcgcttgggctatgtctgatatgtttgagctgaaagccattgaaatgattgccgctaatttgaaagctgcggtagacaatggtaacgatgtagcagctcgcgaagccatgtcgcaagctcagtatattgccggtatgggattcagtaatgtgggcctgggtattgtacattctatggcacatccgttaggcgctcattatgatactcctcatggagttgccaatgcattgcttttaccgtatgtaatggagtacaatgcagagtctccggctgctcctaagtatattcatatagccaaagctatgggagtaaataccgatggcatgactgaaagtgaaggaatacgtgcagcagtagaagctgttcgtaagttgtcattaagtattggtattcctcaaaagttacatgaaatcaatgtaaaagaggaagatttacatcaattggctgtcgatgcatttaatgatgtttgtacaggtggtaatcctcgtcctacttctgtcgaagagattgaggctttataccgtaaagctttttaa

SEQ ID NO: 1412 - DNA, 1194 bp, Bacteroides clarus
atggacatgataaagaaactaacatttatactcctgatagcgggttgcgcacaaggcatgtacgctcagaacacggagaagagtgagaagttccttgagaataaaaccctgtttgaagaacttaccaacgtaaagaaaaaacaggataagttcaacttattcctcaatatgcaaggcagtttcgatgcaaacttccgcgacggctttgaagaaggagctttcaaaatgaggcaacttcgcattgaagccaaaggaaacatcaacaactggctttcatatcggtacagacaacgtctgaaccgttcgaatgacagcagcggaaacatcgataatcttcctacctccatcgacattgccggaatcggcgtgagactcggaaaaggtttttctatctttgccggtaaacaatgtgctgcatacggtggtatcgagttcgacctgaatcctatcgaaatatacgagtatagcgatatgattgagaacatgagcaacttcatgaccggtttgaatatcggatatgatatcaactccaaccagcagttgaacctgcaaatcctggacagccgtaatggttctttcagcaaaacatacggagttgaaaccggagatggagagctccctacaatagaatcgggcaaacttccgcttgtgtataccctgaactggaacggtaatttcaatgacgtattcaaaacacgctggtctgcttccgttatgaatgaggctaaagacaggaatatgtattattacgcattcggtaatgaattaaacttgaataagttcaatatgtttctcgacttcatgtattcaagagaaagtattgaccgtaaaggaatcatgacgggaattacaggcagcatggaaggtcacaacgcttccgatgccgggtatttttcaatggtaaccaagttgaactatcgcttcctgcccaaatggaatgcttttgtaaaaggaatgtacgaaacagcatctcttaccaagcaacaaggagatttagagaaaggcaaataccgtactgcatggggctactttgccggtgtggagttctatcccatggatacaaacttacacttcttccttacttacgtaggacgctcctatgatttcacagctcgcgccaaagcgcttggacaagagaattattccaccaacagggtatcggtaggattcatctatcagttaccgatgttctaa

SEQ ID NO: 1413 - DNA, 1506 bp, Bacteroides clarus
atgatgacggacgaccataccacacaggcgatgtcatgttatggcggtcgtcttatccaaactccgaatatggataggatagccaatgagggtatacgtatggataactgctatgcagtcaatgcgctgtcaggtccctcgcgcgcttgtattctcacgggtaagttcagccacatgaatggctttaccgataatgcgagtactttcgatggaagtcagcaaaccttcccgaaactattgcaggcagcaggttatcagacatcagtgattggtaagtggcatctgatagccgaaccgcaagggttcgattactggtgtattttgagcggacagcatgagcagggcgattactataatcccgactttattgaaaacggtaagcatgtggtggagcaaggttacgtgaccgacatagttaccgataaagcgatcgagtatttggaacatcgggacaagagtaagcctttctgcatgatgtatcatcaaaaagctccccatcgcaattggatgccggcgccccgtcatttggggatgttcaacaacaccacattcccggaacccggcacgcttttcgatacatatgaaggcagaggacgtgccgccaaagaacaagatatgtcgattgagcatacgttgactgatgactgggatttgaagttgctgacccgtgaggaaatgctgaaagacactaccaaccgtctttatcaggtatataagcgtatgccggctgctgtacaggacaaatgggattctgtctatgcgcaacgcatttcggagtatcgtaacggaaacctaaaaggcaacgcgttaatcagctggaaataccagcaatacatgcgcgattatttggctaccgtagttgctgtggacgagaatatcggacggttactcaattatttggaaaggactggcgaattggataacacaatcattgtctatacttccgaccagggtttctttttaggagagcatggctggtttgacaagcgtttcatgtatgaagagtgtcagcgtatgccgatgattgtccgatatcccaaagcaatcaaggcgggaagcacatcgaatgcgatagctatgaacatagactttgctcctacattcctggattttgcaggagtagaaattccggatgatattcagggagaatctttgaaaccggttcttaccaatgaggggaatgcgccagctgattggcggaaggcagcttattaccattattatgaataccctgccgaacattcggtgaaacgccattatggtattcgtacgactgattttaaattgattcatttctataatgatgtggatgaatgggaaatgtatgatatgcagaatgatccgcacgagttgaataatctatacggtaatcctgaatatactgctaaacaagccgaacttatgctgttactgaaagaagtgcaggaacaatataaggacaatgaccctgatgagaggataacggaattgtttaaaggtgacaggcgttttatggagaatcggtga

SEQ ID NO: 1414 - DNA, 1413 bp, Bacteroides clarus
atgcgcataaatgataatattaagaccataacaatgaagataaaactcataactttatccgtctcctgcctgttactgagcagttgcggtatctataccacctatgaacgcccttccgatatcaataccgatgggctatacggacaggatttgaatgaagaggccgttgccgttgatactgcctctatcgcatccttgtcctggcgtgagttgttcaccgattcacatctgcaaacgctcatcgaacacgctttgcagagtaataccgatttgctttcagcccaacagcgtatcaaggaagccgaggctactctttcttcggcgaagttggcttatctgccctcgtttatgctcactccccagggcggtgtcagtagtttcgacaagtcgaaaggctcatggacttataccggtatcgcttccgccagttgggaaatcgacattttcggtaagctgacgaatgccaaacgccgttccaaagctctctatcttcagagcctggagtacgaacaagctgtcagtacttccctgatagccaatgtcgccaatctttattataccttgctgatgctcgacgagcaataccgtatttccgaggaaaccgccgtcaactggcgcgaaagcgtacgtaccatgcgtgccatgatggctgccggtatgacgaatgaagcgtccgtctcccagtccgaagccaactgccgtcaggttgaggcttctttgctggacttgaagcagcagattaaggaagtggagaacagtctttccattcttctcggagaagtgccgggcgggatagagcgcggtcaccttgccgggcaggactttcccgaagagttgacggtaggggtgcctttgcagctcctttcccgtcgtccggacgtaaagagtgcggaactttctttggcgtctgccttttacagtaccaatgcggcacgttctgcgttttatccgtccatcacgttgagcggtacggcaggctggacaaactctgccgggaatatgattatcaatcccggcaagttattgctttccgctgtgggggcattgacgcaacctctgtttaataaaggcttgaacattgcacaactgaagatagccaaagcccagcaggaagaggcgaagctcgcctttcagcaggctttgctcaatgcgggcagtgaggtgaataacgctcttacgcaggtgcagaccgcacgcggcaagacggagttgcgtaccggacagattacttctttggaaaatgccgttcgcagcacacagcttctgatgcagcacggtacttccacttatctggaagttctcaccgcgcagcagtctttgctgtctgcgcagctgacgcaggtagccgatcgctttgatgaaatacagggaattattaatttgtatcaggcgcttggcggcggaagagattaa

SEQ ID NO: 1415 - DNA, 1320 bp, Bacteroides clarus
atgaacaagcgtatcgccaccctttggaagttcctgacatacgacatctggcgtattacggaagatgaagtcaccaaaacgactttttccttatataatatcatcaaaaccatttatctctgcatcaaccgcttcaccaaagacaggcttgtgaacaaggcgtccgcactgacatacagtaccttgctggctatcgtacccattttggccattgtgttcgccatcgcacgcgggttcggtttcgacaatctgatggagagccaaatcgtcaaaggtttcggcggtccgtcggaaacgacggaggttattttccaattcgtcaattcctatttgtcgcaaaccaagagcggcatattcatcggggtgggtttaatcatgttattgtggacggtgctcaacctgattaacaatatggagattactttcaaccgcatctggcaggtaaagaaagcgaggagcatgtaccgcaaaatcacggactacttctccatgcttctgctgataccgattctgctggtagtttccggcggtctttccatattcatgagtaccatgctgaagaatgtggctgacttcaccctgctcgcccccatcggtaagttcttagtccgcctcatacctttcgttttgacgtggttcatgtttacggcactgtacgtcttcatgcctaatacaaaagtgaaattcaaacacgcgctgatttcgggaattctggcaggtacggcacatcaggcctttcagttcctttatatcagcagccagttgtgggtatcccgctacaatgccatctacggcagctttgcggcgctccccatgtttctgctgtggttgcaaatatcctggaccatctgcctcttcggagcggaactgacgtatgccggacagaacatacggaacttcagtttcgataaggacgcgcgcaatatcagccgccgttatcgcgattttatctccatcctcatcatgtctcttgtagccaagcgtttcgaaaagaatgaaccgccctacactgccgaagacatatccgaggagtgtcagattcccatacgcctgaccaaccagaccctgtatgagttacaggaaatcaatctgctgcacgaagtagtgaccgataccaaaagccaggacatcgcttaccagccctctatggacatcaacaagctaaacgtcgctttcctgctggacaaactggacacccacggttccgaggacttcaagatagataaggataaagaattccacgggcagtgggaaacactgatgaaagcacgggaagagtactacaaaagcgcaagtaaagtgttgctgaaagacttatag

SEQ ID NO: 1416 - DNA, 1806 bp, Bacteroides clarus
atgagagggattcgcgccttgtggctgatgctgatgttactgacagccgacggagtttctgcccaattggtagagaaagtgcttcgcgtcatagaaggagacagcttggttccggttacaacgataaaggcagactcggattctgcggtatcactgtctgcaatcaagcaggagttggaagcagcccggctgaatgaagccaacctgcgtatggaaatggagcaactgaggcttgccagctatgcggccgactccgtaaaacacttgcagcagaaacagcgcatcgactccctgcgtaaagtgactcccggcgttccggtggtggtagagggagatacgctgttctatctctatgccaagcgtggcggccatactcctcagcaacgtgccgagatggatgccgctgccatattggaattgggtaaacgctttaatctgcgtcccgattcactgtatatggaaagcagcgatatcgttactgaccttatgtatgacaataaagtcatcgcttcttttatcgaccaggacggattgtgggagaactgtacccgtgaccggttggctgcccacaaccgtaaagttattgtcgataagttgaaagaaatgaaagatgagcacggtctgtggcagttgggcaagcgtatcctgtattttgtcttggtgcttgtagggcaatatttccttttcagacttaccatctggctgtttaagaaactgaaagtgcggatacagaggttgaaagatactaagttaaaacctttctccattcaggattacgaattactggacacgcagaaacaggttaacctgcttattttcctctcgaatctgctgcgttatatcatcatgttccttcaattactattgacggttccgttgttgttttccatctttccgcagaccaagagcctggcataccagctgttttcttatatttggattccggtaaagagtatctttacttcggttgtggagtatatacccaatctgttcactatctttgtgatatggtatgcggtgaagtatttggtgcgttttgtccattaccttgccaatgaggtgaaatccgagcggttgaagatacgcggcttttattccgattgggctgaaccaactttccacatcatccgttttctgctctatgcttttatgattgcgatgatttatccctacctgcccggttccaagtccggagtatttcagggcatttcggtttttgtaggattgatagtttcgcttgggtcaagtactgttatcgggaatattattgccggtttggtgattacttatatgcgtcctttcaagttgggcgaccgtattcagctgaatgaaacgacgggtaacgttatcgaaaagactccgcttgtcactcgtatccgaacgccgaagaacgaggtggtaactattccgaattctttcatcatgtcctcgcataccgtcaattacagcacttctgcccgtgaatacggtttaattattcattccgaggtaagtatcggttatgatatcccttggcggcaaacgcatcaactgttgatagaggctgcactgaatacgcccggtgtgatagacgatccgcgtccttttgtgctggaaacctcacttagcgattggtatccggtgtatcaggtgaatgcatatatcaaagaggccgaccgtttggcggatatttattctgatttgcatcagaatatccaggacaaatttaatgaagcgggtatcgagattatgtctccgcattatgtagctacacgtgatggaagccagagtacaattccgaaggacgacttacgggagaagaaataa

SEQ ID NO: 1417 - DNA, 1359 bp, Bacteroides clarus
atgaaaaaacaatctgcactctggtgcttacttctcttattgacgatagtagcatgcactgccacatccccccggaaagaaaccggagaatgggcaaaagtacccggaatactaaaaaatatcgtaccgcctgcatttgccgatacgatttatgatgtgaccgaatacggagcaaaagacgatacagctttcgacagccgtcccgccatcctgaaagccatcaatcaatgtaacaccgatggcggcgggaccgtactgattcccgcgggaaactatttcatcaaaggagccattacgctgaaaagtaacatcaacctgcacatcgccgagggtgcacgtctggaattctctaccgaagccgccgactaccttcctatggtactgactaaatgggaaggaacggaatgcttcaactactctccctttatctacgcataccagtgcacaaatgtcgcagtaaccggcaaaggtactatcgacggaaacggttcggtgaccttcaacgactggcatgccatacaaggccctgccgtagaccgtctgcgccaaatgggcatcgattccgttccggtctacgaacgcgtattcggcgaaggacattatctacgtccttgtatgatacaattttacggttgcaaaaacgtattggtggaagacttgaagatatacgattctcctttctggattatccaccccgtattctgtgacaacgtaaccgtacgaaacgtatatatcgacagtaataactacaacaatgacggctgcgacccggaatccagcaccaacgtactgatagagggaatggacttcaatgtaggcgacgacggcatcgccatcaaatccggacgcgaccaggacggctggcgcatcggacaggctacggaaaatgtcatcatccgcaactgtcacttcgcacgttgggccatcactatcggaagcgagatgtccggcggagtacgaaatatctatatcgaagactgcaagatagacagttgccgcaatggcatatacttcaagtccaacttagacagaggaggttattttgagaatctgaatatgcgccgcattgaagcggatgtctgtctatggggtgtcatcaatttccgtacaaactatcacggataccggggcggcaatcatcctacattgttccgtaacatctgcattgaagatgtaacctgcaaccgtgtggacagcgtggctctcatggctaacggactgcccgaagccaagctgtacgacatcaccttgagaaatataaccgtaaagaaagccccgaaagccatccaaatggaaaatgtggtaaatctgacattggataacgtgacggttaacggaaaggcggtaaccgctccctga

SEQ ID NO: 1418 - DNA, 1959 bp, Bacteroides clarus
gccatccgttttcttttgctatttttgcattttgtaatcttcagtacaatgatgaaaacagaaccaacaacatataacttgttagactccatttcctatccggaagacctgcgtaaattaagcgtggaacagctcccggaagtttgtgaagaattaagacaagacatcattcaagaactttcgtgcaacccgggacactttgcagcaagtctgggtacagtggaacttaccgtcgcgctgcattacgtctacaataccccttacgaccgtatagtatgggacgtagggcatcaagcctacggtcacaagatgctgaccggacgtcgcgagtctttttgcaccaaccggaagttcaagggcatacgccccttccccactccagtggaaagcgattacgacaccttcacctgcggacatgcctcaaactccatttcggcagccttaggcatggctgttgccgcagccagaaaaggtgagaaagaccgtcatgtagtagccgtcatcggcgacgggagcatgagtggcggactggcctttgagggcttgaacaacgcctcgtccaccgccaacaatctgttgattatccttaacgacaacgacatggcaatagaccgcagtgtaggcggcatgaaacaataccttttcaatctgacaacctccaaccgctacaaccagctgcgtttcaaagcctccaagatgttatttaaaatgggcgtactgaatgaagaccggcgtaaagcgctaatccgcttttccaacagtctgaaatcaatggcggcccagcaacagaacatcttcgaagggatgaacatccgatacttcggtccgataaacggacatgacgtaaagaacttggcccgtattctgcgggatataaaagatatgcaaggacctaaaatccttcatttgcacactgtaaagggtaaaggcttcgaaccggccgagaaagagccgggcatctggcacgcacccggcaaattcgaccccgaaaccggagagcgcatcactgcagacaccagcaatctgcctcctctataccaaaccgtattcggcgagacgttagtggaattggcagagaagaatccgaaaatcgtcggggtgacgcccgccatgcccaccggatgttccatgaacatattgatgcaagccatgcccgaccgggctttcgacgtaggcatcgccgaaggacacgccgccacattctccggcggtatggcaaaagaaggtctgcaacctttctgcaacatatattcgtccttcatgcagcgggcttatgacaacgtgatacatgacattgccatcctgcggttgcctgtagtgctctgcctggaccgcgccggattggtaggtgaagacggaccgacacatcatggcgtatacgacctcgcttatttccgtcctatcccgaacctgaccatatcctcacccatggacgagcacgaactgcgtcgcctgatgtacacggcacagctgccggacaaaggtccgttcgtaatccgttatccgcgtggacgtggcgtgttggtggactggaaatgtccgctggaagaaatccccgtaggcaaaggtcggaaactgaaagacgggaaagaccttgcggtcatcaccctcggtccgataggaaacattgccgcgcgcgccatcaaacgggcggaaacagagaaaggactctccatagcccactacgacctacgtttcctcaaaccattggacgaaacactgttacacgaagcgggacgcaacttcaaacgcatcatcaccatagaagacggtgcgcgaaaaggcggtatgggaagcgccgtactggagtttatggcagacaacagctacaccccgcacatagagcgtatcggcgtacccgacacatttatagagcatggtacggtacaggagttgtatcagttgtgcggaatggatgaggaaggaatctataatatattaattaagaatgatgaatga

SEQ ID NO: 1419 - DNA, 2085 bp, Bacteroides clarus
atgtttaaaagaagtattctaattttagctgcaagttgtatgatgtactcctgtgctacccaaacggaaagtaatccgttcctcaccgagtttcaaaccccgaacggtgttccaccctttgataaaatcaaactggagcactacgagcctgcattccttaaaggaatagaagaacaaaataccaatatccaggctattatcgacaatgccgaagtaccgaactttgaaaatgtaatcgttgctttggacaacagttctcccatactcaaccgggtaagcgccattttcttcaacatgacggatgccgaaaccagtgatgccctgaacgaactttctataaagctcgctccggtactgtccgagcatggagacaatatttcgcttaaccaagagttattcaataaagtaaaagctgtttatcagaagaaagattctttaggcctgacaaccgaacaacaaagacttttggacaaaacgtataaaggctttgtacactccggtgccaatctttctgccgaaaagcaagcccgcctacgcgaagtaaataaactactttctacactgggtatcactttcagcaacaatattctgaatgaaaacaacgagtttatgctctttgtagacaagcaagaagaccttgccggacttcccgaatggttctgccaaagcgccgccgaagaagcaaaagctgccggtcaggagggtaaatggttgttcacattgcataacgccagccgtatcccgttcctgcaatattccgctaaccgcccgttacgcgagaagatatataaagcttacatcaaccgaggcaataataacgacaaaaacgacaataaaaaaatcattaccgacatcgtcagcctgcgtttggaaaaagcccgtctgttaggtttcgactgttactccaacttcgtattggacaataccatggctaaaaactcgaccacagtaatggaattcctgaacaacctgtgggggtatgccctgcctaaagccaaagccgaagctgccgaacttcagaaattaatggataaagagggtaagggcgaaaaactggaagcctgggactggtggtattacaccgaaaaactacgtaaagaaaaatacgaccttgaagaagaccaaatcaagccttattttaaattagagaacgtacgcgagggagcctttgccgttgccaacaaactatacggaatcacactgacgaaactcaacgatatccctgtctatcaccccgatgtagaagtatttgaagtaaaagatgcagacggatcgcagctgggtatcttctatgtagactacttcccgcgtcccggcaaaagtggcggagcatggatgagcaactatcgtgagcaaaaaggcggcatccgtccgttagtatgcaacgtagccagcttcaccaaacccgttggtgacaccccttctctgctcacaatggatgaagtggaaaccctttttcatgaattcggccatgggctgcacggactgttgaccaaatgtaactatctgggcgtttccggtacaaatgtagtgcgcgactttgtagaacttccgtcacaaatcaacgaacactgggctaccgaacccgaagttctgaaaatgtacgccaaacattaccaaaccggtgaagtcattcccgacaatctcatcgaaaagattctgaaacaaaaaactttcaaccaaggtttcatgactaccgagttgctggctgccgccattctcgatatgaatctgcataacctgacagacacgaaagacatagatgttgtggcctatgaaaaagaagccatggataaactcggattaatttccgaaatagctccccgctaccgtaccacctacttcaatcatatcataggcggttatgcagcaggctattacagctatctgtgggcgaacgtactggataatgacgcttttgaagcattcaaagaacatggcatttttgacaagacgaccgccaaccttttccgccataatgttttggaaaaaggagacagcgaagatccgatgacgctctacaagaatttcagaggggcagagcctcaattagagccgatgttaaaaaatcgcggtatgaagtaa

SEQ ID NO: 1420 - DNA, 1191 bp, Bacteroides clarus
atgagtaatccagtaaaaacaaacaaacgcattcttgcccttgacatccttcgcggcgtcacgattgcaggaatgattatggtcaacaatcccggtacatgggcacatatctatgctcccttacgtcatgcggaatggaacggtcttacccccaccgaccttgtatttccgtttttcatgttcataatgggaatttccacgtacatatctttgaaaaagtataatttcgagttcagccgtgccgtcggcatgaagattctaaagcgtaccatactcatcttcctcataggtatggccatcggctggttctcgaaattctgttattactggacttctcccaccgagggcatcagcttcggcgcgcaactatgggaatccgtatggacattcgaccgcatccgtattttgggtgtcatgcaacgtctggcgctctgttatggcgccactgctatcattgcgctgaccgtgaaacaccgcaacatcccctatctcatcgctaccctcctgacaggctatttcatcctgttggtttgcggcaacggatttgcctataacgatacaaatatcctttccgttatagaccgtaccatccttacccccgcgcatatgtacaaggataacggcatcgacccggaaggtttactgagcactatcccttccatagctcacgtactgttgggcttctgtgtaggccgtatgatgctcgaaagcggtaaagcaaatgaagaccgtgaaagtatactcaactcgcatctcatcaaactgtttttagcaggaaccatccttaccttctcaggtttcctgctaagctacggatgtcctatcaacaaaaaaatatggtcacccacctttgtactcaccacctgcggactggcttccagcttcctggcactcctcatttggattatcgatgtgaaaggatataaaaaatggagcctgttctttgagtcattcggtgtcaaccccttattcatgtatgtattgggcggtgtacttagtatcctcttcggcagcatcagctttccgtggggcgcaagcagtataagcatacacggattcttatataagatactattgatgccggtgttcggtgaaaccggcggctcattagcctatgcgctgttattcgtcggtatcaactggtgcatcggctaccaactttacaaacgaaagatttatatcaagctataa

SEQ ID NO: 1421 - DNA, 1830 bp, Bacteroides clarus
atgaagatttatcataagtttcttttgtatcaaaataagtggattcatccttatgtacgtgtggcgttgggggtgatgacgaccctgacctacctggcatccatcctgttgattgtcggtttggtgtatgaacatggatttacaatttcggttgcggaagctcaccagttgcaacgtctgtatcatggagtgtggattgtctttctgagcgatatatccttgcgtatcgcattggaatataaagatacgaggcagacctttagcaagctgacgtggatattgacttttctgctttatctgacgctggttccggtagtttttcatcgtccggaggtggaaggggccatacaggctgtctgggattttctgaacggcaggatatatcatctcgcgttgctgctgatgctttctttcctgaatctgtcttatggcttggtacgtttgctgggacgacggacaaacccttcgcttattctggcagtcagttttctcattatcatactcatcgggacgggattgctgatgcttccccgttctacggtggcgggtatctcgtgggtggattcgctgtttatttccaccagtgcggtgtgtgtgacggggcttacctcggtggatgtggcatccacctttacgacgacgggctttgtaatcatcatcctgctgattcagattggcggtttgggagtaatgacgctgacgagcttctttgcaatgttctttatggggaatacttcgctgtacaatcagttggtggtgcgtgatatggtcagttccaattcattgaattcattgctgtccacactggtctatatcctcggatttacattggcgatagagggggcgggcatgctcgctatttggagcgatattcacggcacgatggggatggatatacacgaggaattggctttctcggctttccactccatatcggcgttctgtaacgccggtttttccacattaccgggcaatttgggcaatccgctgctgatgtcaggccataatccgttctatatatacatctctttattgattattcttggcggtatcggttttccgatattggtgaatttcaaggatatcatcctttaccatatacgccgtttctggagatttctgcgtacgtgggagtgggacggccgccgtttttaccacctctacaatctgaatacgcgtatcgtgctgattgttaccttcctgttgctggtggtcggtacggccggtatcgctctttttgagtggaatgcgtcttttgcgggtatgtcggttgccgataagtggacgcaggcgttcttcaatgcgtcttgtccccgtacggccggcttctccagcgtggatttagccggtttgagcatgcagaccttattgatttaccttattcttatgtggattggcggcggttcgcagtctactgcaggcggtatcaaggtgaatgcttttgctgtcgtggtattgaatcttgtggctgtattgcgcggcacggagcgggtagaggtgtttggacgcgaattgtcttacgactccatccgccgttctaatgctacggtggtgatgtcgttcggagtattgtttgtatttatatttattatcagcatattggagccgaagctgtctttgctcacggttacctttgaatgtgtttcggccatcagtacggtcggttccagtttaaacgccacgcctttgctgggcagtgacagtaaactgttggttgcgcttttgatgtttgtcgggcgtgtagggctgataacgttgatgcttggtatcatcaagcagaaaaaaaatacgaagtatcagtatccgagtggacagattattattaattaa

SEQ ID NO: 1422 - DNA, 975 bp, Bacteroides clarus
atgaaacgcacaattgctattgtatgcggaggagacacttccgaattcgaagtttccctgcgtagtgcacaaggaatctactccttcatcgacaaggagaggtacacattatatatagtagagatgcagggaccggactggcacgtgcagcttcccgacggcacgaaagcttcggtagaccgtaatgatttcagcttccggctgaacggcgcgaaggttgtattcgattttgcatatatcaccattcacggaactccgggtgaggacgggcgtttgcagggatatttcgatatgcttcatataccttattcctgttgcggagtgcttgcggccgcactgacgtatgataagtttgcctgcaatcaatatctgaaaacgttcggtgtgcgtatcgccgactctttgctgcttcgccaggggcagtctgtttccgacgaagatgtgattgagaagataggcttgccttgtttcatcaagcccagtctgggcggttccagcttcggggtgacgaaggtgaatacgaaagagcagatacaacctgccgttgcaaaggctttcgccgaagcgaaagaagtcttggtagaggcttttatggaaggtatggagattacttgcggttgctacaagaccaaagaaaagtctgtggtgttccctattacggaagtggtatcgcataatgagtattttgactataaagccaaatataacggtgagtcggacgaaataactccggcgcgcattcccgatgaactgcgcgaccgcgtgcagaaacttacttccgccatttatgatatcctcggagcttccggaattatccgcgtagactatatcattaccgaaggagaaaaaataaatctgctggaagtaaacactactccggggatgaccgctaccagttttatcccgcagcaggtacgtgcggcgaacctggatattaaagatgtaatgacagatataatagaaaaccaattttag

SEQ ID NO: 1423 - DNA, 672 bp, Bacteroides clarus
atgaagtatgttctgattgtagccggtggtaaaggtttgcgtatgggatgcgaacttcccaaacaatttcttccgataggaggaaaacccgtattgatgcgtaccatagaagccttttacgcttacaatccggagatacggataatattggtgcttccgcgcaaccagcagtcttactggaatgaattgtgccggaaacatgacttttcaatccctcatcatatcgcagacggtggagaaacacgtttccattcggtgaagaacggtttggaatttgttacaacaccgggcttggtcggggtgcacgatggtgtccgcccttttgtagcccgggaagttatagaacgttgctattccttggcggccggaaagcaggcggtgattcctgtgatagacgtggtggagacagtacgtcatttggtcggcgaaggaagtgaaacagtcagccgtgacgaatacaaactggtgcaaactccgcaagtgtttgatgcggatttgctgaaacaggcctatgaacagccttatactccgcatttcacggacgatgcctcggttgttgaggcgttaggcaaacctgtttatctgacggagggtaattgggaaaacattaaaataaccactccctttgatttgaaaatagctaccgcccttttggattcatgttcgatttaa

SEQ ID NO: 1424 - DNA, 1605 bp, Bacteroides clarus
atggtacttaatggcgaaattaacgaatttgacatcattattattggtggaggtgcgaccggagcgggtacggcaagagattgttccttacgtggaatgcgtgttttgcttgtagaacgctttgattttgctgctggtgccaccgggcgaaaccacggattgcttcatagtggcgcccgttatgcggtgactgatagggaatcggctgccgaatgtatcaaggagaatatgattcttcggaagatagcgcgccattgtgtagaagaaaacggcggcttgttcatctctcttccggaagacgacctttcgtatcaaaacttatttgtggaatcgtgtcgggccgcaggtatcaatgcgcaagtgatagaccctgccgaggcgagattgatagaaccttctgttaatcctgccataacaggagcggtgaaagtgcctgacggttcgatagaccctttcagactgactctggcaaatgttattgatgccaaagctcacggtgcgaaagtactggtttatcatgaagtgacagcattgattcaggaccggggaagtatcgtcggagtcactgtatttaatcataaaacgaaaacagaacataattattacgcacctctgactattaatgcgggaggtatttggggacatggcattgctgcaaaagcaggcataagggtggacatgttccctgcaaaaggctcattattgatttttgggcatcgaatcaataatgttgtgcttaaccgttgccgcaagcctgccaatgcagatattcttgttcctggagatacgatctgcctgattggaacgacatccagtcgcgtgggctttgatgaggtggatgatgtgcgggttacgtcggaagaggttgatttgttgttgtcggagggggagaagttggctcctgctttggctacaactcgtattttgcgcgcatacgccggcgttcgtccgctggtggccgccgataacgacccttccggacgtaacatcagccgtggcatcgtgttgctggatcatgagatacgtgatggtgttgcgggctttgtaactattaccggcggaaagctgatgacttatcgactgatggcggaatgggctacgaatctggcttgcaagaaacttggcattgacaagccttgtactacgatgaatgaaccccttcccggttcgcgtttggaagagggacggtctgacggtaaacaagtgacgacggatcaacccaaacgttcttcggtcggacgtcacggtgaaatggccgccaggattgcgtcggaaagcaagtatgacaacagtctggtttgcgaatgtgaagatgtgaccgtaggtgaggtcaactatgctgtaaacgaacttgatgtgcataatctgatagacttgcgtcgtcgtacacgcgtcggtatgggaacctgtcagggagaactctgcgcttgtcgtgcggcaggattgttgggtgaggcgcataattgttctcaaaaagcgaagaatgacctggcttcgttcctgaacgaacgctggaaaggattgtatcctgtggcatggggcgaagcattgcgtgaaagtgaatatacccagtgggtatacagtggagtttgtggaatggaataa

SEQ ID NO: 1425 - DNA, 1902 bp, Bacteroides clarus
atgaaagaaaggcttataggattcctcaagacatatttcttgtttgtttgcatattcgcattacaaaaaccgtttttcatgctcttttaccggccgttgtacgaaggtgtttcgtggacggaatggctgggtgtgatgtggcacggactgccgctggacttgtcgcttgcaggctatctgacggctattccgggattgctttttatctgttccgcttgggctgtgcctaatcttctccgccgtatatggtgcggttactttatcttcgtttccgttttactctctattatatttaccgtcgatttgggcttgtacgaatactggggattccggttggacgccacccctttgttttatttcttttcttcgcccaaagatgcggtggcaagcgtcagtgtctggatggtaatcgggggaattattgccatggctgtttacgcggcggtattatatgggatattctatatcgtgctgttgcggaaaggcgcgttcagacgcatgaagataccttaccggcgtttgagggtgtcgggcgcgctgttgctgctgaccgggttattgtttattccgattcgcggcggcttcactgtttccaccatgaatacgggaaaggtatacttcagcactaaccaacgcttgaaccatgctgccattaatccggctttcagtttgatggaatccctttccaaacaaaaggacttcggcagtcaataccgttttatggaagcggatgcggccgaccgtattttctccggtttggcagaccctgctgtcttgaagaaagacagcgcggcggcggatgcgctccggcaggctccggactctttgcgttcattgttcacggtaaagcatcccgatgtgctgtttgttatcatggagagcttctcttcacggcttatgacaacgcttgggggagaaccggatgttgcggtacagctggatagtctggcgcaagagggtgtgctctttacgaatttctacgcgaacagtttccgtaccgaccgcggattggttgccgtcttgagtggctatccggcgcaacccactaccagtataatgaaatatccccgtaaaacgcagtctatccctgccattgcaggcagtttgaagaatgcggggtataaaacgaaatactactatggcggtgatgccgactttaccaatatgcgttcttatctgatgtcgtccggctttgaggatattgttgccgatcaggattttccggtgtcggagcgtttgagcaagtggggggtgcacgaccatctcgtattccgccgtttgctggacgatttgaaaatggaagccgccgatagcggtttggcaaggaaagatgcaccgcatttccgtgtgctgcaaacttccagcagtcacgagccgtttgaagttccttacagccgtttggagaacgaacgcttgaatgcttttgcatatacggatagctgtatcggtgactttgtgaagcaattccgtgagttgccgcaatggaagaacacggtaatcgtacttgtgcccgaccatttgggagcctatcccgaacatatcggcaatcttgaaatagacaggtatcagattcctttgttaatggtgggcggtgcggtacgcggaccgaggcgtatcgatgtttacggttcccagcaggatattgccgctaccttattggcgcagttgtcggtgccgcatggcgagtttacgttcagtaaagacatgctcaatccggcttctcctcatttcgcgttcttcaccgtgccggacgctttcggttttgtgactccggacaatcaattgatatttaataatgaagcggatgcaatagccgtggatgaaggctcgaagaaaggacagaacctttctttgggacaggcttatctgcaaaagttgtatgacgatatagccaaaagatag

SEQ ID NO: 1426 - DNA, 1227 bp, Ruminococcus bicirculans
ttgcaatggattaaggcttattcatataaacaggaggtaaaaattatggcaaatgaaatgcttttgaaatacggctgcaaccctaatcagaagccgtcaagagtatttatggaggatggcaaggatctccctatcgaggtactcaacggcaagccaggttacatcaatctgcttgacgcattcaacggctggcagctggtaagagagcttaaaaaggcaacaggtatgtgtgcggcaacttctttcaagcacgtttcacctgcgggcgctgctatcggcaagcctttgagcgaggtcgaaaggaagatatattttgttgacgatctgggcgagcttaccccacttgcaagcgcttatgcgagagcaagaggtgctgacagaatgtcatcatacggcgattttatcgcactttctgacgagtgcgacgcttgcactgcaaagatgatccagagagaggtttctgacggtatcattgcaccgggctacactgacgaggctcttgagatactcaagtcaaagagaaagggtacatacaacatcatcaagatagatgagaactatgttcctgcacctattgagagaaagcaggttttcggcgtaacttttgaacagggtcgaaacgagctgaaaatagacaacgatatgctcacaaatatcgtgacagacaacaaggagattcctgaggacaagaaaactgatcttgttatctcacttatcacacttaaatacacacagtctaacagcgtttgctatgtaaaggacggtcaggctatcggtatcggtgcaggtcagcagtcaagaatacactgcacaagactggcaggaaacaaggctgacatctggtggctcagacagcacccaaaggttctgggacttcagttcgttgacaacataagacgtcctgacagagataacgctatcgacgtttacatttctgacgagcatgatgatgtactggctgagggcgtatggcagaacacattcaaggtaaagcctgaggtgctcactgaggctgaaaagaaggaatggcttgcaaagaacacaggcgtttgccttggttctgacgctttcttcccattcggcgacaacatcgagagagctaaaaagagcggtgtggcttacattgccgagccgggcggatctatcagggacgatcatgttatcatgacttgcaacaagtacaacatggcaatggcattcactggaataagattattccatcactaa

SEQ ID NO: 1427 - DNA, 1215 bp, Ruminococcus bicirculans
atggatttcaagaaagtaacagtgggattttttgcagcggtcatggcaatgacctcagtgtgtttcgctgatcccgaaacgcctgtgacaaccgatgtgccagccacagatcctgtaccggaaacaaccactaccgctcagcctcagtgggaggacactgaaacgactacaactaccacagctcagacatgggaaaccaccacatggggaactaccacatcttattcctatgttccggacactccgacttctacgccgacagttgtaaagcttgtggtcagcgaggtaaaggataaaaagttcacagcgaaaataaatatccagtgcgaccaccttatctcaaacgcctctatctccgtgggctatgacgatagccttgtagagtttgaaaagtgcgaaaccaatgataaagcaggtggcatggcagttgacaatgcctttgcaggtaagtttgtatataactatgtgaacgcagacggcacagactttgacggtgattatgcgaccctccatttcaaagtcgcagacgaaaagctcacctcaacagtgctttatctcacagtaaattcccttgatgacgaaaacctcaatgccatatcaaatcaggtagagaacggtatcgtcaagtatcaggacgctgcagacgttcagcaggacgacagcgattatatcgaaatagacgttgactattcaaagtatcctatcgctcccgaggatataggacttacggatgttgacagcgtaacagtagccaacggcgaagtgcttatattcgaggacggcaagttccagaccctcagcacaggcgaaacaaagatagatattgtttataaggacggctcagtagggcattttaaaatagtgataaaagaacctgaagccgtgaagcttgaaagctcagaagcagaagcgacctcaaaagccgcaagtccggtgtcggaagaaaagagcggttcatcaatgggcgttattattggcgtggtctgcgttttgtgcgtagctcttattgccgctgagtatcttatgatagtgaaaaacaaaacagtaggcgacaataagtcagccaacaaggataatgataaagatatccacgatacagacgaaagcgacgataccaatttgtccgagcctgacgaacctgacgaaaatgaagagcaggaagaaactgataatacagacgacgatacagacacagataaagaaacagaagaataa

SEQ ID NO: 1428 - DNA, 2862 bp, Ruminococcus bicirculans
atgatttttcggatagtgacggggaagaatgatattacaaaggggaggtctgtcatgaaaagtgcattgaaaaaggatactgtcagagagataagtcactcgttgggcagatttctctctatttttctgatagttcttcttggctgtggatttttctctggtatcaaggcgactatgcctgatatgatagacacggcggagaaatatttcagtgataacagacttatggatattaagttaatgtcgtctataggcgttaagtctgaggacgttgaggctgtgaaaaaagcagagaacgttgagggcgttatggcgggatattctaaggacgttttctattatcatgaaaatcaaaaccttgtgctgaaattcatgtccttcaacaatgttgttgatgagaacagccctaataatcttgataagcctgttttactagagggcaggcttcctgaaaaaaaaggcgagtgcgcagtagaggtaaaaatgagttcacctaacacctttaagttgggcggagagataaagatcaacgagcctgactcgtcaaaaaatataactgatactttggcaactgacacatacaggatagttggtattgtggcttcaccgctttatatcggctatgagcgtgatgcgaccacagtgggcaacggaactgtggtaagcaacgtttttgtgcctgagagcgagtttgtgtgcgattattacactgagctttatgtgaaattcaaaggcactgacgagcttgacccgttttccgacgagtacaagcaggctgtgaaagataagagcgttcaggcggtggagttttttgaggacagtgtgaacgcaaggtttgaaaaactaagcagtgacgctcaggacagtattgatgtcgctcaggagaaagttgacatcttgaaacaggcgcttgcctgcgacgaaaatcagcttacggagcttttgacaacggcgcagaagtcggttgaggaagctcaggaggcttatgataaggctgaacagagtggttctagtgcaaagtatcttgcaaggtcacagcttttaaaagcacaacagcttgaagaagtggcaggaaagcttcttgaagacaaaaagacaggaagtacggcggcttttgacgaatataatggtcagcttgcggcggcagaagatgagatagccggagcgaaaaaagaacttgaagccgttaaaacgcctgcattctatcagtatgacagatttgaggctagctctgattatagttccttttatggggacgctcagaaggtcgactctatcgcaaaggtgtttcctgtgttctttattcttgtggcggcgcttgtatgcctgaccacaatgactagaatggtagaggaacagagaacgcagataggtacatacaaggctttaggatacagtggggcaagaatagctggaaagtatcttttctatgcagcaacagcggcatcagcaggaagctgcataggcgttgctgttggattgcagatttttccgaagataatttatagttgctataatattttatataacattcctgatattgacacaccgttcaagcctgtttatatggtgctttgcttggtggtgtcggttatttgcacttgctcggcggtgctttacgcttgtatcaaagagcttaagtcacagccgtcacagcttatgcgtccaaagccaccgcagaatggcaggcgtgttttgctggagcgtgtggatcttatatggaatcggcttgactttcttgcaaaggtcactgtgagaaatttgctgagatataaaaagcgtttctttatgacaatcgtgggagtggcaggctgtacggcactgatagtcacgggttttggtttgaaatattctataaagactattgctgaaaagcaattcaatgagatatttctgtatgatggtattgcggtacttaattcagctgattttgacgagaaacaattggaggacaagataagcagtattgcacaggtagacaaatctatgcttatgcagagtacagatggcattgcagaaaatgaaagtgaaaaccagtctgtttctatgatcgtgccgaaaactcctgaaaatatgggagattatatcgatcttgtatctgctgagaatggatcaaaccttgaagtgaaaagcggttctgttatcataacacaaaagcttgcaaagcttcttgacctgaaaacgggtgacactattactataaagctcagtggtcatgaggagaaagagttcaagataggcggagtaagcaagaactatgctttgcattatatttacatcactcctgatgattttgaaagtgtatacggtgagaagcctgtttataatctttcttttattgacttaaagaaagacactgatgaaaactctttcaaggaacagcttatttcaaatgacgagttttatggaataagctttaaaaatgattcaagcagaggtttccttaattctgtggacagccttgacgctatcgttattttgctcatcgtttgcgcgggaggcttggcgtttgtggtgctttacaatttggcaaacataaacataactgagcgtgttcgtgagatagcgacaataaaagtgcttggattctatgacggtgagacttcagcgtatatttacagagaaaatctgatatcgacgattgtgggcattatcgtgggtcttgtggcaggaaagatattgcactattttgtagtgataacttctgaggtcgaccttgtgctgttcaacagacagcttgtttggtgggcgtatgtgcttggtgcattgctcacattggcatttgcatttatagttaatttggttcttcatttcaagcttaaaaagatagatatggtagaatctttaaaatcagtagaatag

SEQ ID NO: 1429 - DNA, 861 bp, Ruminococcus bicirculans
attatgcagggttgtaaaaaggttgtttccattcaggatatatcaggtcttggccggtgttcgctaacagtggtgatacctgtgctttccgctatgggtattcaggtgtgtcctgtgcctacggctgtgctttcggcacacaccggctacagcgagtttgttatgagagatcttacagactttatgaagcctgcattggaacactataaaaaaatggatatgaaatttgactgtgtgtacagcgggtttctggcttcaagcgagcagatagaccactgccttgagtttttcgaggcttttcctgacgccctgaaggtcgtagaccctgttatgggtgacggcggaaaggcatataagacctacacaaaggagctttgcagccgtatggtcgagcttgtaaaggtggcggatataatcacgcctaacctcacagaggcggctatacttcttggtgaggaatatcctacggcttcaatgcgcagctctgagataaaatcatggcttgtaagacttttaaagcagggcgcaaagatcgttgttatcacaagcgtaaatcttgcagacggcggaatgtcaactgtgggttatgataaagaaaataacagcttttggaaaataaagaatgattatgttcctgcacactattcaggaacgggagatatgttcacaagtgttcttattggaggacttctcaagggtgacagcctgcctatcgcaatgaacagagccacagcgttcacagagcttactgtcaagactacatacagctaccagaccccatggacagacggtcttatgctggagggtcagcttccttggctcacaagctatcaggagcttagggactatacgaatttgtga

SEQ ID NO: 1430 - DNA, 1677 bp, Ruminococcus bicirculans
atgagttttgtaatggctgatttttacaagaggtttgttgacgaggagcttgacagcgagggcagacttaaaagctttaagcttgacctgcctgagaacttcaacttctcatatgacgttatagacgagctggctaagaacgtgcctgataaggtggctatgcagtgggtcaacgaggagggtgaggagcatatcttcacttacaaggatctttctgaaaagagcagtcaggtggctaacatgatgctggcacacggagttaagaagggcgattttgttatggctgttcttaaacgtcattatgagttctggttccttgcttacggtcttatgaagataggcgctatccttgtgcctgcaacttgtcagctcaagaaaaaagactatgtttaccgctttgacgctgcgtctatatcttatatcgtggcaactgcggaggacgatgttcctaatcaggtggattcagctcttgagcagtacagcggcatgaaagagaagtttatcactcacggtgctaaagagggttggatagattttctcagcgaaatggacaagtatccaaagacttttgagaggatcgaaacacacgttactgagtcaatgcttatgtatttcagctctggtacgactggatatcctaaaatggtactgcacaagtattcactggctgcggcacacattatcactgctaagcactggcatcatcttgacgagaactcactgcaccttactgtttctgaaacaggctgggctaagtgtgcatggggcaagatgtttggtcagtttatctgcggtgcaacaacttttgtatatgacttcgacagatttattcctgcaaacgtgctgaaagtaattcaggattacaagcttacttctttctgcgcacctccgacaatgtacagatttttcatcaaggagggtcttgaaaactatgacctttcttcactgaaatatagctgtatcgccggtgaggctcttaaccctgaggtattcaacaagtggtatgagtacacaggtcttaagcttatggagggcttcggtcagacagagggcgctgtgcttgtgggcaatctttacggcatggagccaaagccgggctcaatgggcaagcctacaccgctttacaatatcggtatagttgacaacgagggcaagcctgttaaggtaggcgagacaggcgagatcgttgtttacgctaagagaggcgagaaccctgcgctgttcaaggagtattacagaaaccctgaggcaacggacaacgcttggagatttggtatgtatcacacaggcgacactgcttacatggacgatgacggctactactggtatgttggaagaacggacgaccttatcaaggcttcgggttatcgtataggacctttcgagatagagagtatccttatggaacacccttctgtacttgagtgcgctatcacggcggctgatgacgctatcagaggcaaggtagttaaggctactatcgtgcttgcaaagggctacactgcttctcctgagcttgctaaggagcttcagaactatgttaagcaatcaactgcgccttacaagtatcctagaatagttgagttcgtggacgagctgcctaagactatcagcggtaagatacgccgtgttgagataagagagaatgacagcaagaagaatagctggttgatttag

SEQ ID NO: 1431 - DNA, 1818 bp, Ruminococcus bicirculans
atgattagagaagatttaagaaatgttgctattattgcccacgttgaccacggtaagactacccttgtagaccagatgctcaagcagagcggtactttcagagaaaatcaggctgtagaagaaagagtcatggactcaaacgatatcgagcgtgagagaggaatcactatccttgcaaagaatacttctatcaagtataaggacgttaagataaacgttatcgacaccccaggccatgctgatttcggcggtgaggtagagcgtgttcttaaaatggtaaacggtgttatactgcttgtggacgcagccgagggtccaatgccacagacaagatttgtgcttcagaaagcacttgagcttggtcataaaataatcatcgttattaataagatagacagacctgacgctcgtcttaacgaggtaggcgacgaagttctcgagcttctcatggatcttgacgctactgacgagcagcttgacagccctatcctttattgctcaggcagagcaggtacagctactcactcacctgatgaagagggcaaggatatgatacctctctttgacgagatactcagctatatccctgcacctgaggtagatactgagggtccaatgcagtatcttgtttccgctatcgactacaacgagtatgtaggaagaatagctatcggccgtatcgagcgtggcgaaatgaaagttaatcaggacgttacgatcggcgactatcatcagactaagaaggaatatcgtggcaagatagttacaatgtatcagatagagggacttaacagagttccatgccagagtgcaaaggctggcgatatcgtttgtataagcggtatcgagaacatcactatcggtgacactatctgcgacttcggcaactttgaggctgttccttttgttaagatatccgagcctacagttgaaatgacattctccgtaaataattcgccattcgcaggcagagagggcaagttcgtaacgagccgtcacctgagagacagacttttcaaggagcttcttaaggacgtttcactgagagtttctgaaacagacagtacagacgctttcaaggtagcaggccgtggcgaaatgcacctttctatccttatcgagaatatgcgtcgtgagggctatgagcttagcgtttcaacaccgcacgttctgtttaaggagatagagggcaagctttgcgaacctatcgaaagtcttgttattgacgttcctgagaactgcgtaggttctgttatggagaagataggtgcaagaaagggcgagcttcaggaaatggcacctgttggaagcagaatgagacttgaatttcttatccctgcaagaggacttttcggatacaagagcgaattccttacagacacaaagggtgagggtatcatgagctctgtattccatgattacgagccatacaagggcgagataccaaagagagcaacgggctcacttgttgcgtttgaaacaggcgaggctgtaacatacggtctttacaacgcacaggagagaggcgagctgttcatcacagcaggcacacctgtatatgagggaatgatagttggcgcttcaccaaagcaggaagaccttgttgtaaatgtctgcaagaagaagcaccttacaaatacccgtgcaagcggttctgatgacgcgctcagacttgttccgccaagaaatctcagccttgaggattcacttgagtttctcgctgatgatgagcttcttgaagtaacaccaaagagcataagaataagaaagcgtattctgagcaactcacagagagctaaggaaagagctaaaatgtaa

SEQ ID NO: 1432 - DNA, 1944 bp, Ruminococcus bicirculans
ttgaaaaacaataataataatggaaagaccctgttgatctatctgctggtatcggttgccataatctgcggattggtctatatgctaacaagcatgagcacaaaatcttccgacaaaaaatattcggagataatggaacagtttgacagcctgaacgtgtcacagtttgagcttgacctcggctccggacagcttaagtataagctcaagggcgaggataaggtatatagttatacagttccaaatgtttcactgtttgcaaatgaagtccttggcggtgaggacgctgagaactatcgtaagaaatataatactgaaaatccagacgatcctttgcagtataatcttataccgatatcggataacagcttctggctcaatctgataccgacgctgcttatgctgggcgttatgatattcttctttgttttcatgatgaagaatgcaggtggcggaaagatgtcatctttcggaaaaacaaatgccaaaatggcgccaagcagcaagaaagctacctttgatgatgttgcgggtgcagacgaggaaaaggaagaacttaaggagatcgttgattttctccgtgataataagaagtataccgagatcggtgcgagaatacctaagggcgttctgctcctaggccctccgggtacaggtaaaacgcttctcgcaagagcggttgcaggcgaagcaaaagttccattcttctcgatctcaggttctgacttcgttgagatgttcgtgggcgtcggtgcttcaagagtaagagatctttttgagcaggctaagaaaaacgctcctgctatcatctttatagacgagatcgacgcagtgggcagacagagaggcgcaggccttggcggaggtcatgacgagcgtgagcagacccttaaccagcttcttgttgaaatggacggctttgaggataacgattctgttattgttatggctgcaacaaacagacgtgatatacttgaccctgcacttcttcgtccgggcagatttgaccgacagatacttgtgggctatcctgacgtaaagggcagagaagctatactgaaagttcacacaagaaacaagccgctcgctcctgacgttgaccttgaaactatcgctaaatcaactgtgggctttacaggtgcagatcttgaaaaccttgtaaacgaggcttcgctccttgcagcaagaaagaataaaaaggctatcaccaaagatgagcttgaggaagcttctatcaaggttgtggcaggtcctgagaaaaagtctaaggtcatcacagaggacgaaaagaagcttaccgcttatcacgagggcggtcatgcactctgcacatactacagcaaaacacaggataaagttcatcaggtatctatcatacctagaggtcaggctggcggtttcacaatgagcctgcctgtgaaggataaatcttatgttagcaagaacgagatgtatgaaaatatcgtggttcttcttggcggacgtgtggctgaaaagctgatccttgacgatatctcaacgggtgcttcaaatgaccttgagagagctacttccacagctagaaacatggtaacacgctacggcttcagcgacaatcttggtcctgttgtatacggtcagggcgatcatgaagtatttcttggcagggattacactaatacgccaagctattccgataacgttgcggctgagatcgataatgagataagaactcttattgaaagtgcatttactgacgctgaaaagatactcaacgagcatatggataagcttcacgttgtggctaagtatcttatgaagtatgaaaaggttgacggtgcaacatttgagaagcttatgaatggcgagcttacagaaagcgagtttatgggcgaacctgataaaacaccagaaatccaggatactcctgagatagttgatgatatttcagttgatgataattga

SEQ ID NO: 1433 - DNA, 1173 bp, Ruminococcus bicirculans
ggaggtgagaatttgaacgatacaaatactaaagattatatgattgacgttgcccaggataccacttatcaaaatcagagtgatgattataagaagtcgtttgcaaagtggcgttcaaatcctcagaattcttttggattccagtttatacatgatacaagagaacactcatacattgatggcgagggttttgtgcctcataaggcagaggtagcagagaggatctctatgctaaaatgctgtagtttgttgggcatttgtcttgtggtaatgcttgctattgattttcttaactattttatagtgaataaatacgcgccggatacaactggtacatttgtgtatttttctcaaacagatggcggatatggcagatatggtgttggaatgacttttattttaggtctgttgtttgccgcaaagtttgttgtgcctggtcttatttttaagatcgttactaagatccctaataaagtcgtttttgcaaattcaaagggctacgaaaaaatgcgtggaactgctgtggttattatgatggtcataatcgttgtgggcagagttggacaatatatccttagtctgctgttttcaactgtgcatttagacgggatatattctatttttgtattctctgaagaccctgttgttgcttttgtttcttttactttctttgcgatcattgttcctataatgcaagagatagtatttcgaggaatttttttgcagacttttcgtcaatttggcgacaccttcgctattatgatcactgctgttgtgaacggtttatgctactatgatattacatatcttccttttgttgtatgctgtactgcggttcttggactttttactatacgaacaggctcggtttttactgcaatttcaatgagtatttgcgcccacatcacgaattttgtattaagttacattgttctctatgatcttccttatgccaaaatagcagaagtcataatctgtacagtgatcgttggtgtatcacttgtgatgtactcgaagcttacaagctttggtgactggacattcaacattgaaaatgataattcttttatgacgatgtcaaagcgagttaaatctttcattgcaactaactcgattgcagtgtggatagctgcaattcttgtgactatgtttgtgtgtgcgaggataatatga

SEQ ID NO: 1434 - DNA, 1584 bp, Ruminococcus bicirculans
gtgtataatatacataaatcaaataaattaagttgtgataataacaatttagtggaaagaggagagatagcaatgcttgaaaagatcatacagaaaaacacagaaaaatcagagatatccgaacagctaaaagggctgagagaacagctcaccctgcttgaaaacaaaataaagaccgcaggagtgcctgttataatcacatttgacggctggtctgccgcaggcaaaggctcaatgatagcaaagctcatacgctctcttgacccacgtttttacaaggtggtttcctatcgtgcgccgaatgagcaggaaaagcgtatgccatggctgtggcgttattggcagacgctgccgaaaaaaggtgagtttcttatccttgaccgaagctggtatcgtgacactgtgaacgcctttatgtacggtgagatagacaaagaaacaagggatgcacgccttgaagatatctgcacctttgaaaggcagcttacagatgacggatatgatatcgtgaaaattttcctgcacattaccgaagacgagcagaaaaagcgtatcgaaaagctggagaactcctcagttacaagctggcgtgtggaaagccacgatataaagaacatggaaaaatacgataagtttttccgcagatatgacaaaatgcttgaaagcacaaacacggcatttgctccgtggacttgcgttggggcaaatgaacgtgcctctgctgagcttgaagtgctgacagcggtcacaaaggcagtaagcactgcagtttccgccaaggagaagggcgaacattatattcccgaaccacagttcgacacctgcggatacaattatcctgaatataaaactattgaaatgcctgctcttgcagaagtggacatgaacaagtcccttgacgaagcggaatatgagaaaaagctgaaaaaatatcaggacaagcttttcaagctgcaaaatctctgctatcagaagaagatacctgttataatatgctatgaaggctgggatgcagcaggaaaaggcggaaatatcaagcgcattgcggctgcccttgatccaaggggctatgaagttcaccctatcgctgcacccgaaccgtcagagtttgcaaggcactatctatggcgtttctggacacgtcttgaaaagaatggtcactttactatctttgaccgcacatggtatggcagagtaatggtcgagcctatcgaaaagctcacccccgaagaacgtgtgaacatggcttatcgtgagataaacgagtttgaaagccagcttcatgattggggcgcagagataataaaattctgggtgaatgtagataaagacgaacagctccgccgttttaacgagcgtgagaacacgcctgaaaagcgttggaagataaccgatgaagattggcgcaaccgtgaaaagtgggacacctatgagaaatatgttgaccgcatgataacacttacctccacagatatagcaccatggacgatacttgagggcaacgataaaaaatacgcccgcataaaagcactgaaaactattgtgaaacgccttgaaaagcgtttggaaaaagaagataaataa

SEQ ID NO: 1435 - DNA, 1758 bp, Ruminococcus bicirculans
ttgaaagaaatactagcacagatcaaacagtacaagaaggactccattctgacccctgtctttaccgcacttgaggtctttatggaaatgcttctgccttttataatggcgaagataatcgacgacggcattgaaaagggcaacatgacaaacgtttatattttcggtggcgtaatggtagtggcggcaatggtcagcctgctttcgggctttcttgcaggaaaatatgcggcttcggcttcatcaggctttgcctgcaatcttcgtgaagctatctaccgcaaggtgcagacctattcgttctcaaacatcgacaagttcagcaccgcaggtcttgtaacaagaatgacaactgacgttacaaacgttcagaacgcataccaaatgataatccgtatcgcagtgagagcgccgctgatgctcatctgctcaatggcaatgtgctttgcagtaagcggctcaatgagcactatattccttgcagctatcgttcttcttggcatagttcttggaatcatcgttaaaaagacgatgaaagttttcacagaagctttcaaaaagtatgacgacctcaacgcaagcatacaggaaaacgtatcagctatcagagttgtaaaggcatatgtaagagaggacttcgagcagaagaagttcaagaaagcctcaggcaacctctacaagatgttcgtaaaggctgaaagccttatcgcactgaacaaccctgttatgatgttcgttatctactcctgcataatgctcataagctggcttggcgcaaagaatgttgttgcaggcactatgacaacaggcgagctttcatctgttttcacatatgttatctccgccatgatgtcacttatgatgctatctatgatattcgttatgatatcaatgagtacagcaagtatcagacgtatctcagagatactcaaggaaacacctgatcttcacaacggtgagaacccagcaaaggatatgaaagacggctctgttgacttcaacaatgtaagcttctcatacaagcatggaagcggaaaaatggtgcttaacaatatcgacctgcacatcaagtccggcgaaactatcggcatcataggctcaacaggctgcggaaaaacaagccttgtaaatcttatcagccgtctttatgacgttgacgaaggttctgtatgcgttggcggcaaggacgtaagagattacgatatggaatatctgagagatcaggtttctgtagtattgcagaaaaacgtgcttttctcaggcactatccttgacaacctacgctggggcaacgaaaatgccacagacgccgagtgtattgaagcctgtgaagctgcctgcgctgacgagttcattgaacgcttccctgaaaagtatgaaacttatatcgagcagggcggcacaaacgtatcaggcggacagaagcagcgactttgtatcgcaagagcgcttctgaaaaagccaaaggttcttatccttgacgactccacaagcgcagtagacactgcaacagacgcaaagataagagcggcattcgcaaagtctatcccaggcacaacaaaattcattatcgcacagaggatctcaagcgtccaggacgccgacaggataatagttcttgacggtggcagagtaaacggctttgacacacacgaaaagcttgttgaaacaaacgagatataccgtgagatatatgaatctcaggtaaagggcggcggagatttcgacgttcagtcagcagggaaggaggaagcttaa

SEQ ID NO: 1436 - DNA, 1272 bp, Ruminococcus bicirculans
cggggaggtatagtaaaaatgagttacatcgatattttgggacagaaagcaaaagcttgcaaaaaggatatcgccttcgcttcaacaacacagaaaaatgacgcacttcttgagatcgcacatatcctgagagtttgcaaggacgatattatcgaagcaaacaaggttgaccttgaaaacggcagaatgaggaaaatgtcagaagcaatgcttgacagacttgcactcaatgacagccgtatagagggcatggcaaaggcttgcgaagagcttgcacagcttgacgaccctgtgggcgaggtagtttcaggctcaacaagaccaaacggcatgaagatcgagaaagtaagagtgccaatgggtgttataggcattatttttgaagccagaccaaacgttactgtagacggcgctatactttgccttaaaagcggaaacgctgttatactcaggggcggaaaggaagcaataaactcaaacaaaatgcttgccgacctaatgagaaaggctgtcgaaagggcaggcttcagccctgatatcattcagcttgtggaggatactgacagaggcatcgctcttgatatgatgaaagctaatgattatattgatgtccttatcccaaggggaggcgcacagcttataaaggctgttgtacagtctgccactgtgcctgttatcgagaccggcacaggaaactgtcacgtttatgttgacgcaagtgcggatataaaaatggctgtgaacattgttgataacggcaagacctcacgtccgtctgtatgcaacgcagttgaaagctgtcttgttcacagggatatcgcagaggattttctcccgaagcttaaagaaagacttgacaagcaccacgttgagataagaggctgtgagcttacaaggcagatacttggtcctgagaacgttactcctgctgatgatgatgattatgcaacagagtttcttgactatataatctctatcaaggtcgttgacgacatggcggaagcccttgaacatatcgacagattttctacaggacattctgagtgcatcgtaacagaaagcctttttgccgcacaggaatttcaaaagcgtgttgattcagcggcagtatatgtaaactgctcaacaagatttacagacggcggaatgttcggtcttggtgctgagataggtatttccactcagaggcttcatgcaagaggtcctatgggtcttagagaaatgaccaccacaaagtatcttatctcaggcaacggacagataagagaatag

SEQ ID NO: 1437 - DNA, 1473 bp, Ruminococcus bicirculans
ttgagaaatattaaggcaaaagatacaaaaaaattaaacaacggaggaaatcatagtatgaagaagtttttggcaggcttctgtgctgcggcaattgcagcaggatgcatgggaatgacagtcatggcagacacggaagcaacggacaagctcacctcttacgaggcaacaagcgacaatgttaagcttatcggtcgtacttacagaaagggcgacacaacgatacttggctattctgcaagcggtatcgagttcaaatgcacaggcacaaaggctgttttcaatgtaaacggcagcgtaggtgaggcaagaattggcgtatttgtaaacggcaagcttgttaagcagggctacataaaaaataagaagacaaacgcagttgaggtagatcttcctgagggcgaaagcacagttaagctcataaagctttcagaagctgcacagagcgttatcgcaattgacagctttgaggtagacggcaagccacagccaacagaggcagcaaagcattctatcgagtttattggtgactctatcacttgtggatacggtgttgacgatccacttggaaagtcattttctatctacaacgagaacgccgcaaagacatatgcttacaaggcagcacagaattttggcgctgactacagctttgtatcagtaagcggagcaggtgtgatctctggttattcaggcaacggcaagataaatgacgcactgcttgtgccaaatttctatgataagttctgctttacatggagctggttcgacggtgaacagacagctaattatgattgggatttctcacagtatcagcctgagcttatcgttgtaaatcttggtacaaacgataactcatacacaaagggtgaccctgataagtgtgctgagtttgaaaagggctatgtaaatttcctcaaggagataagagctaagaatccaaattctgagatactttgtacacttggtattatgggacaggagctttatccttctattacagatgcagttgacacttataagactgaaacaggcgacagcaaggtatcagttttccagttcagcgttcaggacagcgaaaacaatggttatgcagttgactatcacccatcagctgtttcacagaagacagcagcttatgagcttacatatgctattgaaggcatttacggctgggagagagttgagttggttaatgacggcgttgacgaaatgacaaaggacgacgatgttgagttcaataacgttgttgaggagtcgtcaagtgaggagagcagcgagagcaaagcagaggagtcatcttccgaggcttcttctgaagcatcaaatgacagcagcgcagcggcttcatcatcaaagacaacgacaaatcctaacagcaccacaaaccctaatacagatgcggcaatgggcataagtataggtctggcagcacttgcaggtgcagctatggtggtttctaagaggaagtaa

SEQ ID NO: 1438 - DNA, 1821 bp, Ruminococcus bicirculans
atgtgcggaatagtaggctatgtgggaaaaaaggattgtacaaaggtgctgcttgactcactgtcaaagcttgaatacagaggttatgactcagcaggaatagctgtttttgagaacgatgctatcaagacaaaaaagacaaagggcagacttgctgaccttgaagaaaagcttaaaagagagggttggctcaacggtacttgcggtataggtcacacacgctgggctacacacggcgagccgtctgatataaattcacaccctcacggaaatgcgaatatttctatcgttcataatggtatcattgaaaactacagaactatcaaggattttctgctgaaaaagggatatgtctttgaatctcagacagatacagaaacagttgcaaagcttcttgattattattatgagggcgaccctatggcgacaatacagaaggttcttgctgagatagagggttcatatgctctgggtatcatattcaaggattttccaagaagaatatatgcagtaagaaaggattctcctcttatcgttgcagttggcgaggacgaagcttttatagcttctgatgtgcctgcaatactgaaatatacgaagaattactatcttcttgacgagaacgagatagctgtccttgacgatggcaaggtggagttctttgacgttcatggaatgccagttgagaaagagatgctcgttgctgactttgatatggaagccgctgagaagggcggatatgctcactttatgctcaaagagattcacgaacagccaacagctataaaaacaactttcacaccaagaatagttgacggtatgccaaaccttgaagagtgtggtcttacatatgacagactcaagggctataacaacatcttcgttgttgcctgcggtactgctatgcacgcaggtcttgtgggcaagtatgtgcttgaaaagattggcagaatacctgttacagtggatatggcttctgagttcagatacagagatcctatcattgcaaagggagatcttgttattcttgtttcgcagtcaggagaaacagccgacactctcgcagcccttagaatggctaaggagaggggtgctgaaacactttctatcgtaaacgtaaaaggctcgtctatcgcaagagagtctgatatggtgctttacacccatgcaggccctgagatatctgtagcttccacaaaggcatatatcgttcagctttctgtattctatctgctgagctttgctatagcatacgctcacggagctatctcaaaagaggagtgcatgagacttacagcagagcttcagaacgttcctaatatgcttgaagttgtccttaaaacacctgataattgtcagtatgttgcttcacagcttgtaaacaaggaaaatcttctttatatcggcagaggtcttgactatgcgctttctatggaaggctcactgaagcttaaagagatatcctatatccattctgagtcatatgccgcaggcgagcttaagcatggcactatctcactggtaacaaacaatatgcctgttatcgcagttgcaacacaaagagagcttcttgacaagaccataagcaacgtcaaggaggtcaaggcaagaggagcgtacgttgtccttgttactcacggatatatcaacgttgacgatgaggtggcagattataagatcggtctgccgacaatagacgatctgctcatgcctatgctgacagtggttcctttgcagcttatcgcttactatacctcagttctcagaggcaatgacgttgataagccgagaaatcttgcaaaatcagttacagttgaataa

SEQ ID NO: 1439 - DNA, 1080 bp, Ruminococcus bicirculans
gataggctcatgaaaaaacatcttatctctgctcttcgctcagagcgcaggcgaaattacaccatgaacgccagcatagtttcggcggtatttatgataatgatatgggcagggcttcttacggggtttataatgataggcataaaaagatgcctgcattttctatcccctttgcaaatgccttttgttttccttattgtgggacttgtggtatctgtaataatcggcacttgcatttctgccgctgtagcaagcaagatagtaagacctgtgcgtgaggtaaaaaaggcaatgcacagggtagaaaagggagatttttctcaaaggttagaggtaacaggctttaacggcgagatagacgagcttatagaaagctacaacaaaatggcgcaggagcttgggggcatcgagatgttcagggagaattttatcaacagcttctctcacgagttcaaaacgcctatcgtttctatccagggctttgcgaaacagctaaaaaaagaaaatctgtcagaagagaaaaagcaggaatacattgacattatcatcagcgaatcaaagcgtttgaccaatctttcatcgaacattcttatgctttcaaagcttgaaaatcagcagataatcactgacaagacaagcttttcccttgacgagcagataagaaactgcatacttcttctggaaaagcaatggacagctaaggacataagctttgacattgatatgcaggagatacaatacaccaccaatgcggaaatgctttcgcaggtgtgggtgaacataataggaaacgccataaaattctccccggagggaagctctatcagagtaaagctttttaaagagggtgatgtgataacggctgagataactgaccgtggcattggcatggatcagcagaccatatcacacattttcgagcgtttttatcaaggggacagggcgcacgcttcagagggaaacggacttggtttgccccttgttaagcgtatcgtggagctgtgcaacggcaatatccgtgtagaatcacaatacggaaagggtacaaattttattgttacgctccctcagaatggatag

SEQ ID NO: 1440 - DNA, 876 bp, Ruminococcus bicirculans
aaggaaaaagagatgttaaaaataatcggagtacgctttaaaagcgttggcaagatatactacttcgacccaaaagactatgacgtgaaaatgggcgacaaagttatcgttgagaccgcaaggggcgttgaatgtggtgaagttgcgcttgtggacagggaaatagacgaaacaagattcacaaaccccgtaaaaggcattataaggcttgccacccctaacgatatgaaaactatcgaaaaaaacaggcaaaaggaaaaggacgctttcaagatatgcgagcagaagatagccgctcacaagctgaaaatgaatcttatcgacgttgaatgtacttttgacaacaacaagcttcttttctattttaccgccgagagcagagttgacttccgcgagcttgtaaaagaccttgcggcggtattcagaacgaggatagaacttcgtcagataggcgttcgtgacgaggcaaaaatgcttggtggtcttggcatctgcggacagcctttctgctgttcaagatttttgggagagttccagcctgtttctattaaaatggctaaggagcagggcttgtcgcttaaccctacaaagatctcaggcacttgcggaagacttatgtgctgtctgaaatacgagcaggacagctatgaggatcttctcaagcacacgccaaaggtgggcgctatcgtaaaaacggctgacggaaagggcattgttgaggaagtaaatctgctcacaggcaagctgagagttaaaatggataaaaacgataatgttgttgtggtgaagaaagacgatattgaggtaataaaggattctgttataaggctcgaccgtgacgagataaaggctttgaaggggcttgagggcaagtaa

SEQ ID NO: 1441 - DNA, 1710 bp, Ruminococcus bicirculans
atggcagcggctgttgcagcaatttgcacgctgtcaggctgcggagtgcagataggcagaaacgagagcatgaccgcccccgaaaaaacatctgttgtaaccacaacaaagaaacagacaaacgatgacagcaaggctgacgagcaggctttaaaaagctacgaagaaacaaagatagtggcaaacgccataccttatgtgaagttttcaaaaagcgttgaagccgaaacaggctcagtttcaggcaaggcgaaagtaaaaagtgaccgcaagggctacaagggcaagggttatgtgacgaacatttccactgaggaagattggtcaagagagatcgagcttaccgactcacagtattatgaccttaccataacagtggcttccgatgtgccgtgtgtgaacggcatagctgtgaacggcaaaaagcttcaggatttttcagccagcggctcgggcaagtttgaaaaggtgactttcaagaacatctacatagaaaaaggcaagacggcaatatccgttatccctgtggacggcggacttgacgttgactgcctgaccctcaccgcaagcgaggatatatcaaagcttgaccttactatatcaaagcctgctctttcaaacaaagactccgactacaacgcaaaagcgctttatcagtatctttgcgaaagctacggcaagcaggtgcttttgggtcagcatgacactatcggcacatctgccgaaacagacatgatatacaaaaccacaggaaaatatcctgccatacgttttggcgaccttatgcttgccactgaaaaggacagcattaccaccgacaccgaaatgaacatcgccatggattgggcttcaaaggacggcatagtgggctatatgtggcactgggctgcccctgacgacaagcgtgaatattatgccgaccagacggattttgacatcaaaaaggcagttacaaaggaaaatatcgcagaactcagccttgaggatatcaaaaagcttcaaaaggacggcaaggtaagcaaagaatgtgttgctgtcgttcaggatatcgacaccgtatctgagaaactctccaccctccgtgatgagggaatagcagtgctttggcgaccgctccacgaggccagcaacggcgatttctggtggggcaatgacaaggaagcctacaaatggctttggaagcttatgtacgagcgtcagacgaaataccacaagctgaacaatctcatatgggtatggtcagcacagaatgccgattggtatgtgggcgacgaatactgcgacgtgctttcctgcgatgtttatgacgacggcaataaggacgcacaggtgaacataatgcttttcctgcaaagcatatcaaagaacaagcctattgcaatgagcgaatgtggaagcttccctgacatacagagcattgcagacgaaaaagccatgtgggcgttcataggtcaatggggcggaaattatcttatgaccgatgacggcaagcttgctgaagaaaacaacaccgccgccgagcttatcaagatgtataacaacaatctcactctaacaagggataagctccccgacttcacccaccttgcaagttccataaaggacacggaagaaaaatccgctgagagcaaaaagaatgatagctcaaaggctgacagcaagacgaagaaagaaaatacttctaagcagaatagaaaaaaggggctgtaa

SEQ ID NO: 1442 - DNA, 1488 bp, Ruminococcus bicirculans
atgagccgcagagaaactatcaaggaaaaaagaagctggctgaagaatttcttcacccaccgccagcaccctataatgatattatcttatacaactaaatatatgtggcttcttgctatccctcttgccaagtatctcatagccgcaaaattcaactttcaaagctggtttcaggcacattgggttgatatcctcactatcacatttatcttcggctacgctttcctgcgctggatattcgtctactatgagcttgaagaagattgcatcatagcccacacaggctatttcggcataacacgaacaaaggtctattttgccgagataagctcattgtcactgtcacaaggatatatttccagacttatacattcctgtgccgtatacatagacaccgatgcaaaatcactgcaaaatgcagatataatgctcactcttacaaaaaaacgagcctttgagctttatcattttgccactgccaaatgcaaaaacaaacctaaatatgtctacaactcaaagaaaagcctgctcgttatattctctcttatcttttcatcaactctgtcaggcatgataatcgtgctgtcggtactttacgaagcatataggatagtaggacgagaggcggaggaacaaatactccgcagagtgaatacggagatagcaaaagttccggtgcttgcagaagtgcctgaatatatccttatcgcaggcggtgtgctggcaggaggctggctcatatcatttctgtcgaatctaatgcgccactggaatttttcctgcacacgctgtgccgaccttttcataatcagaagcgggataggcacaagacgcagacacgtcctctatagagatagagtaaactatatcgacctaagacaatcattgcttatgaagatatgcaaaataacctctgtgtctgcccactgtacaggatatggaaaaagacggcttgaaatatcagcacttataccgataacgacaaacggacaggttgaccgctccctgaagatgctcatgccgaaaataccgccggtgaaaagcgacatctccacaggaaaagccgaccttggcagatttataacgataccgctcatatgcacgtttatacccatcatatcaggaagaggagcgctttacttttttcctaactggaaaagagaaataaccatacttgttatactaactaccataccattgctgtggctcgtgatggttaaggcggcggcagcgttcacaacgtcaataggctttgaaaacgggtattgtacattgtcatattgtaaatggtatagctttcataaatcaatagccgcacttgacagagtgtcaatggtaactgtcatgcaaaatccgtttcagaagataagccatacttgtgccgtgagagtttataccaattcggagagtacagactatcatactgtaaagggacttaattatgataaggttataaaattgttgaacaggaatgggtatgcggtgtga

SEQ ID NO: 1443 - DNA, 1056 bp, Ruminococcus bicirculans
atggtaaggcgggagcagatcatcgctttgcattatgggggcgttacttttttgaataatatagaccttaaattcatgtttaaagatacggaatgtgtcagaatgcagtcgggaaagtattcctgcgttatcgcaccaaaacttggtgcagctgtgctgaggcttcgtgacgaggaaaacggcatagaggtgttcagatatcgtgatgactgcactctcaagactataaataaggcgagagagatatggggactgcctactcttttcttgcctaaccgctttgataagggcattataaagacctctgacgcagtgtatcaaatgcctgtaaatgagaaaaagcttgataattttatccatggctgggtgcataagagagaacacgaaatagagtgttattcaacacaggataaaaaagctgtgcttgttacttcttatacctttgacaagaatgacgagatgtattcttattttccggtggattttaaaatgtcttatacgtttacgctgtctgaaaacggtcttttgcaggagatatacctgacaaacaacagcgacaaggctctgcctgtttccatatgtactcatacctgccttaatgcgccaatgtgcgacggcggcagggaggaatcaatgagaatgtgcgtgccgataatcgaaaagtgcgagcttgacaagagatgtctgccaacagaaaagcttttgtctcttaaaaagaaagaccttgaatataaagagggtacaaaaatgcctaccctgcataatatctcaaacgatatgtacaccgcaggcatgaacaagcttgacggcaaggatttctatggctcttatgttgtggatactgacaatggtcataaggtttgcaacgaggtgtcaaaagaatttaagttctggaatatgtggaacgataagggcaataaaggatatttctgccctgaaccaatgacagctatgataaactctcctaatctcagcctgcctaacgaagtgagcggatatgaggagataacaaagggtcacacctttaagtgctggcagagattctttactgaataa

SEQ ID NO: 1444 - DNA, 2241 bp, Ruminococcus bicirculans
atgagtataaacagcaatgagggcaatgatttttgcaacagatataatgcggtgctgaaaagcgataagaaaaaaatgatcgctgcggctgcagcttgcactatcgttatgggagcaggctttggcggatatttatactacggcgcttattatgcttcgggctggcacacccatgacggctcgacttattatattgtcaaggagacgggagaaaaggcgcttggctatcagataatagacaacacctgctatctttttgacgacaagggaaacgctatggctgacggctggcataagtatcgtggggacacttactatgtcaaagacggcgttgttcagcgtggaaaaatgaaaataaagggagaggaatactatttctctgaggagtctggcattttcaggacgggtctttgcgagataaacggcggtgaatactactttgacgatcacggcttccctgacacgggttttgacagcgacggcggttattactatgacgagagcggcaagcgtgtgacaggctgggcaaagataaacaatgttcagtattattttctcaagagcggtgagatggccaagggctttgttgagatagagggcaagatatactattttgatgatgacgacggtcacatggccacaggctggcaggacattgacgggaagaagtattatttttctgagagcggtgctgttcacaagggctggatggagcttgaaaagaagtattactattctgatgaagctacaggtgcttgcgctcagggctttgcggagatagacggtgagagctattatttcaatgacagctgtgaaatggtcaagggctggataacaattgacaagaacagatatcattttgccggtgacggtaaaatgactaagggctggtatgaagaaccgcctgagaagtattatttcaagggcgacggctcggcaggcaagggctttaccaagatcaaggacaagtattattactttgataagaaaaatcgcctcctctccggctggaacgagataggcggaaatgtttattacttcggcagaggcggcgttgtggctgacggctgggaggatattgacgaagatacttactattttgacaaaaagacccatgtggcggcaacaggctggacgaatacggatcagtacactgatgatgagaaaaagaaaataaaagagttcaaatccaatgtttcaaagcttgtgaagtttgagaaggacgattacaaaaaggacgagaagcctgacgaaaaagagacccaaaagcttgaggagcttgcggacaagttcggcgaaaagacattcaatgcttatgacagaaaggtttatgaaaagttcggtggggcggtgttctatcagtattatttctactctgatcacactctttgcacgggatttcataaaataaacggctattacttctacttcgatgaggagacgggtaagaaagctacgggctggaagaccattgacggaaagagatattattttggtctgacaggtgcggcggctgttggcgaatttgaggagggcgaggacaaaaaatacaccttctcaaacgagggcgtgcttgcagacgggatcgttaaaatagacgctgaatggaagttcaagaaagaggacggctcctgggctaagtcggagtttgttacttcaaagggagaaacctactatattggtgaggacgaggctgcacttacaggttggcacactattgaagacaagctgtatcattttgacaatgacggcaagctttcaaaggggctgttcagtgatgattctgggctttactacattgacaagaacggcgctcagaaagacaagtgggtaacagccggcgacaagacctattattttgacggcgatggcaaggcagtttcaggctggagagaaatagacggaacggagttttattttgacagcgatcatgttttgcagaatgaatggacaactattgacggaaagaaatatttcctgcagaatggtgttgcgttgagaggtcctgtgtacattgacgacaagtattacaacttcggtgaggacggatatctaaagtccggctgggtaagctggcgtgggcagaagttctacaacaacaagaacggcactgttgtgacaggttggaagaagataggcggaaagcgatattatttcaatgattatggcatgatgctcataaacactactgttgacggatataacattaacaatgacggagttgcgcataaggcaaagtag

SEQ ID NO: 1445 - DNA, 1359 bp, Ruminococcus bicirculans
tatatacagccatttggcaaaatcaagataagaaaggaccttattactatgaagaaattccttgcggcggctcttgctctttgcatgacaagtgctgctctcacaagctgcggtgattcaaacagctcttctgctgctgactcaaactccgctgcggcaaactctcaggcttccgattcaagtgcggctgataccgaaagtgtttcagacaagcttcttgctgaataccctgcatctacggaaaagatagatgttaaaaatggtgctactgagaacatgatcgccagaagcgttatcaacgagggcgacacttcccgtcttgcggctaagctcgactacgctctgcaaaatcctaaggagacaacaaagatctgtttcatcggcgactctatcacggcaggttcgggtgctaactcctcaactaatcagtatgtaaaccagttcaagagctggtgggaggaaaacataagcttctacgttgatgttactaatgccggtatcggtgcaactgactcatacataggtgttcacagggcacagcgtgacgctttggaggctaagcctgacattatcgttattgagtttatcaatgacgctgatgatgaattttatgagtcctgcatggacagccttgtaagaatgtgtcttgagcaggacaacaatcctgcagttatgatacttgaaccttcaactgaggggggtacatctccacaggctgcacatctcaaggtagcacaggcttacaacattcctatgatttcttatcatgacgctgttatgcctgagatagaggctggcaacttcacatgggctgacatttcacctgacaacgttcaccctaatgatgacggacacgttataatggcttcactgctcacaaaattcgttggcaacataaaggacaatattgacagcgttgacaaggaagcaaaggcatttgacacaagcactgttgcaccgacgggcgatgtattcgctgacgctactatcggaagccgtcagacagaggacattgtaaagacaactgatgagggaacattcacagatgttacaacattccagaagttcacagacggttggggaacgacaacaggcggcactatcaagtttgagataactgcaaagaacattggtatgatatactacatgacagttgacggcaagtccggcgtggctgcggtaaaggtcgatggcgaggacgttgcgactatcaacgctgacttcacaagcggctggggcaactacgctaaggcacagcagatatactcatctgacgaggtggctactcacactgttgaggtaactgtcgttgatgacgcaaagcctaacttccagatacttaactggcttatttcataa

SEQ ID NO: 1446 - DNA, 1449 bp, Ruminococcus bicirculans
atgaacaaggtaagaacaagatttgcaccttcaccaacaggttatatgcacataggtaacctgagaacagcactctttacctatcttattgcaaagcagaacggaggagactttattctccgtattgaggatacagaccaggaacgttacgttgacggtgctgttgaggtcatctataagacacttaaggacgttggtctcaactgggacgaaggtcctgatatcggcggacctgtaggcccttatatccagtcacagagaatgggtatgttcaagaaatatgccgaggaactcgttgaaaagggcgaggcttattattgcttctgcgacaaggaaagacttgaggaagtaagagccattcaggaagcaagcggtatcgctccaatgtatgacagacattgccgtaacctctcacctgaagagataaaggaaaagcttgacgcaggcgttccttatgttatcagacagaaaatacctacagagggcgaagttactttccatgacgagctttacggcgatatcactgttgactgctctaccctcgacgaccagatacttataaagacagacggtatgcctacctataactttgcaaacgtcgttgacgaccaccttatgggtatcacccacgttgttagaggtaacgagtaccttgcttctgcacctaagtataacctgctctataaggctttcggctgggagataccaacctatatccatgttgagcatatcatgaaagataagcagcataagctctcaaagagagacggcgacgcttcctatgaggatcttatgaaaaagggctacctcaaagaagccgttataaactatatcgctctgcttggctgggcgccaaagggcgagaacgagatattctcacttgaagagcttgttaaggagttcgatatccacggactttctaagtcccctgctatctttgaccctgctaagcttaaagctatcaacggcaagtatataaaggctatgacccctgagaagtttgctgagtatgctataccttatatcaagcagtccgttcatagagaggacgttgaccttaacgagatcgcaaagctcttgcaggcaagaacagagcttttcacagagatacctgaaatggtagactttatcgacgctctccctgagtatgatatagctctctatacacataagaagatgaaaacgaatcctgaaaattctctggaatctctcaaagaagttctccctgttctcgagggcgttgaggactggacagaggaaaatatccatgacgcactctttgaccttatcggcaagcttggcgtaaagaacggtatcgttctgtggcctcttagagttgcagtttcaggtaaggcgttcactccgggcggcggtgttgagatatcatatctcatcggcaaggaagatactcttgcaagaataagaaagggcattgagaagctgtcataa

SEQ ID NO: 1447 - DNA, 2175 bp, Ruminococcus bicirculans
atgaacggaggaacatatatgaaagctgttgttttatgcggaggacgtggagaaagattgatgcccatgacagacaggcgacctgcggctcttctgagattatgcggaaaagaaattctgctttttactcttgaaatgctggagaaagcaggctttgaagaagctgtccttgcggtgggctatggctctgaacaggtagaaaggcttcttgatgaaaaatactcaggtaagataaagcttcatatgataaacaccgcaggcaaaagcactgtgcaggctgttagaacagcaatgtccgatgaaacagaaattcttgccgtggaatgtaactgtatctgtatctgcactcaccctcttgatgagattataaaagttcatttgagccacgataccttttgtacggctctgacttatgatactgaaaacaaacctgctggcatatatatagtgaaaagagagctatttgaaagccttaatcctgaaaagcctatggatatgacggaggatattatccccgaggctgtgaaaagtggcgaagctgttctgcttgacggaaaaggctattataaaaggataaccacgcctgaggcttttctcgattgtcaaaggcatatgctttacaacaaaaatatgtcacaaaggctgacagaaaataatttcagcggtgcggcaataggtgagcctgtttatataggagagaacgtttctgtcatgtcagggtcggtcatagaaagcggaagcgtcatagacgataacgctgttgtaaagggcggaaaggtggacggatatgttggcataggctcggtgatatcagaacgctgtgatataaacagggcagtggtatgccgtggggctgtccttgacagcggtgtgaagtgcggtgaatattccgtcataggagaaaaggctcatatcgcaagtgaagccgtcattgaaaaaggagtgggcatatggtctggaaaaactgttgaaaagggtgcaaggctttatgaaaacgtgaaaagatcatctgacagccgactggtcatagacgaaaacggcgagtgcagcttatggggcggtgaagccacagcgcaaaaggctctgctttttggactctgcgccgcaagcgctataaaaaaaggcggaagtatagtgacagcctatggctctgacgaaagccttttgctcaaacaagcccttgactgcggcatatgtcaggcgggagtgaacgtgtacagtataggcagagcaggcatttcagagctttcttatgctgtgaacagattgggcggagagttcggcattctcataggcgcaaacatttcaggtcacgcaaggcttatttcggctgggggaatgttgcctgatgaaaagcttcttgaccgcattggaagcatagctgacgacagagcctatcgcagtgtggggctttctcagacgggttgtgtgacagatttttcagtggtgagggagatatacgtcgcagagcttgaaaaaatacttcctgaccgatttaaaggcgtaaatgtggatatccgcacatatgatgttaaaaaggcgacccttgccgacagactctttcacggcaggaacgatatagacggtgagcgtataatattcaacctttccgcagacggcacaaaagtatcagcttacagtgagaaaacaagctatgtcatgtgggaaaagctggtggcaatgtatgcaggggtgtgctttgaaaaggggcttgcggtggcattgcctgagaatttcccctctaatgccgatgccgctgctgaagaccactgtggcaggctttaccgatacgaaaacaatgctgacatagcaaaggacgttgccgtttcgacccataatatgtttgcctatgacggactttaccttgcgtcagcggtgacgtcttatctgtcagagcaggggataacgctacaaaaagctctctgtgatgtgcctgacgcatacacttcaagccgatttgtgggcataacaatgagccgtgaaaacaaggaaaagatattttcagagcttggctgttcggcagagggtgagataacaagtggcaagacacacgcagttatcagaccgctgagggataaaaaaggtataacagtgtttgcagaaagtgtgagctgcgagcaggcggccgccttttgcgaggatataacaagcaggataaagggcatattcagataa

SEQ ID NO: 1448 - DNA, 1452 bp, Ruminococcus bicirculans
gacagaaaatcatttgatttggaggtcaattattttatgaagatcaagaagattcttgcattggcagtagcgcttacatctgtttttgcagttgcaggttgtggctccacaggcgacagtagttcaaaggtatcaacagtaaagaaagttaaggtcgaggacacacaggaaatagaggctatccctgacgatgctcagaaaactatccgttggatgggtacatatgaccttaaccctgacgagaaaaagggcgaggataagtccgttgagatgacccttttcaacaacaagggtggtaaagtagagtacacaagagtaactgatagcgaaaaatttgaccagctcgctagtgctatcatggctcagcagaatgtacctgatatcttcaagtatgagtggatggctttccctgcacaggtgcttaaggatatgtatcagcctgttgacgatattgtgaactttgacgatccgctgtgggctgatgtgaaaacagcggctgacaagttcgttatgggcggcaagcattatgttgctcctataagcttcacagtcggcacgcttatgatgtatgatcaggacgtcattgatgctgagggtcttgacgatccatatgagctttatcagaacaacgagtggaattgggataactggtatgacatgatgtcggagtttgtttcaaatgctcctgctgatgttgagagatttggtatcaatggttggttccagacacaggtcattcagcagaccggtaaaacaatggtaaactatgacggagagaagttcacaaacaatataaatgaccctgatattgaaagagcagaagatctgctttatcaggtaggtaagaacaaccttgtaaacggcaactggcttggcaatgctaagcaggcacttaaagacggaaatctgctgttctactgcatgggtacatgggctatgacaggaaataacggaccttctgacgctgacacttggagagtggtccctgttccgtctgatcctaacactgatgaaaagtacatgacatctgatatgacggcatatatgtgggtaagaggttcaacagctaaagaggctgtaaagtgctggtatgagtgttgcagaatggctaacacagatgagacatataaggaaaacggcaaggagaaattcctcaacgctaaccctaactggacagaggatatgtatcaggtgatcgttgactgctcatcttctgagtacaatcaggtgtttgactacggctacggaatttcttccacaatgtctgacgacaatgcaaacgaagacggcaactgcgtaacaagaaagctttatgaatacacaaacaaggctgacgataatggcaaacagttctcatggacagagctgagagaatcatactctgcaactgttgacgccgagcttaagactatcaacgacgctgttgttgcattcaataagaaaaattcataa

SEQ ID NO: 1449 - DNA, 2685 bp, Ruminococcus bicirculans
atgacgatactaaaaaggagcgcgtcaatggtgtcagcattggtcatgatgatatctagcgcaggcgcttacaattgcagtgcggagggaacaacggtgaacgatagcaatacaaataatacaagagagatagttattgacggaactacggctcagctcaaagaaaatatgcgctacagaggggcaggcatggtgagtgcaaacaactcatcaaggcttctgttggattacaaggctgaacacccagatgtatatgagcagataatggaatatatgtttggcaaagagggtatcggcattactcaccttaagttggaaatgggtgcggatataaactcatcatcaggcacagaaccatctgtaatgagaacagaggacgaaaaggctgacgtaacaagaggtgcggcataccagcttgccgctgacgcaaagaagataaatcctgacctcacattggatatgctttggtggagtgaaccaaagtgggtatctgacgcttccgacgtttatgctgcaagatacaaatggtataaaaacacccttgacgccgcttatgaaacatatggacttgaatttgactatgtaagtgctgtgcagaatgagcgtggagctgaccctgaatgggtgaaatatctttcctcacatctcaaaagtgaaaaaggcaccccttatgactactcaaagataaagatagtcggtggagaagaggtctgcacatggggctttgctgacagaatgtatgaggacagcgaacttatgaacgttgttgacgtggtgggaagccattacacaagtgagtccaccgagaacgcacagaagcttgcatatgaagaaaacaaagagctttggttcagcgaagcaagctcgccaatggcatatgcgcagtgtacatacagatatgacggctcagggctggcaggcataaacggcacacttgatattgcaaacagaataatcggaatgtatccaaacggcaaaatgatactttatgagtatcagcctgctgtatcggcatactatgacggcgcttgctactgtcagaaacagcttatctcagcctgcgacccttggagcggttattatatgcttgacagcggtttttatatgtctttgcatttttcgcagttcattgaaaaaggctgggctttcgttgacagtggctgttacagcgacggcaaaaaaggcggtgacggacacgctatcgtcgacgctgtttatagctacatgaccgccaccgatacagaaacaggcgattacagcactgttatcacaaacactacaagcgagcctatacagtatgacctcaaggtatcaggacttgacaaggcgtcaagcaacgtgagcgtatgggaaacaagaggtcctgacagcattgacgacagctatgacgagaattatttcaagaaaactgaggatataacccctacagagaacggcggagcttatacatactctgtgacagtgaagccaaattctattgtgacaatttctactgttacacctgagcgcacagaatacaaaaacgctgacgagagcgaacgcactgttttgaagcttccatattcggacgattttgagtatacaggctatcctgagaattatctttcatcaaggggcaatgcgccaagatacacaacagatcagggcggtgctttcgaggtggaaaagaccgacaagggcaatatgctagttcagcagataacggctgacatgaaagccaacgagtggggctacacccccgaacctgtgactacattcggtgacgacaggtggtataactactctgtgaacgttgacgctgcttttgcgacttcgcaggacgcaggatcaaactatgtgggcgttggtctgagatacacgcttggctgcaattcatacagtggctattggataaagctttatgagaacggaagctgggagcttaaagcaaatgacggcactcttagcagtggaagcatagacagctttgacggcacagcttctcacaagcttaaagtcgaggctgtaaacaacgttatccgtggatatattgacggaaacatggtggctgaatacactgtgaacgagggtgaatctcttatcggtgcaggcagagcgtcacttttcagctcatacaacaaaaacagctttgacaacttctctgctgaacctgtggagggcagtgacacatatgtaactcgctttgacgaaacagactcttgcttcacttttgagggcaactgggaacacaaccttatgagcagcttcaaaaactacaaacgaaccatatcagatggcacagagggcgactctttcacagtaagctttgagggaacaggctttgcgctttcaggtgaaacaagagaaaacgctatactcggggtatcaatagacggaggtgatgaacagctcgtgacagtttcaaggacaggtcagcgtgagatatcatgccattttgaaggcttgtctgagggtgctcacaccgcaaaggtaaccataaaatcaggcaaatatacaattgacgctatgcaggtaacaggcggaaagataccattcgagaagaaaaagcctgcgaagtctgaaagcactaagtcaggcaaaagcaagcttcctatagctgttggggcaggcgtttgcgctgctgcggcagtcggtgcagtgatatatggcatagcaagaaagaagcgtaaggaaaataatgactaa

SEQ ID NO: 1450 - DNA, 864 bp, Ruminococcus bicirculans
atgtacataagtctaaggataagaaaaagagtgatgctttgtgttatagctgtgctttctgtgctggcggcggtggctgttatgccgacctttgcaaaagaagaaaaaacagatgggataaagcttccgatcataatgtatcacagcatcgtaaaaaacgaagatcgcagcggtgagtatgtcataacgcctatcgagcttgaaaaggatctgctttatctgaagcagaacggctacactactgtttttgtaaatgacgttataagatatgtgaagcgtgggggcgagctgcctgagaagcctatcatactgtcctttgatgacggcacttacaactacagagaatatcttctgccgcttcttgaaaaatacgatatgaaagccactgtatctattgtgggagcttacactgacgctgcctgcgaggaggctgagcctgatcctgcttactcttatcttgactggcaggacgtttcggtgcttcgtgacagcggtcatgtggagatatgcaatcactcttacgatatgcacaatcttgatggcaggcgtggagtcggtcagctggagggggaaagctacgaggattaccgaaagatatttcttaacgacaccacgaagcttcaaacgctttgcgatgaacactgtggttttcagccaaacgtttacacctatcctttcggcataacctgcgaaagtgcaagtcggctcgtaaagaacatgggttttgaggctagtcttggagtagaggaaaaaatcaatataataaaaaaagaagatgaacgctgcctttttggtctttacagatacaatcgcagcgggatcatctccacagaagaattcatgaaaaaagtttttggagcataa

SEQ ID NO: 1451 - DNA, 1515 bp, Unknown
  Description of Unknown: Firmicutes bacterium sequence
atgagcagaagagcgaaaatggttctggataaagagttccagattgcaccgattgataagagaatttatggttcttttattgagcatttaggaagagctgtatatgagggaatctatcagccaggtcatccggcagcagatgaaaatggatttcgtaaagatgttatcgagttggtaaaagaacttgatgttccgattattcgttacccgggcggaaattttgtatctaatttttactgggaagattctgtaggtcctgttgaggaaagaccacatagactggaacttgcatggagaagtcttgagaaaaatgaaattggtctgaatgaattctcaaaatgggcagaaaaagtaaattctgatgttatgatggcagtcaatcttggtacaagaggaatttcagatgcctgcaatcttctggaatactgtaatcatccatcaggaacaaaatatagtgacatgcgaattaagcacggagtaaaagacccacacaacattaaagtatggtgccttggaaatgaaatggatggtccatggcagattggacataaaacaatggaagaatatggacgtcttgcagcagaaaccgcaaaagcaatgcgcctgattgacccgagcattgaactggtatcctgcggaagttctttccgtgacatgccgactttcccagactgggaagcaacgactctgtcccatacttatgagtatgtagattatgtttccatgcatcagtactatggaaacagagacgatgacagcaatgattatctggcacagtctgatgatatggatgatttcatccgtacggttatctcaacctgtgactatgtaaaagcgaaaaaacgtagtaaaaaagtgatgaacttaagctttgatgaatggaatgtatggttccactcaaatgcagctgatgatgatatcacagaaaatcatccatggcaggtagcaccgccaatgctggaagatatctacaactttgaagatgcactgttagtcggtttaatgctgattactcttatcaaacacgcagaccgtgtaaaaatggcgtgtctggcacagttagtcaatgtaatcgctccgattatgaccgatgcagcaggtggcgcatggaaacagactatcttctatccatttatgcatgcttccaaatacggacgtggcgttgcactgcttccagttatgaacagcacaaaacatgcaactgcaaaacatgatgaaatcacagacgttgaatctgttgcagtttacaacgaagaaaaagatgaagtaacaatctttgcagtaaatcgtaacttagaagaagacgtagaacttacaacagatgtaagaagctttgaaggctaccgcatattagaacacatcgttatggaaaacgaagatctgaaagcaggcaacagcctggccggagaaaaagtttatcctgtaaatggcgatgagagaagcaaacttgacggcggagtgctgacaagcgtaatcaaaaaagcatcctggaatgtgattcgtctgggtaaataa

SEQ ID NO: 1452 - DNA, 2193 bp, Unknown
  Description of Unknown: Firmicutes bacterium sequence
ggaggaaaacgtatggcaattacagtaaaagacaaaatttttaacctggaaacaaaaaacacactttatcagatgaaggtggatcgcttcggagtactcaatcatctctggtatggagaaaaaacagattgttgtatggattatcttctggattatccggacgcaggattttccggaaatatctatgaagcagaaaatgaaagaacctattctttaaatactctgccacaggaatacagcaccagcggagttggagattttcgaatctctgcaatttctgttactcatgaagatggaagtaatgctttagacttaagagtcagggaatatcagattaaaaaaggaaaatatgagattccagggcttccggcagtgtatgcaaaagaagacgaagcagaaacattagaaattactttgaaagatactgcaacggaagcagaggtgattttgaagtatggtgtgtttgaaaaagaagacgtgattacaagaagtgtggtggtaaaaaattcagggaaaacaccgattgtaattaataaagtgcatagtatgtgtctggatattccgtatggagactgggaatggatgcatttttatggcagacatactatggaaagacaggcagaacgagttcctgttttgcacggaatttcagagagcagcagcagcaggggaacttccagtcatcatcaaaatccggctgttctgctttgtgaaaaagattgtacagagacaaatggtcactgcatcggagctgcattgatgtacagtggaggatttcaggcacaggtagaaaaagaccagttagaacagatccgtctggttatgggaatccacccagacacatttgaatggatcttagaagccggagaagcgttctacacaccggaagtgattttatcttgttctacaacaggatttgcaaaattgtctcagaatttccatcacatcatccgaaatcatgtctgccgtggaacataccagttaagcagccgtccggttttgattaataactgggaggcaacttactttgactttaacgaagaaaagattttaaatattgcaagacaggcttctaagcttggaattgatatgatggtacttgatgatggttggtttggaaagagagatgatgattgttccggacttggagactggtttgtcaatgaaaagaaattaaatggcggattaaaagccctggttgagaaaatcaatgcaatgggtatgaaattcggactttggtttgaaccggaaatggtatccgaggacagtgatttgtaccgtaatcatccagactgggcgattcagattccgggaagaaagccgatgagaagtcgttatcagttagtattagacatgtcaaatccagaagtggtggattatctttatggtgtaatgagtgcgattttaagagaaaatcatattgaatatgtgaaatgggatatgaaccgcagtatcagtgactggtatacagctacactttccagaggacgccagatggaaatgccacacagatatgtgctgggactgtatgaattgcttgaaaagctgacatcagaatttccggatgtattgttcgaaggatgcagtggcggaggcggaagatttgatgccggaatgatgtactactgcccacagatttggtgcagtgatgataccgacgcacatgaaagaacctttatccagtatggtacaagtttcttctatccaacttcaacagtaggttctcatgtttccgcagtgccaaaccatcagacaggacgaattacctcaattgaaaccagaggtgtggttgcaatggcaggaagctttggatatgaattagacttaaatcagctttcagaagaagaaaaaacagttgttgcaaaacaggttacccattataaagaatatcaaagtttgatttataacggtgattattatcgtttggcaaatccatttgaggatgggatgtcagcatggtcctggatatcagaagataagaaaatcatattggttcagggtgtattgttccgtgcgaaaccaaatgtattaagaaagactctgcgtctgatgggcttagaagctaagaaaaattataagattgccggaacagaagaggtgtacacaggtgttgctttgatgagtggaggagttttacttcaaagagcggttggagatgatgtctcttttgaaattgtgctggaagaaatttaa

SEQ ID NO: 1453 - DNA, 2109 bp, Unknown
  Description of Unknown: Firmicutes bacterium sequence
atgagagacagaaaaaaagcaagagaacgggcagaagcactggtttcacagatgacagtagatgagatggcaagtcagttaaaattcgatgctccggcaattgaaagacttggaattcctgcatataactggtggaatgaaggacttcacggagtagcaagagccggtacagcaaccgtattcccgcaggcaatcgcaatggcggcagcgtgggatacagatttaatgaaggcagaggcttctgttatttcagaagaagcacgtgcaaaatataatgagtctataaagcatggagacagagacatttacaaagggcttactttatggtctccaaatgtaaatatcttccgtgacccaagatggggaagaggacatgaaacttatggggaagacccgactttaacatccagacttgcagttccatttatcgaaggactgcagggtgatggagaatatttaaagacagcaggatgtgcaaaacattttgcagttcattccggaccggaagcacttcgtcattctttcgatgcaaaagcaaacaagaaagatatgtatgaaacctatcttccagcttttgaagcctgcgtaaaagaagcggatgtagaagcagtgatgggagcttacaaccgtacaaacggagaaccgtgctgtgcaagtgaagaactgatggaacatattcttcgtgaagactggaaatttgaaggtcattatgtatcagactgctgggcaatccgtgattttcatgaacaccatatggtaaccaaaaacggtgtagaatcttcagcactggcattaaataaaggctgtgacttaaattgtggctgtacttatctgtgtttaaaagaagcattaaataaaagactgactacaaaagaaaaagtaaaagaggctgcaatccgtctctttactacaagatttttgcttggaatgttcgacgagactgaatttgataagattccgtatacagcagtagaatccaaagaacatctggaactttccagaaaagcagcagaagaaagcattgttcttcttaagaataatggaatcttaccgctcaaaaaagaagaacttaagattatcggtgttatcggaccaaatgcagataacagaagctctctggatggaaattatcatggaacagcttcccgttatattacagcacttgaaggaattcaggattatgtcggcgatgatgtaagagtcatgtatgcaaaaggaagtcatttatttctggataaagaagaagcgcttgcacaggaagatgacagaattgcagaagcactcagcgtagcagagcatagtgacgtggttgtactatgtattggtctggacgaatcacttgagggagaagagggagataccggaaatgcttatgcgtccggagataaagagaatcttgaatttccaaagagtcagcagagactgatgcatgcagtattagaaaccggtaaaaaagtaattgtatgcaactttaccggaagtgccatgaatctttctgaagcagaagaaaaagcagaggcagtcattcaggcatggtatccaggttcacagggtggaaaagcactggcaaatatcttatttggcgaagtttctccaagtggaaaactgccgattaccttttatcgtaccttagatgaactgcctgatttcacagattattctatgaaaggcagaacttatcgttatctgactgaagaaccattatatccatttggatatggtttaagctatggggatgtgcaggtggaaaaagcagaatttgcaaaagcacctgaaaaagagcaggatgctgaaattcgcgttaccgtgaaaaatcattctgaagtagcaacaagagatgtagtagaagtgtatatcaagaatcaggattccaagtatgcaccggtaaatccggctctgtgcggatttgcaaaagtttctcttggagcaggggaagaaaaagaactgaccattacagtttcaaaagaagcttataaagtcgtaaatgacgaaggagaaaagatttttgattcttcttccagtattctctttgtcggaacaaacggtccggataagagaagcgaagctttaacaggaaagacaacaaagcagttagtaattaactggtaa

SEQ ID NO: 1454 - DNA, 1257 bp, Unknown
  Description of Unknown: Firmicutes bacterium sequence
atgaaaaaatcaatgtttactctgcttatgacaggagtgctgtttgtaggaggggcagtaccggtacaggcagacagcgagaagtatcaggtggatgaaattaagtccattcaggatggaattgtttcctgggaaaaagaccagatgggaattgatgggaaaaatcttctggatggcgtagtactggagagtgcgggaacttcagcaggagactggcttgcatttacagtcagcagaatggaacagccggataatcaaaatggttatcttagtgcactgcaggaacagatagaaacactgtatgaagatgatattacaaaaacagtggaagaacagcacatgaatccgacagatttttaccgggaaattttgacaataaatgcctgtgggggagatgcccttgcttttggcacagataaagataaaaaagaaatcaatctggtagaagatgggatttttgactgtgtgtttgaaaatcaagatcctggagtacagggcgcaaatggttatatctgggcactgcttgcattagacagtaaagattatgaagaaccggaagatgctgtctggaatcgtgaaaaattagtggatgcgattctggaaaaagagcaggaagatggaggattttcactttccacagatggagattccgatgtggatatcacagcaatggcactcacagcactggctccgtataaagatgaggaaaaagtaagtacggcaattgaaaatggattttcctggctttccagtcagcagcaggcagatggagcaatgccatctatgggtgtagaaagtgtagaaagtacagactggacgctgattgcagtatgcagtaatgacatcaatccattagaagatgcccgtttcttaaaagaggaaaacagtctgttagacggaatcttacagtttcggacagagaatggaggaatggctcattctctggcagaaaatgaaaatgcaccagatgcgatggcaggatatcagacgctttatgcgcttgaaagttataaaagatatcagcagggagaaaataccctgtttgatttaacggatgcgcagagtgtagataacagtgcaccacagcaggagacttctaagctgggacagatggcgggaatcctgattgcgctggctgtgcttatcctgattgtggttgttgtgcttgtaatccgaaacagtcataataataaaaaacaaaaagaagtaaaattaaaaaaagtgcaggaagcagaagaacaagatgactggaattaa

SEQ ID NO: 1455 - DNA, 1593 bp, Unknown
  Description of Unknown: Firmicutes bacterium sequence
atggaaaccattacatttgaagaactcggcttatgtcctgaaattgaaagagcagtccgttttatgggatttgaggaagcttctccaattcagacaaaagcaattccggctattatcagcggaaaagatattatcggacaggcacagaccggaactggaaaaaccgctgcatttggtattccacttcttcagaagatagacccgaaaaataaaaagcttcaggcaattgtactttgtccgacaagagagcttgcaatacaggttgcagatgaaatccgtaatcttgcgaaatatatgcacggaatcaagattcttccaatttacggtggacaggatattgtgaaacagattcgttctttaaagaacggaactcagcttgttatcggaactccgggtcgtgtgatggatcacatgcgcagaaagactgtaaagatggaccatattcatacagttgtgcttgatgaagcagatgaaatgttaaacatgggatttcgtgatgatattgaaactattttaagtggtgttccagaagaacgtcagactgttttattttctgcaacaatgccaaaaccaattttggaaatcacaaagaaataccagaatcatgcagaactgattaaagtaaccaaaaaagagctgaccgttccgaatatcgaacagttttattatgaagtaaaaccaaaaaataaagaagaagtgttatcccgcttattagatatttattctccaaatctttctgttgtattttgtaatacgaaaaaacaggtagataatctggtaacagctttaatcggaagaggatattttgcagccggattacacggagatttaaaacagtctcagcgtgaccgtgtgatgcagagtttccgtaccggaaaaacagagattcttgttgcaacagacgtcgctgcacgaggaattgatgtcgatgatgtcgaagctgttttcaactatgatttgccacaggatgaagaatattatgtacatcgtatcggtcgtaccggacgtgccggaagaggcggacatgcattttcttttgtcagcggaaaagaaatgtataaattaaaagaaattcagagatactgcaagacaaagatttatgcacagaaagtgccgtctatcaatgatgttgcaaacactaagatggaacatatccttgcaaaggcagattcagtaattgagcgtgaaaatctttctcttatgttagatgctatcgaagaacgtgtcaatgcgtctgattatacgacaatggatatggcagcagccctgcttaaaatgtatatgggaatggtaaaagaagaaaccgaagaggaagaaataacagattttggagataccggtgcagaagaaccgggaatggttcgtctgtttatcaatattggtaaaaaacagaaaattcgtccaggtgatattttaggcgcaatcgccggtgaaagcggaatgcctggaaaattaatcggaacaatcgatatgtttgataaatatacctttgttgaagtaccaagagaatatgcctcagaagtcttaaaagcaatgaagagtgcaacaatcaaaggaaatcatattgcaattgaacctgcaaatcgtaaatag

SEQ ID NO: 1456 - DNA, 1188 bp, Unknown
  Description of Unknown: Firmicutes bacterium sequence
atgaaaacaattcgggtagaagaattagaacagttaagtgcagatgagattcaggtgattgacttgcgtccggaggaagaatacaaaagaggaagttttccgggtgcagtaaatctgccgatggaagagtttgattcacgatatgaagaagtgctggaaaaagaaaaaccaatttactttatctgtcataccggagagagaagtaaggattatattgaaacagcgacaaaagccggatacaatgcttttaatgtagaaggtggatatcgtgcttatctgcgtctttctttaagtcgttttctggaagaagatacaaaagaaagcaaagaagaaaagacaaaagaaattgagagaagtattattaagaaatttcggaaatccatctggcgtccatttacaaaagccttaaatgaatatcaactgattcaggagggagataaggttgcagtctgtatctccggtggaaaggattccatgctgcttgcaaaactgattcaggaattaaaacgtcatggaaaaattcattttgaagcagtttttcttgtaatgaatccaggctataatgaagataactggaaaattattcaggataatgcagatttacttggaattccacttactgtatttgaaagtgaaatttttgatacggtagcaacaatcgaaaaaaatccatgttatttatgtgcacgtatgagaagaggctatctgtattctcatgcaaaggcattgggatgtaataaaattgcactgggacatcattttgatgatgtaatcgaaaccattttaatgggaatgttatacagcggaaaagtagaaaccatgatgccgaagctgcacagccagaattttgagggaatggaattaattcgtccattatacatggtaaaagaagatgcaattaaagcatggagagattacaacggactgcattttatccagtgtgcatgtcgttttacagaaaactgcgtcagttgtggcggaggcagaggttcgaaacgtgatgagatgaaagaactggttgcgcagtttagaaagaccagcgatgtgattgaaaccaatatttttaacagtgtccgtaatataaatttaagaacggttatcggttatcacaaagacaaagaagcttacaattttctggatgattatgatttgcgcggaagtaaaaagagtgacagtcaggaagagtaa

SEQ ID NO: 1457 - DNA, 2145 bp, Unknown
  Description of Unknown: Firmicutes bacterium sequence
atggacattattttagctttgaccaaagaactaaatgtggaaaagtggcagatagaggctgccgtaaaattgatagatgaaggaaatacgattccatttatttcccgttaccgaaaagaagtaaccggtgctttaaatgatgaagtgcttcgtaatttaaacgacagactgacttatcttagaaatctggaagagaagaaaactcaggtgctttccagtattgaagaacagggaaagctgactgaagaattaaagaaacagattttagaagcgcagacgctggttgtggtagaggatttatatcgtccataccgtccgaaacgtcgcaccagagcaacgattgcaaaagaaaaagggttggaacctcttgcaaacattattttattacagatgacagacaaatcccttgaagaagaagcgaagacatttgtctccgaagaaaaagaagtggcaacagtggaagcggctatttccggtgcaaaagatatcgtagcagaaagtatttccgataaagcggactaccgtagtgaaattcgtgagcgtactttcaggaaaggcatgctcgtttcaactgcaaaaaaaccggaagagatgtctgtttatgagaaatattatgaatatgaagaacgtgtggaaaaaatgccgggacaccgggtgcttgctattaatcgtggagagaaagagaagtttttaggtgtaaaaattgaagctccgacagaagaaattttaggatatcttcaaagagagattattacaagaaaaaatccaaatacacaggatgtattaaaagaagcaatcgaggatagttataatcgtctgattgcacctgcaattgagagagaaatccgaaacagcatgacggaaaaagcagaagatgaatccattaaagtctttaagaaaaatcttcagcagctgttgatgcagccaccaattgttgggaaagtagtgcttggatgggacccggcgtttcgtaccggttgtaaacttgcagtggtagatgaaaccggaaaagtcttggatacggttgtgatttatccgactgcaccgaccactcctgctaagatcgcgtcggcaaaagaaactctgaaaaaattaattaaaaaatacaatatcagcctgatttctcttggaaatggaaccgcttcaagagaatccgaacagattattgtggaacttttaaaagaaattccggagaaggttcagtatgtaattacaaacgaggcaggagcttctgtatactctgcaagtaaactggctaccgaagaatttccaaactttgatgtaggacaaagaagtgccgcttccattgcaagacgacttcaggatccgcttgcagagctggtaaaaattgacccgaaatctataggtgtcggacagtatcagcatgatatgaaccagaaaaaattaggggaagccctgtctggagttgtagaggactgcgtgaataaagtcggaattgatttaaataccgcttcggtttccctgcttgaatatatttccggtatcagcaaagcgattgcaaaaaatatcgtagcataccgtgaggaaaatggacgttttgagagtcgaaaagaacttttaaaagtaccaaaattaggaccgaaagcgtttgaacagtgtgcaggtttccttcgtattacagggggaagcaatccgcttgatgcaaccagtgtgcatccggaaagttatgaagtagcagaaaaatttctggaaaatatgggaacaactgcagaagatattttcaaaggtcatggtgcattttatgtaaaagattatagaaagatggcagagtctcttggaacgggagaaatgacccttcgtgatatcgtaaaagaacttggaaaaccaggacgtgacccaagagaagaaatgccaaaaccggtgcttcgtactgacgtgcttgatatgaaggacttaaaagaaggcatgattttaaaaggtacggtgcgaaatgtaatcgactttggtgcatttgtagatatcggagtacatcaggacggactggtacacatttcacagatgacagaccgatatatcaaacatccacttgaagcagtcagcgttggagacatcgtggaagtcaaagtgttaagtgtggatgaaaagaaaaagcgaatttcccttactatgaaaggaattcagtaa

SEQ ID NO: 1458 - DNA, 1410 bp, Unknown
  Description of Unknown: Firmicutes bacterium sequence
atgcataaaatgtggtatcctaaccacgataacacaaaaatttttaacaatacaagggttaatgaaattatgatgaatatacgaagattaatagccatctggagcggtcgtctgattaaaaccgcctgccagattaccggaaaacagggtgttacgctcgccggaaaagtcgcactctccatttatccgccaatcttaaaagaactggcagccgaagtgcgaaaagacacttttattgtatgtggtacaaacggaaaaacaactaccaataacctgctttccgattttctcgtctcaaacggaaataaagtggtctgtaatcacaccggttctaatatgttaaacggtgtagtatctgcctttgttttaagcgccagattaaatggacacttagatgcagattatgcctgtattgaaattgatgaagcttctactgtccgtgtgcttcctcatttcaaaccggactacatggttttaaccaatctgtttcgtgaccagcttgaccgctatggagaaattgatatcactatgaatctgctctcccgcgccatgaaaatggcaccaaatatgaagcttttagtcaatgccgacgattccctttctacttacctggcaatggataataaaaatccatataccacttacggaatcagcgaacaggtattcaaagaccagaattccaaagagatccgtgaaggtcgtttctgtaaacgctgtggtcacaaaatggaatacaaattttatcattacagccagctcggggattattactgtccgaaatgtggattcaaacgtccaaaaccggaatttgatgcttcccacattgatatgtccgacggacttgcttttgatgtaaaagcctcccatatcaaagccaactatcgtggattttataatatttacaacattcttgccgtatttggcgcagcttccatggcaggaatcccaacaaaaaactttaataaagtgcttggagattacactccgcagtttggacgaaacgaacagttttttatcaatggcacgaaagttatgttaaaccttgccaaaaatccggctggatttaaccagaacatcggtgcagtcatgactgataccagtccaaaagacattattattctgatcaatgataacagtcaggatggaacggatgtctcctggctctgggatgttgactttgaccgtttaaaagatgccaatgcaagctctatcaccgtaacaggaattcgaggagcggatatgcgtctgcgtctgaaatatgttgacattgcttctgatttagaaaatgatattgaaaaagccattgaatccaaaattaaaaatggcacaaagaatctttatgtactggttaattacaccggactttactctacacacaatattttaaagaaaatggagggaaaaaagtaa

SEQ ID NO: 1459 - DNA, 1443 bp, Unknown
  Description of Unknown: Firmicutes bacterium sequence
gtgaaaaagattttatttgtggcatcagaagcagtgccttttataaaaacaggagggctggcagatgttgtaggggcattgccaaagtgttttgacaagaacgaatatgatgtgcgggtgattattccaaaatatatgtgcatgaaagaagaatataagaatcagcttcagtatgtaacacatttttatatggatattggttaccgcagagagtatgttggaatcatgcagatggtatatgagggaatccagtattactttatcgataatgaatattatttttcaggttatcagccttacggagatattcgatttgatattgagaaattctcttatttttcaaaagcagctttatccattcttccggttattgacttcagaccggacttgattcactgtcatgattggcagaccggattagtgcctgtattcttaaaagaccgtttccaggatggtccgttctatcagggtatcaaaactgtcatgactatacataacttaaaattccagggaacttgggatattaagacaatccgtgatttaaccggacttccggcatattactttactccggataaactggaatcttataaagatggaaaccttttaaaaggcggtctggtttatgccgatgcaatcacaaccgtaagtaatacttatgccgaagagattaagacagaattttatggtgaaaaactggatgggctgatgagagcgcgtgcaaatgacctgcgtggaatcgtaaacggaattgattatggtgaatggaatccagagacagatcagttgatcgcaaagaattacaatgcgaaaacatttcgtaaggaaaaagtaaaaaataaaatagagctgcaaagagaacttggtttaaatcaagacccgaaagccatgatgattggtattgtctctcgtctgactgaccagaaaggttttgacctgattgcttatgtgatggatgaattatgtcaggataatattcagttagtggtacttggtacaggggaagaacagtatgaaaatatgttccgtcactttgcatggaagtatcagggaaaagtatctgcaaacattttctatgataatgcaatgtcccataaaatttatgcttcctgcgatgcattcttaatgccgtctctgtttgagccatgtggtttaagtcagttaatgagccttagatatggaacgattccgattgtaagagaaactggtggattaaaagatactgtagaaccatataatgaatatgaaagtaccggaaccggattcagcttcacaaactataatgcacatgaaatgctggcgaccattcgttatgcagaagctgtttactatgacagaaaacgcgaatggaacaagctggtcgaccgtgcgatggcaaaagatttctcatggggaaattcagcaaaacagtatgaagaaatgtataattggttaatcggttaa

SEQ ID NO: 1460 - DNA, 1245 bp, Unknown
  Description of Unknown: Firmicutes bacterium sequence
atgaaaattgtggatgtagtttgctcaaaagcaagaacaggatttttctttgatgaccagagagccatcaaaaaaggtgcagtagcagatggtgcggcttattttggagaaaccgtaacaccgggatttaaatccgtaagacaggcaggagaagcaatctctgttatgttaatccttgaagacggacagattgcgtggggtgattgtgcagccgttcagtattcaggagcaggcggaagagaccctctcttccttgcagaagatttcattccgattatcgataaatatatcaaaccggaactggttggaaaagaagcagacagctttaaaggactttgtgaaatggtagaaaaccttcaggtagaaggaaagagacttcacacagcaatccgttatggtgtcagccaggcgattcttgatgcagtagcaaaatctacaaaacgtctgatgtgcgaagtagtagcagacgaatatggtacaactgtatctgataaaccaattccaatctttacacagtccggtgataaccgttatgataactctgataagatgattttaaaaggtgcagccgttatgcctcatgcattaatcaataatgtaaagacaaaacttggcgaacatggtgaaatcttaaaagaatatgtagaatggttgagagatcgtgtattaaaacttcgccatgatgaaagttatatgccggtattccatatcgacgtatatggaacaatcggtgcaatcttcggagtagataactttaccgctatggcagattatcttgcagaacttgaagaagctgcaaaacctttccatttaagaattgaaggaccgatggatgcagaagaaagagaaaaacagatgctttgcttaaaaggcttaagagaagaagttgataagagaggcattaatgtagaattagttgccgacgaatggtgtaatacattagaagatgtaaaatatttcgcagacaataaagcaggtcatatggctcagattaaaacaccagaccttggtggaatcaataatatcgtagaagcagttctttactgcaaagaaaaaggatttggagcttaccagggtggtacttgtaatgaaacagaccgttctgcacaggtttgcgtaaactgcgcaatggcaacacagccagaccagattcttgcaaaaccaggtatgggtgtagatgaaggttacatgattgtttataatgaaatggaaagaattattgcgcttcgtaaagcaagaagttaa

SEQ ID NO: 1461 - DNA, 1518 bp, Unknown
  Description of Unknown: Firmicutes bacterium sequence
gtgaaaggagatttttttaaaatgaaagcatcaaaaaattataagttttggtttgcaacaggctcacaggatttatacggagatgagtgcttgagaaaagttgcagaacattccagaattatcgtagaagaattaaataaatcaggagtacttccttatgaagttgtattaaaaccaactttaattacaaacgaagtaatcagaagaactttcaatgaagcaaatgaagatgaagaatgtgcaggcgttattacatggatgcataccttctcaccggcaaaatcctggattttaggtcttcaggaatacagaaaaccactgcttcatctgcatacacagtttaatcaggaaattccttatgataccatcgatatggacttcatgaacgaaaatcagtctgctcacggagacagagaatatggtcatatcgtaagccgtatgggaattgaaagaaaagttatcgttggacattggagcgacaaaaaagttcaggaaagaattgcttcctggatgcgtacagcaattggtatcatggaaagcagccatatccgtgttatgagaatcgcagataacatgagaaacgtagctgtaacagaaggcgataaagtagaagctcagattaaatttggctgggaaattgatgcatatccggttaatgaaatcgcagaagcagtttcagcagtatccaaagctgataccgatgctttagtagaagaatactacagcaaatacgacattctcttagagggaagagacccggaagaatttaagaaacatgtagctgcgcaggctcagattgaaatcgggtttgaacgtttcttagaggagaaaaactatcaggcaatcgttactcattttggagatttaggatccttaaaacagcttccgggtcttgctattcagagattgatggaaaaaggttatggattcggtggagaaggtgactggaaaacagctgctatggtgcgcctgatgaaaatcatgactgccggaatgaaagatgcaaaaggaacttcctttatggaagattatacttataatttagtaccgggaaaagaaggtatcttagaagcacacatgttagaggtttgcccgactatttctgatggtccaatcagcatcaaagtaaatccgttaactatgggtgacagagaagaccctgcacgtttagtatttacatctaagacaggttcagcaattgcaacttctttaattgaccttggaaatcgtttccgtctgattatcaacgaagtagactgcaagaaaacagaaaaaccaatgccgaaacttccggttgcaactgcattctggacaccaaaaccagatttagctacaggtgcagaagcatggattttagcaggtggagcacatcataccgcattctcttatgatatcacagcagaacagatgggagactgggcagcagcaatgggaattgaagctgtttatatcgatggagaaacaagaatcagagatttcaagagagatttacagcttggaagcctgttctacagataa

SEQ ID NO: 1462 - DNA, 2661 bp, Unknown
  Description of Unknown: Firmicutes bacterium sequence
atgaagtacaatggtttatcagacaaggaagtcgaagagtccagaaagcaacatggctcgaatatgattcctgattcagaaccaaccacattttgggatgaattcaaggaaacttttagtgatccgatgattaaagttctgttagcaattgcagcccttatgattgcaatgtttttctttgggtatgctgagatttatgaaccattaggaacgattgttgcagttttaattgttgcgtttgtgtcagcaaagacaggtgttgccagcgatacaaaatatcgtgagttgaaagaaagtacagagaaagataaatgtaaagttcacagaaacggtgtaattaccattattgatgtggacgatgttgtagtaggcgacaaggtacttcttcagtctggtgataaaattccggcagatggtatcttaattgatggttctcttcgtgtcgataactctgcgttaaatggagaagcagaggaatgcaagaaaacacaggcagatgaatcattccagcttgcagatgaaatcacaggagataccttcgtagataaacattctcttttccgtggtgcaattgtatttgatggagagggaattttggatgtcagaaaagtcggcttgaaaacaatgatgggaaaaatggcagaagagatgcaggaagatgagccggattccccattaaaagtaaaacttgcgaaacttgcaaaacagatttctacctttggatatattggtgcaattgtaattgcagtgctctattttgcttattttattgttttggccggaggtccgtccgcttattttgcagagggatttgaaaatgttttaaaagatttaattcaggcggtttctcttgcaattgtaattattgtctgtgcagtacctgagggacttcctcttatgatttctctggttttgatgcaaaatacaagtaagatgcttgaccataatgtacttgtccgtaaagcccagggtattgaaacagcaggttctttaaatattttattcagtgataaaacaggaacgattacaaaaggacgactggaagttgttgagttcttctttggagatggaaaatcggttgctcttagtgagttaaaaaatcatggaaaagtaaaagggcttgtggatcttgcaattggaaagaatacgcagtctatgtttgatgcatctcataaagtaattggtggaaatgcgacagaccaggcattgatgaaatttatcggagaatctactttccgtgcacttgaaagtgataaagagtgtataattacacaacagcagggatttaactcttctaataaatttagtcaggctagaattgaaagtcttggaaagacattttataaaggagctccggaacgtttattgggagccgcaaagcattatctggatgcagacggaacagtaaaaccgctggatatggatgtagtaaataaaaagattgatgagttggcagtaaaagcaatgcgtgtccttgcttttggatattcagagagaactatgacggaaaataaaatcaatgatgatgttgtaattattggtttagttggaatccgtgatgatgttcgcccggaagcaaaagaagcgattgcagaagtgcagggtgcgggaattcaggttgttatgattactggtgaccgtctggaaacagccgttgcaattgcaaaggatgcgggtctgttaaaaaataaagatgataaggcactttcttctgcacagttaaatgagatgagcgatgatgaagtaaagaaaatcattcctcatattcgtgtcattgcaagagcacttcctacagataaatccagaatggttcgtctgtgtcaggaaatgaatcttgttgtgggtatgacaggagatggagtaaatgactctccggcactgaaacgtgcagatgtcggatttgcaatgggaagtggaacagaagctgcaaaagaagccggtgagattgttattttggatgataactttaagtccattaaagatgcaattttatacggaagaacgatttatcataatattttgaaattctgtaaattccagcttgtaatcaatgtgacggcagtagtggtcagtgcgattgcaccgttctttggtgtagaagaaccgttaaaagtaactcatttactgtttgtaaaccttgttatggatggtttgggcgcaatcatgcttggaaatgaaccggcacttgagaaatatatggatgaaaaaccaagacgcagagatgaaagcatcatcagtaaacagatgatgggacagattttaacaatgggtctttggcttacggttgtcagttttgtgtatttgaaagcaccgttctttaaaaatttatttgaaaacgaagaacagcatttaacaggatattttgtattattcatcgtaagtgctttgtttaatggatttaatgtaagagatgacggagctgaaattttcaaaggactggatttaaatccaggattcttaaaagtgttctttgcaattattttagtacaggcagtgattgtaaatgcaggtttgattccatttgtcgtatttgattggattggtgaaatgttcagttgtgttccatttggaattaagggctggattgcagcgattcttttagcggttactatgataccggtagatttaatccgaaaagcaattgtaaataaaaaacattaa

SEQ ID NO: 1463 - DNA, 1326 bp, Unknown
  Description of Unknown: Firmicutes bacterium sequence
atgctaaatcctgtaatcgtagcagtaatcttactttgtgtattatgtctgctgaaaattaatgtattactctccatgctcgtatctctgactgtagccggtcttatcgggggtttgccggttgtcagctccggagatgaagtgagcattatgagctgcgttatcgacggattcagttctaacgcagaaacagccttagcatacgtattgcttggtacatttgcttcttgtatggcatacaccggcattacagaaatcttatctgttaaaattgcaaaaactgtaaagggtaacagatggcttttactgggaatcttattaatcattgcatgtgcatctcagaatatcattccgattcacattgcatacatcccgattcttgttccaccattactgagtatgatgaacaagatgaaactggacagacgtggtgttgcatgtaccatagcatttggtcacaaagcaccgtatatcgctcttccattcggatttggtctgattttcatgacaatcatccgagacaacatcaaccagaatgcagtagactttggatggaaaataacaattggtgatgttacaaaagtaaactggattcttgcagttgctatgcttatcggtcttgcaattgccgtattcattacatacagaaaacctcgtgaatatcaggatatcaaattagagggacagcatgaattagaaagcctgaaattagaatacaaacattggattacacttttagcagcactcgtaatcgtaattcttcaggttaaatttggttctcttcctgtagcagcattcggtggacttttagttatgttcatattcggagctgtaaaaattaaagatattgatgaacagtttaacggcggtatcaaattaatgggctttatcgcattcgtaatgcttatagcaggtggatttgcgaaagtcttaaacaacacaggtgctgtagaagaactggttgacagtgcaatcagccttatgaatggaaatacatgggttgcagcaactatcatcacattaatcggtcttttagtaacaatgggaatcggtacttctttcggtacagttcctgtacttgcagtactttacgttccgctgtgtcataagatgggattctcaccagcagcaactatcatcctgatgtctgcagcagcagctcttggtgatgctggttcaccggcttctgatacaacactcggacctacatcaggtctgaatgcagatggtcagcatgaccacatctgggatacttgcgtacctacattcctgcactttaacattccgttaatgattgcagcaatcgtagcagcacagttcgtataa

SEQ ID NO: 1464 - DNA, 2040 bp, Unknown
  Description of Unknown: Firmicutes bacterium sequence
atgaatggcaatatcaagataaagggacagcttaagctgtatatgcagtggccggttatcatggtacttttactcctgcttatggatttgtgtattttccgcatcagtataaagggcggagtgattgcaacctgttttatagcggtgtatcttgcgatagcagtttttcagtatcataatagtcgggctgatatactcaatgagctgatttcttttgccacacagtatgggcaggtacagaaaagtctgttacgtgattttattgtaccttatgctttagtggatggcagaggaagaatcctgtggatgaatgaggcattttcacagttgagccagaaaccggtcaaataccacaggtcgattacaagcatttttcaggaaattacaattgaacgtctgccaaaggatgaatcttcagaggttctgtttcagtttgaaaacagagattacagagcttcgatgcgtaaaatttcaattgaggcaatgttagaagattcgggtttgattgaatcggatgcagataattttctgacggcaatttatatttttgatgagacagatgtaaatcgttataaaaaagaacgcgatgaagagaaactggtgacaggacttttatatctggacaattatgaagaggcgttaaacagtgtggaagaagtccggcgttcgctcttagttgcgttgatagagagaaaattaaataaatatttctccgagatggatggtctggtgaaaaagttagaaaaagataagtttattctgattttatgccagcgttcgttagaagagttaaaagaaaaacggtttagcattctggaagaggtaaaaagcattaatatcggtaatgatatggatgtcacaatcagtattggaattggaattaatggggcaaactatgtccagaattatgagtattcgagaattgcaattgatttggcgcttggacgaggtggagaccaggttgtcataaaagaccgtgatactatgatttactttggtggaaagtcacagcagatgggcaagacaacacgagttaaagcgagagtcaaagcacatgccttaaaagagtttatggtagcgaaagataaagttgtggttatggggcacaagatttctgatgtggattcaatcggtgcgggaattggaatttaccgtgcagcgaaatctttgaataaacgggctcatattgtagtcaataatccaaccatgtcggtgcgtccgattattgaaaactttattaataatccggaatacgatgagcacatgtttgtaaacagtgcagaggcaaaagaaatcgtagataacaatacggtagtcgtagtcgtagatacgaataaaccaagttatacggaatgtgaagacttattgtcaaagacaaaaacgatagtggtattagaccatcaccgtcagggtgcagaggttatttccaatgctgtactgtcttatattgagccgtttgcttcgtctgcctgcgagatggttgcagagattctgcaatatttttcagatggaattcgaatttataatatcgaagcggatgccctttatgcaggaattgtaattgatacggataacttcacttcaaaaacgggagtccgtacttttgaagcagctgcatttttacggcgctgtggcgcagatgtaacccgtgtaagaaaaatgttccgtgatgatgtcagctcttatcgggcaaaggcagagacagttcggacagtggaaacttacagggattcgtttgcaattggaatctgcccaagcagtggactggatagtccgactatcgtagcagcacaggctgcaaacgaactgttagatattgatagtataaaagcatcatttgtattgacggattataacaatttgatttatattagtgcaagggcaattgatgaggtaaatgttcagctgattatggaacggctgggaggtggcggtcatattaacgtggctggtgcacagttgaaagatgcaacggtaaatggagcaattattcaattgaaagatacaattgaccagatgattaaggaaggagcaatttaa

SEQ ID NO: 1465 - DNA, 2109 bp, Unknown
  Description of Unknown: Firmicutes bacterium sequence
atgccagagcgggaggttgatatggcaaagtatttagtgatagtggaatcgccggcaaaagtaaagacaataaaaaaatttttaggttccaattatgaagtcatggcatcaaacggacatgtaagagatttgccgaaaagccagttggggtttagtgtagaaaatgattatgaaccaaagtatataacaattcgcggaaagggtgacattttagcagcacttcgaaaatctgcgaaaaaagcagataaagtttatcttgcgactgaccctgaccgtgagggagaagcgatttcatggcatctttcaaaggcattgaagttagatgataaaaaaatgcgtcgtattacctttaatgaaattacaaaaacagcagtcaaagcttctattaaagaggctagagagattgatttaaaattagtggatgcacagcagaccagaagaatgttagaccgtatggttggatatagaatcagtccggttttatgggcgaaagtaaaacgtggattgagtgcaggacgtgtgcagtctgttgctcttcgtattattggagacagagaagaagaaatcaatgcatttataccggaggaatattggactttagaggcacagtttgcggtaaaaggtgagaaaaaaccgctgactgcaaaattttatggaaaaaaaggacagagaatcaatattcattccaaaggagaactcgatgaaattttaaaaaaccttgagggtgcaagctatgaggtggatgaagtaaaaaagggagagcgtaccaaaaaagcaccatttccatttactaccagtaccttacagcaggaagcctccaaagtgttaaacttctcgacacagaaaaccatgcgtcttgcacagcagttatatgaaggaattgatatcaagggaaatggaacagtcggtgtgattacttatctgcgtacggattcaacccgtatctcggatgaagcccagaaagcagcacaagagtatattacagaacagtatggagaagaatataccaaagtaactgagaaaaaagatagtaataagaagaaaattcaggatgcgcatgaagcaattcgtccaaccgatattacaagaaccccgatttctttaaaagagtctttaaccagagaccagttccgtctgtatcagttaatttggaaacgttttaccgcaagtcagatgcagcctgcaaaatatgaaaccacttccgttaaaattaaaggcggagagtattattttacaacatctgcatcgaaattaaaatttgatggtttcatggcagtttatgtgcaggaagatgatgaaaaatcagataagacggttttgacaaaagggctcgatgagacgagtgagctgacatttgagaaatttaacgaacagcagcattttactcagccaccggctcattatacagaggcgactcttgtaaaaacattagaagaacttggaattggacgtccaagtacctacgcaccaaccattactacgattattgcaagacggtatgttgcaaaggaaaataaaaacctttatatgacagaaattggtgaagtagtcaataatattatgaaaacttctttcccaagtattgtagatgtacattttacggcaacaatggaagaactgctcgacagtattgcagaaggattgattgagtggaaaacggtaattcgcaatttctatccggatttggatgaggcagtaaagacagcagaaaaggaacttgaagaagttaagatagaagatgaggtaactgacgtaatctgtgaacagtgcggaagaaatatggtaatcaaatacggaccgcatggaaaatttctggcttgccctggatttccggaatgtcgtaataccaaaccatatctggaaaaaatcggagtaccgtgtccaatctgtggaaaagaagtagtaatgcgcagaagtaaaaaaggacgccgttattatggctgtgaaaacaatccggaatgtgaatttatgtcctggcagaagccatccaaagaaaaatgtccaaattgcggtggatatatggtagaaaaaggaaacaaactggtctgtgcaaatgaacagtgtggatttgtgaaaatacagccgaaagacaaagtcgaagaggcttaa

SEQ ID NO: 1466 - DNA, 1710 bp, Unknown
  Description of Unknown: Firmicutes bacterium sequence
atgagtgaagaattcaagaatgaatttgatgaaaataaagaaacagagacagataatgtaaatatgcaggaagaaacagagactgtttttgaagataatgcatctgagacggaaaaaacaacaaatgaaagtgcagtgacacaagaaccgggaaatgcgccaacaccggaaaatccggtttatgcaagagcataccagccgcatgaacagcgggagtccacaaaagaagagtggtatcaggaagcacagcaggaacagaaacagcagcaaagttataatgcttatcagtttactgctccggaatcaaagaagccaaacagatccggaaagaagttaaacggacaaggcagaaaatttggcacagtcgttgcgacagcggttgtgtttggtctggttgcaagtgcagtttttcaggggacaaattatgtgggaagtaaattaaatccacagggaaaaaaatctgttcaggtacagtctacacagacaatcagtcaaaataaatcatctgattcagaagaaagtgtatcaggaagcactgagggaacttcaagcgtaagtcaggttgcccaaaatgcaatgccgtcaattgtatcgattgtaggagtcagcgttcaggagattccacagatttatcagtactttggatatggacaacagcaggaaactcagagcagtggttctggaattattgtaggacaaaatgataccgagcttttgattgcaacaaataatcatgtagttagcggaacaaattctcttaccgtgtgcttcacaaatcaggacggaagtgcagtaaccggaaatggtgacgtggaaaagaccagtgccgaaggtgaaagcggcagcacaaatcaggatggtcaggacagcagtttggatgatgttcaaagcggcgcggtatctgcacagattaaaggtacggatgcagataatgatcttgctgttatttcagtaaaattggaggatattccggaagatgtattaagtgagattaaagtggcaacaattggagattctgattcccttcagatgggtgaacaggttgttgcaattggaaatgcacttggatatggtcaatcagtgacaagtggttatgtcagtgcattaaaccgtcaggtaagttcagatgatacagatggaacttttattcagactgatgcagcaattaaccctggaaacagtggtggtgcacttttgaatatgaaaggtgaactgattggtattaactctgcaaagattgcttctgatgaagtggaagggatgggatttgcgattccgatttcaaaggcagaaccaatccttgatgagatgatgaatcaggaaacccgttacaaagtagaagatgaagataaagcagcatatattggaattacctgtgaaaatgtaaccagtgatgtcaaccagatgtatggaatccctcagggagtttatgtagatactgtagtagaaggtggaccggcagaagaagcaggaatcaaaaaaggtgatgtcattactaagattgatggtactgcgattgatgcatacaaagatttggtagacagactggaatactatgaagccggagaaaccgtagaattagaagtttaccgtgcacaggatggagaatataacgctcagaaaatcagtgtgactttaggagcaaagaaagatgcgccgagcacaaattcttcttctaatcagcagcaaaatgaaaaaaataataaatag

SEQ ID NO: 1467 - DNA, 984 bp, Unknown
  Description of Unknown: Firmicutes bacterium sequence
atggaattggaaagaacaccaatttatgagatttttgacagaaaacagtcgggaaatcagctctatatcatgagagaagatttactgccattttcacttggaggaaataaagtaagaattgcgaatgccttttttgaagatatgcagaaaaaaggttgtgatattatgattgcttatggaaatgtgcgctctaatttatgcagggtgattgcaaacgaatgtttcagaaaaaagattccctgttatatgatttgttcatttgaagagggcgaaagtgaggaaaaagagacaagcaacagccatttgatgcagatgcttaaggtaaaaattgtaaaatgtagaaaaaatcagattgcaaagacagtagaggcaacgatgaatcggttaatacaggaaggacacaaaccgtattatatctatggaaataaatttggaaccggaaatgagggagtttctgcttctgcttatgcaaaagcttatcaggagatcttgaattttgagaaaaaccaagggattttctttgattatatttttcatgcatcgggaacaggagcaacacaggcaggtctgacttgtggacatcttttggcgagagataaaaagcagattgtcgggattttgatttcctcaagagagtatgaacgtgcggtttcgattattgaaaccggaataagagaatacttaaaaggacttggaaaagagttttccatggaagaccaaaaagaaatccatctggcaagtgagtatacaaaaggtggatatggacagtatgatgaggaaattgagcagtgtatccgtgaggagtttgccttaaatggagtggcaatggatggaacttataccggaaaagcatttcttggaatggaacactatatcgaagaacatcagatttctggaaaaaagatattattcattcataccggaggaacacctcttttctatgactggcttggtacacaaaaaaaagatttaggaaggttataa

SEQ ID NO: 1468 - DNA, 1410 bp, Unknown
  Description of Unknown: Firmicutes bacterium sequence
atgattaaggtgtacctgtcgggggtgcacctttttttattagctaaacatcttcaaacaaaagcttatcaatcaaatgcgaaaggagaatcaaccgtaattatggaatacacaacacagatggatgccgcaagaaaaggcattatcacaaaagaaatggaaatcgcagcaaaaaaagaaaacatggatgtcaaagaattaatggaatatatggcaaaaggtcaggttatcattccttgtaacaaactccatacttcaatcgaaccaaacgctatcggttctatgctcaaaaccaagatcaatgtaaaccttggaatttccagagactggaaagacatggatatggaaattgaaaaagtaaacaatgcagtcaaaatgggggctgaatctatcatggatttaagttcttacggagatacccgcaccttccgtaaacgtcttaccaaagaatgtccggctatgatcggtactgttccgatttatgacgcagttgtttattatcacaaaccattaaaagaaatcacttccaaagaatggattgatattgtgcgtatgcatgcggaagatggagttgactttatgaccattcactgtggtatcaataaagccaccgcaggacgtttcaaagcaaaccgtcgtcttaccaacatcgtttcccgtggtggttctatcatttttgcatggatggaaatgaccggtgaagaaaacccattctatgaacattatgatgaaattcttgacatttgtcgtgaatacgacatcactatgagtcttggagatgcctgccgtccaggatgtttaaaagatgcttctgatatctcccagattgaagaacttattactttaggcgaactgactgcacgggcatgggaaaaagacgtacaggttatggtagaaggtcctggccatatgccaatgaaccagattgccgcaaatatggaaatccagaaaactatctgcaagggtgcacctttctatgtactcggacctttagtaacggatattgctccaggctatgaccatatcacagctgcaatcggtggtgcaatcgctgctgcatccggagcttccttcctctgctatgtaactcctgcagagcatctgcgtctgccaagccttgatgatgtaaaagaaggcatcatcgcttccaggattgcagcacatgccgcagatattgcaaaaggcgtaaaaggtgccatcgaatgggatcaccagatgagccttgcaagaaagaaattagattgggaggaaatgtttgatatctgtattgacccggaaaaagcaagacgctaccgcgccgaagccaaaccggaaaaagaagatacctgcagtatgtgtggaaacttctgtgctgtaaaaaatatgaaccgtatcttagatggggaaattgtaaatatttacgatgaatga

SEQ ID NO: 1469 - DNA, 1551 bp, Unknown
  Description of Unknown: Firmicutes bacterium sequence
atgaaacagaatgatattgttatcgtattagcggcatttgcagcttacctgatattaatggtagttgtcggtgcggtttatatgaagaaaacaaaaaactcggaagattatttccttggtggacgtggactgagcggatgggtggctgctttgtctgcacaggcatctgatatgagtggctggctcttgatgggattgccgggaaccgtttatgcacttggaaccggtcaggcatggattgctgtcggtttgtttttaggaacggtgtttaactgggtctgtatctcttctcgtctgagacggtatacaattgttgcaaataattcattgacacttccggcttattttgaaaaccggtttcgcgataaaaaacgtgtattacttttagtatcttcgattgtaattgtagtattctttctggtttatacggcatctgctttatcagccggaggaaaattatttcattccgtatttggaattgattatcacattgcacttgcaattggagcagttgttattcttgcttacacgtttatgggtggttttatggcagtttgtgtgaccgattttattcagggaagtctgatgctggttgggctgcttgccgtacctgtgcttgcgtattgttttattggaagtggaaatttaaatgccatgttagatgaaagccaggtcattggcggacatcaggcatatttaagcatgacaagaaatggagaaagttcttattcttttatcgaaattttctctcagcttgcatggggactgggatattgtggaatgccgcatattttgacccggtttatggctgtaaagaatcaaaaagaattgaaaaaatcaagagttattgctattatatgggtagcactgtctctctttgcagcagtggcaatcggtgtgcttggacgagcttatctgtatccggttattttaggaacggaaggtcaggcttccgcagaaagtgtatttattgagatgattacgaagatatttacacaggatttacgtctgccgtttatcggtggagtattcttatgtggaattttggcagcaatcatgtcaactgcggattctcagctcttagtcaccgcatcttcggtttcaaaagatatttataaggatattttaaaacctcaggcagatgaaaaaacagtattaaaagtaagtcgtgttaccgttatcgtggttgcagtgctggcatttgcaattgcatggaatccgaacaacagtattatgggactggtatcaaatgcatgggctggtcttggttctgcatttggtccgattgtactgatgtcattgttttggagaagaacaaattttgcaggcgcagttgccggaatcgtgtcaggaggattaaccgttattatctgggattatattccgttcattaatggacagactctgggtactgcaactggtttatactctcttgcaactggttttgtaatcagcattttgtgcattgtgattttcagtttgtgtacaaaagctccggagaaagaaatcttagaagagtttgacagagtcaaaaaaatgaaagaagagtaa

SEQ ID NO: 1470 - DNA, 1731 bp, Unknown
  Description of Unknown: Firmicutes bacterium sequence
atgaaaacagtattagttgcaattaatgcaaaatatattcattccaatctggcggtttatagcctgcgttcttatgcaagaacctttggttatgaaccgaagttattggaatttacaattaaccagcaaaaagaccagattttaaaaggaatctatgaggcaaagccggacttgctttgtttttcctgctatatctggaatctttcttatgcagaagagattatagaggacatcaaaaaaatcctgccaaaggttacgatttgggcgggcggaccggaagtgtcttatgacgcacccaaatttttaaaacgacatccggaagtagatggaattatgtgtgccgagggagagaaaacactgacagaattaataagctattatgaaatcggaaaaagtcagggaaaatccttagatggaatcaatggaatcgtgtatcaggaaaacaagacgatccatcagacaccgcttagagatatcatgaatatggatgatttagtttttccttatgaagatttaaaagatttcgagcataaaattatttattatgagagcagtcggggctgtccattttcctgcagttactgtctctcttcaattgacaaaaagttaagattccgcagtttttctctggtggaaaaagaactggaatttttccttgcgcacaaagtaccgcaggtaaaattcgtggaccgtacctttaactgtaagaaaagtcatgcgatggcaatctggacttatatcaaagagcatgataacggaattacgaattttcattttgaggtagcagcagatttattaaccgaggatgaaattgctctgattcagacgatgcggccaggattgattcagcttgaaatcggtgtgcagtccaccaatgaaaagacccttgcggaaatccatcgaaagactgattttgaagaaatcacaagaaaagtaaaagcggtacaaaaaggagagaatgtacatcagcatctggacttgattgcaggacttccttatgaaaattatgagagttttggacattcctttaatgatgtctatgcgttaaaaccggaacagcttcagcttggatttttaaaagtcttaaaaggttcttatatggcagaggcagcggaaggatatggctgcgtgcataaggcaaaaccaccttatgaagtgcttggaacacgctggctctcttatgaagagattttaaagctaaaaggcgttgaggaaatggtggaagtttactataacagcggtcagttccagaaaaccatccgtgctatggaatacttatttgaaacggccttttcgatgtatgaagaactggcagatttttatgagaaaaacggttataacgaggtttctcataccagaatccgtcgttatgaaattttacaggaatttttacaggaaaaagaagcaaatctggaatattttaaacagcttatgatttttgacttatatgcaagagaaaatatgaaaacaagaccgcagtgggcaaatgatttgtcagcttataagatgcagattctggatttttataaaaaagaagaggaaaatccggagctgttaaccgattatcagggctatcaggcaagacagacgataaagatgacgcacattgaagtatttacttatgatgtcataaatgaaaacgaagaaaaaggtgcttatccggtcttattcgattataaaaagagaagtccgctgacaaatgatgcaaaagcggtttttgttcaattgtaa

SEQ ID NO: 1471 - DNA, 1719 bp, Unknown
  Description of Unknown: Firmicutes bacterium sequence
atgaaagggacagaattgtttgtaaaggcattacaaaaagagggaattgattttctttttgcttatccaggaggatatgcgattgatatttttgatgaattatataagcaggattccattcaggtaattctgccacgtcatgagcaggggttggtacatgcagcggatggatatgcaagagcaactgggagaaccggagtctgtcttgtaacaagcggacctggagcaacaaatctggtaacaggaattgcaactgccaattatgatagtgttccgcttgtttgttttaccggtcaggtaccgacaagcttgattggaaatgatgcatttcaagaagttgatattgtagggattacaagaagtatctgtaaatatgcggtaacagtaagaaaaagagaagatcttggaagaattattaaagaggcattttatattgcaaataccggaaaaaaaggaccggttgtagtagaccttccaaaagatattatgttagaagagggcgatgacctttatccaaaagaagtaaaaatcagaagctataagccaagcaaaggtgttcatatcgggcagcttaaaaaagcaaattccctgctttcacaggcaaagaaaccattatttttaatgggtggcggagtcaatatttccggtgcaaatgaagaagcaaaaaaacttgcagagctgacacaggttccggttattacaaccattatgggaaaaggggcacttccaaccaatcatgaactgtatattggaaatgttggaatgcatggatgctatgccgcaaatcacgcaatcagtgaatgtgacctgttgttttcaattggaacacgctttaatgaccgtattaccggtaagattgatgagtttgcaaaaaatgcaaaaattgttcatatcgatattgatgcggcttcgatttccagaaacattcaggttgatatcccgattgtagccgatgcaaaagaagcaatgacagcacttttaaaacatgccaaaccatgtgctaccaaagactggcttgaagagattcgtggatgggaaaaagaacagccacttggtatgaggaaagataagggaatcacaccgcagaagattattgaatgtatgaatgaagaatttaaaaaagcggttgttgtaacagacgttggacagcatcagatgtgggtaacacaatatctggaaatggatgaaaacaaaaaacttttgacttccggtggtcttggaacgatgggatatggacttccggcagcaatcggtgcaaaattcggttatccggatacccctgttatctgtgtttccggtgatggcggagtacagatgaatattcaggagcttgctaccgcaacagcttacggacttccggttattctctgtatctttaataacagttatctgggaatggttcgccagtggcaacagttattttatggaaaacgttattcctctacctgtaccagaagaagaaaatcttgcagtgctacctgcaaaggacctggagaacagtgcccaaaatatcagccggattttgtaaaattagcagagagttatgaagcttatggaatgagaattgaaaaagaagaagatatcaaaaaagcatttgaatttgcaaaagaacatacagatgcaccgaccatacttgaatttatgattgacagcgatgagctggtacttcctatggtacaaggcggacaggcacttgactgtatgattttggactgctaa

SEQ ID NO: 1472 - DNA, 1386 bp, Unknown
  Description of Unknown: Firmicutes bacterium sequence
atggcaatcgaatatcttggcttaagtgaaatcaacggccctctggttgtgctcgaaggggtgcaggatgcagcctttgatgaaattgtagaatttaaagtagatgacggtacaaaaaaaatcgggcgtattgtagaaatttatgaggataaagctgtcattcaggtatttgaaggaacagaaaacatgtctctgttaaatacccatacaaaattgaccggacacccgatggaagtagaattatctccggacatccttgggcgaacttttaatggaatcggaaaaccaattgacgaccttggtccggtgattccggaaatgaaattaaatattaatggtctgccgttaaatccggtcaaacgagagtatccgagaaacttcattcagacaggtatctctgcgattgatggtttgacaaccctgattcgtggacagaaacttccgattttctcaggaaacggacttccacatgatcagcttgcagcacagattgtaaaacaggcttctcttggtggggacagtgatgagaaatttgcgattgtatttgcggcaatgggcgtaaaatatgatgtagcagaatttttccgcagaacttttgaggagagcggtgttgcggaccacgtagtcatgtatctgaatctggcaaatgaccctgtagtagagcgattgattacaccaaaggttgcacttactgcggcagagtatctggcatttgagaaaggcatgcacattttggttattcttactgatattacttcttttgcggaagcgatgcgagaggtttcttcttcaaaaggagagattccatcaagaaaaggttatccgggttatttatacagtgaactggcaaccctttatgaacgtgcaggaattgtaagaggtggaacaggttcggttacacagattccgattcttacaatgccaaatgatgatattacgcatccaatccctgacttaaccgggtatattacagaaggtcagattgtactcgagcgtcagcttcatgggcaggcaatttatccgccgattaatgtccttccatccctgtctcgtctgatgaaggatggtatcggtgaaggttatacgagagaagaccatcaggatgtagcaaaccagctgttttcctgttatgcaaaagtaggagatgccagagcacttgcatctgttattggtgaagatgaactttcaccgctcgataaaaaatatctggaatttggaaatgcatttgaacaacagtttgtcggtcagggaccggatgaaaacagaagtattcaggaaaccctggatctcggatggaaactgcttggaataattccaagagatgagctcgaccgtattgacacgaagatactggataaatactatcatccggaagagaatgcataa

SEQ ID NO: 1473 - DNA, 1722 bp, Unknown
  Description of Unknown: Firmicutes bacterium sequence
ttgattttcattttttgcttctttcttgttttttctatcatctttttgaaaaaaatcgaacccactctggaaaacaaacagtttgaacactttaccgattctatttttacttccgaactttcttctaatactttaaatctgcattatacgcttgcacatcccgagaaatttggaatcaaggattataaaatcagtcttggctcaatgaacgaaaaagctcattctaattcattttctagattaaaatccaatcaaaaacgcctgaaaaactttcactatcaaaaactttccaaagaaaaccagctgacttatgatattctctctctggaattttccacgcagctttccggtgaaaactttttctggcttcaagaacccttaagtcctcatctcggaatttcttcccagcttccgattctgcttgccgaatacaccttccgcacaggaaacgatatcaaagactatttttctctgctctcctgcctccccgactattataacgaactggcagaatttgaatctcaaaaagcgaaacgtggactctttatgagtgatgcttctttggagcgcctgcttacacagtgtcagaccatgctctcctcggattatcttgcttctgcttttaaagataagattaattcacttcaaaatgctgatacacttaccaaaaaacaggcagattcctatctaagcctccatgaaaaattaatccatacctgcgtgattccttcctatcaatcactttcagaaaagctttctgctctaaaaggcagtgaaaaaaatgacagagggcttgccggttttccagatggtactgcctattatcactatctgattcaaagtcaggtcggagattttcgcagtaccaacgaaatcgaagaacggctttttacccagcttgcccttgattaccgccagatgcagactctgctctcccaaaatccatcccttgcacaaaatttttctgttttttctctttctgccacaccagaagaaatgctttcctatctaaacaaagccatgcagacggattttcctgatttagacagtcccaagtacgaagtgaaatatgttcccacctcaatggaagaattttccagtcccgctttttatctgactccacctgcggataccttaagtccaaataccatttatatcaatcgaagttcacaggtaaatcctgccgaactctttaccacacttgcccatgaaggctttccgggacacctctatcagactttatattatggaaagcaaaatcctgcccctatccgtaatctgctcggatgcagtggctatattgaaggctgggcgacttatgtcgaatccatttcctacggctatgccgcctcctattttaaagtcgaaccagaacttttacagcttttatggcaaaaccgctccatcagtctctgcctgtattctctgctcgatattaaaatccatgaatacggctggaccttagctcaggttacacaatctttgcatggattcggcattgcttctgatgatacctgcaaggaaatttaccaatacatcattgaaaatcctgccaattatttaaaatactatctgggatatctgaattttatggatttaagagacttggccgagaaaaaagccggtgataaatttgataaaaaagagtttcatcgatttatattagaaaccggacctgctccatttccggttatagaaaagtatgtgctggagaattattaa

SEQ ID NO: 1474 - DNA, 1428 bp, Unknown
  Description of Unknown: Firmicutes bacterium sequence
atggtggaaaaccaaataaggagaattactgtgaagaatctttggaaatttgtaaaaacttcaggtatctattttataggtacagtattacataaattgattacgttcttcctgcttccgatttataccaaatatatcgacaaagcagatcttggaacgtatgaccttgcaactgcttacattaacttcttgtgttcgattctgtttctggatatctggagcggaatcatgcgttttgcctttgaatatgaaggagaagagcggaaaaagccgattaccagtggaattgcgattttcaccggttctacggtactttataccatcgtgttatttggagcaggatgtatctttgatatcaagtatcttccacttatctatctgtatggtattatgatgaacattcagactttagttggatatcttgcaagaacctatggaaaaaatgcgttatataccacatctggtctggtcagctcttttgtaactgtagtatgtaacattttatttattgtatatttccgcatggattacagtgcactgtttatctctgcctgtatcggatatctggtcaatatcgtagtgcttggatggggaatcaagttgccaaagctgatttctgtgtcagcctttgataaagatttattcaaaaggatgctgattttctcacttccgctttgcatgaattctgtggcatattggtttttaacttcctataaccgtgtcgcaatttcaaatgttttatcagtcagtgaaaatggtctgtattcgattgccggaagattttcttcgtttattacgttgtttacgacctgctttaatatggcatggcaggaaatgtcttattcaagagaagcacagaagcagacgaatcagggagaattttataccactgctttaaattcttatatcaagtttttatgtatggggcttttaatgctgattcctgcaatttcagttatcttcccgattatgattaatgaatcttatgcggacgcaaaacagttggtaccgtattatctgcttgcaaccattgtttcctgcatcagcagtttctttggaaatatctttactgcaattaagaaaaataatgtattgttttataccacagtggcaggaagtgtggtaaatgtagtcagcgtgcatctgctattaccgattgttggggtacagggagcaagtattgccctgtttttaggttttatggtaaataatacgattcgtgcttatctgctgaaaaaagaaattcaggtttcaatcgatttgaaattcattgttgcatgggcaattgtttacattggagtaagttatatttatctgcatgcaaatgccatcatcaatgtgttaactgtttttgtgggaggattgttgactttatttgtattccgtaaggaattaaaggagattttaggtacaataaaaaacagataa

SEQ ID NO: 1475 - DNA, 1893 bp, Unknown
  Description of Unknown: Firmicutes bacterium sequence
atgagtgaattcaaattaaccacagtagaagaattcgaagctgctactgagagactcctggagacaggggcaaaagttggcgcggatgcttggcagttccgtgtaaaaaatcagactccgcactgtaagtttggtgaagaaggtgtctgctgtcgtatctgttctatgggaccatgtcgtattacaaaaaaagcaccgagaggaatttgcggatgtgacgtacacggtatcgttggacgtaattatctgaaatttacagcaggtggttctgcaacacattccgaccatggtcgtgaaatctgtcataccttatatgaatcatcagctgatggatgttatcaggtaaaagatccggaaaaactgattcgcattgcaaaagaatggggtgtagagacagaaggaaaagatatctacgacttagcacatgaagttgcagaaatgggtctttgggaatatggtaaaccatttggaacacagagattcttaaagagagctccgcagtcacagcaggaattatgggaaaagaacgaacttgcaccaagagcaatcgaccgtgaggtttcatgttctttacatatggctcacatgggatgttcctctcttccggaagcattaatcaaacagtccatccgtgcaggtttatctgatggatggggcggttccatgatgggaacagagttctctgatgtcctgtttggaactccaaagccaattgatacagaagcaaaccttggtgttatggtagaagaaaacgtaaacatcgttgttcatggacatgacccgagtctttctgaaatggtttgtgaatatgcagattctccggaaatgattgcttacgcaaaagaaatgggagcaaagggaattacagtatccggtgtatgttgtacatcaaacgaagtagctatgcgtcgtggtattccgatggcaggtaacttcttacagcaggaaaacgttgtacttacaggtgcttgtgaagcaatcgtagtagacgtacagtgtattttcccggcactcggacctttaagcaaatgtttccacacaaaattcatcacaacatctccgattgcacagatgccggattctgaatttatccgctttgatgcaaaaacagctggtgaaaaagcaaaattaatcgttaaaacagcaattgaaaacttcaaaaacagaaaaccggaactggtacatattccacagttaaaacagaaagcaactgtaggatactctgtagaagccatcatcaaatgcttagacggtgttgcaaacagccaggttgatgaaatgggaacagtaaaacctctgttacagtgtgtaacatcaggtgttcttcgtggagcagttgcaatggttggatgtaataacccgaaaatccgtcctgaccttgcacatatcgaactgatgaaaaaattaatcgcaaatgatatcgtaattattgcatccggatgttcagcacaggcagctgcaaaagccggtcttatggacaaacgtgcaaaagatatctgtggtgatggattaaaacgtgtttgtgaactggcagatatccctccagtccttcacatgggttcctgtgtagatatcagccgtatgatgattcttgcttctgaactggctaaatgtgccggtacacatgtttcacagcttccagttgttggatgtgctccggaatggatgtctgaaaaagcagtttccatcggtaactatgtaattggtacaggtatcgatactttccttggtgttgacccttatgtttctggttccagcgaaattgctgaaatcttaacaaatggcacaagagagtgggtagaagcagcatttactgtggaaaaagatattgataaacttggagacgccatgatcgcacgtatcgaagaaaaacgtgcagcgctcggaatttaa

SEQ ID NO: 1476 - DNA, 291 bp, Ruminococcus sp.
atggcaaagatcaacgaaacctatgaagcaatggtagttttcagcctgaagcagggtgaggacggcattaaggctcttactgagaagttcaagggtatgatggcagaggcaggtactgttgagtctgttgacgagtggggcaagagaaagcttgcttacgagatcgacgatcagaccgagggctactacgttctctacacatttacatctgctcccgatttccccgcagagcttgaccgtgtactcaagatcaccgagggcgttatgcgttcactgattactgttaagtaa

SEQ ID NO: 1477 - DNA, 513 bp, Ruminococcus sp.
atgcggcacggcaaagaaaggatggtattattcatggattctcttatcaagcttttaaagggaaatgctcgtctttctaacgaacagctggcggtcatgctcggtgttacccccgaggaggtcgcggcacgtattgccgattatgaaaaaagaggcgttataaagggctacagcgttattttgaatgaagaactggcggataaaaacgccgttactgcttttatagaagttaaggtaacacccaaggcggactttggttttgatgagctcgcccgcaccattatgatgtacgacgaggtggattccgtaacacttatgtcaggctcctttgacctggcagttaccctcagcggtacaaattacaaggagatcgcactgtttgtggctaagcgtctgtccagcattgacggcgttatatccacatcaacacattttgtgctcaaacaatataaggaacaaggcttctttatcgaaaatgaagccgcagatgaaaggggattcgtttctccgtga

SEQ ID NO: 1478 - DNA, 624 bp, Ruminococcus sp.
atgattatgattatgaagtatgacatttattcactgggtataatggtagctgtcatctcattcctcggattttcactggaaaatctgtggctatcactgacaaaggggttcattgacaaccgcaatatgaatgcgccgttccttatgggatacggtctgctggtcgttggaatgtacctgctgctgggcacgcctgaaaatatggcactcgcagagatggttcccgttgacagatcaaagggcgaaaaattctttgtatatttcctctgcgctttcgcagttgtcaccgtgggagaacttattctgggtcatctgatggaaaagatatgcggcattcagtactggaactacaactggatccccttgcatatcacacaatacacatcaatacccacaagcatcggctttgcagccatcatcacttcctttatgggcgcctgcttcgaccccataatgagcgttatcacaatgatacccgcacaggaagcaagatccgccagcattatccttatgctgataatgtccaccgaccttattgcaagcttctcaaagatgcacagaacaagaagtctcaacacaaagtggcagatacagacccgccgcagtcacctcaaaacaacatga

SEQ ID NO: 1479 - DNA, 474 bp, Ruminococcus sp.
atgaaaaagaacatcacagttccgggatttatgacccttatcaccgtttttctgatagtgagccttgtatctctgggagggcttgcctgcgccgcagcggcaggaggttcagctctggctgacaggagtgcagaatatctgaccagataccgcagtgcatacaatctttctgaaaagcggctggcagaggttgacggctgcattgctcaggcggcggaaagcggactttttgatatgaattttgaggcaatggtctcagagcttgactatgcggaatatcatatagaaaaggacttttatactgtttcctgcacaacgcccgttgacggcagcactgctgtttactgggagataaaggtgccgcttgacgcatcggcagagggggagcggtacacggtcacggcaaggcgcactgttgcgctggagcctgaagatagcagcgaagaagagcacattaacgtatggctcggatag

SEQ ID NO: 1480 - DNA, 894 bp, Ruminococcus sp.
ttggttcagactcggaaggatggaattgatttgtcctcatactatgaccgcaaaaagaaggaaaacggcatcaaattccgtatttcttttgtaatattatttgccgcagcaagcttcgctgcgtgctttgctctttatatgaaaagcagctcgcctgccgatgataagccccaagctgacggcagcgcatctcaggtgacggcttttaccgtttcacagaccgtttcggaaacagaaacagaaacagaaacggaggcggtgagcgaaagaacatctactgccgacattaaccccattgccgaaagtgcagaggtagatgaaagctactttgatgactgtatgtttgtgggtgactcccttatggtgggacttggcacatacggctttatctccgaggaacagatcgctgcaggcatcggaatgagcgttgtcagtataggcactacacctcttacaaatgcagacggaagcgagatccttgcagccgataaggtcaatgccgcttctccccggcatgtttatatcctgctgggacttaatatgctgggaacctataccgatgagcagcttttgtcatattacggcgattttattgacagcatcaacagggaaaatacggatatctatgtcatttccgttccgcccgtaacaggggagagggaaactgacgaggataatcctatccttaattcggatatcgacagcttcaatgccgatctgcttaaatttgcaaacaaccgctgtgtttactatgttgaccttaacacggcactcaaaggtcccgacggaagatttcccgaggaggacgccgaggcggacggtgtgcatttcaagaagcctacctacaggactatgcttgaatatcttcgtacacacgtttacagcggagaataa

SEQ ID NO: 1481 - DNA, 954 bp, Ruminococcus sp.
ttgacagatttttttatatgggatataattatagtatctattttatcagaaggaagaacggctatgatgatgctttccgaaaaaacagcatacaaagctgtggcttttgccgcacgccataagtgggcaaagccattctgcttcggagtgtattctgccgtttacgcagcagagaagctgaaagcagatgaaaagccgttttcaaggcgggtcatcgcatttgccacagcctctgcatttgtttttatgaccgttccaacgtcatatgccgccgcacttgttcagtcggagacttccgttgtcacggagcagatgaacaccatggagcctgttgccatgtcccccgaggatatcgccgcaagagttacactggagggtctggcggaaaatgaggcttcttacggacttacgctgaatatccgctcgctcagaacagatgttaacgcaagatttacaagctccgaccaaatggaaagcgatataaaagctgcctttgaaagctacggcataaattccgacgagctgtgcatatcccccgtaaaaatacagctttacaggaacgatacaagggaaaagctgcagatatcagaggggtattccgctgatgttactttgccagtgcccgaggaaatgctcagccgcattgacgagctgagaggcgtccgccttgaggataacggcacactcaccgtcatcgagggcgagacagatgaaaatacattttcattccgtacaaataagctgggcagctttgcactggtcacatataaggacacggcggaggatatcggcagcggtgcgggagtatccgacacgggtatcgttacggatatatccatatccgttccccagcctataacagacgaggataagcgccgcttccgcaggaacaggggaaagaagtgcatttacagaataaagcgtatagtcaaggaaaacgagcgcttgatataa

SEQ ID NO: 1482 - DNA, 600 bp, Ruminococcus sp.
atgtccatgttattgtacacatcggaaaggattggagataatatgcgggtaataaccggtctggcaagaggaagaaagctcgttacccttgagggggaggacgttcgccctaccaccgatatggtgaaggaagctattttttccgtaattcagtttgatatagaaggctcagtggtgctggatcttttcagcggctcgggtcagcttggaatagaagccctttcaagaggagcaaaatactgccgatttgttgacaaaagtcaggcatcggcggagataacacgtcagaatgtaactgcctgcggctttgtccgtgacagcgcagtttccgttatggacagcatcgactttgtacgtggcgtgagaatgacctttgatattgcatttctcgaccctccgtacaggcacggtcttatcgggcaggcgctccctcttctggaaagcaaaatgtccgacaggggcattgttgtctgcgagcatgaaaagggtctggtgcttcccgacaatgtgggtaagcttgaaaagaaaaagacctacagatacggcaagatagaggtaactgtttaccgtgttcccctgcctgtcgatgatgaagaatga

SEQ ID NO: 1483 - DNA, 585 bp, Ruminococcus sp.
atgaaactgatattagcttcaaacaacaaaaacaagctgagagaattccgtgagatcctggagcctatgggctttgatgtaatatcccagtcggaagccggcgcaaacatcgaggtagaggaaacaggaactacctttgaggaaaacgcttatctcaaagcaaaggcaatttacgatatgttccacctacctgtcatttccgatgacagcggacttgaagttgatgccctgaacggcgctcccggaatatactccgccagatatgcggaggagggcaagcgctgcgcaagagttctctccgagcttgaaaacgtcccggatgacaaacgcacagcacgattcagatgctgcatctgctacattgacgaaaacggcaataagaatatagtttcaggcgcctgcgagggcaagataggctacgaaaagcgtggaaccaacggcttcggttatgaccctatcttcatgttcggcgacagatcctttgcggagctttccgccgatgaaaaaaatcaggtgagccacagaagcgacgctctcaggaaattcagagagcttattgaaaaaaattaccctgcaaagcagtaa

SEQ ID NO: 1484 - DNA, 912 bp, Ruminococcus sp.
atggatcaggtacgtgttaagaacggcaggctcagcagatcttacatcgaaaaaatggtgacagtttgcctttttctgctgatacctactgttcttttgattgttttcacatacattcccgccgcagaaatgataaagttcagctttgaacagcgtgatgaattcggcgtaaatgttcagaacgtgggacttaagaactataaaacggttttcagtacccctgaatatttcgacgcattcaagaacagcatctactatcttgtaggttcgtttatccagctgagtctggcgctgttccttgcaactatcctctgctcgaagatacgtttctccaacttcttcaagggagtgcttttcttcccctacatgataaacaccgttgcggtcgctcttattttccgcagatttttccagaagggcgacggcgtaacaaacaccgacggaacactcaactcaataatctccctcttcggcggagaccccgtaaaatttctctccactgagggacttgtaaacatctgcctggtattcgtatccatctggcgatacatcggatttgaccttgtaatgttcataggcgctatccagtccgtatctcccgacatatatgaagcggcagagcttgacggtgcaaaccgtttccaggtattcaggtacatcattgcgcccagcatcagacccattatcctgctgcaaatgatactggctgtaaagggtgccatcagcgtgtacgaaatacctttcatcatcacaggcggacgttttggttcaagcaccttcgttatccagacaacagagacggcattcaagttccacaaggtcggacttgcctcggcgatggctgtagtgttgttcctgataatcgtggtggtaacaataatccagaagcttgttttcaaggaggataagtaa

SEQ ID NO: 1485 - DNA, 834 bp, Ruminococcus sp.
caaacttatagaggaaaatcagaacaaaggggaagttatatgaatattctggtcacacttaaccgaggttatctttaccagctctgcgtaatgctttcatcgctcataaagtcaaatcccgacacggaatttgatgtttacgttatgaacgcttctcttaccgaggcggattttgaggctgtccgtcagcgtatccctgccgataaatgcaggctcattgacataaagacaggggagaacgaatttgcggacgcccccattaccgacagatatccccgtgagatgtattttcggatatttgccgcaaagtacctccccgaaagccttgacaggatattgtatcttgaccccgatatcgtggtgctgggttccgtaaaggagctttacgagacccagctggacggctattattatgctgcggcttcccacgtaaatgaagtcatgcgaatgataaacaaaatacgccttggcatggacgatgaaggcccttacataaattcgggcgtaatgcttatgaatttagatcttctccgcagcagccagagcgaggaagaggtatataactacatcagtgagaacgaaaagctgcttatcctgcccgatcaggacgttctcagcgggctttattccgacaggatatatccacttgagccactcagatacaatatgaccgagcggctcatggtgtatcatatgatgacccccgaaaatgtgcggaacatttctgccatagtccattacatcggcaggaacaagccgtggaaggactcgtacatcggcaagcttggcgtgttctatgaggaagcgtccaaggatattccgcctattgaataa

SEQ ID NO: 1486 - DNA, 639 bp, Ruminococcus sp.
atggatagcgaaagacttaaaaagcagctggattttcttatcgaagccgataagatgaaaagcctttacaggcagacatatatcataggcaacgagagccgaggtgcttcaatgcgtgagtttgagggcgaggagcagaagtacaaacgccgtgagaacgatgcggagcattcatttcatcttgccctgttcgtgataatgcttgccgagtacgcaaacgagcctatagacgtgcttaaagctgtgaaaaccgttcttatccacgacattgtggagatagacgcaggcgacacatatttctttgacgacaagggctatgagaccaagcgtgaccgtgaaacaagagccgccgaccgtctgttcggtctgcttccaaatgagcagcgtgacgaataccgcaccctgtgggaagaatttgaagcgggcagcacaccggaagcacgctttgcctcctccgttgaccgtatgcagcccatgctgctgaactatctcaaggacggcataagctggcgtgagcataacgtaagctatgagcaggtcaaggagcgtggaaagtgcataaagggcggctccgaaaagctttgggagcatatggacgctctttttgatgatgtacataacaagggtctgctgaaataa

SEQ ID NO: 1487 - DNA, 795 bp, Ruminococcus sp.
atgaataagtctgacaaaaaggacttttttcaaaagatgctgagcatattgttctggcttgctttgtggcaggcgggggcaatggcactcaacaaaagcattatactggtaactcccgttgcggcggtgaaaaggctttttgagcttatcccgcaggcggatttccggcggacggttctaaactcattcctcaggataggcggcggatttatgctggcgcttatcatgggaacggtgcttgcggcgctttccgcaggatacaagctcatgcgcaccctgatatcgccccttatgacggcggttaaggcggtgcctgtggcgtcgttcatcatatttgcactgttttttatgaaaagcagagagctttcggttctgatatctttcctcatggtgcttcccgtgatatacgaggcggtgctggagggagcggaaagcacagacagggagcttaaagaagcggcggaagtattcaggctggacggtgcaaaaaagctccgatacctgtattttcccgctgttatgccattcctaactgcggcatgcagaacgggagcggcgctggcgttcaaaagcggcactgcggcagaggtgataggtcagcccgatcttaccatgggcgatatgctttatcgggcaaaaatttatcttgaaactgccgacctttttgcttggacgctggtaataatcatattggcaaagctctttgagcttttgatattaaaggctctgggttttatatacaaaagatcacagaaagtgaaaataaaagggggtgtttgctccgatgacaagtaa

SEQ ID NO: 1488 - DNA, 720 bp, Ruminococcus sp.
atgagcatgaagctttcatacagagataaggtaatcattatcgtgctcgcagtgctggttgtactgggcgtaggtattttcacctttatcaagcctaagtttgcagatctccaggcatctgaggacagacttactgccaaggaagctgaaagagacgatgttcagtccaagatggatactcttgaagtgctcaagaagcgccttgaagatgatatcaagtccgttgaggaaactcagaagcagttcatgagcgaaagagattacggcgagacttatcagataagcaagtatctgatggataagctccaccccgcaggaatcgagatcacaggaatttctcttgacagacttacatcaacacagctcgaagcatatacatataataagtatgcagttgcatatcctatgaagataaacgctgatatcgcaggcaagcttcctcccgaggttggctatgcttacgagggcggttatcctgcagctcccgcaagtgttgcagttggcggaactgttgtaacagtaagctacacctgcacaaacaatgacggcgtgttcgatgctatccagtccgtagctgataacgaggagaacatttatctccagagcgtttccgcaagctacaaggacgagggtaagaccgaagacggcaagatcgagggcgatatggtcatcgagatctatgaggtttacactatggatcccgctgatattgaggactaa

SEQ ID NO: 1489 - DNA, 426 bp, Ruminococcus sp.
atgtatggcttaacaaattacagaaacaatgaaaacagtatcttcgaccccttcaaggatttcttcggcggacttttttccgatgatatgtccgaaaacagctgccgcaccgatataagggacgagggtgacagatatattattgagtctgagcttcccggattcaataaagaggatatctccgttgatatctccgacggctatatgaccgtcagcgccgagcacagcaccgagaacgaggataaggacgacaagggcaattatatccgccgtgaacgctcctacggttcattcagccgttcctttgacatctcggacgtggacgctgaccatatctccgccgaatataagaacggcgttctcgaaatgatcctccctaagactcagacaactaagcctgagacacggcgtcttacagttggataa

SEQ ID NO: 1490 - DNA, 798 bp, Ruminococcus sp.
atgcacaaggtattatgctccacgggagcgcttataacaagaaaaaacggcagagatcacaggcttctggcaggctttgcggagcagctccactgcgacggatttgagtttatgctctatgattcgtggtatgataagcttgatagtattgccgatgatgtaaaggcgatggggcttgatatccccgccgtccactgcgaaaaaagcataggcgagcttatcgctgccgaagatgatctggcatatgagcggtttgagatgaactgcaaggctgccgaaagggtgggcgcaaagctgctggtgcttcatctgtggaacgggcttgtgtccgacagcaatttcggtgcaaaccttagagcttacggcaggcttgcggatatggctgcggagcatggactgacgcttaccgttgaaaatgttgtctgcaatcaatccactcctgcggctcatcttaaagagttggcggaggaatatccccatataccgtttacctttgatacgaaaatggctgagtttcacggcgagcttgacaaggtgtatgatgaaaagctctggactgacaatatccgtcacctgcacatcaacgactatggtgggggagtaaaggactggtcagacctgcgtacgctgcatttcggcgggggtcatgtagattttgaaagatttttcgcatttgagaggaaaatgggctacagcggcgactttaccgttgaagcaagctctgtcagagatgacggttccgttgatataaacaagcttaacagggattttttgattatcaagggtcatattgcctaa

SEQ ID NO: 1491 - DNA, 528 bp, Ruminococcus sp.
atgagcttggactttaccgcctctgtaagacgtgcacaggcgggagatgccggagcgtttgccgaactttattcccttgtttacaaggatctgtaccggatcgctctgctgaacctgaacaatcaacacgatgcttccgatgtggttagcgacacggtgctggaagcttacacctccatatcaaagctgagggacgaaaaagcattcaaagcctggataataaagatccttacggtaaagataaaaaacaagcgcaaggaatataaagagataaacaatttccgggaagatgtggacgatctcagcgatgccgaagaggctgctgtaagtaaagaaatagatttcggcagcatagaggtaatggaaggctttaagcagctcagcgaagaggaacgtatggtgctgtcactcagtgttgtttcaggctataaaagcgaagagattgccagaatgttcggaacaaatgcaaacaccgttcgttcaaaggtagcaagggcgaaagccagactgaaacagctgctgacttag

SEQ ID NO: 1492 - DNA, 738 bp, Ruminococcus sp.
atgctggagcttcaaaatatccactggcagcttcccgacggcggcgaaatattaaaaggcattagcctttctatccccgacggtcagctgactgttgtaacaggtcccaacggaggcggaaagacatcgctggcaaaggtcatcgcaggtctgtacgctccctctgagggcaaaatacttctcaacggtgaggacatcaccgaactcagcatcaccgaccgtgccaaaaagggcatcgcatacgcatttcagcagcctgtccgcttcaagggtcttacggttcttgacctgctggagctttccgccgaggaaaagcttccaagggacaaggtatgttccctgctgggcgaggtaggtctttgctcaaaggaatatatcaacagagaggctgactccagcctttcgggcggcgagagcaagcgcatagagatagccaccgttcttgcaagaaagaacgcttccatgctggtttttgatgagcctgaggcaggcatcgacctgtggagcttctccaatcttatcgaggctttcgagcgccttaaagcagagggcagccgctcgctgctggtcatctcccaccaagaaaggatcatggaaattgcggacaacatcgttgtcattgcaggcggaaaggttcgcacctgcggcaaaaaggacgatgtcctgcccactctgcttgcagatgaaaagacagaacgctgtcccatggacaaggctaaaagggaggtcagggcatga

SEQ ID NO: 1493 - DNA, 903 bp, Ruminococcus sp.
atgtatgatgtgataattatcggtgcgggtcctgcgggacttacggctgccgcttacagcgcaaggtcgatgctcaaaacgcttgttatcgagagataccccttgacgggcgggcagatgcttctcaccgatgttatcgcaaattttcccgcatatgtcccctccgatggctcagagatagcaaaaaatctcaaagctcaggcggaagaagcgggtgccgagtttataactgcggaggtcacacgcatagctgacggcaggccaaaaactgtacttgcaggcggaaaggaataccaggcaaagaccctgataatcgcctgcggagctgagcataaaaagcttggagtacagggcgaagataaattcgcaggcaggggagtttcctactgtgctgtgtgtgacggcggatttttcagagaaaaggatattgcagttatcggcggaggggatacggctctcaaggacgcattgtatctttctgccatatgccgaaaggtgtatcttatccaccgcagggacagtttcagaggcagtgcggacaagctcagcaaatgcgaacagacggacaatattgaaattatccgcagtgctgtatgccgtgagatatgcggtgaaagcagtgttacgggcattatcatcgagcagaacggtgagcgccgcaggacagagtgcagcggagtttttgcggctgtgggcatggcgccctcgaccaaacttataaatgatatcgtgaagcttgacgaaaagggctgcattgaagcgggggaggactgtgttacctcggcagagggcatttttgcggcaggagatatccgcacaaagcccctcaggcagatagttactgcctgctccgacggagcaaatgcggcaagctcggcaaaaaactatatattatccgaataa

SEQ ID NO: 1494 - DNA, 1332 bp, Ruminococcus sp.
atgactgtcagaagctttctggaaatggtctcccagttttttataatctttccctcagcgatattgtgctccctgccaatggtgaaaaagctgcggttcccgctgaaaaagatacttttgtgggagtttggcatacttctggtgctgtcgcccgtaatggcatttctgtgcctcaggttcgggctgtccataaatacgttgctcattcctgcgctcatactgttttatatcatgttcaggggaacggtcacaacgggaaaaatgcagacgctggcggtgttcgtgggagtgtgcaaccttatgtcgttcccgtcggtgtattctgttatgtatgacgcttacctacaccccgacggactgctggaaaattacagcatggaggcaaatatcttttcgcttgtacttacgctgatattgtccgcagtgataggctatcccctctgcgtaaaaggctcggagcttatagagcaccagaccagcgaaaaggtttggggactgactatccccgtgtcactggtcatgttgatgataaactacagcatagagcctgtctattacaggaatatgtatgtgggcagaatgttcttcctggcaattatgataataaccgcaatgcttctgctgctaatgttccttatggtcatattctactatgcggcaatgagcatctatcagaacgagcagaccaaggcaaaggcaagaatgctggaaatgcaggaaagcagatatctaagacttcaggactatatcgagaaaacaaggaagctccgccacgatttcagacagtcgatacacgttatgaatacccttgctgcggaggaggactatgataccctcaaaaaatatcttgccgagtatgaagcacagatgccggtggggcttaccgactattgcaggataaattcagtaaatgcactgctcaactactacggtcagtgggcggagcagaacgggataaagctcagctggaagatacagctgcccgacgatgcgggaatatcccagcccgacctgtgcagcgtgctgggaaatgtggtggaaaacgcacttgacggctgcatgacagcacagacaggggagagatatcatcagctttcggtggtctgcgaggagccgtatatatacatagtttccaccaatagctttgacggcaatgttaaggaaaagaacggaagctttatgtcaacaaagcataagggaatgggaacgggaataccgtcaataaaagcggcggtggagaaatataacggcacagccgagttcagatataaaggtaaggagttttatggggatattatgatgaaaatgggggagacacaacaaagccaataa

SEQ ID NO: 1495 - DNA, 636 bp, Ruminococcus sp.
atgacaaaggcaatcatcggtaagaaaatcggcatgactcagattttcgatgaagcaggaaaggttattcctgttaccgttgttgaagcaggtccctgcgtagtagttcagaagaaaaccgttgaaaacgacggctacagcgcagtacagtgcggcttcggcgacatcagagagaagctcgtcaacaagcctatgaagggtcacttcgcaaaggctgacgttgctctcaagagaacacttaaggagttcagactcgacaatgcagagtcccttaatgtgggcgacgtactcaaggctgattctttcgaggtaggcgacatcgttgatgtttgcggtacttcaaagggtaagggcttccagggtactatcaagagaaataacaatgcaagacttaaggaaactcacggtaccggtcctgttcacagacacgcaggttccatgggtgcgtgctcttccccttcaagaatcttcaagggcaaggctctccccggacacatgggtgctgaaaaggtaaccgttcagaaccttgagatcgttaagatcgatgctgaaaacaaccttatcgcagttaagggcgcaattcccggtcctaagaacggtattgtaacaatcgttgactgcgttaagaaagcttaa

SEQ ID NO: 1496 - DNA, 507 bp, Ruminococcus sp.
acctccgtgttaatattcactgacattatagcatatcgggcagatgaacgtcaatcggtaattgaaatttctgcgcatatggtgtataattatatacatcaaatgtttggaggtaagcagatgaaaaatcttgtgaacggaatacatcatgtatcgctcaaatgcagaaaagagcaggaatatgacaaggcagtggatttttacggcaatgtgctgggacttgaaacaacccgagtgtgggaagacggcataatgtttgacacgggaaacggagtaatagagattttcacaaacagggaagacgatgcagatacaggtgtgatacgtcactttgctttctccgtaaatgatactgacaggtgcgcagctgctgtaagagaggctgggtatgaggtatttattgagccaaaggacattgtaataccatctgaaaagcctcttagtgcaaggatagccttttgctttggccctcttggcgagcagatagagttctttcaggtgaaataa

SEQ ID NO: 1497 - DNA, 1038 bp, Ruminococcus sp.
atgtccatgagcgatgaagtaagatttgaaagaaagcctgcgaaaaaaggccccaagaaaacctttgcgcaatccttttttccgcagaagggcgactcttcatcagagatcatcaataagataatcgtacttatctccattgttgtcctgatagtctgcgccgttcttctgggcgattacttttaccagatgtatgaggcaaagcagaaccacaatactctgaaagtcatctatcagcaggcgcagctccagcagtcacagtcctctcaggacaagactgatgatgttcctgccgagaccgatgaaaacactcctcccgaggagcttcctccccttgaagagctggctgcggcaaaagagctgctggcgatcaaccccgacactgtaggatatgtacgtatccccgactgcgttgatgagcctgttgtcaaaggcacggacaatgagtattacctcaagcacaacttctacaacaatcagcgccagtgtggaacctgctttgcggattaccgcaacaaggtgggcggatatgagcgctcggacaacattatcctttacgctcacaaccagaaggacggcactatgttcggaaatctggactactaccgctgggatcccgcttactggctgaaaaatccttttgtttattttaacaccaattactcggaagacgtttatgttataatcgcttcctttgtaataaacactctccctgagcatgacaatggaaatcccgttttcgattatcagaattatatcgatttcaacgacgattatccctatgacaagttcatggacgagataacaaagcgcagcactatcattaccggtattgactgcactgaggacgatgagtacctcactctttccacctgctccaccgagtgggacgaatcccgccatgttatcgtggcaagaaagcttcgagctgatgaatccacagacactatcgacaccacaaaattcagcaagaaccccaatccgaaatggcccgccatctactataaatataacggcggaacatatatagacgagtaa

SEQ ID NO: 1498 - DNA, 579 bp, Ruminococcus sp.
atgataactgccaaggacattaacaccagaagatttgaacaggccaagccgggctacaagcctgaggaggtcgatgaattcttaaaggagatcgccgaccagatcaacgcaatgctcaaggacaaggaggacaccgagaagaagatcgaggtactggtcgagagcattcgcagatacaaggctgacgaggaagccctcaaggacgctatgataggcgctcagaagcagggcagagccgttatcgaggaagccaagggcaaggccgagaccattgttgccgaggcacagcagaaggctgagcagatcatctccgccgcaaatgtcaaggctgatgagatcgtgggcaccacagctatccgtgctcagagagaaaaggctgagcttgaaaagatgcagaacgctgttatcgacttcaagtcccgtctgctcacaatgtacaaatctcacctggagcttatcacagcacttcccgaaaacgatgagcctgtcgaggaagaggctcccgcacctgcgccccagcctgccgaggcagaggacatggaagctacaagagttatcgacacctcttccgttcaataa

SEQ ID NO: 1499 - DNA, 882 bp, Ruminococcus sp.
atggctaagatcgttagaaccatctcggacgacgcttccgttgtagcgaccgctatcgacgctaccgacatcgtttccgagatagaacagatacacaagacatcggcagtggtaacagcagccctcggccgccttaccatagccgcttcccttatgggaataggtctcaagggcgaaaaggatacccttaccctgagaatgaacggcaacggccccacaggcgcacttatcgccgtggctgacagccgtggaaacgtaaaatcctacgtctgcaaccctgttgttgagatacctctcaacaagtacggcaagctggacgttgcgggagctgtgggaaaagaaggcactctttccgttgtaaaggaccttggcctcaaggagccttactgcggtcagatacccattgcgtcgggcgagatcgccgaggatatagcaagctactttgccacctccgagcagatacccaccgtatgcggtctgggcgtactggtaaatcccgaccttacggtaaaggcagcaggcggatatcttatccagctgctcccctttgcagatgaaggcgttatcgacacacttgaaaagaacgtgaacgctctcccctcggtaacacagatgctctcatcgggcgtgactgccgaggatatggcaatgaaggtgctggagggtctgcagcccaacgttatggacaggctggaggcaagctacaagtgcgactgctccagagagcgtgtggaaaccgctcttatctccataggcaaaaaggagctttcagacatggcagacgagcaggagacctccgaggtatgctgccacttctgcggcaagaaatacacctttacttccgacgagatccgcagccttgcagaaaaagcaaaggcatga

SEQ ID NO: 1500 - DNA, 1062 bp, Ruminococcus sp.
ttgaaaacagaaggcagatcaagcggcagaagaaatcttaatgctacggtggcgaagatgcacgccgtttacggaaaaaggctcaagcccgaggattattcggcgctgctgagctgcacctccgtatcggacgctgcggattatctgaagcgcaacacctatttcagcaggtggctggacggcgttgacacagagaatatccacagaggaaacctggaaaatatcctgcgccgaagccttatggagaattatttccgaatagtcggctttgaaaaactgggcggtgatgagttttataactacatcatcatcaagacggagatagatgagatacttatatgtatccttcaccttaacgcaggcacgggcgaccacatcaccacgctgcccatttacatgaacaaatacacgtccttcaacctgatggacctggctcatgtaaagagctatgatgagcttcttgaccttacggcaaagaccccttatcacgatatcctgaaaaagtacaagcctgaggtagcggacggtcacatcgactatgctgcctgcgagctgagcctgaggacatattattcgggacgactggtggcatcgctgcacaagttcggcggtgagacggaaaaacgcctgaagagctatctgggaactcagatagacaccatcaacatcgcaaatgcctacagaatgatacacttcttcaatgcggatcagcaaacggtaaagtccagaatgatccccgtgtatctgaaaattcccgagaggaaaatggacgagctttactccgcccagaacgatcaggaattcctgaaaacactggctgcaggttattacggcagagaaatggcggagcagggcattgatatggccgaacccgatacggctctggcaaggctcaggttcaagcagaccaagcgtgctttcagcagcgcaaggtcggctcccgagtgcttctttacctttaactcccttgctgaagttgaggtaaagaacattataaggataatcgagggtatccgctacgatcttcccgcaaaggagatcagtgagcttttaattacttaa

SEQ ID NO: 1501 - DNA, 708 bp, Unknown
  Description of Unknown: Firmicutes sequence
atgactgaacgcctcgacaagctattatccgacagcggcctctattcccgcagcgaggcgcgcgccttggtccgcgccggccgggtcagcgtggacggcgcggcaataacagcgcctgaacgcaagttttcccgtgagtgcgatatccgcgtggacggggagaggctcaattgcgcgaaataccgctactttttgctggacaagcccgagggatatgtctgtgcgacggaggactcgcgcctgccaactgtcctggagctgctgccggaggaatttcacggcctggggctctttccggtggggaggctcgacagggacacgaccggcctgctgctgctcacgaacgacggagactacgcccacaaggtcatatcgccgcgctctaaggtcgaaaagtgctatcttgcggagacggaggccccggtcacgtccgaggatgcggcagccttcgcagaaggtctgacccttgctgacggcacgcgctgcctgcccgcggggcttgaaccgcttgatgggaattactgccttgtgcgtgtcatggagggcaaataccaccaggtaaaacgaatgttagcctcgcgcggcaagccggtgacgcgcctgcgtcgcctgtcaataggcgcgttgtcactgccgccggcctcggaacctggggagcttcgtgagcttgacgaaagcgcgaaaaaccttgcattgacgcaattgtga

SEQ ID NO: 1502 - DNA, 738 bp, Unknown
  Description of Unknown: Firmicutes sequence
atgaacagctttggcatcactgacaggggaaaagtcaggcgggaaaatcaggacagctttctcatcgagcgcatcgacgagaaggattgcctgatagctgtgctctgcgacggcatgggcggcgagaaggcaggcaatatcgccagcgacctcgccacgaagacctatgtcggggagataaggcagaagatgagcataagcaggcagaagaagcccgacgtcaaggcaatgatggtccaggcctgccacattgccaaccacatgatatatggctactcctgttttgacaccgactataccggcatgggaacgacaatggtctccgccgttgcgttgggggacgaggtctacgtcctgaacgtgggagacagccgcgcttacaggataacaaagcgaaagctggtccagataacgcgggaccactcgcttgtgcaggacatggtggacaggggcgagataagcgccgaggaggcgcgcacgcacccgaggcgcaacgtcataacccgcgcactcggcgtggatgagaacgtcccctgcgacatattcaagccccggctctcgcgcggcgacatgctgctgctctgctccgacgggctgacgaacatgctggaggacagggagatttttgagctctcgaagcataacccggacccgctctccctgggcagggcgctcatggccgaggccctggagcgcggagcgacggacaacgtcacggtcgtcatcatttccaaataa

SEQ ID NO: 1503 - DNA, 882 bp, Unknown
  Description of Unknown: Firmicutes sequence
atggcggacgcagtcgggaataaggccgcgaaggactaccacatcggcactcccacgccggatcagggcttcttcgcgaagggcctcggccacacggactggggcatgaaaaaccgcatctcgcgcctgttctcccccgagacgggcaacaccgtcatgctggccttcgaccacggctatatcatgggctcgacggcggggctggagaggctggacgtcagcatcgcgccgctttgcgagtacgcggacgtgcttatgggcacgcgcggggctatccgcagctgcatcccgcccacgacggggaaggccgtctgcctgcgcgcgacgcacgacagcagcgtgctctttgaggacatgagccagggctccggcctcgcgctggacatggaggacgccctgcgcatgaacgcggcggcgctggccatccagtgcttcgtcggcggcgcgggggagcgggactcgcttgaggcgctctgccgcgcggcggacgcgggctacaaatacggcgtgcctatcctcggcgtcacggccgtgggcaaggagatggcccgcacgacgcagtacttcctgctcgccacgcgcatcctggccgagctgggcgcgagcgcggtcaagacctactactgcgaggactttgaaaaggtcgcctccgcctgcccggtgcccatcgtcatagccggcggcaagaagctgcccgaggccgaggcgctggagatggcctgcagggccatgtcgagcggcgcgaggggcgtcgatatgggccggaacatcttccagtccgagcaccccgaggccatgtgccgcgccgtagccgccgtggtccaccagggcttcgacgcaaagcgcgcctacgaatactatctcgaactcgcaaacgcataa

SEQ ID NO: 1504 - DNA, 1677 bp, Unknown
  Description of Unknown: Firmicutes sequence
atgagggcaaggcttcgtaacctctctttcaggaacaagctgcttttggctttcctgctcataggcgttgtgccgctgctcatttccacgctgctgatgctgaacatcttcagggtcacgctggccgggaacgcccgggatgcggcgcaggcggagctggacggcgccgttcgcgcgctcgacaccctgctgggcgagggcgtggagaccctgcacgatctggctggggacggccttgtgtgcgccgagctctccgagccgggcagccagccgccgcagagcgtctacgacgcgctctacacgctctcaagcggtctgcgcgggcaggcggacttcgcgctctactccgcccagggggagctgctgtttacgaccggcacggccagcgccgccgagctcggcacacactgggggctgctgaacgccgctgcccaggctgacagctgtgccttttcgggagacggcggctatatgctcgccgccaaggcgctgctcgaaggcgatgtgcctctgggttacgctgtcatgagtctcggggcggtccagcttgacgagctcttctccgcctacgccggttccggcggcatactgctgctcgacccctactgggactgcgtttaccgctccgccaacgccgggggcgaggacctggcccccctgctcagggagcggctgctggcggggcaaagcctctccgacggcggcggaagcgagttttacgtgcgggaaagcgccgtatccggtttcatgctgctctacaggcagccggaacccgtggctgactgggtcatgcgcctgctctacatcgtctcggcgctgaccattctcatttgccttgcactgtgcgcagcagtctcgatgcgcatcagccgccagctttttgagcctgtgcgcgcgctcaacgccgccatgggcgccgtcgaggaggggaagctggacacgcggctggaggtgcgctcgacagacgagcttggccagctcgccggccgcttcaaccgcatggtggagcgcctgcgcgcacacctggaggagtctgtccgccgccgccaggaactgagcgacgcacagatacgcatgatgcaggcccagctgaatccgcacttcctctacaacacgctcgacaccgtcaaatggatgggcaagataaacaaggtccccgaggtcgcgaccgtcgccgccgacctcgcggacatcctgcgcagcagcatctccggcggcgaatttgtgacgctcggcgaggagctgactacgctcgaccgctacgtcgagatacagagcatccgtttccctgggaaatttgcgctcgtaaaggacgtggaggacttggcgctggatgtgctggtgccgaagctcatgctccagcccatcgttgaaaactccatcatccatggcttcgctgattcgggcgggagcatcgtcgtcacggcccggcttgcggatgaggagctgataataaccgttcgtgacgacggctgcggcatgtccgaggaaagcctgcgccgcttccgtgagggtggagcggacggtgggcggcatctggggctccggaatgtggacgccattctccgcctgcactacgggccggagcacggcctgcgcttcctgccggcggaggggcgcggtacctgcgtaatgatcgacctgcccgccgcgagaaaggaggagagaggatgttga

SEQ ID NO: 1505 - DNA, 1602 bp, Unknown
  Description of Unknown: Firmicutes sequence
atgaagccaaaggagcttacagccgacgccgtctggcgcgagtacgagaagatgctcgcctacaacgacagcatacagctcgacgacactgtgagggtgaacgaaaacttcttcataggcaaacagtgggagggcgtcgagtccaacggtctgcccacgccggtctttaacttcctcaagcgcgtcaccctcttcaccgtggcctcgataacgagcgaccagctgaagctgaagtgctcgcccctgccctccggcgcgggggacaggggactgcgccgggcctgcgatgtcataaacgccgagtttgaggccctattcgagcgcaacaagctgacctggctgctcaaggagtacatgcgcaacgccgccgtggacggcgacggggccacctacacctggtggaacgccgaggccgacgccggcgacggccgccggggcgcgctcgtcaccgagatagtccagaacacgcgcataggcttcggcaaccccgcggacaggcaggtccagagccagccctacatactcataaagcgccgcgagatgacggagagcctgcgagagcgggcgagaaggctcggctgcgccgactgggagtctatcaaggaggacacggacgagcagctcatggacgcctacaaggacacgggcgaaaagaccaccgtcatcctccgcctctggaaggacgagaggaccggcagcgtctggggctgcgagtgcgcccgcggcgtaatggtgcgcaaaccctgggatttgggcctcaggctctaccccgtcacctggctgtgctgggactacgtccaggacagctaccacggccaggccatgataacgggcctcatcccgaaccagatctacatcaacaagctctttgccatgagcatgatatccctcatggccacggcatatccgaagatcgtctacgacaagacccgcatcccgcgctgggacaacggcataggccgggccataggcgtgaacggcgggggcgtggacagcgtggcccgcgtgctcggtccggcgcagatctcgccgcagatagcgcagtttatcgagctgacgcagagcctcacgcagacgaacctcggcgcgaccagcgtcgccctaggcgaggcgaagccggacaacacctccgccatcatcgccctccagcgcgccgcctccacgcccaacgagataacaaagcagaacctataccagagcatcgaggacctgggggccatctacctcgacttcatggccggctactacggcctgcggccggcggagattgaccccgtggctgaggtatccgaggagctgctggacttcgtgggcgaggccctgccccggggcgagaacgggaagatatccgttctctacgatttctccggcctgcgctctctgccgctccggctgaagctcgacgtcggcgcggcggcctactggagcgagatagcctccacgcagacgatggacaacctcctcgcgcagggacacattgatgtgctggaataccttgagcgcgtgcccgacggctacatcactgaccgccagggcctcataaacgccatcaccgcccgccgggccgcccagggcgcaccgcaggatgcggcggcaatctga

SEQ ID NO: 1506 - DNA, 792 bp, Unknown
  Description of Unknown: Firmicutes sequence
atggagctttttgcaggagtagatataggctcgaccacgtccaagtgcgtgctgctggacgagaagggcgagatgttgaccttccaggtcgtgatgacggagtttgaccgcaacgtcagcggcagcaaagcatttgccgcggcgctggaggccgcgggagtccgggaggaggacgtgaagtacgtcgtatccacgggttacggccgcaaggcctacgagcgggcggatatgaacatccctgagataatcgcccacggcatgggcacctactacgtggaccccacggcgaggacgataatcgacatcggcggccaggacagcaaggtcatagagctggacgagtacggcacggtgacgcgctttgagatgaacgaccgctgtgcggcaggcacgggccggtttttcgaggtgctgacgcacaggctgctgggcatagagatgtcggagctctcggacctcatgaagcaggcgacggagccctgcacgataagcagcatgtgtacgatatttgcggagagcgagataatctcctatctgtcgcagaaggtgcctgtggcggacattgcggcgggtacgggccgctccatcgcgcggcgcataatttccatgggccgggcggcgcagataacgtacaagccgcccatagtgttctccggcggcgtggcgaacaacgccgccatagcggacatttttgcagaccttctgggcaagccggtaaaggccctgagcctcccgcagtccaccgccgccctgggcgcggccctgaaggccaaaaccgaatacgcaaaatga

SEQ ID NO: 1507 - DNA, 1020 bp, Unknown
  Description of Unknown: Firmicutes sequence
atggctcgctcaaccctcaaggatgtcgcgcgcagggcgggcgtctcccccgccaccgtatcctatgtcctgagcggcaagcgcacgatatcggaggacacgaagcgccgcgtgcgcgaggccgtggaggcgctggactatgtccccgacctcgccgcccggggcctgagccgccgggactcgatgctcattggcgtggtcgtcccccaaacggagccgggagaccggctgatgttccagaacagcttctacagcgaggtgctgggcagcatagagtactacgcccgccagcgcggctaccacatcctcatctccgctacggacgccaacgagagctatctcaccctggcaaagcagcgcaacctcgacggcatcatcgtcataggcatgtatcccgacgagttttaccagcagatgaaaaagacgcagatacccatcgtcctcatcgacagctactgcaacgaccactattacaacaacatccgcatagacgacgcctacggcagctatctcgcaacacgttatctgctcgactgcgggcaccgggacgcggcctttttcgccgggcagctgaaggaaaacggcgtcatgaaaaagcgcctcgcaggctacaggcaggccctggaggagttcggcgttccctaccgggagagcttcgtctttgaggggcagatcgactacaagagcggcgtagccatggctgcgagcctggcgcgctccagcctgggcgcgacggcggtggtcgctgcggcggacattctggccatcggcgccgtccgcggcttttacgacgcgggactgcgcgttccggaggacatgtccatcatcggcttcgacgacctggagatatcgcaatacctggcgccggggctcacgacgataaggcagcagatatccctcaaaggccagcgggccgtggaactgctgctcgaacacatagccgacccgagtctctcgaagcaggaggagatactgcccctcaagctcatagagcgcggctcggttagaaaactgtcataa

SEQ ID NO: 1508 - DNA, 1710 bp, Unknown
  Description of Unknown: Firmicutes sequence
ttgcaggagctctcggacaggaaccccattgaggacgtcgtgggcgaatacgtgcagttcaccaagcgctcaggccagaacctcttcgggctctgtcccttccacagtgagaagacgccgtccttctctgtgtcgccctcgaagcagatctaccactgcttcggctgcggcaagggcgggagtgtcataaacttcataatggagatagagaatctcagcttccccgaggccgtggagttcctggcccggcgcgccgggatgaaggtcccggagcagcagagcgacccgggcaagcccaagcgggacaggctctatgccctcaaccgggacgcggcgcgctttttttacgagcagctctcgaccccggcgggcgcggcggcggtggactacatgctccggcgcggaatcacgcccgggacggcgcggcgcttcggcctcggctgcgcgccggagagctgggacgcgctctgctcggccatgaaggagaaaggctacaccgagcgcgagctctatgacgccggtctcgtgcgccgcggcaagaagggcggagtgtacgacgccttccgcggcagactgatgttccccgtcatcgacgtgcgcggcaacgtcatcgctttctccggccgcgcgctcggggacgtggagcccaagtacctcaacagccccgagacgccggtgttcagcaaaagccataaccttttcggcctgaatctggctaaaaagtccaaatccgggtacattatcctcgtcgagggcaacatcgacgtcgtatccctgcatcaggcgggcttcgacagtgccgtcgcctccctcggcacctcgcttacgccggagcaggcacggctcatctcccgcttcaagcaggaggtagtcatcgcctacgacgcggacgaggcgggcaagaaagccgcccagcgcgccatcggcatacttgaaaagctggagctgaaggtcagggtgctgaccgtccgcggcgccaaggacccggacgagttcatcaaggccaagggcccggaggccttccagaacctcctggccgagagcgagaaccacgtcgagtaccggctcgatgccgtgcgcgcgaagcacgacctcgccacggacgagggcaaggtggcctatctgaaagaggccgccggcgtcatcgcccagctgccagacagggcggccagggaggtctacgccatgcgcgcggcctcacagtgcggcgtctcgcccgaggcggtgcaggacgaggtcaggcagcagcgccgccgccgcgccgccgcggcccggcggcagaccgagcgcgaggagctccgccccctgcgcatgtcccagccacaggagcgcggcatccagtacaaaaacccccgctccgccgcggccgaggagggcgtcatacgcctgctgaacctcgacccctccctcttccggggcgtcgagcttgcggaggcggacttctcctcccccgagctctggcgcatatattccgcgctccgccgcagggcggacgagggcgcgggcctatcccccgccgcaatgagcggggagctctcgccggaggagttttcgcttttcacaagcgttatccaaaagccggagtccgccgcgaacgctccgcgggccctggccgattacatagccattatgcgtgccgctgacaaggcggagggcgacctcctggcctttcaggaccggatgaaaaagacaaagagttacggaggatga

SEQ ID NO: 1509 - DNA, 1404 bp, Unknown
  Description of Unknown: Firmicutes sequence
atgaagagattcggcggtgacaaaaaatacctctattggggcgtgacggcctttgccgtcatcgcgtgcagcataattttttacctgctgctctcgcgctggccgggggtcctgcaggcgctcagcgcctttgtacacatcatagcgcctttcatctggggctttgcgataacctacctgctccggcctgccatggtgttttttgagcgcacggtgacgaatccgctgggggacaggctcttcaaggacgatcatcgccgctccttcggcttcggacgtgccgtggcgataatcttagccgagctgctgatgctcttcatcgtgggcgcgctgctctggctcatcctgccgcagatatattcgagcataaacagcatagtccagaacagccagagctattacgagaccatcgtgaactgggtcacgcgcacctttgaggattacccggaactgaaaaacggcgtggtctcgctgctggacagcgcctccgaccggctgacccagtgggcgacggatacgctgctgccgcagatgacgaacctgataggcagcatcacctctggcgtctacaccttcgtgcgcggcatctactatgtcgccgtgggcatcatcgtctccttctatgtgctcttcaacaaggaagccgtggcgacgggggccaagcgggtgctctactgcatcttcaccgtcgaggcggcggagaagatactggagggcgtgcgtttcacggacaagaccttcatggacttcataagcggcaagatactcgacagcgcgataatcggcatcctgtgctatatctgctgcagcctcatgaatatgccctacaccctgctcgtagcggtcatcgtgggcgtgacgaacgtcatccccttcttcggaccctttataggcgccataccctcggccttcatcattttgctcgtggatcccatgaaatgcctcattttcctggtgttcatcctcattttgcagcagtttgacggcaatatcctcggcccgaagatcctgggcagctctacgggcgtgaacggcttctggataatgttcgccatcatcataggcggcgggtttttcggcttcatgggtatgctgctgggcgtgccggtgttcgtggtcatctattccggcgtcaagaatctcacccggcgcaagctgcgccgcagcggcctgccggaggactatgagagctatgagaacctgcaccacatagaccccaagacgggcgagcacatagagatgccgccccagcccacgccggaggagcgccgcgcgaagaaggcggaggcccgggaggcctcccgcgcagcgggcgcggcgagggcggagcggctgcgcagcctcataatgaaagacgcccgggggaagaaccccccggacggcaaggacggcaagaagaaataa

SEQ ID NO: 1510 - DNA, 1281 bp, Unknown
  Description of Unknown: Firmicutes sequence
atggcggaatatgtacctggcagggaatttgcgctgcgtctggacgcggcggacgctctggcctctcgacgggagctcttttacatccggcccggccagatctatatggacggcaactcgctcggcctatgttccaagggcgccgagcggacggtcctgcgcgcgctggaggactggaaaaaatacggcataggaatctggaccggcgcagagacggactatttcctctattacgagagcataggcgcgaagctggcgcggctcataaacgcgcggcccgaggaggtaacggtctgcgcgagcacgactctgaacatccaccagtgcgtggccaccttctggaagccggacgcgcggcgttataagatagtcgtggacgagctgaacttccccactgaccgctacgccgtgacgagccagatagcccagcgcggcctggagccggacgaggtgctcaaagtcgtcccgagcagggacggcaagaccctggcgatggaggacatcctcgcggcgctgaccgaggatgtgagcctcgtgctgctgccctcggtgctctaccgcagcgcccagctgctggacatggcggccatcacgcgcgcggcgcacgagcgcggcatcatctgcggtttcgacctctgccacagcataggcgccgtggaccacgacatggaggccgtggactgcgacttcgcggtctggtgcaactacaaatacctctccggcggcccgggcgcgacggcggggctctacgtgaaccggcgtcactttgagcgcgggcccggcctcgcgggctggtggggcaaccggaacgacacgcagttcgagctccggccggagttcgagcacgcgatgaacgccggcggctggcagacgggcacctctcccatcctgagcatggccgccgtggacggcgcgctcgacgcctacgagggcctgacgatggcccaggtgcgcgcacgctcgctggagctgacgcgctatctcatgtacctcattgacacggagctcgagggctacggcttcaccataggcaacccgcgggaggacgctgtccgcggcggccacgtggcgctggagcacgcggacgcggtgcggataaacgaggcgctcaaggcggcgcaggtcgtgccggacttccgctatccgaacgtcatccgtctcgcgccgagcccgctgtacacgagctttgaggaggtctgggagcttgtgcggcggctgaaggagataatggacactcgcgccttcgagaaatactcggacaaggccggcactgtggcctaa

SEQ ID NO: 1511 - DNA, 1188 bp, Unknown
  Description of Unknown: Firmicutes sequence
atgaaaaacggattcggaagatttctgcacgcatttttcggcataaagatacgcttctgggcgtttatacttatctgtgccatctgcgtgggcgtcacctacggcctcacggtccgcagcgagcgggacaggataggcggcggcgacaactacacccaggccatgaaatacctggagataaaaaacgtcctcgacaaatattacgtggacgatgtgaacgaggaggccgtctcctccgcggcgtttgacgccatggtcacgggcctgggcgacaagtggagcgactacatgagcccctcggactatgaagcgtacaagctctattcctcaaaccagtataccggcctgggcatcaccatggacaaggatgcggagaccggaggttttgttgtccagggcgtgacggaggactcaccggcggctaaggctggtatagaggtaggggagataattctggccgttgcgggacaggatatcacctccctgacgataggcgacgcgcacagcttcataaacagcaacctgagcgcgagcgtttcggtgaagctcctgaaccttgagggcaaggagagcaccgtgaacgtggactgcagcgccaactatacgaacccggtgagctataagatgcttgaaggcagcgtgggctacgtgcgtatactgagctttgacgcgggctccggcgaggcggccatagccgccgtggacaagctgctggccgacggggcgctgggctttgtttttgacgtgcggacgaatccgggcgggatatatgaggagatggtgaagctcctggattacctgctgccctccggtgatatcctcgcgtatgtggattccgagggcagcgagacggtgacgaagtccgacaatgtctgcctcgacctgcccatggccgtgctggtgaacggggacagttacgccgcgtccgagtttttcgcagcggcgctcaaggagtataactgggcgacgatagtcggcgagcgtaccacgggcaaaggccgcagccagataaccatagagctgacagacggcagcgcggtcgtcatttcaaacgggaaatatctcacgcccacgcgcgtggacctctccgcagaggggggcctgcgcccggatatagacgtcgccctgaccgacagcggagacgagcagctcaccgcagcgctcacggaggtccagtggcagacctga

SEQ ID NO: 1512 - DNA, 1710 bp, Unknown
  Description of Unknown: Firmicutes sequence
atgctgacggagctccacattgagaatatcgcagtcatagagcgggcggacatagagccggggccggggcttaacgtcctgaccggcgagacgggcgcgggcaagagcatagtcatagactcgcttgaggccatcctcggcgcgagggctagccgggagctcgtgcgaaccggcgcgcagaacgcggccgtctccgccgtctttgacgacgagcgcgccgcgcgctggctggtggagcacgacctcgaacccgtggggcagtacgacccggacaccggcgagggcgagcgcatagtcatccgccgccgcataagcgccgagggcaagagctcggcgctcgtgaacggggagaacgtcactgcggccgagctgcggcagcttggcgcgctgctgctggatatccacggccagaacgacggccgccagctgatggacgagacgcggcaccgcgattacctggacggctttgcggggctcgcgccgcagctggagcggcagggcaggctgtacgaggaatacaggcaggccctttcggcgctcaggaagctggagatgacggaggccgaacgcgagcggcgggagcgcgaataccgcatgaccgccgacgaactggcggcggcgaacatccgcccgggcgaggaggagcagctgctggcccggcgcgagctcctgcgcaactccgaaaagctgaccgaggccctggacgcggcctatgaggcgctctacggcggggaggacagcgcggcggagcaggcgggaaacgcctccggttggacggagcgcgcggcgtccctggctccggagctggacgaggccctggctgaaatagagagcgcccgcgcctctatagaggacgcggcggagcgcctgcgtgatttcagggagagcctggacttttcccccggcgagtacgacgcgctggagacgcgcctcagtcagctccggcggctggagaaaaaatacggcgcagacgaggccggcctcgccgcgctgctggaggctgcgcagaggggcctggaggagctggacggctccgaagaaaagcgccgcgaactcgaagccgagcttgcaaaaaggaagaaagcggcgtataattccgcaaaagagctctcgcagctccgccgcgccgcgggcgaagagctcaggcagcgcgtagagcagggcctgagggagctttccatgccctccgtgcgctttgagacggagatagtccccctggagggcgagcctggctttgacgccactggcatggacgaggtgcgcttcctcatgtccgctaacgcgggcgaggcgccggggcggatatcgaagatagcctccggaggcgagcttgcgcgcatcatgcttgtgatgaaggacgtgctctcggagcgggacggcacgcctgcaatggtgttcgacgagatagacgagggcgtttccggcgtcgcggcccagcgcgtggccgagaagctggcgcggctctcgaaaaagaagcaggtcatttgcgtgacgcacctgccccagatagccgccatggccgatacgcacttccgcattgagaagacggagcgggacggcaggacgtataccaaggtcacaccgctggagcgcgagggccgcatccgcgagttggctcggctccacggcggggcgaacataacggacacgacgctggcgagtgctgcagagcagctcgacgcggcgagcgaatacaaagggggaatatag

SEQ ID NO: 1513 - DNA, 867 bp, Unknown
  Description of Unknown: Firmicutes sequence
atggacgcggtcatcagggccgagggcctgacacatgtatatagccgcggcacgccctttgaaaaggcggccatacgcggcgtgagcacagagatctacccgggccagctcgtggcggtcatcggccacacgggctcgggtaagagcacctttatccagcacctgaacggcctgctgcgccccgacgaggggacggtctactgcgagggcgaggacattttcgccacgaaggaggccacgcgggacgtgcgcttcaaggtgggcctcgtgttccagtacccggagtaccagctctttgaggagacggtctaccgggacatagccttcgggccgaagaacatgaagctctccgaggcggaggtggacgagcgggtgcgcgaggccgcgcgctttgtcggcataggggaggagctctttgagaaatcgcccctggagctctcgggcgggcagaagcggcgcatcgcaatagcgggcgtcatcgccatgcgccccaaggtgctcattttggacgagcccaccgccggcctcgaccccggcggctgcgagggcatactcaaaaacgtcctcgactacaggcgccagacgggctccaccgtcctcttcgtcacccacagcatggacgacgcggcgaggatagccgacaggctcatcgtcttccacgagggcggtatagccatggacggcacgccggacgaggtcttttcccgcgcgcgggagctcacggagatgggcctggacgtgccccagcctgccgccatagccgccgccctgcgcgagcgcggcgcagcgctgcccgagtccgtctacaccgcgcagcagctgcacgaggccgtgctggccctgctcaggaaggggggacgggactga

SEQ ID NO: 1514 - DNA, 1380 bp, Unknown
  Description of Unknown: Firmicutes sequence
atgcactatctgagacagggccggggcttttaccgcagcgctatagccctgatgctgcccatgatcctgcaaaacctcgtcacgaacttcatggccctggccgactccttcatggtcggggccctgggcgagacggagctggccgccgtgaccatggccaactccgttttctatgtcctgtcgctcattatcttcggcatacagagcggcacgggagtccttgtcgcacagtattacggcaagggcaggctggatgcgataaaccgcatcatgggcatgggctactatgtctccctgggcctcaccgcgctcatagccctgctgtcctttttcttccccatgcagctcatgcagctcgtcacgaacaaccccgacctctgggagccgggcgcggagtacgcgcgcatcgtgggcttttcctacgtctgcatggccttctccggcgtctacatcgccgtccagcgcagcatggagaaccctggcctcggcgccatactcctgaccgtctccggagcgctgaacatcctgctcaactatatgttcatcttcggtaaatggggcgcgcccgccatgggctgcgccggagccgccgttgccacgctgctcagccgcgtgctcgaggtcctggtcgtcaccggctgcttcttccggagcaagcgcctgcccgtgaagccgggcctcatgctcaggccgggccggataatcgccggagacttcatcaaatactccctgcccgtcgtgctcaacgagggtatgtggagcctcgcaatgtcgctcttttccatcatcatgggccacatgccgaacagcacgcccatccttgccgcctacaccatcgccggcaacatcgaccgcatggctgccgtcgccctcttcgccgccggcaacgccaccgccgtgatcataggccgggacataggctgcggggatacgaaggagatctacggcaagggagtggcgctcaactttgtctgcttcgtcaccggcatcataagcatgggcctcctgctcaccatccgcgcgacgctgctcgacggcttcatcttcccgctcatggacatctccgccgaggccggggagctggccaagatgatgctggccttcatcgccgtcgtcatgcccctgcgcagcctcaacctctgcaacatcgtcggcgtattccgcgggggcggggacgtgcgcttcggcctaatttgcgacataggcccgctctactgcgtctgcctgcccgccgccgccctctgcggccttgtattcggccttggcatcaccgccgtctacgtctgcatctgcctggacgacttctgcaaggtcttcctctgcctgcccaggctccgctccggcaagtggataaactccgtcacgcgcgagacgctgtga

SEQ ID NO: 1515 - DNA, 1125 bp, Unknown
  Description of Unknown: Firmicutes sequence
atggatatcacgtttcactattttgccgtcaagacgcttgcgcttgaggcgggttttcctggggcggaggcgcagaggctcgcggctttttcgcagttcgtggacgacttcgacaggcgcggcagcctgtattgcggaaatgtgccgcgatatatccgcctgagccgcgaccacgacctgtacagtccgggcggcagtccgcttgagggcaacttcgagcccgtgaccacgggctcgggcgggcttgcggattttgcatcgcttctgctcccgcgcgcgcagaaattcacgcttgcaccgttccacttcctgcctgcctcgccgcgcgcagactgggctgactgccgcaccgtacccgcgcggcttggggacggctcgctcgcaagctcgcagctgcttgaggcgcgcgccgcgctgctctctgggcggggctccagacgcgccgcgctcatgcgcataggcatatatctgcacagcttcgcggatacctatgcgcaccagctcttctccggcggcaactcctgggtgaacgacgtgctgctcgaaagcgtcaccgaaaacgcaggtggaacggatgtcaccgccgcggcgctgggcgagagggagctggccgcggcggagtgcttcggctcagggcgtgggccggaggactggcgcagcatactgccgcgcattggccacatgtgggccggaaggacgcccgacagggcaaacctgagcttcactctgagataccgggcctcggcggatgacccggactacagcctcagctattcgcgcagcaacactgcgctgttccttgaggcggcggagcagatactgaactatctgcgcagttgccgccgcctgccgccggtttccgccggagcctgggcgtcgctctcatcgcggctggaacaggcctttctgctgcccgcgccggagcgggacgcacatcgccgcctcgcctcgcgctggtcggcgctctttccggggtatgtctacgcctacgaccccgccgtcatagaggcctccttccgccccgccgggggcgacagctattcggaggacttctacctcttcaactacatagccgaagagcccctcatccgcctttacggccccaaaccccgccgcagaacgtga

SEQ ID NO: 1516 - DNA, 1437 bp, Unknown
  Description of Unknown: Firmicutes sequence
atgaaaaaaatcaagttgctgcccataattttgattttgacccttctggtatcggcgctgggtctgcccgcgctcgcactggagcagccggagataaactctccccgcgccgtgctgatggacgccgcctccggccgcgtcttttatgaaaaggacgcggattcccaggcctaccccgcctcgctgacgaaggtcatgaccgttctcgtcgccgtcgaggccatagagcgcggcgaattctccctcaccgacagcgtcacggccagcgagcgctgccttgagggcatggtggacgacggcagcaccgccggcatagtccccggggagacgatgccgctccaggacctgctctactgcgcgctgctcgcctccgcgaacgaggcctgcaatgtcatcgccgagtacgtaagcggctcggtcgaggcttttgtggagcagatgaacgccctggccgccgagctcggctgctccggcacgcactttgccaacacccacggcctgcctgacgacgaccactacaccaccgcccgcgacatggccgtcatctaccgcgaggccatctcgcacgagcttttcgccgagataagcggcagcgtcggctacaccgtcgcggccacgaacgtctccggggagcggcagctgtccaacaccaactccctcataaaccagaacgccacggtctaccccggttactactacgagtacgccaagaccggcaagaccggccacaccaccgccgcaggctactgcctcgcctcctccgccgagaaggacggggtcagcctcatcgccgtcgtcctgggcggcgaggccccgcagaacagctccggcggctacgactaccagaacttcatcgacagccgcaccctctacgactggggcttcgagaatttcagcagccgcgagatcctcagctcctctgagctcataaccgaggtccccgtcgccatggcggcggacgacggcatggccaccctccggcccaacaacgtgctgaccgccgttgtcgccaacgacttcgacgtcggcagcctcgaacgcgacatcgtcatctacagcgagcgcgacggcgagacgctggaggcccccatcgccgccggcacggtcctgggcgaggtgacgctgagcctcggcggcgaggtctacggcacggtacagctcgtcgcgggcagcagcgtggagctctcgaaggcgcagtatatgaaaaaccagatagccggggtcctgggaatgacctgggtgaaggtcgtcatcatcgccttggtgctggcgctcatctgctacatagccctggtcatccgctaccgggtgctgcaccggcggcacatgcgcgaggtccggcgcgcgaagctggagcggcagcggcgcatggagcgcgtggccgaggaggcgcgcagcgccgtcgcgcgccagtcgcgccccgcgactcttgcatct

SEQ ID NO: 1517 - DNA, 1989 bp, Unknown
  Description of Unknown: Firmicutes sequence
ttgaaaaaggtggattacgagcatttttcccgcttcctcatgccgaacagccccgccgcgcgcggggaggagctctatttctgcgtgaagcgcgcggacatggaggagaaccgctatttctccgacctctggctctggaagggcggcgcggcaaagcgcctgacctcctccggggacgtgaacggcttctggctgaccgaggcgggcgtcgtcttttccgcactgcgcgagaagcgcgacaaggagcgcgccgaggccggggagcccctcaccgtcctccagctcctgccctacgacgggggcgaggcccgggagctctgccgcctcccctgcgccgtcaccgccctgcgctttgcgggcgagggccgctttttcttcaccgccgactgctcccgcgactgggacgccgcccttgcgcaggcgcagggcgacgcgaaggccgccgccgaggcgctcaaaagatcccgcgccgagtgccgggtcatagacgagctgcccttctggttcaacggccgcggcttcgtgaacggctgccgcagccgcctcggcgtatatgaaaacggcgctcaccgcttcctcacgggcgaaaatacggacgtttcgctcggcggcctctcgccggacgggaaaaagctcagcttcaccgcctcggactggacgggcagcgcccccatcggggacaggctctgcctgctcgacacggacacgcttgagatcgatgacgtcacggtgcgcgagggcgcgcagcactactggtccctgcccctcggaggcggccgcctcgccgccctcgtgaacaccatggacaagtacggcatcaacgagaacccgaagctcttcctgcgcgagggcggggtctggcgccttgtcctgggcgacggcgcacactgcttcggcagcagcgtcggcagcgacgtgaaggccgactccggcttctgcggcgacgcgagggagcgcggaggcgagctcttcttcctcgacaccctgggcagcgagagccagctgctggccgtggacgaaaaaagcggcgcggcccgggccctcgcgggccgcggcctcaacatcagctccgcctgcctctggcgggagggcttcgccgcctgcgccatgcgcggggcttcgggcgtcgagctcatgtacataggccccgacgggagcgagaacgtcctcacggagtttaactccggcatctgcgaagagtacgaatactccgcgcccgaggcgctgaacttcgtaaactccgagggccgcgagatagccggctgggtcataaggcccgcgggcttcgagcctggcaaaaagtaccccgccatcctggacatccacggcgggccgaagacggtctacggcagctgctatttccacgagatgcagctgtgggcctcgcgcggctttgccgtgctgttctgcaaccccacgggcggcgacggcggcggggacgagtttgcggacatccgcgggcagtacggccggcaggacttcgcggacctcatgcagtttgtggacaccgcgcttaagcgctgcgatttcatagacgcggagcgcctcggcgtcacgggcggcagctacggcggcttcatgacgaactgggtcataggccacacggacaggttcaggtgcgccgccagccagcgcagcatctctaactgggtaagcttccgcaacagcgccgacataggctggtatttcgccgaggaccaggtgggcggcgagccctggacgggcctggagaagatctggggccagtcccccctcgcctttgcggaccgggtcacgacgccgacgctgttcatccactcggaggaggactaccgctgcccgctctcggagggcatccagatgttctacgccctgaggcagcgcggggtggagtcgcgcatgtgcatattcaagggcgaaaaccacgagctctcccgctccggcaggcctcaaaaccgtgtccgccgcctgcgcgagataaccgagtggatggagcgccgcctgaaataa

SEQ ID NO: 1518 - DNA, 2232 bp, Unknown
  Description of Unknown: Firmicutes sequence
gtgcttatcctgctggcagcggcggtttttgccgcgtataagctgaccaacggcttcgctgatctccgcctgcctgtcaaagtctcgctcgataacacgaacaccgaatttgattatgaccttgaccgcctcgcggggcagatcgtccccggcatgtacgtcggggactgcggcccgctcgaagccgaggagctgcgcgaatgtgcaaagaaaaacagcgagtgggcggacgagcttgagttcatggccgagcatatctccatctatactgaggatgcggtaaaaaccgcgctgcttggcccagagaagaccccctttgccctgctctccgccttttgcgagccgaattcctccggccttgacgctgagatcagcgtagatgagggcgaaataccatacctgctgcaatacgactcacgctggtgcttccacggctacggcagttccttcatgggcttcacggcctgcggccccacctgtctctccatggcgctcatcggcctcacggggaataccgactacacccccgcctatgttgcggacagggccgaggctgcggggcattacgtcccgggcgccggtactgcctggtccctcttcaccgagggcgcggcggagttcggcctgcgcggcgaggcgatcagcgccgggcggagagagttgagccggctgctggacgagggcagcatcgtcgttgcctccatgctgccgggcgacttcaccaccagcggtcactttatcctcatctacggctcaaatcttctcggcttcaaggtctatgacccgaacagcatagagcgcagcgagcgtctctggagctacgacaccctggccccgcaaatagcccagctctggagcctgagcctggcctccggccaaatcgacagcggcggcacggctccagctgacagcggcgaggcgggcgacatataccttgccgactgtgaggagttcatcaccctgcgcgaggagccggacgtgggcgccgatgccatcaccaccatccctaagggcggagagatgacccttgtctccttcgacggcgactttgcgctggtggagtatcagggcgagcgcggctacgttctcgcctcctacatagagccaaaggccgccggggcggggcttgcccatgcgcagtccgcctccggcgcggcctttatcgcggactgcgaggagtttgtcaccctgcgtgcagagccggacgtggaatcccgcgagctcggcaccatcccgcgcggcggagagatgactctcgtcgccttcgacggggcctttgccctcgttgactatgccggacagcgcggctacgtactctcgacctacattgtgccgaagctggattccgcctccccgggcgggggcttcggctatgcagacctgcaggagggcctggagcggctcgctgcggagcatccggaggagctggagctctcgtccattggacagagcgccgagggcagggagctgctgctcgccgtcgtcggaagcgagggcgcggagtacgagcttctcatccagggctgcatccacggccgcgaaaatatgagcgcatatcttgtcctgagccagcttgagcacctgctcaagagcggtgtgtcggaggatgtgcgctttcactttatacccatggtgaacccggacggcgctgaaataagccgcacgggcgtgctgggcgaggcgcagcgcgaaatctatctttccgacctggccgcgggctataccgaggccggagaggccgaatacgcccgcgcctggaaggcgaacgccgcgggcgtggatctgaaccgcaactttgacgccggctgggcgcagctggacagccgcgccgccccctcctgtgaaaactaccgtggaggcgcgcccgaagaccagcccgagagccgcgcgctggccgactacacacgcgccatcctacctgacgcgacgcttagctaccacacggcgggcagcctcatctacgcggactacgccggggcctccgaggccgtgaacgcggcctcccgcagtcttggaacggctctgggccaggcggcgggctatcccctggaggacagcggcgaccttgacagcggcggttacaaggactgggccgctgccctgggcataccctccgttaccatagagcttggctacggcgacagtccccagcgcgcaggagcctacccgaccgtgaggctccgcaacgagagcgcccccctcgtcgccgccgagtggctgcgcggcaactga

SEQ ID NO: 1519 - DNA, 561 bp, Unknown
  Description of Unknown: Firmicutes sequence
atgtcccagaaacattctgccgcgttctgggtgacacgcacggcgctcggagtggcgctggtggtagttgcccagctgctcggcaaggtcatccccgcgggggcggtcatagcggggccgttctcggtgacgcagctcgtgacgggctcgcttgtgaactgcgtgctgtttgtgttcacggcgacgacgggcatttggtcgggcgtggcgataggcatcatatcctcagcgctggcggcgctcataggcataggccctgcggtaccggcggtgacgccggtcatcgcctgcggcaacgcggtgctggtggtgctctttggactgctgcacgggcgctggagctttggccgctgggcctttgccgctgtagttgcggcggcggcgaagtgtgcgttcctgtggatatgcgtacctgcggtgctgcagctgctctcgggcgtgcctgaggcgcaggtaaaggcgctgggcatcatgttttcctggccgcaggggctgacggcgcttattggcggcgcgctggcgctggtcattcttccgaggttggggaaggacaggccgtga

SEQ ID NO: 1520 - DNA, 729 bp, Unknown
  Description of Unknown: Firmicutes sequence
atggaggtaacatacatgccaacaccccacaacagcgccgcgaaaggcgactttgcaaagaccgtcctcatgccgggggaccccctccgctcaaagtacatagccgaaaacttcctcacggagccgcgcctcgtgaacaacgtccgcggagtccagggctacaccgggctctggaagggcgcggaggtctcggtccaggccagcggcatgggcatcccgtccatcggcatctacagctgggagctgtacaaggaatacggcgtcgagaacattatccgcataggctccgcgggcggcctggccgacagcctgaagctcatggacgtcgtcgccgccgtcggcgcgtgcacggactcgaacttcgcccaccagttcggcgtcctcggcaccttcgcccccacggccgactggacgctgctcaagacagccatgggcatcgcggaaagaagcggcctgtccataaaggccggcaatgtgctctcggcggacaacttctataacgacggctcagacgggccggaccagtggcgcaagctgggcgtcctcgccgtcgagatggaggccgctggcctctatatgaccgccgtgcgctgcggcggcagggccctgtgcctgtgcaccatctccgaccacctctaccgccccgaagagctcacgcccgaggagcggcagaccggcttcaacgagatgatcaccctcgccctcgacacggcagcggccctcgcctga

SEQ ID NO: 1521 - DNA, 2283 bp, Unknown
  Description of Unknown: Firmicutes sequence
atgatgcttcgccgcacactgtttcttatgtcggtgtgcggcatagctgcgtttctggccctgggcgcgcgcctgtgccagatacagatcttccagcacgatgagtacgaggccgccgccatagcccagcaggtgcgcgagacgacggtgagcgccgcacgcggcaccatttatgaccgaaacggcgcgatccttgccatcagcgccggggtggataccgtgtacataagtcctgccgagatagagcgaaataacgaggacaaggaggccatcgcccgcggcctggcggagatcctggacgcagactacgagaccatactcaaaaaggcgggcaacacaaagtcctggtacgaggtcgtggcccgcaaggtggaggctgaaacggcggagcttgtgcggaagtttaaggccgagggcggctacgtcggtatcaagatagagtcggacaccaagcgctattatcccaacggaagcctcgcctcccacgttatcggcttcgtgggactggacaacaccggcctcggcggtatagaatcacgctatgacagcctgctctcgggcgaaaacggctacgtcatgcgttccaccaccgcggcggggacggatatgctctaccagagctacgaggactacgtggacgcccacaacggcgacagcctgaccctgacgatagacgctgtcatccagagctacgtcgaaaagcacctcgcccaagccgtggaggactacgacatccaaaacggcgcggcggctatctgtatggaggttgacacgggtgctatactgtctatggtgtcccttggcaatttcgacctgaacgattaccagaccatcagcgccgaggccgaggccgagataagcgccgccgcacagagcgaggaggagtatgacgagctctacgcccttgcccaacagcagcagtggcgcaacaaggccatctcggacacctacgagcccggctcgaccttcaagataatcaccctggccatggcccttgaagagggcgtcgtgaacgagaactccagcttctactgcggcggcagcatgaacgtgctgggccgcggcagcccgctgaagtgctggaaatacggcggccacggcccccagagcctgacgcaggccgtgcagcactcctgcaacgtcgccttcgtgaacataggccagctggtgggggaagagaagttctacgaatacgccgagggtttcggcttcatcgagcgcacggcggacacttcccagcagctgacggccaagacgggcatagacctcggcggagagagcggcagcatctggtggagcgaggacgtgttctgcaacccggagaatctctcccagctcgctgcggcctccttcggccagaccttcaacataacgcccatccagctcatcactgtcgtctccgcctgtgtgaacggcggcaggctcatgcagccgtatctcgtccagagcgtggaggacccccaggggaacctggtctcgcagacggaaccgcaggtcgtgcgccaggtagtaagcgaggagaccagcgcctcggtgcgccgcatcctcgaacaggtcgtcagcgaccagaccgagggcacgggccacaatgcctatgtcgcgggttaccgcataggcggcaagaccggcacctccaccaaaacgacgaaggagatatccggcgagaaggaatatatcgtctccttcatcggctttgccccggctgacgacccggaagtggccatcctcgtcctgctggacgacccgagctcggagagcggcatctacatctccggagggcagatggccgcgccggtggtagggaagatgatggcggatatcctgccctatctgggttacgagccggagtataccgactccgagcttgccgccgccgacaaggccgtgcctgagctcaccggcatgagcattacgcaggcgaaatccgccctctcggagagcggcctcggctgccgtgtgataggcgagggcgatacggtcacggaccagctcccgcgagcaggggcagtcatcgccgcgggcagcgaggtgctgatctatgccgggcagaaccccgcaccgacaacggagacgatgccggatctgcgcggcctgagctacgaggcagcgcggcagaggctgggcgagctcggcctgtatctgacagcggaaaacggcgttacggaccccgccgcgcagctggtttccgcccagagcaccgccccgggcgaggagctggcgcacggctccgtggtgggcgtcacactatatgaaaacgaagcatcaatgcttggcgaatactga

SEQ ID NO: 1522 - DNA, 1272 bp, Unknown
  Description of Unknown: Firmicutes sequence
atgagcggatacatagccgcctacatagtcctcatctgcctgtcggcctttttctcggcctcggagatgtgcttctcctcggccaaccgcatgaggctggagtccgccgccgagggcggctcccgcggggccaggatcgccctcaaggtcatggacaggttcgacgactcgctctcggccatactcataggcaacaacctcgtgaacatcgcgacctcctccatcgcctctgtcgtcgtcatcctcatcgccggcgaccactggacctggctctccaccgttgtgacgaccatactcgtcatgatcttcggcgagaccatgccgaagatcgtcgcgaagaagaacgccaatcgcatcgcgccggtcttcgcctaccccataaggccgctcacctatatcctcatgccggtcatctggatagtcgtgggcctggtgcgcctgttcaccctgccgctcaggggcgaggagcagcaggaggacgacgaggccgccgtcgaggagctgcagtccatcatagagaccgccgaggacgaggaggtgctcgacgagaaccgctcggagctcctccaggccgccctggacttctccgaggtcagcgccagcgaggccatgaccgcgcgcgtggacgtcgaggccatagacatagacgacgactgggaggagatactggaggtcatagagaactccacccactcccgcctgcccgtgtacgaggacagcatagacaatgtcatcggcttcctctacctcaaccacttcctgaaggccctgacggaaaacgagcggcccgacatccgctccctgctcatggagccgctctacgtctacaagacgataaagctcccgcaggtgctctcggagctgcggcacgcgaagaagcacctcgccattgtgacggacgaatacggcggcaccctgggcgtcatctccatggaggacgtactggaggagatagtcggcgacatctgggacgagacggacgaggtcgagagcgaggtcgtcgagaaggccgagggcgaatacgagctggacggcgacatgtccatctccgacttcctggagctgctcggcctgtcggaggagagcttcgactgcgaatccgacaccgtcggcggctggacgctggagcgcttcggcggcttccccggggagggggacagcttccgctacgaggacctggaggtcacggtgctggccatggacggcctgcgggtggaccgggtgctcgtaaagcgcagcgggcccgagccgggcgagactgaagaaaactga

SEQ ID NO: 1523 - DNA, 1107 bp, Unknown
  Description of Unknown: Firmicutes sequence
atgctgataaagaacggcaaggtattcctgagcgacggaaagttccacgactgcgccctgcgtttcggcgcgcaggtggaggagataggagcttttgacggcgagggctacgacgcctccggctgctatgtgatccccggccttgtggacgtccacacccacggcgccatgaaccgcgacttctcagacggtgaccccgaggccctgggcgtcgcctccaaatattacgccgagaacggcgtcacgagcttcctggccacgaccatgaccctcaaggagcaccagctcatgcccgccatggcctgcgtgaaggactccggccccctgcccggcgcgcgctgcgcgggcatacatctggaaggccccttcctctgctacaacaagcgcggtgctcagaacccggataacctccacgcgcccgacgcggatatgttcatgcgcctgaacgaggcctccggcggcgcggtacggctcatcaccgtcgcgcccgaagtggaaggcggaattgacttcattaagcgcgtttcgcccgtctgcaccgtctccgtaggccacacggaggcggattacgacaccgcaatgcgcgcctacgaggctggcgcgagccacacgacccacctcttcaacggcatgcccggcctgcaccaccgcaagcccggcgtcatcggcgcggcctttgacgcgggcgcgacggtcgagctcatctgcgacggcctgcatctgcacccggcggctgtgcgcctggcgatgcagcttttcggcagccacgcggcgctcatctcggattctctgcgctgcgccggtatgccggacggggactacgagctcggcggcctgcccataaagctcggcggcggcgttgcacgcctgctggacggcaccctcgcgggcagctgcataaacgtgggcgaggccctgcgccgcgcggtctccttcggcgtgcctctggaggccgccgtcaccgcggcaaccatcaccccggcccgctccgtccgcctggacgactgcggcgagctcgcccccggcaagcgcgcggacatcgtggtgctggacacggagctgaaggtcaaggccgtcttcgtcggcggcgagaaggtcgtcggctga

SEQ ID NO: 1524 - DNA, 1371 bp, Unknown
  Description of Unknown: Firmicutes sequence
atggcagactttgaacaatacctgaaacccggcaagcgcggccatctcattggcgcgggaggcgtctcgatggcgccgctggcggaggtgctggccggcatgggcctggtgatagacggttccgacatggcggagagcgagaaaacacgctatctgcgcagtctgggcatagacatcaagataggccactcggccatgaatgtcgcgccggatatccagttcgtcgtccgcaccgccgcggtgcatgacgacaaccctgagatagtcgaggcgcgggcgcgcggcgtgccgatcttcgagcgcgcacaggcctggggcgccatcatgcgcgactacgacaacgccctgtgcatcgccggcacccacggaaagacgacgacgacgagcatgtgtacccatatcctaatggctgcggagcgggacccgaccgtcatgataggcggcacgctgccgctgctgcacgcgggacaccgcgtcgggggcggggacaccataatccttgagagctgcgagtatcacgactccttcctctatttccgcccgaccatcgccgtcatcctggacatagaggccgaccacctggactatttctccggcctggaggacgtgaagcgctcattccgcgagtttgcctccaaagtgccggagcacggccgcatcgtcgcgaacatagacgaccgcaacacgatggacgccctcgcaccgctggggagggagctcttcaccttcggcctgacggagaaggcggacgtctacgctcgcaatatccgccgcgtcggcgcgaacagcgagttcgacatctactgccacggcaagctcttcacgagcgtgacgctgcatatcccgggcatgcacaatgttaagaacgccctggcggccaccgcggcctgcatctgcctcggcgtgcggccaaatgctgtgaaatacggcctcgctggcttcaacggcgcggggcgccggttcgagttcaagggcaagtataacggcgcggacatctacgatgactacgcccaccaccccggcgagctgaaggccctgctcgacgccgtggagccgctgggctacaagcggacgatactcgttttccagccccacacctatacgcgcaccgccgcgctctttgacgacttcatagagcagctcgtgcgcccggacgtcacctacctcgcggagatatacgccgcaagggagcacaacaccctgggtatctcctccgccgacctcgcgcggcaaatagacggctgtcacttctgcccgaagttcgagcagatagaggccgccctgagggagacggcccgccccggcgatatcatactcaccgttggcgccggagacgtgtataagataggcgaacacctggtgtgcaagtga

SEQ ID NO: 1525 - DNA, 729 bp, Unknown
  Description of Unknown: Firmicutes sequence
atggctatttctgtccggcttaaggacgttttgccgctgctggcggcgctgctgctggtgtttttcgcattcagcctgcctccgttttatgaggaggcggaacccgcctcggcacaggcggagagcgggcgcgtgctcataatagacgccggccacggcggggaggacggcggcgcgactacggctgagggcgtgccggaaagcggcataaaccttgccatagcgcagaagctggaggccctagcgggcctgtgcggcgtcgagtgcgtcatgacgcgggagagccaggaaatagcctaccccgagagcgcctccaccacggcccagcgcaagcagtcggaccagaaggcgcgcgtcgagcttataaacgctcaggaggatgctgtgctggtcagcattcatcagaacttcttcccggacacgcggccgtccggctgccaggtgctttacggcaagccggagggcagccgggaattgggcgagctggcacacaagaacctcacggaagccctctgcccccagagccgccgcgttgcagcgcccatctcggaggatatttacctcatgcgcgctgcgaagtgtacctcgatactcgtggagtgcggcttcctttcaaacccgggcgaggcggcgctgctgcaaaccgagggctatcagctcaaaatatccgccctgctgctggcatcctatctgcaatacgaggcggggcaagacggaatggtgttatga

SEQ ID NO: 1526 - DNA, 507 bp, Roseburia sp.
atggtaatgagactgatcgcagcggtagacagcaattgggcgataggcaataagggggagctgctcgtaagcatcccgcaggataagaagcagtttcaggagctgacgatgggcggtgtgatccttggcggtcgaaagacgatggagggactgccgggaggaacgacattaaagggacgaaagaatgtgatcctcacccgaaaacaggattaccggtactccgatgcggttattgttcacagcattgaagaagcactggaggagatcaaatcctatccggaggaacagatctatattatcggaggagagcagatataccgccagtttcttccatactgcgacagagcatatatcacaaagattgattatcattatgaggcggatacgcattttccgaatctcgatgaggatccggagtgggagatgacgcacatctccgacgaacagacctattatgatctcgagtattattttacgatctatcagaagaaacaaaagagcaattag

SEQ ID NO: 1527 - DNA, 441 bp, Roseburia sp.
atgcaggacgaatcattagaagccaagaagaaggcgatgtctcttttgaagtatatggatcggaccgagtggcagcttcgtgacaagctgtcgttgaagggattttccgagggagccattgaagaggcaatcgagtatgtcaagtcgtttcattatctggatgattacagatatgccgttcattttgtagagttccatcatgaacagcggagcagacagaggctgcggcaggatctgtatcagcgccatgtgccggaggagtatattgatctggcgatagagaacgtatgtgagaatgatgacgctgcgttgcagacagcgctgcgcaagctcacgcatggagagactgagttttcctatgaggagaagcagaagattgccgggaagttataccggaagggctttcgacttggagatatcaagaaggcgttggacatgtaa

SEQ ID NO: 1528 - DNA, 897 bp, Roseburia sp.
atggaaccaataaataaaaaaaatgtattttttcaatacattgaccggctgaacactcccctggaagtatttattctgcaggaaagtgatacgagtaccggtgtcggaccccactggcattattacctggaaatgctttatgtcctccacggcgagcttaaggcacagtgtgataatgatttttatatcctgcatcccggggatctgatcctgttttatccgcaggcagtccattcgatgcaccgcgcaccggattatacgggagaggttcactattttgtgatcatgatcgatctgaacttcttaaatattacaaacgagtaccgcacccgtttctccaagctgttccggatcgcctaccagcagaatcccgattatatccacttccgccgccacgaactgcaggagctgccgatcttacagcttctcacgcacagtctcgaggagaagcgccggcacgactacggctatgacgtattgatctgttcagatatcgcttcgatcctgacctacctgatgcgctgtctcaagcagaagggcgtcgataccgacacgatcattactgcgccggatgactacgatgcctcaatctattccatttccaaatatattgagcagcactgcggagagccgcttcgtgtacatgagcttgcgcagatgtgcggtatgagttactcgtattttgcgaagcttttccgggaaacctacaatcagtcctgcaaggaatatattgaatttacccgcattaacaaagcggcggatctgttgcttttcacaaaccaggatctgacgtatatcagccaggagaccggctttgccgactgcagtcacctgatccgcaccttcaaaaagtggaagggaatgacaccaaagcagtggaagaaatcgctgaaatag

SEQ ID NO: 1529 - DNA, 516 bp, Roseburia sp.
ttatacacaaataaattaagcaaagtaccaaaaacaggacagagaaggacggggaggtaccggaatatgaaaaagaacgaactagaccatattgattttgagatcttaaagatgcttcaggcaaatgccaggattccgctcaaggagatcgccgcaaaggtatatttgtcttcaccggcagtatctgcccggatcgagactctggtaaataaaggatatattgaagggtttcatgcgcagatcaatccggaggtgatgggatatcacatcaaagcgtttatcaatcttgaggtgataccgcaggataagaagaagttttatccatatattaaggagtgtaagaatgttgtggagtgcaattgtgtgaccggagattattcgatgcttctggaggtattgtttcagagcacctcggagcttgatcagtttattggcgagctccaggagtacggcaggacgaatacactgatcgtcttctcgacatcggtagagcatcgtggtgtgatcatagaataa

SEQ ID NO: 1530 - DNA, 975 bp, Roseburia sp.
atggattacttcgatacggtgataccggtgctgctttcattttcaatcagtgtcatattatgtcctattgtcattccgtttttaaagtggctgaagtttggacagtatgtcagagatgatggacccaaaagccatctgaaaaaggcaggaacgcctacaatgggcggattgatcatattgatctctgtcgttgtgacatcctcgctttatctgcgtgattatccggagatccttccggtgatctttgcgacagttgggtttggattgatcggatttctcgatgattacatcaagatcgttatgaggcgttctctgggattgcgggcatggcagaagctggtgctgcagcttctggtgacaattatttttgtgtattattacacacagcacctgcattacgagatgcagatgctgatcccgtttaccggaggaattgcatccggaagatatattgctctgccgggatggctgtttattccgtttttattttttgtcatggtgggaactgtcaacggcacaaattttacggacggactggatgggcttgcatccagcgtgacgctgcttattgctgtgttttttacggtggtcgcgatcggtacgggaagtacggttgcaccggtatgcgcagcggttgcgggagcgttgatgggatttttagtatttaatgtgtatcctgccagtgtctttatgggagacaccggctcgctggcattgggaggctttgttgcttcgacagcgcttcttctgaaaatgccgctatatatactgatcgtagggatgatttatctggtggaggttctgtcggtaatccttcaggtaggatattttaagataacccacggcagaagaatctttaaaatggcaccgatacatcatcatttcgaacagagtggatggtcggagacaaaggtagtcgctgtgttttcaatcgtgacggcgttgttttgcctgatcgcactggcggctctataa

SEQ ID NO: 1531 - DNA, 705 bp, Roseburia sp.
atgaaatatcattttctgtattttttatatagagacgcaagggaggaagcaatggaagaaaatatcaaggaatatggcaatatgatgctgcaggatgaaaagggacataagatacagatgatatccattatcggagagattgaagggcatgagagttcttcgaatacaacaaagacaacgaaatatgaacacatgctcccgatgttagcttcgctggactgtacgaagcaggtggatggtgttttgtttgtgatcaataccatcggtggagatgtatcctgtggacttgccctgtcagaaatgattgcgtccctgtcgaaaccatctgtggcacttgttatgggagacagtcattctattggcgtgccgctttctgtcgctgcagattatacggtgatcgcaccatctgcaacggtcattatccatccggtacgcatgagcggtcaggttcttggggcaccacagacgtatgaatattttcaactgattcaagatcggattacgggctttattgcagaccattccggtatggatcagaacaggctcgagagtatgatggtaaagccgggaatccttacaagggatctggggacgatccttgtgggaaagcaggcggtagagtgcggactattccaacaggtgggcgggatgcatgatgcactcaagaagctggaggagttgattgaagaagcgggaacagtgtaa

SEQ ID NO: 1532 - DNA, 876 bp, Roseburia sp.
atgtctttatggaaggcgattttactgggacttgttcagggattgacggaatttctgccggtgagcagctccggtcatcttgttttgatcaagcagcttcttcatgtggatctggaaagtggaggcttgttttttgatgtgatgcttcattttggaacattactggcgatcttcgtcgcattctggggcgatatcagccatttgatccgggaaggatttcatatactgggagacagtttttcaaatgtgggacgattttttgaaaatttaaccggaaagaaacgtccgtatcataagatagtcagaagctcgtaccgtaaatacgtgatgctgctgatcgtttcaacaatcccgaccggtctgatcggtgtgatctttaaggattatgttgagcaggccaatcagattgcactgatcccggcatgctgtctgatggtgacggctgtatttctggtgattgctgacatggtggagccgggcagcaagcggccgaagaatatttcctatggggaggcggcaatgatcggcatttcccagggcgtggcaacactgccgggagtatcccgctccggaacgacgatcacggcatgtctgctctgtggctttgacaagaagttcgcagtaaaatattcgtttattatgtcgataccggctgtacttggtgctgtagttctggaggtcaaggatctggcgacgctgacgttaacacagacggatattatctactgcattattgcgatggtcgtggcggcagtctccggttatctggcgatccgcttcatgatgggactgatccgtggaagacgttttaaatattttgcgatctactgtgccgtagtcagtgtggcatccgtgatcgcactgttgagaggataa

SEQ ID NO: 1533 - DNA, 396 bp, Roseburia sp.
atgatccatatgaaacgaagaattttgacttatttgcagcagatcgatgagctgatccaggatccgccggaagatacagactgggaccgtgccatccacaatcatctgactcagattcagtttttccagcacgaacggctgatccatctgatcgtcaccgtgcttttcgcactgatgaccacctcggttgttgtcggtcttgtcggaaccggaagcatctggcttacgcttctgctaatccctcttctgatccttctgttcccatatatcaatcactattatcttctggaaaacggtgtccagaaaatgtatgcgcagtatgaccgcatgttagaataccaaagcgacaaaaagtggaaccgcttttttgcagttccacctaaagaagaaaaataa

SEQ ID NO: 1534 - DNA, 1320 bp, Roseburia sp.
atgaacctgagaaaggaatatttaataaaaatgaacagacagacagatgttgtgatagttggaacaggtgcggcaggattattctgtgcacttaagctgccggtggagtatcagatcctgatgatcaccaaggatgacgtggatcagagcgattcctttctggcacagggcggtatgtgcatgctgcgcggcgaggaggactataacagctattttgaagatactatgaaagcaggacactatgagaataataaggcatccgtcgatgtcatgatccgttcctccaaccggatcgcagaggatctgctgggctatggtgtggattttgaacggaatggcgatgagcttgcatttacaagagagggtggtcattccagaccgcgtatcctgtttcatgaagatatcaccggcaaggagattacaagcaagcttcttgcgagagcacaggagagggacaatattacgatattggatcatacgatgatgctcgatatcattgacggagaaaacggctgcgagggacttgtgatccgcgaggcggacggcagcctcggcacggtacaggcgggctatacggttctggcgtgcggaggtcttggcggactgtatcagcactcgacgaattttcggcatatcacgggagatgcgctggcgatcgcaattcgtcacgggattgagatggagcatatcgattatattcagatccacccgacgacattatattcggagaaaccgggacgacgttttctgatctctgagtctgtgagaggcgagggggcgatccttctgaataagaacggagagcggtttgtggatgagcttttgccgagagatgttgttacggcggcaatccataagcagatggcggaggatgatatgccgtatgtgagactttcgctggagcgtattccggaggaggagatccgcagtcattttccgaatatttgccagagatgtctggaggaaggctatgatgtaacgaaggagccggttcctgtagtgccggcacagcattatttcatgggaggtatcaaagttaatctttcgagcagaacctccatggatcggttgtacgccgtcggggagacctcctgcaacggtgttcacggagcaaaccgtctggcaagcaattccctgcttgagtcgatggtatttgcagaccgctgtgcgagtgagatcacgtcgtctgagcttccggtggcaaaggatgttacggaccgtgttgactggagcctgtatcagaatttggagcagttaaaggaacaatacaagaacattgttttagaggaaatagaaaaggagaaaaagagacatgagtga

SEQ ID NO: 1535 - DNA, 921 bp, Roseburia sp.
atgctgaagatacatcaggtatcaaaaatctatcagaggaaatatttgctggaggatctgaatctggaggtggcaaatggtgagatatttggcgtgatcggtgcacacggcgccgggaagacaacactttgccggatggttgcggggcttattccgtttgagggaggagaaatcctggcgggaaccccggaggtgcggatcgacggagagggtgctgcggggctggtcggctatgtccctgcagagtttggaagatatcgtgatatgaccgtggcggagtatctggaatattatggcggattgtatggaatatccggataccggatcgaccagcgaatgcaggaattgcttccggcgtacagaatggacgggatggaggtggtgccggtggcggaactggcaccacacgaaaagaaacagctggccttagtgagatgcatgctgagagaaccggatgtacttgttttggatgatttctatcatggcattgacgcagggaagagaccggtgttggatgaactgcttcatctgcttcaggatacagggaaagccgttctggttacctctgccggtttctcgcctctggcggggagtggtgcgtttctgggaattctccagaatggggcaattgccgtgcagggatcgttagaggaaatctcggaacagatcaatcagacgaatcctctggagcttctggtggcagaaaactgtgccggagccgtagaggtgctgaagcaggaggagacggtgacaaggatctcgattgatggcggcaggattctcgcgggctttcggggaacgcaggaggatcagacaaggatattgcggcgtcttgtggaaaatgatgtcgaactgatctcgtttcagcgaaggaaaagcgatctggagacggccttctggaaaatgacagaggagaactga

SEQ ID NO: 1536 - DNA, 723 bp, Roseburia sp.
atgaaagaacagctttataccatcccggtaaatgatgcgttcgccgtagactgtgaatgtccggtctgctccatgtacgattccctggagaaggatgcgattgaatttaccatgggaccaagctatatggaagatgacatccgtatggagaccaacaagatcggcttttgtacccaccatgtgaaacagctttacaagcatcagaaccgtctcggtcttgctctgatccttcacacacacatgcagcgcaccaaccgcgatctggaggatctgctttcttctgacaagccggtcaagaaagggctgtttgccaagaagacagagaatgcttccccggtcacggaatatatcgagaatctgaatcattcctgttatatctgcaatcggatcgaccggatctttgccagatatctggcaaccatctatcactgctatgagcatgacgaggagttccgccggaagtttgctgcttcaaagggcttttgcacgaagcatttcggtatgctttacgagggtgcaccgtcaagtctttccggcaagcgcctaccggagtttatcaagactctgaatgaggtttatctgaccaacatgaaacgtgttacggatgatcttgagtggtttaccgacaagtttgactaccgcaacgaggacaaaccatggaagaactccaaggacgcactgccccgcagtatgaataaaacgaacagtgtgcttccacagtaa

SEQ ID NO: 1537 - DNA, 585 bp, Roseburia sp.
atgggattggagaatacgttttttgcaattgtcacacgaatgaagtttatcagccgatggtctgtgatgcgtaattcctacacgcagaatgatagtgagcattcgatggaggtggcgatgatcgcccatgcgcttgccatcataggcaataagagacttggaagggactatcatccggagcggatcgccgtgatggggctgtatcatgattttacagagatcatcaccggcgatctgccaacaccggtcaagtaccgcaatgataagatcaagtcagctttcaaggagatcgaggaggaggctgctcaggagcttttggagcgtttgccggaggatttgcgcggagagtatgccccttatctgcaggaatctgagtggacaccggaggagtacaagttagtcaaggctgctgataaactgtcggcactgatcaagtgcattgaggagcagaaggcaggcaatcaggagtttcagaaggcgaaggaggcgtcagaggcatatctgagggatatgaactgtccggaagcagatattttctgtcaggaatttctgccgcattattataagactttggacgaattgtag

SEQ ID NO: 1538 - DNA, 1035 bp, Roseburia sp.
gtgttggctttgagccgcgagaggaattataatatcgaattattgcgggtcatttcctgtttattggttgtctgtattcatgtatcaaatgtatatagcagagggtacggagaggtttccggcggaacttatctgttttctcttatgacgaactgcttcagccgtgtggcagttcccatcttttttatgatcagtggctaccttctgctggacgaaaatgtcagtctgcgtaagagcgtacacagggtagttcatacgatcgttgtacttgttttctggagtgttctgtactatttttggaacattgtatattggggtgaccggtatgactttaaaactctgtttgaggatccggtcaagaaacatctgtggtttttatatgcgattctggggatgtatattgcactgccgtttttccagcttctgtttaaaaagatgtccaggcgcctgatggagtacttcttccttttgtgggtgttttttctgacactttattatgttctggcaatggcagacatggaatttacatatatggtaccaatggtaggtaattccagctatctcggttattttgttctgggatatattatgcggaagttcagtaaatactataagttggggacgaaaacctgcttcggaattgttctgatcgtgggactgatcaatatcgggctgacctgttacggaacctttacgacaggggatcatgaagaaatatattttcagtaccgtaatcctctgatcgcgatctgttctctgggagtatttatagggatcatagagcatgggaagatcgcatttaccgaggcgcagaaatctatcatgcagatgatctcacgtcattcctttacgatatatctgtcacatattatttttctggatattgtaaaggaagaattagaaccgctcgatgtaccgggatggatcgggataccgctgtatacggttggaatttttcttgtgacctttgcgtttgccgtggcagcagataatgcatggaagcatttgcggacatatctgccggcatggatgtag

SEQ ID NO: 1539 - DNA, 585 bp, Roseburia sp.
atgcaatctttttacacaactatttgctttggagtacaagcaaatagctctgatggcagaagaaaaatcacctgcgtgaatttttcttcgcctcttcgcaacaagttgctcagaaaagaggtagttatggtattaacagaaaaagaaacggcggcattgaaggatctgcagtcacaggagaaaatctgcgcgaagaagtatgagaaatacagtcagcaggcgaaggatccggaactgaagaatctgtttgagacgattcagaaggaggagcagaagcattacgaatcgctggggcaggtgctagacggaaccgtgccggaatgcgactgcaatgacagcaatggcaaggattacacgccgaaggcaacgtatatgtccgatgataattcggaggataagatgaatgacagctttctggcgaccgactgcatcggcacggagaagctggtgtcatcggagtacaacacggatgtctttgtgtttggcgagccgggggtgcgcaagcttctggcagacattcaggtcgaggagcagaatcacgcagaaatgctctataagtataagaccgtgaaccgcatgtcatag

SEQ ID NO: 1540 - DNA, 1011 bp, Roseburia sp.
atgcatttccggttatgtgaaacggaggacaagatgagtagtgcagtaaagacgattggtgtattgacaagtggtggggatgcgcccggaatgaatgcagccattcgcgcagttgtgcgtaccggtattgcaaacggcgtaaaggtaatgggaatcaagagaggatatgcgggtcttctggatgaggaaatcgtggagatggatacgctgtccgtatccaatatcattcagcttggcggtacgattctttataccgcacgctgtaaggaattccgtgaaaaggagtatcaggagaaggcagcagagatctgccgcaagcacgggattgacggcatcgttgtaatcggtggagacggatcctttcagggagccagcaagcttgctgagttaggcatcaacaccgtcggcgttccgggaacgattgatctggatatcgcatgtaccgagtataccattggttttgatacggcgatcaacactgcgatggaggcgatggacaagctccgtgatacctcagagtcacatgaacgttgcagtattgtggaggttatgggacgtaccgcaggacacatcgcactgtggacaggtattgccagcggtgcagagtatattctgacgacagaggaatatgatggaaatatacagaagattattgagaagatacagcagcgccacaagattggcaagaagaatcatgtaattgttaatgccgagggtgttggcaattcctatgagatggcaaagatcattgaggcagctacaggtgttgagacacgagcaaccgtcctgggtcatatccagcgtggcggtaatccgacctgtaaggatcgtgtatatgcatctgcaatgggtgcaaaggcagtggagcttctctgtgagggtaagacaaaccgtgtcgtaggttatacgaacggagagtttgtagattatgatattcaggcagcactggcgatggagaagggactggatccatatctgttccatatcaccagaaagctgaccacgtattaa

SEQ ID NO: 1541 - DNA, 267 bp, Roseburia sp.
ggtgcggttattgatatgtataccaatgtatgtaagcattgccataaggtttttcattccaagatacggaccttgtgctgtaaggactgccgtgcggaggatgaagatcagttagatgatattgtaaagtatctgaaggaatatcccaacagcaatgcacttcagatctccgaggagctcggaattcatccttatgtgatcctcaagttcatggaagagggctggctgggagagtcgacggggagctttgagaagctgccggattga

SEQ ID NO: 1542 - DNA, 903 bp, Roseburia sp.
gtgagtacattatggtatggcttgaaacagggcataaaaagtatcatacaaaataaaatattttcgctggcggcgatcggtaccattacggcgtgtctgttcctgctgggcgtattctattcattgttgaccaattttcaacatatggtttataatgcggagagtacggtaggaatcatcgtattctttgatgaaaatgcaacgcaggcgcagatcagcagtatcggtcagcagatcaaagcacgcaaggaggttgaacgtgtcgactatgtttctgcagacgaggcgtggaaccggtttaagtcagagattttggaggatcagcaggaaatggtcagcgtattcggcaatgacaatccgttagctaattcctcctcctatgaggtttatttgaaggatgtcacgaagcagtcggagatggtatcgtttattgagagcctgagcggtgtgcgtaaggtcaacagtgcacaggaggcagcaaccggcttcggaagctttaatatgctggtcggttatgtgtccgtttccatcattctgctgttgatcctcgtatcggtattcctgatctattctgcggtggatatgggtatcaatgtacgaaaggatgagatcgcgatcatgaagctgatcggtgcgacggatctgtttgtgcgtcttccgtttatcgtggagggaattaccatggggattatcggagcggcaattccgctggtgatcaccggcgtgttatatgataatgtggtacgatttatcgtttctcacttctcggtactttccggatggctggcatttgtcagtacagaagaagtgttccgtgtactaattccattgtgccttggcattggagtaggcattggtgtgatcggaagtacgatgtcggtaagaaagcatcttcatgtatag

SEQ ID NO: 1543 - DNA, 1017 bp, Roseburia sp.
aagatgaacaacaaacattcaaaaaattccagaaccctgagcatgtatgtccgtctttgcgccggaaagcggatcaataaggcggaggaagccaatcgatttggcgtggatgagcggtcgatccaacgcgacattgatgatatccgggcatttctggaggatcagaaagcggaaagcacggcagagtcacgggagatcgtgtacgacaggatacataaaggtttcgtgatgaccgggacggacggttccgccatgagcaacagcgaaatacttgccgtgagtaagatccttttagagagccgggcgtttggcaaaaaggagatggaagcactgctcaataagctggtggaaggctgtgtgccactgcgcaatatgaagctggtatctgacctgatcgccaatgagaagtaccattatgtggagcttacccatccgatccggaatccggacattttgtggaagctcggtgaggcggtccggggctgtaaccggcttgagatccactatcagaagcaggatgcggtacaggagaatgtgaagcgtgtcattgaacctgtcgggattattttctccgagtattatttttatctgaatgcattcatcgtcgaaaagaatgcggccggaagatatgagcacaagtacagttatccagcaatattccggatcgatcggatcgtcaaatgccgggaaatgggtgagaagttcaaattgccgtataatgggagatttgaggagggagagtttcgtaaaagagttcagtttatgtacagcggtgaactgatgcgggtgaaatttctgttttttggaaggaatgcagaggcagtgttagaccgcctgcctacagcaaaaatcgtgtccggtcaggacggtgcctgtgaaatagaagcggaagtgtacggaaaaggcatcctgatgtggctgctcagtcagggggaacaggtggagattctgagaccggagtggctgcgggaggagatgggacaaaagcttggaaaaatgcaggagagatatcagtag

SEQ ID NO: 1544 - DNA, 723 bp, Roseburia sp.
atggtcaatcggaatggtttgatgaaaaggcggtgggagcaggcttcctatacggttgaagcggcctttgtggtgccgcttggatttctggtgttgatgtctcttagttgtctgtttaccggtgcggtaaagcagaataatgtccagatggcgcttttgaagacggttcaggcatatggaatgacacagagcaggacatcagcgctgcagggaatagcagatcagaaggtgctgatccgttgggaggagcagggaggagaagagtttgtctgtaccgattattatcagagaattccgtttcttggctcacgattgtttggactgcaccggtaccagcagatggcagcggttgattattccggtcttagcatggtttcggatgaggagggagattattttgtttatatcgcagagaatggacgggtataccatatggaccgcgagtgtacttatctgcgaccgaggatcaggcaggatacggtgttcgtattgaaaagaaaacggaaccagtcaggtggaatttattatccgtgtgagagctgttgccggtcggaaacgcagccggcaggaatgcatgtttactatgcttcatacggggaacggtatcatattcgggaagattgtcccaaattaaagagaaccgtccggtcagttcgccggtcgaaggcgggcagtctgccgccttgcagcaaatgtgggaatagaaaggaaacaacagagtga

SEQ ID NO: 1545 - DNA, 1038 bp, Roseburia sp.
atgaataaaccaggcagaacacaccatatcagaaaccggatcatcacagtcattttgatccttgcagcagcattctgctttggatttgtccagtggaattcccgcatacattactattccgatgagtatacaaccggcaatactagcactaatctgttaaacggtggtctgtttgccgagtccggggacacgatctatttcgccaatccctatgatcagaactcgctctattccatggataagaagctctcccatgttaagaagcttcacgatgactataccagctacatcaatgcagcaggcagatatatcttttatacaagacgtaatgacaagaagggcactgattcacaggcacttttttccttcagcactaccggcttataccggatcaacagcaacggtcagggcttaaagcagctttaccgggaaccatcccagtcgttaagtctgcttggcaatcatatcttttatcagcattatgaccgcaagctcggtctgcagcttttccgcatcggcatcgatggcaagaaagacaccatgatactgaaggagggtgcatcaccggtgatcgctgatgacacgatctactataccgggcttgacagtgatcacagcatccacagcatttctaccgatggaggaagtgcccgggtcatctatgagggcaacttcaccggtctgtcctttgtcaaaggctttctttattgtatggatatggacaacgattacacgctgtgccggctggatctttccaccggcgaaatgacacatctgacacaggttcgcatcgccacctataatatcagccgggacggtgctacagtatattatcagattgacaatggcagtgataatggtttatatgccctggataccaaatcaggagcgcaaacccagttacgctccggcaattttaattatctgcatattattgatcactatctgttctttgaaaactttgacgggagtaccgcctatgtgatgaatcttgccaatgaacagatcgaagaatttcatccaaagactgcaaagtaa

SEQ ID NO: 1546 - DNA, 927 bp, Roseburia sp.
atgtcctcgttttttactgtcagaccgacagattttatgggaaggagtggttggatggacatcaataaatacattctttttgctgacgtggcggcgacaaagaatttcacgaaaagcggggagcgtatgggctacacgcagcccggtgtcagccatgtgttaaaggcgatggagcgggagcttggctttcctctgtttctgcgcacgccgaagggggttacgctgacctccaacgcggagacgatcctgccgcttgtgcgcgaattgctggcggttaatgagcagctcacgcagacggtcagcaacattaacggacttgaaaccggtcatctctgtattgctacatttgccagtatttccagaagctggctgccacaggtcatctttgcgttcaaacagaaatatccgggtattgagatcgagctgctggagggcggcacggatgatattgtcgggtgggtcgagaacagtcaggcggatctcggactgctcagcaaaaagcatgccagttctctgcgctggacgccgctttacgaggatgcacttatggcgattctgccaaaggattatccggtcaatggcagggaggcgattccgatgaaggagattgagaagtggccgtttatcatttcggcggagggcgtggattatgatgttcacaacgccatccagaaggcggggatcacgcccgacatccgctacacctcgacagatgatcataccgttatctccatggtatccaataatctcggcgtcagtattcttccgaatcttgtgattggcacggcgcaaagcaagatccttgcgttgccgctggaaccgtatttttccagagagcttggaatcggtgcgcgtgcggattccgggttgtcgccggcggcgagaagatttgcgcagacgatcaaggagacattacaaataccgtaa

SEQ ID NO: 1547 - DNA, 1194 bp, Roseburia sp.
atggaaagtgatatggcaagagtgcaaaatggcagacgggagcaaacctcccgcagaaacagcactgcaggtgaaagaaagaaaagagaacgctattaccgccagtatgattatatgcttttgttcatgacggtggcgatcgcgctgtttggtattctgatgatctacagtgccagctcctacacggcatcaaccagccgttttggagatccgtttcgtttcgtgtcccagcagctgagaggactgattcttggtgtggcagcgatgctgatcatatctaatctggattacagagagctttatctggggaagatcaactggatctatattttctatgggctctgtattgcgatgcaggttgcggtgctgatcccggggatcggaattgagcataacggtgcgagacgatggctgaagatcggtgtagagttccagccttcagagtttaccaagatcggtgtgatcctgtttgtggcatatgcgatctatcagtccagacgttcgatggatacttttacaggctttttaaagctgatcggcgtttatgtcttaccggtggttggacttatcgcggcggagaatctgagtacggcgatcatcgtcggtgttattgctgttggaatgtgttttgtggcgagcaaacgtaagaaatacttcattgtctgtggtattgtcggagttgcggcggctgcggcgtatgctatgatcggcggaggtttccgtgccggtcgaatcacatcgtggcttgacatcgaaaattcgccgggaggctttcagatccttcagggcttatatgcgatcgcatccggcgggatccatggaagcggactcggagagagtatgcagaagctcggttatattccggaggcatataatgatatgatctttgcggttatttgcgaggagcttggcatcgtgggtgctgtcatggtgatgggagcatttctggtgcttttgtggcgtatcgtcatgatctcctgtaatgcaccggatattttcggaagcatggtctgtgccggttccatgatacatattgcgatccaggtgctttttaatatcgcggtcgtaaccaacacgatcccgtccaccggtgtaccgctgccgctgatcagctacggtggcactgcctgtgcgatcatgatgttagagcttggactggtgcttggcgtctcaagacagatcaagctgaaatag

SEQ ID NO: 1548 - DNA, 1431 bp, Roseburia sp.
atggaaaaagaaatgaaaaattacgacccttataaaaggacgatcttattttttgcatccttggtcaatattatattaatgacagcaatttttgcgtatgcctggtatggttactatgcatcgaccatgtaccagctgaccttctaccgcaaaggacattatgcactgcttgctttgtatgcgctgctgatgttcttcttttcgaccatgtacggcggactcaagatcggtcagcttcgcaggatcgaggtgatgctgtctcagtatctgagtcttttgtttacgaatatagtagcatatatggtgatctgccttctggcgtttggctttgtaaatccggggcagctttgcctggtatttctggtagagatgatcgtttctacaatatggaatgtgatcattatctatttttataaccgtattttccagccatggaagatcctgctgatctacggggaacgtccggccgccgatctggtgtataaggtggaggcaagaagagacaagtatgcgatctacgatgcgatcaatgtggatgagggcattgatgcgatcgccgagaagatgaagtcgtttcaggcggtgatcatcggtgatatttctgccatcaagcgaaatgatattctgaaatactgctatgcgcataagatccgtgcatatgtgattccgaaggtgtctgatattattctgatgggagcggaccggatccatgtatttgatacaccgtttcttttgtcgaagggatatacgttaagctttgaccagcgttttgccaagagagcacttgatctggtcattgccgtaccgcttacggtacttttatcgccggtgatgctgctgacggctcttgcaatcaagctgtatgacagaggaccggtattttacaggcaggtgcgctgcaccaagaacaaccgggagtttgagatcatcaagttccgcagtatgatcgtcaatgcagagagcgacggcgtggcgaagttagcctcagagaatgacagccgtatcacaccggtcgggcattttatccgcgctacacgtattgatgagctgccgcagctgtttaatatcattcgtggggatatgtcctttgtgggaccaagaccggagcggccggagatcattaaagaatactgtgagaatatgccggaatttgcgttccgtaccagagtgaaggcgggactcaccggatttgctcaggtctacggcaaatataatacaactccttacgataagctgaagctggatcttttctatattgagaattactccttctggatggatctcaagctgatcctgatgaccgtgaaaacagtcctgaaaaaggacgctacggagggcattgccgagggacaggtgacagcgcagaaggatgtggcggatcaggatccggaatcagtcgaagaaattgtgaaggaaatcgtgaaaaagtag

SEQ ID NO: 1549 - DNA, 321 bp, Roseburia sp.
gtggaaaagaaaaaatatgaaaaatatcatttaggatctctgtcggaatgtctggaggagagggctgttttactggcacagtatatgattgagcataaagcgactgtccgtcagacagcgtctgtattcggggtcagcaaaagcacggtacataaggatctgacggaaaagcttccggtgatcaatcatgcattggcggcgcaggtgcgtcaggtgcttgatatcaataagtccgagcgtcatattcgtggcggactggcgactaaggagaaatatcttctgaaagaaaaagaacaggagaaattccgaaatgcatattaa

SEQ ID NO: 1550 - DNA, 798 bp, Roseburia sp.
atgcggaaatggaaaagaagaaagaaacgaagacttgtgctgacggtgcttctggtgatcggggggctccgtctgctgacgtggaacggcggtgccggaaatgttttgaagaacggaatggaggcggtttcggagcggatttctcggggacaggatcagtttctgaaaaacgaagacggaacttatccggatcaactggtggagcttgcaaaaaagaacagggagacaagacagtttgtgaaggattatcctgaaaatgccggcaaaaagcagaagattaagctgaccgacgaggatctgaaggggaatcagggaagcagcgtgccgttgcttgttcagtgggatgagcgatggggttaccggaagtacggtaatgattttatggcgctgaccggatgtggtcctacgtgtcttgcgatggttgcggaaagtcgaggagagacaaaatggaatccgtggagggtggcgaaaatggcgcaaaggaatggttattatgtggatggtcagggctcggcatggtcgctgatgacggaaggtgcggcaaagatgggcttaaacggtacagagatgtcctgtgatgcggaaacgatccggcggacgctggaggacgggcatgtgatcatttgtgccatgcgtccgggggactttacaacagcaggacattttctggtgcttgccggtgtgacgcaggatggcgaggtgatcatcaacgacccgaacagcagaaagaacagtcggagaacgtgggatctggaacgggttgtgccgcagatcaaaaacctgtggaagtattcctga

SEQ ID NO: 1551 - DNA, 726 bp, Unknown
  Description of Unknown: Rhodospirillales sequence
atgacttttgaaaatatcataaagagggtgagccaggtgttggccgcggcgtttatgttcttgatggccgacggtttctatctgtcgcagaagggattcaactgggtggacggcagtctggtgctggtcaaaccggcggaagcgtcggtgccggcggccgccggcggcgtggtgcccagccgttttgaaatgaatgccgtgcatgtgctcggcagcgcggacgcgccggtgacgatttacgagttttcgtcgctcggttgttcccattgcgccgattttcatctgaacatgctgcccgagctgaagaaggattatatcgacagcggcaaggtcaagctggtgtttgccgatttcccgatcgacgccaagtcgatgaaaggggcgatgctggcccgttgcatgcctgccgacaaatattttgattttttgagcctgctgtttaaaaaacagctgacctgggggctttcctttaaaaccgaaaagctgctgaccagttatgccgaactggagggactttccgccgaaaaggcgaaagcctgcatggaagacgacgacgcggccaaggaaattatgtcggttcgtcaggacgcgatggaaaagctgcaaattcagggaacgccgtccttcctgatcaggagtgacctcggcgaagaagttttgcccggggttcccgattatgaaaaactgaaagaagtgctgaataaatatctcggcgttaacaagtaa

SEQ ID NO: 1552 - DNA, 648 bp, Unknown
  Description of Unknown: Rhodospirillales sequence
atgaagtacaaatatgcggtgtttgactgggacggcactctggcggacacttatccggtgatttcggcggcgtacgactatactttcgataaaatggggctgctgcggattccctatgacgaaatcaaacggatcaccagcaccctgcagaacaaagacaccctcggatacgttttcaaagagcggcgggacgaggcggcagggtatttttacgaatatatcgaaaaatttcataccgaccggctggcgccgatgttcggtgcggaaaagctgctcggcttctgccgcgacaaagggcttgaatgttatctgattaccaacaaaaaaacgcgctttatcaaagaagagctggaaaagctcgggttcggcaaatattttaaaaaagtggtggcggccggcgaatatgcggaagacaagccgcatcccctggcctgtcacgcggtgtttgacaaccggctgccgccggccggcgaaatcgtggtcatcggcgacggcgaagccgacgttaaaaccgcggcggcttttgagcatgacggcgaacgggccgaatgcatcatttacgatcccaaacgcaaataccgcggtcccgaaccggaccataagatagaaagtctgattgaagcggcggcaattttggagaaagaataa

SEQ ID NO: 1553 - DNA, 477 bp, Unknown
  Description of Unknown: Rhodospirillales sequence
aaattattaacatttatacatatgaaaaagaagataaagttcaaaagactttggatttcggtcattggctggattctggtcggaggttttgtcaataacctcttcgttgctccgttcaccgaaatttctttggtagagtggaacggtctgatcacttctctcggcattttgctcggtatcagcggtacccgcgattatttcctgaaaaattctctggacaagcttccggagaacaggtcgggcaaaggctggcagagaatgtggatcccttgcgtgggctgggctttggccggcggttttttcatcaactgcatcatagcgccttatcttgaccttcgtgtcaatgactggtcgcagctgattaccgccttaacggttattctcggcatcagcggcgcgcgcgacgtcggtctgcgcaggctgccgaaaaatcgggaaactccggcggctaaggaggaaacgaaagaagaggaataa

SEQ ID NO: 1554 - DNA, 495 bp, Unknown
  Description of Unknown: Rhodospirillales sequence
ttctcaaacaaacaacaacaaacatgccgggagcagacattgtccgcatttgaacagacattcagacaaaaaggcatcagtctcacttcgtcgcggctggccattttcgaggtgcttgaaaacgcctccgcacacatgaccgtcaccgacattttcaacgccgccagacaaaaggatcccggtctcggcatggcaaccgtttatcgtaccctcaacatgctctgcgacctggggttggcggaaaaacacgagtttcccaacattgacgcggtttatgaaaaaaccggcgccggaaacgggcatcaccaccatatcatagacgcagacagcggccggatagaagagttttccgccgccgaactcgacgttctgctggaaaaaatcgcccgcgaacacggctatgaaatgctcggccacaaaattgaaatttacggaaagaaaaaaggaagaaacgcagcaaccggcgttgccggcggcaaaaaacaaactatatag

SEQ ID NO: 1555 - DNA, 765 bp, Unknown
  Description of Unknown: Rhodospirillales sequence
ttacgtgtctattttgaggagaaacctatgtttaaagaaaaagttgatttgcaaaagaactataccgacgtcggggtggaaagaaccgccgtcgatgacggtttgcgcgcctatctggtcagcgtttacaatcatatggccggcgcgctggcggttaccgccgcggtcgctttcctggtcgccaacacttcgctgatcaccatgatgttcaacccgcagaccggcggcatgtcggttctcggctggctgtttctgttgtcgcctttgattgtcattttcggtttcaactgggttctgaccagcggaactctagcgcaggtgcgcggcgtgttctggctctattcggctctgatgggcgcgtctttggcgccgatctttctggtttataccagcgccagcatggttcgcgtctttctgattacggcggcgatgttcggcgccatgagcatttacggcacggtgaccaaacgcgacctgacctcaatgggcgcctttctcagaatgggtctgtggggcattatcattgccgcggtggttaacctgtttatgcagagtccggctctttattatgttctgtcgatcgtttccgtcgtcgtcttcaccggtctgaccgcttacgacacgcagaaaatccgtcagatctatatgtcggccgacaacgacgatacgatgacccgtaaggttgtcgtcggcgctttggaactgtatcttgattttatcaacctgttcctggctttgctgcgtttgatgggcgaccgcaaataa

SEQ ID NO: 1556 - DNA, 297 bp, Unknown
  Description of Unknown: Rhodospirillales sequence
atggaagggagcctgaagctcccttttacttttacggaggaatatatggactgggggctggtaagcggcggagcggcaatgctcggcgtgttgtataattttatcaggatcggggaatggaaagcccggcaggaaacgcggctggacggactggaaaagcggcaggacggttatgacggccgggttgaaggcctgattttgctgatcaacaagcaaaatgaactgctgacggaattgaaggttaaactggatctgatgctggcggacaaaaaccggaggaaaagaaaagatgactga

SEQ ID NO: 1557 - DNA, 513 bp, Unknown
  Description of Unknown: Rhodospirillales sequence
atgaaggtttatgaggaaaatcaaatgaaaaagttcaaaaaaatgatgtatctcaaactggcgcgcgctttcggccgcagcaacaactgccggcaggtgccgacgattatcggcgaaaccaccaaggtttgcggcgacatcaacagcaacggcattcttcatgtcgacggctatatcgaaggcgacatcaactgcgaagaactggtgatcggggttaaagggaacattctcggcacggtgaaggcgcagagcatgtttttgtacggcactttgcagggcaaagcgacagccgacagcctgtttattgccaatacggcaaaactgatcggcgacgccactcataatacgatcgcgattgagccgggcgcttatattgacggacattgcatccgggtgcagaacaagccggcagccgagcctgccgcgtcggaagcgccgaaaacggctgccgcgccgcagccgacggtggtggccgcgccgaaggtgattgccaaaatcaaggcagtcaaatag

SEQ ID NO: 1558 - DNA, 903 bp, Unknown
  Description of Unknown: Rhodospirillales sequence
atgctttggatcatcgacgggctgatttacggcttttttacggctgtttataccattttcaaccagcactacaagctgaacgcttacctgctgggcatgtggcgcggctggggaatcgccttctgttttgccccgtttctttactttctgggttttccgtcttccgcttactactggtttctgctcatcatgcagggactgatgattgccgtttacgattctcatttgttttttgcctccgcacggtacggcgccggtcccacttcccgggtcatggcgctgacggccatggttaccacccttttctggtggtttctgacgccggaaagttttctcaaactgcttgacaacggcactttggtcatcaccattatcctgctgctgttcggtttcaccgtctgttattggcagatgatcaaatccccggtttcccaagagcttgtcaactatatgattcccgccatcctgtcgctttccggcatgagcatcgccaccagggaaatcgcctctttcggcaccaccgcctggagcggcatcacctattatctgacaattgccgttttcgtcagcggcagcgtcaacgcctgttggtatgtccgaagcgtcaagcccggtttttccggtttcttccgccaggttttctcgccgcgtatgatcaggatcggtttctacgtcgtcagtttcagcgcggcgctcatcaccgccaaaaacctggcgctgagaacggcccccaaccccggctatgtcatcgccctgcttctcacctcgccgcttttcgttttcggcctcaacaaatacaacaaaatccccgatgacatttcaatcagggaaggctttctgatgatcgcctttctggcggcgctgatgatcctcgtcaccggcaatttcggcgtcaacgattga

SEQ ID NO: 1559 - DNA, 606 bp, Unknown
  Description of Unknown: Rhodospirillales sequence
catttttttctccttcggttacctgaattttaccttttgtttatcatatatgggtatcattacgccaattgtgataaaaaagcattaatgaggacaaaagagatgaaaacatttttaagcgccgtgctggccgtttgtctgtttgcccttcccgtttccgcgcaaaacggggacgacggcgattcgggccgcagtctgccgcggatggcctcactgcgttccaaactggtcaacgcccgttccggtcccggttcccgctacccgatcgaatgggtatacaaacaaaagaacgcaccggtcgaaatcattgccgaatttgacctgtggcgccagatacgcgactgggaaggctcggaaacctgggtctacaagccgatgttaagcagccagcgctggatcaaaatgaccaacaaaggcaccagcagcatctacgccaagccggaacacgccgccaaagtgattgccaaagtcgaagaccaggtgatcggcaaggtggaaaaatgtccggaagacaaggatttttgcctgatcaaattcgcctcaatcgaaggctgggttcaaaggggggactttttcggagtttatcccggagaaacgattaactga

SEQ ID NO: 1560 - DNA, 735 bp, Unknown
  Description of Unknown: Rhodospirillales sequence
atgagtattagcaaaaaagttttcggtttggctctcggggccgtgttggcaaccaatgtcggttcggcggcggcgcagcaggccgcttccgccgatgacgacaaggcggaagaattgttgtttaagattcatgacattacgccggttgaaaaccgtgaaggggaagtgatcgcctgcgatttcaacaccactttctataaccgttcgggctataacctcaaagaggccatgcttgattttacctggaaagacacttcgcttgaagacgtgatcaaacaagagaaggaagaagacgcggaaaaacagaaccgcaatgccaaccgcgcctattcggaaacggaaagacgcacttcaaaagacgtgaacatcatgattgaagtgccggcaatcaaaccttataagcaggttacggtcaacaaccgtatcaacacggatcgttgttttctgctgatcgaaaaagtcgatttttccgttaagtcctgttcggcggaaggtttgtccggcggccgttccgcccgcagcgcttccaggagaagtccctgcagccggttgtttaaatatgtttctcccgaagacgcgcagtattaccttgactttaaggaaataaccccggatgaggaaaacagccgcgaagaggcagaaaaacaggaaagcaaagacgaagtcgccggcacctatgccaaaacgattgacgctctgaattctgccggcagcattatcggcggaatcaaataa

SEQ ID NO: 1561 - DNA, 1176 bp, Unknown
  Description of Unknown: Rhodospirillales sequence
gtgaaggattatattaagaaaatgtcgaaaggtaaagaacaaaaaccggttattctgcaagtgctgccggaacttgaccacggcggggtggaagtcgggacggtgcaaatcgccgacgccctccggcaacacggcatcaaaaacttcgtcgcttccgccggcggacgcatggtgcgcgaattggaaaaaatcaaagtgcctcattttacgctgccgctgaaaaccaaaaatccgatcaagctttacctcaattcgctgaagctggaaaaaatcattaaggaaaacggcatcaacattgtgcatgcccgttcccgcgcgccggcctggagcgcctattgggcggccaaacgcgccggcgtcaaattcatcaccactttccacggcacttacggactggggccgaagggaatcaagaaattctacaaccgggtgatgacctacggacagctggtcattgccatttctaaccacatcaaaaaacacatcacggaaaattaccggatcaacgaagacaagatccgccttatccaccgctgcgtcgacattgaaaagttttcgccggcggcggtttctcaggagcgcattatccgcgctgtgcaggaaaacggcatcccggaagatctgccggtaatttcgctgatcggacggattacccgctggaaaggccagcatgtgctgctcgaagccctttccaaactgaaagaccgcgactttttctgcctcatcgtcggttccgaccaggggcgcgtcaaatataccgaagaactgaaagaactggtgaaaaaatacgggcttgaaagcaaagtcaaattcatcggccagagctttgacattcccgcgctgctgatggtttccgacatcgtgctgtcgaccgccgtcgagccggaagctttcggccgcgccgccatcgaaggtcaggcgatgggcaaaatcgtgattgcctcaaacctcggcggttcgctcgaaaacaccattgacggcgtgaccggcaagctttacgaaagcagcgacccgcaggctctggccgacgcaatccgctgggcgcttgacctgcctttggaagaaaagaaaaaaatttccgccgccgcaatcaaaaacgtaaaagaaaattttacaaagcagataatgtgtgataaaacgatagcggtttacaatgaactgatcaacatggattaa

SEQ ID NO: 1562 - DNA, 537 bp, Unknown
  Description of Unknown: Rhodospirillales sequence
atgaagcgcatgaaagaatattttacttacgaggaaccgtcggcgttcgtttccgtgtccaatacgccgccgcgcctttttcgtcaggaacgggattggacctgcagcgttgcctgcatccgcaccctgttgtcggggcggaccgcggaggttccttccgaaaacgaatttatcgaaaagttcggtcttgtgcccgggcctcattatacggacgaatttctggccaagggaatgctgtcgccggccagaaccgtcaaaacgcacaagaactttcggccggaggagatcgggctgccgcttctggcaaaactgctggcggaaaagtattacataatggcggaatgcatgtacaattacgcccattgggtcgtcgtgctcggttattttgccgtccgcgatccggaagacaccgaagaacaccggattttgctttatgatccctattacgaccaggtacggctggtgattgccgacgaatttctgaccatgtggtgcgatcccgacgggcatgtcaaagaatttgtggcaattcgctga

SEQ ID NO: 1563 - DNA, 573 bp, Unknown
  Description of Unknown: Rhodospirillales sequence
aatgcaaaaattttccggcggctcttgattctgccttttggccaccctacctgttttaacagaaggatgattgatcaaacaaggaggtttaaaatgtctgattcattggtcagccgcaaagaacacggtcatcatgccccgctgcgctgcggctttaacaaagattttaacgatctgctcaacggctttttcggcaactggctcgatttgccggaagaaaagaactttattgccaagaacgaaccgaaaatagaagtccgcgaaaacgaaaaagaagtaacggtacgcgccgaaatgccgggtatgaaggaagaagacattgatctggaactgtcttccgacgggtatctgacaatttccggcgaaaaaaagcaggaacaccgggaagaacacaaaggaagttatttttcggaaatttcctacggcactttcagccgtacggttccgctaccctgggaactgaaatttgacgacgccaaagccgattttgaaaacggcgtgctcaccgttacggttcccaaatcttccgacgaacagggcaaaaagcgcaaaattgccatcaaccgcaaataa

SEQ ID NO: 1564 - DNA, 846 bp, Unknown
  Description of Unknown: Rhodospirillales sequence
atggcttttactttttttacgctcggcggacggcagttttgggaagatatatacgtctatcaaaaatggcggattcagcggaattgcattacaaaacactatcgtctgctcgacaactgggacattcgtcgtgccggcggaagttttgaacaatgcagcagggcactgacccgctgtgccgaaatcttccagctgacgccgccgaaaacgaaggcggttgtcctgctgcacgaactggcgggaaacaaaaaccagtttaatcaaatggttaaaatggcagaatcggcaggtttttccgccatcgccgttaattatccgtccacccgcaaagaactgcgggcacacgttcgtcagcttgaattgctgctcaacagccttgaatatgtcaaagaggtttccttcatcaccgcaggaatcggcggactgctggtcagactgttgctggctgccgattcgcaatggaagaaaaaaatcaaaaccggacgaatcgtccagattgatccgccgaatcgcggattccggttatgggaacggctgagcgacagcaaaatcgccgccctgttcctcgggccgtcgataaaaagctgcgattcgcataaggttgtcaaaattccgcgttttcccgatacgacagagttcggcatcatcaacacacacaaccggattgcggatatgctgaaagattcgcttcccgaccgttggagaatcttttttccgcaaatcggcgattcgtttctgccgggcgcaaagggcatgattgatatcaaaacatggaagacgaatccggcggcggacgacaagacgattcgcgcctgtaaaaattttttgctgaacgggaaattttga

SEQ ID NO: 1565 - DNA, 921 bp, Unknown
  Description of Unknown: Rhodospirillales sequence
atgtttaattggtttgctcccaaagtttttaatcagggatatttgcccgaggaagacggacatcaggtgttttttatggaagccggcagcaaagacggaaagccggtgctggtttttcatggcgggccgggcggcgcttcccgccttcgtcatgcggaggctttcgaccgccgcaaattccgggtcgtcttttttgaccagcgcgggtgcggtcgttcgcagccgtcgggagaaaccgcgcacaacaccaccgccgaccttttgcacgacgccgcccgtctgctcgattttctggatataaaggaaaaggttattttgctcggcggttcctggggggcgacgctggcgcttctgtttgccgaaaaatatcccgagcgggtgaaggcactgctgctttcaaaaattttccttgctgacgaaatctccgccggctggacggatgacgtcagcggctggttttatcccgacgtgatggacaaactgcgccgcaatatgccggaaaacgcgaatctgccggaatattacgccgaaatggtcaattcccgcaatctctccgatcaggttaaggcggcttccctttacggcaattacgagcgggtgctggggcagctggtgcccgcttttgagaaaaaggaagtaactcaggacgacgttaatgcggcgaggattttcatcaactatgcggcagcgggatttatgctcaaagacgaccagattatgagcaacgtcgagcgcatcagggagctgccggcgctgatcgttcataaccggctggatatggtctgtccgctgatcggcgcctggcgcctgcataaggcgctgccggcgtccaaactggtaattgtgccggaaaaagggcatgtcggaccgttgatggcccgtactttgaagaaggaaatccgccgtttcctcaagatttaa

SEQ ID NO: 1566 - DNA, 366 bp, Unknown
  Description of Unknown: Rhodospirillales sequence
ttttatcgtacctatataatgaacactacagtatcagagaaaggaaaaaacatgcaatcgattaatgattcccagtttgaaaacgaagtcttaaacagcaaaggtctggttctggttgatttttgggcggaatggtgcggcccctgccgccaactcggtccgattctggaagaagtcggcaaagccatgggcgacaaggtcaaaatcgtcaaaatgaacgttgacgaagcgcccaacaccgccgccggctacggcatccgcagcatcccgaccatgtttctgttcaaggacggcaaacagatcgacaccaaaatcggtctgaatccgcagtcggcaatcgtttcctggatcgaagccaacagctga

SEQ ID NO: 1567 - DNA, 699 bp, Unknown
  Description of Unknown: Rhodospirillales sequence
cttatatcacaaggcaggaaaggagaaacaaacatgaacccgagttgcatttataaccggcagtccaaagccgtgcgcgccctgtggaacttcctcaccagtccgaccggagcgttccttatcgccgtttccgccattttgatcggctattaccagttttacatcagccggccgattctgaaatatacgaccgaaacgacggaaatatcttccgcgtccggcagcgacgacttcaaaatccacatcaacggcaaagattatcccaaactctacaaaaccgccgtaacgctttccaacaccggagaagacgcccttgccggcagcgacgtttcctccctcggacacgacccgattcggattccgattccgccgcgggtaaaaattctttattacggcatcaacaacgcggaaacttcaagcgacgtttcggccaaactgatcaaaaccgacaacgccattgtcattgagttcaactacctcaatccggacaaccaaatcaccgtcaacatgtacagcgaagacaattacgacaaatttgaaattctcggttccgccgtcaacgtcaaccggatcactcaggcctggagtcccgaacagacaagaaaattcatcatcgccaccatcgccggcatcattcttttctacactctgttcatttacctttacgtccgccggcacaaaccgctgccgcggatttaa

SEQ ID NO: 1568 - DNA, 864 bp, Unknown
  Description of Unknown: Rhodospirillales sequence
atgaagatgataaagccgatcgttaacgtttcaaaggttgcggatgcctatgacgccgtcctttgcggttttaacggcgtgcttcacgacggcgtttctttccgggcggaagcactggaagctttgctttgtctttataaaagcggcaaaaaaatcgtgcttttgagcaacgattgccgccgggtggaagagattgcccgtctgatgcatcaaaacgggttttctccccgtttgttttccgcaatggttaccgccggggaaattctgcaccatcatctggccgccggccgcggcgtttacgcttcgctcggaaaaaactgctgctgccttgacgaggacggcggcgcttctttgtttgaagggttggattttgccgtaaccgcagacccggcaaaagcggatttcctttatgtcggccgtttgcccgccggccgtgcagtcgacgattatctggatgtgctgaaccatgccgccagcctcggcctgccgcttttgtgcgcgggcaacgacacgtcggtcgtctgcggcgaagacacggtgccggcagccggcgccgttgccgaacaatatgcggttttaggcggcagaatcattaccgtcggcaagcccgatcccgccgtggttgactatgcgctggccgctttcggcccgacggagcgcaaacggattctgatgatcggtgacagcatggcgtctgatatccgggcggcgtcggccgccggcatttcgagctgtctggtcagcaagggcgtgcatgtcagctttttgggagaaggttatattcccgacgtaaccaaaacccgggaactcggcaatatgatcgaggcctatcccgattatgtgatttccggtctccgccgataa

SEQ ID NO: 1569 - DNA, 915 bp, Unknown
  Description of Unknown: Rhodospirillales sequence
atgaaatatgtgacgctgaacaatgaccggaaaatgccggtgatgggactcggaacctggaaggccgcgccgggggaagtttatcaggcggttcgctgggcgataaagatcggctatacccatattgactgcgcggaaatttacggcaatcaggacgagatcggccaggcggttgccgatgcggtcaacgaaggcgacatcagacgggaggagttgtttgtcacttccaaactgtggaacgacagccatgcgccggaagacgttttgccggcgcttgaaaagacgctgcaagaccttaaactggattatcttgacctttatctggttcactggccggtagcgcagaagaagggcaccgggctgccggaaagcggcgcggacatgattgccccttcggaactgccgcttgaactgacctgggcggaaatggaaaaggccaggcggcagggcaaagcgctggcgatcggtctttccaactgcggggaaaaaagaatttccgcgcttctggaaaaggcggaagaaatgccggcggttttgcagatcgaatcgcatccttacctgccgcagaacgaactgattgacttttgccgcaaaaatatgattgcggttaccgcctattcaccgctcggttccggccacggcgaacttttggccgatccgcggatcgccgaggcggcggcgcggctgaaagtgacaccggcgcagctggtgctggcctggcagatcaaccgcggcgtcgtggtgatccccaagagcacgcatgtcgagcgtctgaaggaaaactttaccgcgctcggcattgagctggaccgggcggatatggaattgctggacggcatgaataaagatctgcgttatgtgaccggcgaaaaatttgctttcggcggctatgtgccggcagaaatttttgcctga

SEQ ID NO: 1570 - DNA, 795 bp, Unknown
  Description of Unknown: Rhodospirillales sequence
gaaacgccgatggatctcaaagacaaactcagtcacaaatggcgtcaaatgacgttgatcgcaggcgttgtcctgctctcgtcgatgacggtgcaggctcaaaacacgtccgaacagaatcgaaaagaaacgccgaaagcctatttcagtcccaagcaactggcttccgcgttgtctgccatcaatgccgacgacaaacaagcggacatattcctggaagcttatttgcagaagcttgacccgcagggacaaatttctccgggcgatctggttcaggttttcaaggaatcgggaatagacaaagacgaagcggtaaaaatgtcggaagttttgctgtcgccgcaaaagcagccttcctcccgcggctatgacttcggttcttacgatctcagtttcgccatcgacggcaacggcaatctttcctctttaattttcaacggtgacaaaaaaattgacgatcgcgacattgatgccgtgcataaagcccgctgccgtcaccgcgggttggccgcggacgataacagtgaacgtttccaatcgtcgcaattgctcggcaaaatgttagtgcggcaggtgattttggaaaaacggaaagacggacggacggttccgaacggcgacaaattcctgcaaaattttgacagggaattgcagcaaaacggtttggaaataggccgggacggaaaattgcacggtattgaagcaagcaaaaacaaacctctgctgacggaaaaagacctttacaatcagtatctgatgaaaaggcagcaggagatgaaaaagttttacgaatag

SEQ ID NO: 1571 - DNA, 495 bp, Unknown
  Description of Unknown: Rhodospirillales sequence
atgaaagaatttatctcggaaaacagaggactggtcagagcgatcatccgcaaacttaccggttcttacaacgaagacatcgaacaggaagtctatatcaaaacctggcgcagccttggcagctatcaggaagaaggcaggttcagacaatgggtcgcgacccttacggcaaacgtctgccgggactatttcaaatcgcgggcataccggcagaaatgtacggaagtctgcgacgatgaaacgctggaaacgatccggtccggttattcgcaggaagaaatcatcaatgccaaaatgcgacagaagctgattttgaaagcggtggacgaactgcccgccaaaatgcgcaaagttattattctgtttgaatttgagggtttgagccaggaacagatcgcccgcaagaccggtgttccggtcggaaccgtaaaatcccgcctgtttcatgccaggcagatattaagtcaaaaactcagttatttaaaaggagaatga

SEQ ID NO: 1572 - DNA, 786 bp, Unknown
  Description of Unknown: Rhodospirillales sequence
tattgccgaaaaaaagattttattaaagataatattattatagtatgtagtcagcaaaaaaccaaggagtattcgccggaaatgagcaaaacgccaatcattgagatggaaaacgtcggcatccgctacgggcgcggaccggaaatcttaagcaatatcaatttgtcgctggaaaggggctctttccattacctgaccggcaagagcggcgccggcaaaacttcgcttttaagcatgatgtatctggcgcagaaaccgagccggggaaacgtcagcgtgttcggcaacaacgtcaatttcgccaaccgcaattcgctggcgatgttccgccgccgaatcggggtggtgtttcaggacttccgcctgcttgagcattcttccgcctttgacaatgtggcgttgccgctcagggtttgcgggatgaacgaaaaggaaatccgcaaacgggtcaatgagcttttgaaatgggtggaaatcgaccgcagcacctcggcgatcacgtcgacgctttcgggcggcgaaaagcagcgggtggcgattgcccgcgcggtgatcaaccgacccgacgtccttttggccgacgaaccgaccggcaacgttgacaacgacattgcgccgaagctgatgaagctgtttgttgaactgaacaagctgggaaccaccgtggtgattgccacccataatgaaaatctgatcaaggaattccgctatccgaccattcatcttaaaaatcacggattgtcgatcattaacccggaagacggagacgaatatgctgagatataa

SEQ ID NO: 1573 - DNA, 318 bp, Unknown
  Description of Unknown: Rhodospirillales sequence
ggagattttaccatggcaaaaaagagttctatttacagaaacctgaaaagaatccggaaagccgagaagtttgctgccgttcgcggcaagttgatcgccgagatcaaagacaaaaacacttctccggaagaaagattcaagaaagtgttgaaattagccgaactgccccgcaattcgtcgaaggttcgcattaagaaccgttgcgaaaatacgggccgttcccgtggtgtttaccgcaaattcaagctgtgccgcaacgaattgagaagaatggccagcttcggtgaaatccccggtttagtaaaatccagctggtag

SEQ ID NO: 1574 - DNA, 600 bp, Unknown
  Description of Unknown: Rhodospirillales sequence
atgaacaacgaactggaaaacaaactgaaaagcctgaccgatctggcaaaaaatttcggttttggcaaggaagaagccgtcaaactggcgaagaacctgatttccgagtacaaaatctcttttgccgacctttatcccgacatgtcggcgcgtttcgaagaagtcaaagagctgtgcggcaagatacaaaaaaccgcaaacggcctcaacgaaaaaatcgaaacccgcagcgaaacctcggagcctaaaggagtgacgctgccgtttgaagtcatttatgccggcggcatcagaagcaaacagaccatctccggccgcgtaccgatcggggtcgtcgtttcgggcaacaagcttttgtactggcaggaatccggcgaggccatgagccgcagcgatgcacggaactacatgaaccgtctgccggagggatacaggtggcatctgatgaactactgcgaagcctcgggcatcaaaaacatcgtttataaagtaaacgaaactttgcgggcaatcggcggcgacgtcatcggcagccgcaactacatgctcgacggcgacggccaaagcagcggcatcgtccgttacattgccgaactctga

SEQ ID NO: 1575 - DNA, 747 bp, Unknown
  Description of Unknown: Rhodospirillales sequence
ccgatggcagaaacttttcaagaccttaaggtcaaacttatcgaacattatcggcgggtgcaaagcgccgatgaactgacggcgggttttaacctgctggttgacggggaggaactgcggcagctgatcggcggattgaaaaagacttttccgaaagagcctgctctcggtgacgaatataccatgtattttgcctatgcgatgatgcaggcagaccagcggacggcggaagatttgcttgattggcgcagacataccaaaaaattcattaacaactgtccgcaaaaccataatcttgccaaccatttgcgcagcgtaattcatcatttgccggaaatgggcggaaccaccggggaaacttataattacggcctgcgggccttaaatctgctgccgaaaacttatccgcagtatcgggaatgcgtcaaagcggtggagaaaatggcgcgcagcgatttccgctttttgctggacaaggcaaaaaacgaaccggattatcaaaaacagctgaaagcctatgaccgtgcgctggcacggttaaccgacattccttccggcgagcgctataaggggctggacgagtgtatgcaggcgatgttcccggtttataaccgcaccgaatggggacgcctggaactgccgcataaacgccggctggcctcgaaacggattttcaagagcctgccgcatgaggcgcagacggcaatccgcaatcgtaagcattataacgactggttaagccggtga

SEQ ID NO: 1576 - DNA, 837 bp, Tyzzerella nexilis
atgttagatatgttaaaagtaattatacttggaatcgtggaaggtatcacggagtggctgccaatcagcagtacaggacatttgattctggtagatgagtttattaagcttggggcgagcagcgcattcaaagagatgtttaatgtggtgatacagcttggggcgattttagcggttgtagttttgtattttcataaactgaacccgttttcaccaaagaaatcaagaaaacagaaagtgtatacgattcagttgtggatgaaggtgattgttgcatgtttaccggcggctgttcttggaatcctgttggatgactggatggaggcgcatttgcataattatgtagtagtatccattacactgatattgtatggtattttatttattgtgatagaaaattggaataaagataagacaccgcaggtgacaaaactgcaccagctttcttatcagacagcattgcttatcggagtatttcaggttctttcgcttgtgccgggaacgtcacgttccggtgcgacgatcatcggtgcattgttgcttggtacttccagatatgtggcggcagaatttacattcttccttgcaattccggttatgttcggtgcgagtggaattaaattgttgaagtttatcaaagttggcggcggtttcacagggatggaagcagctatgctgatcgtaggatgtctggtggcgtttgttgtatcgatcattgcaatcaaatttttgatgggatatatcaagaaaaatgatttcaaagtatttggttattaccgtatcatcctgggtgtgatcgtgcttgggtactttgcggcaagcggatttttaaaataa

SEQ ID NO: 1577 - DNA, 1554 bp, Tyzzerella nexilis
gtgccaacaataattactataattattgctgtagttgcattcattgttgcagcggtcatcactcgtttcctgacgatttcaagcctgacaaaagacgcagattcgaagatcggaagtgcggagactcgggcgagagaaattattgatgatgcattgaaaactgctgagacaacgaaaaaagaagcgctcttggaagtaaaagaagagtctatcaagacaaagaatgaactcgaaaaagagacaaaggaaagacgatctgaattacaacgctatgagaaaagagtgttatccaaggaagaagctttagacaaaagatcagaagcaattgagcagcgtgaagcaaactttacggcgagagaagagcaaattaagcagcgtgaagcgaaagtagaagagcttaatcagcaaagagtacaggaactagaaagaatctcaggattaacctccgaacaagcaaaggattatttgttaaaaactgttgaagatgatgtcaaacatgacactgcgaggatgatcaaagaattggaaacgcaggcaaaagaggaagctgccaaaaaggcaagagagtatgtcgtaacagcgattcagaagtgtgcggcagatcatgttgcggagactacaatttcggttgtacaacttccaagtgatgagatgaagggaagaattattggtagagagggacgaaacattcgtacactcgagacaatgacaggagtagaattgattatagatgatactccggaagctgtcgttttatcaggatttgatccgatcagaagagaagttgcgagaattgctctcgagagattgattgtagatggaagaattcatcccgcaagaattgaagaaatggtagagaaagcacaaaaagatgtggaattgatgattcgtgaagagggagaggcagcagctttagaagttggagtacatggtattcatccagaactgattcgtctgttaggaagaatgaaatttagaaccagctatgggcagaatgcattgaagcattccatggaagtagcgcagttatccggacttctcgcaagtgagattggtttggatgtcagggttgcgaagagagctggtcttttacatgatatcggaaaatcaatcgatcacgatgtggaaggctcccatattcagattggtgtggatctttgtagaaaatacaaagagtcgccggttgtgattaacgcggtagaagcgcatcatggtgatgtagagccggaatcgttaattgcatgtatcgttcaggcggcagatacaatttctgcagcaagacctggcgcaagaagagagacattggaaacatatacaaacagattaaaacaattagaagatatcgccaaccaatttaaaggtgtcgataaatcttttgctattcaggcaggtagagagattcgtgtcatggtagttccagaacaagtgtctgatgcagacatggtactgatggctagaaatatttcaaaacaaattgagtttgaattggaatatcctggacaggttaaagtgaatgtgattcgtgaatcacgtgttacagactatgcaaaatag

SEQ ID NO: 1578 - DNA, 1191 bp, Tyzzerella nexilis
atgaggattttaaatattacagctcagaaaccgcacagcacaggaagtggaatttatctgacggagttggtaaagaactggaatgcccttggatatgagcaggcagttcttgcgggagtttatgaggaggacagtgtaaatttcccagagggagttatattttatccggtgaaatatttgtcggaggaactgccgtttccaattgcaggaatgtcggatgagatgccatataagagtacgagatataaggactttacagaagagatgtttcaagcgtaccggagtgcatttcaaatggtggtgcgaaaagcggtcgaggagttttgcccggatttgattgtgtgtcatcacctgtatcttctgactgcgttggtgcgggaatggtatccgaagaagaaagtcattggaatttgtcatggctctgatttgcgtcagatttgtaaaaatccattacagatggaatacattcagaagtggattccgcagttggatggcattgtggcattgcatgacggacagaagaaagagattatccggatttttacttgcggcgagaagcttgtgcacactgtcggggttggctacaatcaaaaccttttttatcggaagaaaacagaagaaaaaccttatagacagttggcatttgcggggaaagtgacagagaagaaggggattttcagtctgcttcgggcattggagatgctttcggtcaaaccggaaaatctggttgtgaagattgcaggagggcatggcagcagagaagagtatgaagaaatttgcaggcttgccagagaatgcagatatccggtgatatttttaggcagtttgcagcaggaagctttagcagaggtatttcggcaaagcgatgtgtttgctctcccgtcattttttgaaggattgccactggtgacaatggaggcaatggcatgtggatgtaaggtggtctgttcgcagattcctgggatggaagagtggttagatgagcatgtgccggggcaacaggtggagtttgttccgttgcctgagatgactcgggtagatgagccgaaagaagaaaaattgccagagtttgaaaagaaattggcggaggcaatagagaagaaattagaacaacaacaagaagaatgtcccgatttgaacggtgtctcatgggaaggcatcagtcggactgttctggaaatgataacgtag

SEQ ID NO: 1579 - DNA, 360 bp, Tyzzerella nexilis
atgcgaaaagaaaagggaaaaaataaggcaaaagaaagaaaaaaaagagccaatcgcaaatatggacaggcaaagctgaaacactctaaaaaagggatacagtcctgtgtgatcgcgggaattgtattggtggcattggctgcaatgattgtgattgcatacattagtgcagggactgcggcgccttacatcggaggactggcacttgtcactcttattcttacagtgactgggtgcgtgcttgcagtgagagggctgaaagaacgagagaaaaactatcttacatgtaagataggaattggttgcaacatattctttatcattgcatttattgctattttttgcagggggctattttaa

SEQ ID NO: 1580 - DNA, 831 bp, Tyzzerella nexilis
ttgggagcgaacgggcaaaacaaaacagagtggataaagtttttaggtaatggagaagatgatatgaagcagatttttgtatgcaatgatacgattacaggaattttttcggcaatttacgatgcgtggaagattgtactctcttccggagagactgggattgcgctgaaagggatgatgaaccaggaacttttttgtgaatacactgaaagtgtggagagtgagaaaaaggcaattgcagtggagaatatgataaaaaagaatctggggatggaggtgtaccggaatatttattatgcaatattggcagaggatgcaaagaaggcgaatgcagttcttggaatgatgcaggaggcgaggcgaatacacgataaaaggaagattatggagcatttgtcgcataagcaggttagaaaagtgttcgagctaaagagaacagtggagaatgaagcacactgttttcaggaatttatccgtttttctgagttggagagtggagtgcttttttcgaaaattgcacctaaaaatcaagtgcttacatgcatcgcagatcattttgcaaatcgtttgccgttagaaaactggatgatctatgatgagacccaccagatgtttctgatacatcgcaaacagcagaattggtttcttgtttggaatgaaaaattgaataaagaaaagataaacagggtatcctatgcagagaacacgtactccgaactttggaagggcttctttgaaaatatatcaatagaagaaagagagagttaccagagacagagacagcatttaccgattcggtttcgtggaaatatggttgaatttgtacaataa

SEQ ID NO: 1581 - DNA, 1350 bp, Tyzzerella nexilis
atggcatttgacagtttatcagaaaaactacagaatgtattcaaaaatcttcggagcaagggacgtttgacggagtctgatgtcaaggcggcgctcaaagaagtgaagatggctctcttagaagcagatgttaactttaaagtagtgaaaggctttgtgaaggatgttcaggaacgtgcaataggacaggacgttatgaatggactgaatccggggcagatggtaatcaagatcgtaaatgaagagttgatcaagctgatgggctctgagacgacagagattaagctggaacctggacaggcgacaaccgtgatcatgatggcgggtctgcaaggtgccggtaagacgacaacaactgctaagattgccggaaagttaaaattaaaagggaaaaagccattgttggtagcgtgtgatgtgtacagaccggctgcgatcaagcaactgcagattaacggtgagaagcaaggtgtggaagtattctctatgggagagaatcataaaccggcgaacatcgccaaggcagctctggaacatgcggctaagaatggcaacaatatagtgattttagatacggcgggtcggcttcatattgatgaagatatgatggcagagctgcaggagattaaagaaactgtgacggtgcatcagacgattttggttgtggatgccatgaccggacaagatgcggtcaatgtggcgagcagtttcaatgagaaaatcggaattgacggtgtgattgtcacaaagttagatggtgatacaagaggtggtgctgcactttccatcaaagcagttaccggaaaaccgattctttatgtcggtatgggtgaaaaactttccgatttggaacagttttatccagatagaatggcttcccgtatattggggatgggagatgtcttgagtctgattgagaaggttggagaagatattgacgaagagaaagccaaagagatgtcgcagaagttgaaaaaagcacagtttgattttgaagattaccttgagagtatgaagcagatgaagaagatgggcggtcttgcgaacatcatgagtatgatgccgggacttggcggagctaagatgaaggacattgattcagaagagagtgagaaaaagatggcacagattgagtccattatctactcgatgacaatcaaagaacgtcggaatccggatattttaaatccatccagaaagcgcagaattgcgaaaggcgcaggggtggacatcagtgaagtgaaccggctcgtgaagcagtttgagcagtctaagaagatgatgaaacagcttccgggtatgatgggtggcattggtggtaagaaaggaaagttcagacttcctttttaa

SEQ ID NO: 1582 - DNA, 648 bp, Tyzzerella nexilis
atgtcggagtccattcggcttggaattatacttgcgctttcgggagggtttatggatgcctattcctatatgtgcagaggaaaggtatttgcgaatgcccagacgggaaatatcttattatttggtatctatatgtcggaaagacagtgggatatggcaatcaggtatttaattccggtcattgcatttgtgaccggaatcggagttgcagatcttgtccgaatgaagattaaagaaaaaagtattttccactggagacagctgtcggtgttaagtgaagcagttgtattatttgtagtctgtttcataccgcaaaagttcaatcttccggcaaatagtctgacgtcacttgcctgtgggatacaggttgagagtttccggaagatacatggaaatggaattgcgacgacgatgtgtattggaaacctgcgcagcgcgacacagcagatgtgtgagtatttgggctcgaaaagaaaagagcatctcaaaaaagggtttttatattacggaattattttttgttttgtaatgggggcagttttggggaatatctgtgtgaaatacttgtctgaaaaagcattgatagtctgtgtggtgatgttaggtatggcgtttgtcatgatgttcatagatggagaaaagcaataa

SEQ ID NO: 1583 - DNA, 1500 bp, Tyzzerella nexilis
atgatcattttgattacgatgtatacatacgaatgcttcactgtcttcggatatgcagacggagacaaaaagcggcgtattttgcggaaccagaataaattgatgtttatgatacattttcttgcgtttgcgggaatgtattttaaaatcggagaaataaagattttgatattttatgcggtacaggtagtactgcttttggcaatcatactgctgtacacatggatttatccaaaggcttcacgccttgtagtcaataatatgtgtatgcttatgacaatcggttttatcatgatcacaagattgtcttataataaggcggtgaagcaatgcgttattgcagcaggcggtgtggcaatcagtctggcagttccggtgatcatccgaaaagtgaaacaactctccgagtggagatggctgtactgtggtgtgggaattgtcgcattggctgcggttgttgttgtgggaaccgaacaatttggagcaaagctgggatttatggtgggaggtgttggagttcagccttccgaatttgtaaagatattgtttgtgttttttgttgcatccagcttttatcactccaaagcatttaaagatattgtgattacaacggcattagcggcttttcatgtgttgattctggttgcatctaaggatttgggtgcggcattgattatttttattgtgtatcttgttatgctgtatgtggccacaagccagacgttatatgtatttgccggccttggcgcgggagcggcagcgtctgtcgtggcttattatttgtttaaccacgttcgtgtccgtgtgatcgtatggcaagatcctttcgcttcttatcagaatggtggatatcaggtggcacagtctttgtttgcgattggaacagggagttggtttggaaccggattgtttcagggaaaggcagatgcgattccggtagcggagacggattttattttctcagcaatttgcgaagagatgggactgatttttgcgctttgcatcatattaattttcctaagctgttatgtgatgtttttgaatattgcaatgcagcttcataaccgcttttataagctggtggcactgggacttggaacttgtttcatttttcagtcatttctgactattggcggtgtgacaaaatttatcccgtcaacaggtgtgacacttcctctgatcagttatggaggaagttctgtattgagcactttgattatgtttgcaattattcagggattgtatattttaagagaagacgaggaagaagatattgagagaagaaaagaacaacaattacgagcacagaaaaatcagacaagacggcaggagacggcaggaagacgaaagagtccgcaagacacgcaaaggacaacaatcaagagaagaagtaccgccggtgaaaaaaagaacgagcgcgaaaaagatgcagcaagacggccgcagagaagagaaaaaacgaacaaagaaaaagaaatcaacaaacaaagaattcgctag

SEQ ID NO: 1584 - DNA, 657 bp, Tyzzerella nexilis
atgttagaaaaatataaaacagtatatcaaggcggcgaaggggagaccgttgaaaaaaagtcaagattcattgcgacggtcattccggtaaagacagaagaagaggcgattgcgtttatcgaaagcatgaagaaaaagtattggaatgcaacgcacaattgctctgcctatgtaatcggtgagcagtttcaaatccaaagatgcagtgatgatggagagccaagtggtacagctgggaaaccaatgctagatgtcctgcttggcgaggagattcatgacatagcagttgttgtgacaaggtattttggaggaacgcttcttggaacaggtggacttgtgagagcttattccggttcggtacaggcgggactttccgctagtaagattattaccaaattgcacgggtataaacttcggatacagacagattatacaggacttggaaaaatacagtatattttggggcagagaggactgtcggtacttgattctgtgtacactgatcaggtggagctgactgcgttaattccggcggaggaactcaaaacagtgcgaaatgagattacagaaggcacgaatggaaaagctgtcatggagatagaagaggagtgctacttcgcggagatagatggggaaatgaagacttttaaagattga

SEQ ID NO: 1585 - DNA, 1071 bp, Tyzzerella nexilis
atggctaaagacataaaaacatattatgaacaatcttatattgacaatacacttcgattacgtgaagttttacagacattaccatcatttacaaaagattattttcgtgctgtagaaccgactacatcggctaagacaagaatttcttatgcttatgacatccgtgtattttttcattttttaattgagaacaatccaatttatcacgattatacaacaacccagtttacccttcaggacttagaacgtgttgaaccgatcgatatcgaggaatatttagagtatttaaaggtatataaagcagatgataatcaggtgatcacaaatggagaaaaaggacttgcacgaaaattttcttctcttaggagcttttaccggtatttttaccgtcatcagatgattgaaaaaaatccgactatttttgtggatatgccaaagttacatgataaagcaattatacgtttagatattgatgaggttgctttgctgcttgattatgtagaaaattgcgggaaagaattgacggggcaaaaaaaagtttattatgaaaaaacaaaaactcgcgatttggctattttgacattattgcttggaacggggattcgtgtttcagaatgtgtaggtcttgatatcaatgatattgattttaagaataatggcattaaggtgactagaaaaggtggaagtgagatggttatctatttcggtgaggaagtacgtaatgctttggagaattatcttgagacaacaagagccagcgctactcccctacccgaccatgaaaatgctctttttttatcgacccaaagaaaaagaatgggagttcaggcaattgagaatatggtgaaaaaatatgccaaacaagtgactccaaacaaaaaaataacacctcataagcttcggagtacctatggaacgtccttatacaaggaaacaggcgatatttaccttgtagccgacgtgttggggcataaggatgtaaatacgacaaaaaaacactatgcggctattgatgatatgcggcgaagacaggcagccagtgctgtaaaattaagagaagagcgaaattaa

SEQ ID NO: 1586 - DNA, 927 bp, Tyzzerella nexilis
atgaaaaaaccagtattagtaattatggcagcaggaatgggaagcagatatggcggattaaaacagattgatccggtggacgagcaaggccatatcattatggatttctcaatctatgatgcaaaaaaagcgggatttgaaaaagtagtatttatcattaagaaagaaaatgagactgattttaaagaggctgtcggaaaacgcatggaagaagtaatggaagtatcttatgtattccaggatttacataacttgccggaaggatatgaagtgcctgaaggacgtgtgaaaccatggggaacagcgcatgcagtattcagctgtattgatgagattgacggacctttcgcagtaatcaatgcagatgattactatggaagagatgcattccagaaaatttatgactacctgtcaacacacgaagacgatgataaattccgttacacaatggtaggttatcaattggaaaatacattgactgagaatggtcatgtggcacgtggtgtctgcacgatgaacgaagccggagagcttgtgagcgttgtagaaagaacacgcatcgagaaaaaaggagatggagcagcgtatacagaagatgagggagagacatggacagaacttccaaaaggaagcattgtttctatgaatatgtggggattcacagcaagcatccttcaggagattaagaacggatttacagcatttttagatgaaggacttaagaccaatcctttgaaatgtgaatacttccttccaacagttgtaagtaatctgctcgcagaagaccgtgcaacagtggcagttctgacatcagcagataaatggtacggagtgacatataaagaagataaaccggttgtggtgaatgcgattaaaaatatgaaagaatcaggtttgtatccagagaacctgtggggagaaaaataa

SEQ ID NO: 1587 - DNA, 906 bp, Tyzzerella nexilis
atgaagaaatataaatcactgatcattcttttggcagttttggttgtgcttgtagttgcgtatgttgtgacagggcagttaaaaaagaaatctgcggagaaagaaaacgaagagaaacagattgcagtgcttgatatgtcggatatcacctcaattcagtatacgaacggaacagatacgatgtcgtttataaaagaagatggtacatggtacagtgagtctgataaagaatttccactgcagcagagcagtcttaagacgatggcggagacttttggaacgctttcagctaatcgggagttaaccgatggagatacacttgcggactatggactggaagagccacagtatacgattacgctcaagaatgctgatggagaagaacagaacatttatatcggcaatgcggcaggtgaagactattatatgactgtaggagataaggaaaagatctatacggtagattacagtgtggtaaatgcaatgaattttgatttggattctatgcttcagaaagagacattcccaagcattggatcagataatatcaagaaggtgacaattacaaaagccggcgagacaaccgagtatgatgcagataacagtgatcagtcagatgatatcacagcaatcggcgggggacttggggcagcttattttgtagattgcgtggactattctgtacaggcggacgaactggatcaatatggattaggtgaggcacagcgtacaacagtcacagtcgtatatacagacagtaatgataaagaacagacatttacactttatgtaggcggaagagatgagagtgatgcctataattatgtgcagatggatggctcgaaaatggtcaatacgatgacaaaagaggttgtaaataatatattgaatatcgaagaagaataa

SEQ ID NO: 1588 - DNA, 1215 bp, Tyzzerella nexilis
atgagactgatacatacagcagactggcatctcggaaaacatattgaaggtcacagccggttggaggaacaagaactgtttttagaggattttgtgaatatcgtgaaagaaagagatgcagatgttgttctgattgccggcgatatctatgattcctcgaatccaccggcgaaagcggaacagttattttatgatacgctgaaaaagatttcagacggaggcagaagacttacgattgtgattgcgggcaatcatgataacccggatcgtcttgtgtcggcgacaccgcttgcgatggagcatggaatcatcatggtgggaacaccaaagacggtgattccaaaagggcagtatggaagctgggaagtctgcagaagtggagaaggatacattaagattgagagaaaatctgagcaagcggtcgttttgaccgtaccgtttccaagtgagaaaaggctggaagaggtactttattcggagatggaatcggaagaaatacaattggaaacgtataatgagaggctgaggtgtctgtttgacagactggcagatcagtttgaagaagagacggtcaatatcatcgtctctcatttgtttgtaatggatagtttggaagaaggttctgaaagaagcatacagcttggaggaagttatctggcagatccggatatttttccgaagcttgcagattatgtggcacttgggcatattcacagaccgcaaagtgttccgggacacccgaatattcgctattccggttcaccgatcgagtatcggaaaggagaagaacgttaccaaaaacaggtgctgtgtgtggatatcagaaagggcgaaccggttaaagttgagccgatcgaattaaaacagtacaaaccaatcgaggtgtggagatgcacgagtatatcggaggcaatcatggtctgtgaggagaaccgggacaagaactgctgggtgtacttggaaattgagacagagcgcgccattttggaagatgagatcaagaagatgaagcagacgaaaaaggatatcctggaaatccacccgatcttgcgggaaaaagacacggaagaggcagagacatcgtggaaggatcgtccgtttccggaagtgtttgcagaattttacagacgggaacgtggtgtggagatgtctgaagagacgcgggatatgctgctgaaactatgtgaagaggaggagccgcatgagaccgattaa

SEQ ID NO: 1589 - DNA, 891 bp, Tyzzerella nexilis
tggactggaagaatatttcttaaaagtgattggaggaaaataattatgaagagtttgataagaagtgatttttacaaattaagaaaagcgaaatctttctgggtatgcatgattctcgctgtcgcactcgctgtattcagtgtattgatcatggatttttctgtaaaactgatggataaagtaccgcagcaggcagctcaggaagaggcagcactggaagaaagcggattgaatatatctaccgacggtatcccgatgagctctgcggatctaaatgcttccaacatgctcctcatgcagtttgccggaacaacaaccattttgatctccatctttgtgtcactgtttgtcggtggagaattttcacacggaacgatcaaaaatcttgcttccaaaaatcatacccgcacccagatctatctttccaagataatcgtttctgtcatcgccgcaatcgtcatgactctcctttacgccgttgtagctacaggtcttggcacagctctctggggctttggcaaagttgacagttcgtttgtcgctaacgcttgcaaaggtatcgggattgaatttcttttggtaagcgcattcactgccgtgtttgtcatgttcagcatgttgatccgtcaaagtggaggtgcgattgccgccaatatcttctttttggaatttatctctctcatcgtcatgttcggagagatgatcattaacaagattttcgatacgtctatcacgctctcgaattatctgattgacacaaacatgacacagattgccacttccgatattaccggaaaactggccgcaagaagtatctgcgtagctttcggattttttatcgttgccacagcgattggactgatttctttccgaaaacgagatatcaaataa

SEQ ID NO: 1590 - DNA, 855 bp, Tyzzerella nexilis
atggtcagaggattaaatgaatggcaaaacaggaggatgtttcatatggaattagtaaatcatatagaaatccctgagattgggcttggtgtttataagatggaagcgggagctgagatgaacgaagcaattggaaatgcatatcaatatggctacagattgtttgacacagctcagatgtataagaatgaggaggcattgggagatgcgttgaaagaaaatcatatccaaagagagactgtttttctgaacagtaaagtggataattgtaatcagggatatgaaaagaccatctcaagttttcatgattctttaaaaagattgcaaacagattacctggattcttttttgatacattggccgggattgaataaagagaggactttgagtacatggaaggctttggaggaactatataaggctgggctgatccgggcaatcggtgtctcaaattttgagatcagtcagctggagattttgttagagaactgtgaaattcctccgatgataaatcaaatcgagcacactccttttttgcatgatgaacagttgaattctttttgtaaaaagaataaaattcaaattatggcatggggaccattgcttcgtggaaaaatggaggatgatggaattaaagaaatagccagccgctatgcaaaaagtccggctcaattattgcttcgatggaatattcaacagggaattattccaattccaaaaacgaaaaacagttcaaggctgatagaaaatatttcagtatttgattttcaaattgagccggaagatatggaaaaattaaatgcaatgaatgaaaatatcagaacaagctataatccgttggaatatgatttttaa

SEQ ID NO: 1591 - DNA, 795 bp, Tyzzerella nexilis
atgaaattagggtttataggatgtggcaatatggcaaatgccatgatagccgggattattggaaatggaatctgcaaggcagaggagattatcgggacggcaaaatcagaggcaagcagagtacgtgtgaacaaagagtttggaatttatatgacagaggataacaaagaagcagcagaaaaagcagatgtgattgtactttctgtgaaaccacagttttatgaagaggttatctgtgagattaaagatgttatgaaagataatcagattgtagtgacgatcgcacctggaaaaacgcttgcgtggctggaagaaaaattcggtaaaccggtgaaactcgtgagaacaatgccaaacacaccggcaatggttcaggaaggaatgacaggtgtctgcaaaaatacatatgtgacagagagcgagatggagcgtgtatgcgatattttacgcggatttggagaagtagaaattattccggagagattgattgatgcagtcgtgacggtaagcggaagttctccggcatatgtgtttatgatgattgaggcgatggcagacgcagcagtcgcagaaggaatgccaagaaagcaggcatataaatttgcggcgaaagcagtgatgggaagcgcgaagatggttcttgagacagggaaacatccgggagaattgaaagatatggtatgctctccggcggggacaacgattgaggcagtgaaagtgctggaggcagcaggattcaggagtgctttgatggaagcgatggaagtgtgcgcggaaaaatccagaaatatgtaa

SEQ ID NO: 1592 - DNA, 936 bp, Tyzzerella nexilis
gtgcaagcagcggaaaatatacagataggagaagctatgagagcagattataaatcaggttttgtaacattgatcgggagaccgaatgtagggaaatctacattgatgaattatctgatcggacagaagatcgcgattacatcgaacaaaccgcagacaacaagaaatcgaatccagaccgttttgacaacggaggaaggtcagattgtctttgtggatacacctggaatccacaaggcgaaaaataagcttggggaatatatggtgaatgtggcggagcggacattgaatgaagtcgatgtcgtactttggcttgtggagccgtctacctttatcggggcaggggagaaacacatcgcagatcagttaaaaaaagtaaagacgccggttgtgctggtaattaataaagtagatatggtaaaaagagaagaagtgctgacgtttatagatgcatatcgtaaaatatatgattttgcggagattgttccggtgtcggcaagaagcggggagaacacagatgagcttgtgaaagtgattttgcagtatctgccgtatggtccacagttctatgatgaggatacggttacagatcagccggagcgccagattgtatcggaattgattcgtgaaaaggcgctgcactgtctgaatgaggaaattccgcatggaattgcagtgtcgattgaccgtatgaaagcgcgaaagaaagtgatggacatcgatgcaacgatcatttgtgagcgtgattcacataaaggaatcatcatcggaaaacagggaagcatgttaaagaagataggaagtaccgccagatttgagattgagcgtcttttggattgcaaggtaaacttgcagttgtgggtgaaggtgaagaaagactggagagacagtgacttcttgattcagaattttggatataaaaacgaggaagaataa

SEQ ID NO: 1593 - DNA, 942 bp, Tyzzerella nexilis
atgatgaagacagaaatcacaaaattattaggaattgaatatccgattattcaaggtggtatggcctgggttgcagaatatcatcttgccgccgccgtatcagaagccggaggcctgggactgattggagcagcaagtgcgccgccggaatgggtgcgcgagcagatcagagaagtgaagaaacttacagacaaaccatttggtgtgaatattatgcttatgagtccgaatgcggacgaggtggcaaagattattgtcgaggaaggagtccctgttgtgacgacgggggctgggaatcctgaaaaatatatgcagatgtggaaagcggcgggggtgaaagtgattccggttgtcgcatcggtagcaatggcaaagcggatggagcgctgcggggcagatgcgattgtggcagaagggacagaagccggaggtcatatcggagagaatacgacgatggttctggtgcctcagattgtagatgcggtttcaattccggtcatcgcagccggaggaatcgcagatggaagaggaattgccgcagtgtttctgctgggagcaagagcagttcagatgggaacacattttgtagtgacaaaagagtctcaggtgcatgaaaattataaaaaatgtattttaaaggcaaaggacattgattcgagagtgacaggcagaacaaccggtcatccggtgcgtgcacttcgcaaccagatgaccaaagaatatcttcgtctggaaaaagaaggagcctcttttgaagagttggagctgcttacgcttggaggtctgcgaaaggcagtggtagaaggcgatgttgtgcacgggagtgtgatggcaggtcagattgcaggaatggtcaaagaagagatgacctgcaaggaactgatcgaaaaactggtgagggagacagattcattgatgaaaggaaccggcttttatgagtaa

SEQ ID NO: 1594 - DNA, 1488 bp, Tyzzerella nexilis
tgggttgaagtgaggtgtaaaatgataaaaataatcgtaaaagaggaaatgtatatatacgatatgtaccatattttaagggctttttacccggggagtgagattgaccaaacaatcgacagtggtgtccctaatttgattgaactgagaatagatgggcagcgaaaagagtgtcttttgatcaaccaaaatgaggtggaagaatacgcagagcgaaagcagaaaaagaggtatgtgaacctgaaagtgtatgactggttgtcaaaacaaaccgaaaaggaacttgcctggggtgtgttgacaggaatcagaccgacgaagattatgatgaacttgctggaagaaggaaaaagcgaacaggatgtcattgactatatgaaagaaaattatcggacaacggacaaaaaagcaaacctcggcatggagattgcaaaacgagagaaagcgctgctggctcaattagactataaggatggctacagtctttatgtggggattccattttgtccaactacctgcagttactgctcctttacctcgcagccaattcacaaatggaaagaccgggtagacgaatatttagatgccttgtgtaaagagatcacttttgtaggagaagtgtcaaaagaaaagaaactaaatacggtttatattggtggaggaacgcctacgacgctggaaccggaacagttggagagacttttgtcacatattgaaaaaacattttcatttgaagatttgaaagaatttacggtggaagcggggcgtccggacagtattacaaaagaaaagttggaagtgctgagaagacatcaaatttccagaatttcaatcaatccgcagacaatgcagcaaaagacattagattgtatcgggcgaaaacatacagtagaggatattcgacaagtgtatgcgatggcaagggaactgggatttgagaacattaatatggatttgattgcgggactcccgggagaaactttagacgatatgaaagatacactgcgacagatagaaatgtttgccccggacagtctgactgtgcatgcgcttgcgatgaagcgtgcatccagactgacacaggaaaaacgagagggaagctatcggggaaatgaccaggcagacagtgccacgatgttatcggagatgatcgaactcgcagcagaatatgcggggaaaatgcagctcgtaccgtattatctgtataggcagaagaatattgcgggaaattttgaaaatgttggttatgcaaaggttgacaaagccggaatatacaatatacttattatggaagagaaacaatctatcgtggctgtgggagcaggggcatcgacaaagatcgtgctgccaaaagagaagaccttgatagatgaaaagacaggcaatccgaagcagattgtcaggacggagaatgtaaaagacgtcgaacaatacatcaatcgaattgatgaaatgatagagcgaaaaggagaatggttatggcattaa

SEQ ID NO: 1595 - DNA, 1032 bp, Tyzzerella nexilis
atgatcaaagaagcaattgtaaaaatcgtaaataaagaggatcttacttataaagaggcatatgcggtgatgaatgagattatgagcggagagacaactgccacacagaatgcggcgtttcttgcggcgctttccacgaagagcgcaagggccgagacgacagacgagattgccggctgtgcggcggcaatgcgggcacatgccacaaaggtggagacagatatggaattgtttgagattgtaggaacaggtggagacaatgcccatagctttaatatttcgactacatcggcgcttgtcgcagttgccggtggaatgaaagtggcaaagcatggaaatcgggcagcatcttcccagtgtggaacagcagattgtctggaggcgcttggtgtgaacattcagcaaagccctgaaaaatgcgtggaacttttgcgggaagtgggaatgtgctttttcttcgcacagaaatatcatgcatctatgaaatatgtgggagcgattcgtaaggagcttggttttcgcacagtgtttaatattttaggaccacttaccaatccggggacaccgtctatgcagcttttgggagtatatgacgaatatcttgtggaaccacttgctcaggtgttgatcaatttgggagtgaaacgaggaatggttgtgtatgggcaggataaattagatgagatttctatgagtgcgccgacaactgtttgcgagattcgggacggatggttcaagtcttctgtaatcactccggaaatgtttgggtttgagcgttgtacaaaagaagagttaagaggtggaagcccaaaggagaatgcggatattacgctcagtattttaaacggagaacgcggacataagagaaatgcagttctgatgaatgctggagcatcattgtatatcgggggtaaggcggaaagtatggaggaaggaattgcacttgcaggcagactgattgattccggaaaagcactcgagactctgcgcagactgatagaaataagcaatcgtcaggaggtgaaagaatga

SEQ ID NO: 1596 - DNA, 534 bp, Tyzzerella nexilis
ttgttgggtttaaaaattcatggtaaagtaatcctgacaaactatctcaaggaggtaaaactaattatggaaatgacaactttatgctacatagaaaaagatgactgctatctgatgctgcaccgtgtttccaagaaaaatgatgtcaataaagacaaatggattggtgtaggagggcattttgagaaagacgaaacacccgaggaatgccttttacgagaggtaaaagaagagacaggtcttactctcacttcttatcagttccggggaattgtcacattcatttcagacaaagtcggacacgctgaatatatgtgtctctatactgccgacggctacgaaggtgagatgatttcctgtgatgagggcactttagaatgggttcccaaaaaggatatctatcagttgaatctctgggaaggagatcggatctttcaccgcctgatcgctgaaaatgctccatttttttcactgaaacttcgctatgaaggcgacgttttagttgaggcaaaattaagcggacagcctgtataa

SEQ ID NO: 1597 - DNA, 510 bp, Tyzzerella nexilis
atgaaaagagaacagacgaaaaaattatgtatggcaggaattttatgtgccgtggcagtggtcggaagcacactgtccgttccggtatttgggagcaaatgtgccccggtacagcatatggtaaatgtgctctgtgcggtattgttaggacctggatacggagttggagttgcattttgcgcaagtttgattcgtaacttattagcgcttggaagtattttggcatttccgggaagcatgtttggggcgctgctctgtggagttgtgtactggaagagcaagaacttattattgacactgcttggagaggtatttggaacagcgatccttggaggactctgtgcatatccgttggcagttcttgtcatgggtgtgtcagcaggcgaagttgcattttatgcatatgtacttccgttttttgtatctacagcagggggagcaatattggcgggcattctgatccagatgctgaaaaaagcaggagtgctccgtatggcagctaaaaaatag

SEQ ID NO: 1598 - DNA, 1077 bp, Tyzzerella nexilis
ttgaatgaaggtgagaaaatgtcatttacagaagaaaaaagagaatggattaaaaagtatatgttagagaagattcgtcaggacgatggagcatatgcccagaaaacgatggaaaactttgaggtctctattacgactgtaaaaagatatctgaaagagtgtgtggaacaaaaaatcatcgttccgaatgcggataaagaatgtggatattgcttgattaccgtggaagaagagtgggaagtggacaatgttgaagacttggaagaagatacattttactttgataaagtatccccgattttaaatgatctttccgagaattccagaaagatttggtactatgcgtttacagagatgatgaataatgcaattgaacatgcgaaggcaaaaagaatctgctgtaaggtgaagaaagacgtactgtatacagaaatttccattgcagatgacgggattggaatttttaacagtattcgacaatatgccgatcagcagcttcatatcaagatggacacggcacaggcaaggatggaattgtataaaggaaaattcacaacgagtccagagagtcattccggagaggggatcttttttacttccaagatgctggcgcaatttgccttgtggtcagaagatgtggtgtatagtaatcggtgtgacgatgaagcaaaatttgtaagaagtcatttaattgcttattatacaaaattgaatcatattggaacgatggtgcagatgaaattggaaaatgatacgaagcggacggcacgagaagtgtttgatatgtttgcgccccttggggaaggggttgtaaagactctgattccaatgaaagaattctgtcgtcagggcgaaccggttgcaagatcacaggcgagaagaattgtgagtcgcttggaagaatttaaagaagtgatttttgatttttcggaaattgattttatggggcaaggatttgccgatgagatatttagagtgtttcagaatcgtcatccggatattgtgttgactgtaaataatgcgaatgaagaggtcgcagggatgatacaacatgtaaaaagcaacggaaaccactag

SEQ ID NO: 1599 - DNA, 567 bp, Tyzzerella nexilis
atgttaaaaagtaaggagatgatttttatgaacaataagtatgtgggaacagagacagaaaaaaatttaagaagtgctttttcaggagagtcggaggcgagaaataaatacacttatttcgcttccgtagcaaaaaaagaaggttatgagcagattgctgcattattccaaaagacggcggataatgaaaaagagcatgcgaagatgtggtttaaagaattaaacggaatcggaaatacggcagataatctgaaagcagccgcagaaggtgaaaattacgagtggacagatatgtatgagggatttgcgaagacagcagaagaggaaggatttccggaactggcagcaaaatttcgccttgtagccgagattgagaagcatcatgaggaacggtatagagcattattgaagaatgtcgagacggcagctgtgtttgaaaaaagtgaagtgaaagtatgggagtgcagaaactgtggtcatcttgtagtgggaacaaaagcaccggaagtttgtccaacatgtgctcatcctcagagctattttgaagttcgggctgaaaattattaa

SEQ ID NO: 1600 - DNA, 825 bp, Tyzzerella nexilis
atgattagagatattacaattgggcaatattacccggcgaatagtaaattgcaccgcttagacccgcgggtcaaaataatgtgtactttattctatttgatttctttgtttttatttaaaagtgttttggggtatgcgattgcaaccgtgtttttggcagcagttatccgtatttccaaggtaccgctgaaatttatcctgaaaggtttgaaaccgatcatcatgcttttgatgatcacggttgtgttcaacctgtttttgacaaaaggtggagatgttttgtttgaagcctggatttttcaagtgacggaagaagggcttcggacggctgtttatatggcggtgcgtctgatttacctgattattggttcgtcgcttatgacatttacaacaacaccgaatgcactgactgatggaattgaaaaactgctttggccattcaataaaatcaagatgccggtacacgagattgcgatgatgatgtcaattgcgcttcgtttcattccgattcttttggaagagacagataagatcatgaaagcgcagattgcaagaggggcggatttggaaagcggaaatattattcaaaaagcaaaaagcatgattccgattttggtgcctttgtttgtgtcagcatttcgacgggcaaatgatttggcgatggcaatggaagcaagatgttatcgcggcggtgagggacgtacaaagatgaaaccgcttgtatatcaaagcagagactatatcgcatatgccattactattgtgtatatggtggctgtgatcgtaatagggaggttagttccatttaaagtgtggatattttaa

SEQ ID NO: 1601 - DNA, 6744 bp, Alistipes indistinctus
atgaaaatcgtaggcgaaccgaaagcattcctgagcaacgaggctctccagttgctgaacctgtacgaatcgttgggcgagcgggccgaaatcttcctgccgcgccacatcttcgacaatctgaccagctttgtcagcctctgtatggaagagcccgacgatccggcccgccaacaggccgagatcaaccgttacctgctcaaattccgcgaggatatccccggttataccgatgtgtcgctgatgctgatccctcacaacaactcgaaagcattcgaactgagcagcaaacgcggggaattcgtcaaaaagatcaattcggtgctcgataccgacgggacgactaccgaaatcaaaaatatcctgatcaatatccgcgacagccatgacctttcggtcggcacgccgccgatcaacagttatcacatcgacttcatgtcgcaaatccagttaggcgggcacgttcgcgacctgcgcaaataccgcgacgtgatcggtgtaacgggcgacatcaacgaagcgcactggaactacctgatggacacgctcgaacagatgatcagccaaagcacccattacacgacaaaagccgaaatttgcgacttcctgcaccgcagcaagtgggccgtgaatttcaaagggatgaacggcatgatccgtacggtcgtgtccgggaacgccgacaaagccgtctccctgctgcgcggcgacgtattcagcaaggactgcgtcgtggtgatggaatcgcccgccccggaactgctctacgaaaagatgacggccgacaccacttcggtattcgtcgtcaaggtaaagcacgcccgcatcaaccattatgccggtgaaaaatggttcccgttgctgacgcgattggtgatcgtggacgactcgaaagagtcgcgcagctcgaatacctcgctgatcttctgtttccacaacggcattatcaatacgctcaacaaagtacacaccaaaaaactcggctcgccgtcgaatacacagctgaacctgcgcctgatcctggaaaatgtcaacccgacctatctcaaggagttccgagaaaagatagaagcccagatcggagagtacgccgccgaactcgaaacgctgctcaacgaacagacgggcgatccgaacgacatcgagaagcggatcacactcttcaaactcgactctttctcgcggcaggtcgtacaggataaatactcgctcgaaaagctgcgcgactttatcttcttccttgagaactgccacaaacaggaaaccaagaaggtacagacccaggagctgatcgacgagttcgaaagccgcatgaaaaattatttctatgcgggcaacaaactcatcgacgtcataacgatcctcgaaggcggtggccgtcaccaaatcaagactttcggggactacctgcgcagtaaaacattcaacaacctgaacagcaaaatccgctatgcatgccagctgatcctcgacatcattccgagctgctacgagcggacgctgcacaatcatttccataagaatttcggcattaacctgttccttgagaaataccaggaatacctgaccaaaacgggcaaagatgccgacaacaaggggcgcttcgagaagtttctgatcgacctgggcatccgcgacaaatacttcgcgctcaaagaagaggacaaggagatcgtcaaaaatttcctcgccgcgttaggcaacctcgaccagacctcggtatcggatgccgtacagatgatcatccgcgacctgctgttcaacccgaacggccggccgaagccctatatcatttacaatgcgatccaggcctgggagtacaaagacctgctgccggacgactgtttcgacatcaatccgttcgacatcgaaatcgagaacgacaacgaaggcaggcttgcctacgaccgcctgatcgaccggttgcaacggatcaaatcgaccttggcattattcgacgacagcggcagcctgtgggaccttttctgcgaaaatacgacgatcatcgtcaacgacccgaacaatcccacgggttataccgatttcaacagcgaggcggccaacaactttctgcgtttcctaaacagttgcaaaatcacgctgttcctcgacgaagcatacgcagagagcgtcaagatcgaagaccgcgagttgccaaaatggcgtacgctttctcgctacatcatgaacaacattaacgcgcagtcgcgtatcaaggccatttcgtcgctttcgaccacgaagaacctcgccgccacgggcgaacgcctcggcgccgtagccgtcactccccaggcagcggacttcgcaaaatacgcacgggcctgcaacagcgccgaacacggcaacaacaactcgttgctgatgctcaacaatacgctcgagatcgcccaggtagctaagcgcatcaaagaccagatcgaagccgaactgccgaaaaacgcttcgcgttcgaaaatcaaaaaggcgatcgtcaaatttatcgtcagccaattcgaaaagacccagcaaaacaacgagatcagcaaaaccaaccgccagttgcacaaaacggccggtttcgaggggtcaccgctctacctgttcctgctcgacgaactggtagccctggacaagctcgacgtactgggactgccggacgatttcaaataccacgacgaaccgtttttcgtctactaccaaagcaagttggtggaaaacctgaaccgtttccgggttaacaagaactttcgccacgaatcgctcacgcgtatgaagatggccaaagagatcggacagcgtctgcttgacaacagtccggcggggacagcactacgagtcatccaatcggacggttcttacctgttcaacttcaagatcaccggtccctattcgtaccccgacctgctgctgttctgccagatgctggcccggaacaaaggcgtagccaccgtaccgtatccgacaggactcgtacgcttctctctgggcggctatacctcggcatcgaaagaggggttgaaagttctcggggccgaattggaagatgccttttcgatcttcatccggtattggaaccaatttgccgccatgcgtgccgattcggcgaacaaagagcgtgaaagcagcgccctgctgaatgagatgttccgctatccgaaagacaaagatttcatcgagagcatcattgcggattatccgctttcagcgaaatacaagaaagacaaagcgccgtcgctgcaaatccgcgacgtacgctcgctgtaccacgcctctcccgaaaaaagcggcgtaacgatcactacaatcggaaggtcagccaactcggtgatcgagctgcacggcgatatcgtcggcacctgcaaagacgttttcgaattcgtccgcagttcggcattcaccaaaatctatgaaaacctgctcgcacaggtttacaaacgtgttccggcgctggccgacctggatttcaacacggtcagttcgaaatacagcaaagcggtcatcctgaaatacattaccaacaaacggactttccagccgaaccaccacgtactcgacaaccccgaggagaagagtgtaatgatggagatcctgatcgagatggagaacttgctcttctcggacagcaaaatgaaaatcctggctatcaacgcaacgggcagtcccgaactcgacaaggcaaaactcgaaggattgaactcgatcatcaaaaagtatatccgggagatcttgctgcacttcaacctgccgttcgagaaggagagtctcgagcctagccgccgcgaaattatccagatggccggcgcatgcttcgaagagatcaccggtatcaagcttttacagttgaacctgaatatctggatcgacgaattcatgcgcacgctgcgtgacaaagaagagttccgcaacctcgccatctcgcaaaaaagcatcggctatatcgaagacgtactgcgcacaggagtggaccgggcagccgaaatcacggacaagatactctatctgtacctactcgaaaacgacaagtctttctacaagatggtctgcgacaaactggcctatttcgacaagcgcatcagcgattgcgacgacacggaagtgaggatgctcaccgaagagttcgtttcgagcatcatgccgatgcagttgcaggaactgagtaactacatcatgcgcaagaaagacatcaagatcgcagaaagcgaaatctatgcggtcagccgccgcgtcgtgcgattctacatcagcctgatcaagcgcacccggggtacggactattacaaccgttatgcgcatacgatcgtacggatcgtcgaaacggcattcaagaagcaaaattccagcgtaaacgaaatggtacaacacggcatttcgatttacaaaggtttcgaaatggaaaacaagtcgctcgaaaccttcgccggaggccgtatcaactggattaacgaactgatgaccaagtgcggcgtaatctcgtcggaacagcccgtacaggaacacacgcggatcgttaccgacgcaaaaaaacgcgaatatccgttccacaagatcgaccgggtggaaagcaaaaagcctgatggggagattccttccgattatccggccgaatacatccgctacatcgacttgcggcccgatccgtcgttcttcgtacaccgcctcgcacgtttcgtcgcaaacatggactcggacgactaccgctgcaaggtggttaaacacggtatcgtcaaggaactggtcatcttccagaaaggttacctgaaatacctgaccgacaactaccggctcaattatacggaagacatcagcctgcaggacatccgtaatttcgtgccggacgtcatttcgctgctcggagccccggaaaaactgatttcattcccgcagatcggttatttcgacatcaaaggtcccgcaggcaacatcaagacgatcgtcacgccgctcaagtcggaagccgattatttcggcgacgtaaaaaaaccgcgcctgacggtcatcaacgaaaaggtgaaagagatgggtggcacgccgcgccacggatcgctgtttatggtcgaagagaacgacggcagcgtcttcgtaatcgagatcaacggcgacagcggggtaggcaagagcgaaatgatcgctgcctttgtcctcaaatggctgcgcaacaatctcgaaggcatccgctcggtgaaaatggtcgccggcgacatgttccacgaattccaggacgccgacggaaatctttacggcatcggcaccgaagtgggcgatttctcgcgtacgaccgatttcgaccccgactatatcaaatactacaagtatctgttcgaaagcagtgcggacagcaacgtggacgaccgcaacgcccgcagcaccgtgagtggcatgtgcgacatcacgatgccttacaaggtggatatcatgctgtctgccagcaactattcgaaaaacgaaggcggcattacacggatcgacaatccagaaaactttctgctctatatcgatgcacacggtgaacgcaaggagaaagcgaccagcggagacggcccgaacttccagtgcacgctcaaacgctacacggccgacaagaatatcgtcgaggtgatttcacgtcacggcaactacctggacgacattctcgactgggatttctctcccgccgaccaacaatactacctcgcttcgtcattcaaactgctcgacaagatagatatcaccgaagtggtgaaaatgatcttcgcaggcaggtcgtttacccgggatggggtagcctacacgatcgaaaatgtggcattcgacatgatccagaaccgcttcatcgcaacggtttcgtaccggttcggcgatgacaggctgaccgatgaaaaacagatcgaccgcaaaatgttcagcgcgatattcgatgcactggccagtacgccgggcggccagccgttcatctcggaagagggacaggtagaatgtattcacaatcttatcacctgtctgcgcggcggcaaagacggcaagggtggggcacgccacatccagtgcggcgtactgtcaaccgaaatcggcaagaaaggccgcgaaatcacgggcccgcagaaggcagcggccgcactcaaacaactgattcaggaagtccgtgtgaacaaacccgaaatcaacgaaggcaagatcaaggtaaaacggttgctgaatgaaaagtaccaacatcttttccacggagagatgaacagctccgagttgtggcgctacaacttctacctctaccagctcgacaacatgcgtaaagccgatttgcgccggatggacaacaagtccaaaaaggtggacatcaccaaccttgtcaatttccatccgtccgacccaaatcacgaattcagtccgctgttggtaaatcccaacctgaacatcgaactgacgagcttcggggaaacattcgaggaattgatgagttttccgaactatcccgatttcgcagaggagtttgcggccaaagtaccgacactttacatcgccgaaggctacagcgaagaaacgaacatcaacaatatgatcgtgcagttattgatgctcgaaggctacatcagcagcgacgacctggcccggggaagcgtaatcgagaaggtaaaccgggaaacgatcgcagctgccaaatatgcagtagtgcagtacctgaattcgctcaaaaaacagggaagcgaaccggcggcagccaaagccaaaccggagaacgataaaacagcactcaaaacagtaaccaaaccgggtccgaagcgcaaataa

SEQ ID NO: 1602 - DNA, 4266 bp, Alistipes indistinctus
atgtcattcaagaaagacaacaaggcacaaagcggattctcgaagatttcgattggtctggcatctcccgaggagattctggaaaattcgagcggagaggtcctcaagcctgagacgataaactaccgtacgtacaagccggaacgcgacggcctcttttgcgagcgcattttcggtccggtcaaagactacgaatgccattgcggcaagtacaagcgtatccgctacaaaggcatcgtctgcgaccgttgcggcgtggaagtgaccgagaagaaggtgcgccgcgaacgtatggggcacatttcgctggtcgttccggtagcgcatatctggtatttccgttcgctgccctcgaaaatcggctacctgttggggatcccgaccaagaaactcgaagcgatcatttactacgaacgttacgtagtggttcagccgggagccgccgctgtgaacggcgtggccgaactcgacctgctggcagagaaagagtacctcgatatcgtcaatgctttgcccaaaggcaaccaacagctcgacgactccgacccggacaagttcatcgccatgatgggcgccgaagcgatctacacgctgttgcagcgcgtggacctcgacgagctctcctattcgctgcgccacaaggccagcacggagacctcgcagcagcgcaaggccgaagcactcaagcgcctgcacgtcgtggaagcattccgtgaatcgcgcgaagtgaataaacccgagtggatgatcctcaaggtgatccccgtgatcccgccagaactgcgtcccctcgttccgctggacggcggccgtttcgccacttccgacctgaacgacctgtaccgtcgcgtgattatccgtaacaaccgtctgaaacggttgatcgaaatcaaagcaccggatgtcatcctgcgcaacgagaaacgcatgttgcaggaggccgtggattctctgttcgacaactcgcgcaaaagcaatgccgtgaagacggaatcgaaccgcccgctcaaatcgctttcggatagtctgaagggtaaacagggacgtttccgccagaacctgctcggtaaacgtgtcgactattcggcccgttcggtaatcgtcgtcggccccgagctgaagatgcacgagatgggtattccgaaagacatggcagccgagctgtacaagcctttcgtcatccgcaagctgatcgaacgcggtattgtcaagaccgttaaatcggccaagaagattatcgaccgcaaagacccggtgatctgggatatcctcgagaacgtgatcaaaggccacccggtgctgatgaaccgtgcaccgaccctgcaccggctcggtatccaggctttccagcccaaactgatcgagggcaaggccctgcaattgcacccgctggcttgtaccgccttcaacgccgacttcgacggcgaccagatggccgtgcacctgccgctgggcaatgcagccattttggaggcccagttgctgatgctcggttcgcacaacatcctgaacccggccaacggcgcgccgatcacggtgccgtcgcaggacatggtactcggtctgtattatatcaccaaagaacgtgctggttcgaaaggcgaaggactcgctttctacggacccgaagaagcgatcatcgcctacaacgaaaaccgtgcaggcctgcatgccaaagtgaaggtgatggccgacacgctcgacgagaacgaccagccggtcaagaaactgatcgataccacgatcggacgtatcctgttcaatcaggtggtccccaaagaggtgggatacctcaacgaggtattgaccaaacgttcactgcgcgacatcatcgcactggtgatgaagaaagccggtgccgacaaggctgccgagttcctcgacgcgatcaagaacctcggttatcaaatggctttcaagggcggtttgtcgttcaacctcgacgcggtcatcatccccgaagagaaagacaagctggtacaggaaggctacgaacgcgtggacgaggtgatggagagctacaacatgggtcttatcaccaacaacgagcgttacaaccagatcatcgatatctggaccaatatcaacatgaagctgaccaagacggtgctcgaccacctcacctcggacatgcagggtttcaatccggtctatatgatgttggactcgggagcccgtggttcgaaagagcagattcgccagctttccggtatgcgcggcctgatggccaaaccgcagaaatcgggagcagaaggcggtcaggtcatcgaaaacccgatcctttcgaacttcaaagagggtttgtcggtactggagtacttcatctcgacgcacggtgcccgtaaaggtctggccgataccgcactgaagacggccgacgccggttacctgacgcgtcgtctggtcgacgtagcgcaggacgtgatcatcagcgaagaggattgcggcacgctccgcggcctgacggctacggccatcaagcgcaatgaagacgtggtgcaaaccctctacgaacgcattatcggacgtaccaccgtgcacgacgtgcacaacccgcacacgggcgaactgatcgtcgctgccggagaagagatcaccgaaaatatcgctgcggctatcgatgccgccggtatcgaatcggtcgatatccgttcggtattgacctgcgaatcccgcaagggcgtctgtgcgaagtgctacggccgcaacctggctaccgcacgcatggtacagaaaggcgaagtggtcggcgtaatcgccgcgcagtccatcggcgagccgggtacccagctgacgctgcgtaccttccacgtcggtggtgtcgccggaggtgtggcaaccgacaacagtgtcgtttcccgctacgaaggccgcctcgagatcgacgatctgcgcaccgtcaagagcaagaacgaagcaggcaaagaggtcaatatggtcatcagccgcctcgcggagatgcgcatcgtcgatgtcaacaccgacatcgtactctatacgcacaacctgcaatacggctcgacactctatatgaacgacggcgacctggtgaaaaagggcgacctgatctgcgaatgggatccgtacaatgcggttatcatctcggaatacgacggtaagatcgccttcgagaacgtcatcgagaacgtcacctaccgcgacgagttcgacgaacagacgggcttccgtgaaaaggtgatcatcgagtcgaaagacaagacgaagaacccggtcatcaagattctcgacaagaaaggcgacgagcagaagcaatacaacctgcctgtcggcgctcacatcgtcgtgaaagaggatgctacgatcaaagcaggcgaaatcctgatcaagatcccgcgcgccatcggtaaggcgggtgatatcaccggcggtctgccgcgtgttaccgagctcttcgaggcccgtaacccgtcgaatcccgccatcgtatctgaaatcgacggtgagatttcgttcggaaagatcaagcggggcaaccgcgaaatcgtcgttacctcgaaaatgggcgacgtgaagcgttacctcgtaccgctgtctcgtcagatcctcgtgcaggagaacgactatgtccgtgccggtacgccgctttcggacggagcgatcactccgggcgatattctggccatccagggcccgactaaggtccaggagtacatcgtcaacgaggtacaggaggtataccgcatgcagggtgtgaagatcaacgacaagcacttcgaggtgatcgtgcgccagatgatgaacaaggtacagatcgacgatccgggcgatacccgtttcctgcccgagcagatcgtcgacaagtgggaattcatggaggtcaacgacgaactgtacgacaaggtcgtcgtgaccgatccgggcgagtcgcctacgatgcgcgccgggatgatcatcaccgtgcgcaaattgcgtgacgagaactctgtactcaaacgcaaagaccagaaaccggtcgaggtacgcgacgtcatccctgccacctcgaaccagatcctgcagggtattacccgtgcggcactgcaaaccagcagcttcatgtcggcagcatcgttccaggagacgaccaaagtgctgaacgaagcggccatactcggcaagagcgacccgctcgagaagctgaaagagaacgtaatctgcggccacctgattccggccggtacgggcgaaccgaagtaccaaagcattctcgtcgggtcgatggacgattacaattcaatgatggtaggtacacagtcgcaggaatag

SEQ ID NO: 1603 - DNA, 4761 bp, Alistipes indistinctus
atggctaaaaagattgtcaaatacctgttgcgggggctgctctgcacgctggctgtattgattgtactgcctgcattgctgtatatcccggccatccaaaacttcatccgcaccaaagcggaagattacgtctccgcacagacagaattcaacctgtccgtgcgacgcatccggctggcattcccgttaaacctcgtgattgaacaggcactggtcagccaaccgggcaacgatacattgctctactgcggcaggttgcaggctgatgtggcgttgttgccgttactgcgcaaacaagtcaccgtgcggaaattcacgctgagccaaaccacagcgaactacctcgacacggcggcccagttcgggctgcgggcccagatcggtaagctgatcctcaaagccgacgacatcgacctgaagcgtcgtgtggccggaatcacctctgtcgaactgtcgcaaggcgacgtaagcctttcgaccggggagagcccggccgacaccaccgccaaagatacggcaacaatcccctggaccattcaagccaaacgactgcggctcaatcagatcaatttcaggatggaaacccggccgcaagtgacgcgattggctgtacgcctggcagcgggtgacatcgcagatgcagaaatcgatctgggtaagcaagaggtccgtgtcaatcggattctgctgaaacagggcaactactcctacctgacggacaccacatctcaaaagagaacggacacggaaaccgtacaggatgcgtcctcaaatgttgcttcacaaccgtggacgattgccgtaaaccgcattgaactccaaaacaatgcggccgagtacggccgcattgacggaatacccgccccgggattcgatccatcgcacatcgcggtttccggcctgaatttcgtagcggactcgctctacaaccggggcagtgagattcgcggccgaattgcctccctctctttgagagaacgtagcggattggcggtcgaccggctcagcggaagtttcggaatggatagcagccggatttttttgtcggatttcaatgtgcagactccgttctcttcgatccggatcgacttgcaagccgccgcctcggcacttaaactcgatccggccagtccgttgcaaatgaatctggcggcagacatcgacctgaaagagatcatgccgctgacgcccttcagggacgacccggccatacgaaaagccctgaatggaaaaacggttacgcttaacagcaatttttcaggtaccgtcggcaggttctcctccgaaatcgccctagcgattccgcatcatctcaatctttccgtgaacggccttctcgcttcggcaaccgaccccgcaaaactcaacggccaggcccggatcaaaggcgtattcagccggacggacttcttgagggaattattgcccgattcgaccttacgcaaccggctccgcattcccggccacatcggactccacggacgcatcgaaatgcacaacggagcgttcgcaccggtactcgcattggctgtagattccggcacgcttacactgaaaggacacctaacgcccaaaagccagcaatacgacctgacgctcgcttgcgatagtttcccggcaaaggatttcctgccggccgattcgttggggcgcattacgttgcagttggaaacccggggaaaaggattcgatccgcttgtagcaaagacacaaagcgagctgaagctgcaaatcgaccggttcgattacctcggtttcccgtacaacgggatcgcactggaagcggtattaaaggaacaaaacctgtccgggcggctgaccagccaaaacgaagcgctgcaactcgatctcggattacaaggccacctgacagaaaccatacaaaaggccgaaatccggggagtcgtagacagctgccacctggaccgcatgcacctgacccgggagcggatcgggggtaccctcacaatcgacctgaccgcttcggcaactgcggataagagttacaccgcgacactggccctcgacaaaatcgttctttggaacaaatgggaaaccaatacaatccggccgacgtcgctcacattgctgtcagctcccgaacgggtagaagccggaatccgctcgggagacctgcagctggacttcgaaacacgcgtcggagccgattcccttggagcccgtttcgcccgcggcgtaaagctgttctccgaacaactgcgcaatgaagatttcaacatggataccatcagtagccagctaccgccattccggttgcaggcaacggcagggaggaaaaacatcctgaacaactacctaaaattacagggaatcagctttaaaacattttcgtttgacgcgctgctcaaagattcgacaccgttttccgcccggatggtcgtctaccagttgacctcgggcagtatcaggctcgacacgttgactttcagcctgcaccaacagcgcaagcaactcaactacctgctccggctggcaaaccatccgggtaacctggataatgtgggtatgatcgccctctacggcaatattgcgggcgaccgggccatcctgaactgcctgcaaaaaagccgttccggcgaagaaggcttccggttcggactacaaggcgtactctcggacagcacggttacgataagcatgttccccgaaaatccgacattcggctcccggcaatggagcgtcaatccggacaaccacatcgtgtatcacatcggcaaggacatccatgcggatttcctgctcacacacgacaatcaacgcgtttcactgcgcacgactgaccacaccgagcacggcccgctggcgctggacatcgccgggatcgatatcggtaagaccctggcattatttccgacccctccccccatagacggtcgcttcgatacgcacatcgttttgcaacagcaggatacgacgggtacttcgctggaggccggaggcaacgtcaacgtcaccgacctgcaatatgataaacggcgtatcgggaccatcggactcggcttcgattaccggatggagaaggggagcggtcagcagttcgacgcaaaactctcgctggacagcacggaggtgttatccgcccgaggcagctataccgacacgctgccggagcggccgctcgaattgaaggttgaattgccgggactgccgctcacccccgtcaatgcactgttaacaccgggcatggcacagctgtcgggcgccctgaaagggaagatcgccgcaacaggctccttccagaatttatcggtcgacggcagccttgcctttgcggaaacagccgtggaagtgggtatgatcgggactacgttcacattgtcgcccagcccgatctcgatcgacaacagtctcgtccggttcggcaacttccagattatcgcaccgaacaagaagccgctgacgatcgacggacaaataaacctgcgggactttcgcgccatcacggcagacctgctcctcaccgcatccgatttccaggtggtcaacgtggctaaaagccgcaagtcgatggtgtacggacaagcttatatggatctgaatacaaaagtcaaaggcaggctcgacaatctgttcgtccggggagacgtctcgctgctgggcggcacggaggtgaactacgtcatgcaggactccccgttggaggtgaaacaacagaaccagaatatcgttacattcgtctcgttcaacgataccaccgagttcgaacagttcgattcgatccgcccgatgaagatcaacgggctggatatccaggtaaatgtcaacgtaaacaactctgtcaaactgggcgtcgatctgtcggaagatgcagaaaacagggtccagttgcagggagggggtaacctcacctatacgatgaaccaattgggagacagccgtttttcaggtaaatacgaagtctccggcgggttcgtgcgctataaaccgcccgtaatttctgaaaaatcgttcgacatcgtcgcgggcagttacgtcgaatggagcggggagatgctcgacccggccttcaacctgaccgccgtcgacaaagtgcggacgaacgtcaccagcgacggcagcgacagtgggcgtcccgttacgtttgacatcagcatcaaccttcgtaatacgctgagcgatctggctgtcacgttcgacctttcggctcccgaagacctgaccatgcagaaccagctctcgtcgctgaccgccgaacaacgggccagccaggcgatgagcctgctaatctacaacacttacacgggacccggcaccaccgcgaaggtcaattcgtcgaacccgctgaacactttcatcgccaaagagctgaaccagtgggcgcagaacaacctcaaaggcgtagacctgagcttcggcgtggatacatacgaccagaccgccaacggaggaacgcagcgcacggactactcgtacaaagtctcgaaaaacctcttcaacaaccgtgtccgcgcggtgatcggaggcaagttcagcaccgatgcggacccgaccgagaaccttaaagaaaacttgatcgacgacatttcactggaatacatggtcaccaaacgcgacaatatgttcgtcaagctgttccggcataccgattacgaaagcatcctcgaaggtgaagtaatcgaaacgggagtcggtttcgtgatccgcaaaaagatgctcaagatcaccgacctgttccggtttatgaagaacaaagtccaaacacaggccgcaccgccagccaaaaccgcagctaatgaatag

SEQ ID NO: 1604 - DNA, 3273 bp, Alistipes indistinctus
atgctgaaattgttcttcggaacaaaaagcgagaaggaccgcaaggaaatcgagccttatgtagaaaagatcaaggcggtttatccgctcatagagcaacttaccaatgacgagctgcgtgcgcgcagcgctgcgctgcaagccgccatcgcccagcacatagccggcgatgaagcacagatcgtcgaattgaaggctcaactggagaacgtagacacgtcgctcgacgacaaagagaatatatcgcgccagatagaccatctgaccgaggagatcgaccgcaaaatcgaggaaaaactcgacgaaatcctgcccgaagcgttcgctatcatgaaagatacgggccgccgttttgcacagaacagcgagatcgtagtgaccgcgacagatttcgaccgcaacctggccgccgaaaaggacttcgtccgtatcgacggagacaaagccatttacagtaacagctgggtggccggcggcaacacgatcacgtgggatatgatccactacgactgccagttgttcggcggagtggtcctgcacaaaggtaaaatcgccgaaatggcaaccggcgagggtaaaaccctcgtggcaacgcttcccgtattcctgaacgcactggccaagaagggcgtccacatggtaacggtcaacgactacctcgcccgacgtgactcggaatggatgggcccgttgtatcaattccacggcctgtcggtcgactgtatcgaccggcaccagcccaactcggccgcaaggcgcaaagcctatatggccgatatcaccttcggcacgaacaacgaatacggtttcgactacctgcgcgacaacatgtcgatctcgcccgaagacctcgtacagcgcaagcaccacttcgccatcgtcgatgaggtcgactcggtgctgatcgacgacgcccggacaccgttgatcatctccggccccgtccccaaaggcgaggaccagatgttcgaacagtaccgcggtgcggtcgaaaacctcttcaacctgcagcgcaacctcgtcacgcaactgctcgccgatgcgaagaagctgatctcggagggcaaaaccgacgaaggcagcatcctgctttaccgcgcccacaagggacttcccaaatacaagccgctgatcaagtacctcagcgaaccggggatcaaagcgatgatgctcaagaccgagaacatctacatgcaggacaacaaccgccgcatgccggaaatcgtcgacgatctcttcttcgtgatcgacgaaaaactgaactcggtagagctgcaggacaaaggacacgaggcgctctcgaagagcgtcggcgaagagggtttcttcgttctgccggacatgggcagtatcctggccgatatcgaaaaagagaatatcccgggcgaccaaaaagcgatgaagaaagacgcggtgctgaacgactatgcgatcaagtcggagcgcgtacacacggtcaaccagttgctcaaggcgtacagcatgttcgaaaaagatatcgaatatgtggtgatggacaacaaggtgaagatcgtcgacgagcagacaggccgtattctagaaggacgccgctattcggacggcctgcaccaggccatcgaagccaaagaacgcgtcaaagtcgaagctgccacgcaaacattcgcgaccgttacgctgcagaactacttccgcatgtaccacaagctcggcggtatgaccggtacggccgaaaccgaagcgagtgagttctggaacatttacaaactggacgtcgtagtcatcccgaccaaccgtccgatcatccgcgacgacaaggacgacctgatttaccgcaccaaacgcgagaaatatgcggcggtgatcgaacagatcgatgaactggtcaagcagggccgtccggtgctggtcggtaccacctcggtcgagatttcggaattgttgagccgcatgttgaaactgcgcggcatcaaacacaacgtcctgaacgcgaaacaacaccaactcgaggcacagatcgtcgccgaggcgggccagaccggccaggtgaccatcgccaccaacatggcgggccgcggtaccgacatcaagctgacgccggaggggaaagccgccggaggtttggcgatcatcggtaccgagcgccacgaatcgcgccgtgtggaccgccagttgcgcggccgtgccgggcgtcagggcgacccgggctcctcgctcttcttcgtatcgctcgaggataacctgatgcgcctgttcggctcggagcgtatcgccaaactgatggaccgtatgggcctcaaagagggagaagtgatccaggccggtatgatgtcgagggcgatcgaacgagcccaacgcaaagtcgaagagaacaacttcggtatccgtaaacgcctgctcgaatacgacgacgtgatgaacgcacagcgcgaggtgatctacacccagcgccgccatgcgctctacggagaacggatcgaggtcgacctgaacaacatcatgatggactacgcgcaatccttcgtcgacacgtacagcgaagacgatttcgaggatttcaagttcaacatgatccgccaggtggccgtgcagccttcgttcgacgaagcgacctacaagtccgccagcaaggagatgctgaccggcatggtggtcaaagacttccaggatgcttacatgcgccgcatcggttcggtagctgcgacggcatatcccgttatcaagcgtgtttacgaagaacagggcgataaatacgagaatatctacattcccgtgtcagacggtttccggggttacaacgtaccggtaaacctgaaaaaggcctacgattcacagtgcaaagaggtgttcaagagcttcagcacgatcgtcgtgctgaccaccatcgacgagaactggaaagagcacctgcgcgagatggacgaattgcgccagagcgtacagaatgccacttacgagcagaaagacccgctgttgatctataaattcgaatcattcaacctcttcagcaaaatgctcgagaaggtaaaccgggaaatcctttcgacgctgttcaaggcattcatcccggtacgcgagaacccggaagcggcagcgccgcaacaaccggtcgctcctcccaaaaccgacatgtcgcgtatgcagacttcccggatggaagctgcggccgcagccggacagggggacaaaagcaagcccgccccgatccatgtcgagaagaaagtgggccgcaacgatccctgcccttgcggaagcggtaagaaatacaaacattgccacggccagaacgaataa

SEQ ID NO: 1605 - DNA, 3237 bp, Alistipes indistinctus
atggttatttttgcgcgacgtggcgggattttttgccccctccacaaattcgacctaaactttaccaaatcaacaatgaagaacgcaaacaaggtttcccgttctttccagcacatgatcctgttgtgcggatgcttgctaatatactattccgtatccgcccggcaacataagcccacagaatcgggttacatcgcacaaaaaacgcagggcatagattcagattacgtactgattttcaactcgtacagcgaatcggctccctggtgccgcagcctcgtcgactcgacggtaatggacctgatcaagctttccccgcaaaccatgacggtgacccagaacctgaattcaggactgctccgggacgaaaaagcgcttgcacaactgcgacaacaggtggatgtctcctaccacgacaaaccccggatgattatctacatcggttccaccagttggccgttcctgcacgaaaccatcgaaaagaaatgggggaaagtaccttctatcatcttctccgacatcgattataccggtcctataaccaatctactccggaaaactccgatcgcacctgccctccgcatcccgtacgacaagattgtcaaggagtacgaaggtgcgcttagcgtcgtctatatgcctatttacctgcggcaaagcctcgcgctgatgcatcagctgacgcctccgatgaccgagctgtgcttcatttccgacacccgctggatcagcgcacaaatgcgagcggacatggccgccatcaccaagaccgattttccggagctgaaagtacgatacctgatttcggcagacatgtcgacgttggatttgctcgattcgctgcagcattacggacaggaaaccggcgtactcttcttctcctggctcaagcagagccaagtgggagattcgttcgtcaacgactcccatttccggatcatcatcagcaaatcggcccggcaaccgctgttcgtactaaacgacaatgaggtcaatacggacagcgatgtcctcggcggctacttcccgacccgggccgccgtttcacaccatatccgcctggcacttgagaaaacgcttgccggccagccgggttcgttccagacggtggaacccgcgcaaccggtaatcgactacctgacacttatccgcaaaggcatatcccccgacctgctgcccagcaatacccacatttactggaaacccgacaattttttccaccaataccgttacctgctgggcggaggcgcacttatcgtcgcggttctgctgctgatcatttacttcctttcccgcagccggacccaacagcgaaaagtcctgacatacatggcccaataccgcaacctgttcgaaaacatgcctattccgtacctgcagatggaaatgctcttcgaccagaacggccgatcgcacgacctgatcgtccgtgacgtcaaccctgcgttcgaaaaagcattttattcgcacaactgggtggtcggccggcgtgtcaccggacaacacacacaacgggacaatacactgaatctcgcccgcactgttctcggtgaaaaacgcgccgtgagcgtatcctactatttcaagcaaaccgatacgcattacacagtgatcctcgccccatcgaaagagcctaacttcatcgatgtcttctacaccgacaacacggcgttggtccgcgcacaacaactgctgcgcacggtgaaccacaaactcgcaatggctctggagatttcgaatattaccccgtggaaatgggatctggaaacggatacgatcctatgcgacgtaaaccgttcggtggaactgatgggaggcgagaatatcgacgagaacagacttgcggtgcccgaaacggcctatttcgccaaaatacacaaagaggaccgcgaacgcatcaaacaggcctaccgggacctgattgaggggaaagtaccgaaaatccgcgaagagtaccgcgtggccgaccccggccgttcgcacttcgactgggtggaagtacaggctgccgtggatgcccgcgacgctgccggcaaaccgctgacactgatcggctcgtcgctggtgatctcgatccgcaaacaaatggagcaggaactgatttcggccaaggagaaagccgaagagtccagtcgtctgaaaagcgcgttcctcgcaaacatgagccacgagatccgtaccccgctcaacgcaatcgtcgggttctcgaacattctcgccaccaccgatgcagaagaggagaaacaggagtatgtcagcatcatcgagaacaacaacaacctgctgttgcagttgatcaacgatatcctcgacctgtcgaaaatcgaggccggcacgctcaacttcacgtataccgagaccgacctgaaccggctgctcgaagagatcgtgcacgcagcgcaaatgcgcaatacgtccgatcaagtggatgtcgtattggccgaaaccgtccccggctgtattgcccgggtagaccggaaccggctcacgcaggtgctgacaaacctgaccaccaatgcactcaaattcacacagcgagggagcatccgaatcggctacaggttagaacccgacggcaaattcctgtacttccacgtcagcgacaccggctgcggtatcccgaccgacaaacaaaaatcggtattcgaacgtttcgtaaaactgaacagtttctcacagggaaccggcctcggactctcgatctgccaaacgatcgtcgaacatgtcggcggccggatcggcgtcgaatccgaagaggggaaaggatcgaacttctggttcacgatcccttaccgtcccgtctcggatcaaaagaacagaaaaccgcaggacaaacagatcgagccgataccggtcgaacgcgacaaactgaccatcctggtagccgaggacagtgcggacaactttaaactattcgaaacaatcctgaaaaaagactacacgatcctgcatgcgtgggacggccgggaagccgtggaactgttcaaaacccaccagccccatctggtactgatggacatcaacatgccggtactgaacggctacgaagcgacggcagaaatccgcaaactttcggaacgggtaccgatcatcgccgtaacggcttatgcctatgcgtcggacgaagagcgcatcatgaacagcggcttcgacgcgtatgtacccaaaccactcaacgccagtatcatgcgaagcaagatcgtcgaacttctgaaaaaacggctggttttcatttga

SEQ ID NO: 1606 - DNA, 3345 bp, Alistipes indistinctus
atgtttaatcaaccaaaccaatcccgtatgaagcaattcgtctctttcatgctttgcctgctggcattctctgccgcctcggcacaggtcaccacctcgagcatgagcggacatgtgcaggatgaacagggtgcccccgtagtcggcgcactggtcctggccacacacactccctcaggcaccgagtattccgccattgtggacggtaccggcaattaccgcattatgaacatgcgttcgggcggtccctattcggtgaaaatttcgatgctcggcttccagaccgtactcaatgaaggtatcaatatcgcattgggtgacaactatgtactcgacgtcacgctgcccatcgaatcgaccgacctggacgaagtggtggtcaccggcacacgcagttcgatcctcaattccgaccgtgccggcgtagcgacgaacatcaacaaccgccagcttaacgtgctgccgaccgtcagccgttcgatttcggactttacgcgcctgacgccgcaggccggaaacagcggttctttcgggggccgggacacccgttacaacaacgtttcgatcgacggtgcggccttcgcacagcgcttcggcctgagtacgtcgaacaactacccgggcggcgacgcgcaaccgatttcactggatgctatccaggaaatttcagtcaacctgaccccgttcgacattcgccagtcgaatttcaccggtgcgaacatcaacgccgtcaccaaatcgggcgataactcataccatgcaacggcctatacgttccagcgcttcaaatcgatgaccggcgaccgggtgcaggatgccaccgtcgccaatgccaaaaccacctcacgccaaacctacggtgccagcgtcggcggcccgattatcaaaaacaagctcttcttcttcatcaacggcgagctcgaatacaaatcgttcctcggaaaccaatggcagccgagcacagacggtgtcggaagcgccgaaaacaagatatcacagaccaccatcgccgacttggaacgggtttcgaatttcctcaaagagaagtacaattacgatcccggcgcataccagaatttcggcaactcggctgcggacaactacaaaatcatggcccgcatcgactggaacatcagcaagaaccacaagctgatggtgcgctacaacgatgtcaaatcccaggacgacaacctcgtgagcggagcttccaccccgggcggcgtccggctgaacaacgcaggccgaaacagcatcaactccatctcgttcgccaataccggttacaagcaggaaaaccgcgtgcgttcgatcacggccgagttgaacagcgtcttcagcccgaaggtctcgaacaagctgctcgcttcgttcacgaacatcaacgacacccgtaaaacggacggagaccttttcccgttcgtcgacatcatgcgtctgggcagcgacggtaaaacctatgaaggttacatgtcgttcggcacagaaatcttctcgttcaacaacggcgtactgaacaataccttcaacatcaccgacaatgtgaccatcggtttgggacagcacacgctcaccgccggactgtcttacgaaaaccaacatttcagcaacggttacatgcgcgagggaaccacttactacgcctacaattcggtggacgacttcatcaacaacgcgaaaccggccgcattcgcctaccagctcggataccccggcaatgaggatgcgcgcacgaaactcaccttcgggctggccagtgtttacgtccaagacgaatggagggtcaatcctaaactgcgcctgaccgcgggtctgcgcctcgaagttccgatcttctacacgaaactccaggggccgacttccacgtcgattaacggtgtacaaactccactgagcgaaattcctttcgagaacgggcaaaccgtcaacctgagccaatggcccaagagcaaaccgcttttctcgccgcgtgtaggcttcaactgggacattacgggcgaccgctcgatccagctgcgcggaggaacgggcatctttaccgggctgctgccgttcgtctggttcacgaaccaaccgggaagcgccggattcgtacagagccccgaagtggtactcaccggtggcggagtgcccaacgatctgcgtttcaacccgaattaccgcgaccaggtattcaacaatccggctattttcccgaatccgcccaaggcgggagaaacaccctccggctcaaacttcgccaaagtggacgagaatttcaaactcccgcaattgtggcgcacgagcgtcgccgcagatttccgcctgccgtgggagatggtgctgactctcgaagcgatgtactcgaaggatatcaacgccgtaacgcagcgaaacatcaacctgcccgatccggtcggcaatttcaccggcgtagacgaccgtcccagatggaattcgggcaaactgaacaaggacgtcagctcgatgatggtgctgaccaatacgaacaaaggacaccaggcttcgctgacggtacagctgaccaagcaattttcgaacggtctgtccggtatgatcgcctacacctacaacaatgcgaaagacctcactgccaatccgggcagtgtcgccctgtcggcctggagatccagcgcctcggtgggcagcctgaacgatccgggagtcagctattcggccttctcgatgccgcaccgtgtaaacggctatatctcctattcggtagactgggccaagaaccacctgcgttcgaccttcacgctttactatagcggcacgaaccagggacgcctgagctacgttttctcgaacgacatgaacggcgacaccttcggtcaggacctgattttcattccgcgtcccgaccagaccaacttcgtcgatgtgaaaaacaaagagaccgggaaagtgacctattccgccgccgagcaacagcgcgattacgaagctttcctgaacggcaattcgtacctgaagaagcgtcagggtcaatatgccgaacgttacggagacgtacagccctggatcaaccagttcgacttcaagttcctgcaggacatcgcctcgaatttcggctcgaacaaccgctattcgctgcagttcagcgtcgacattctcaacgtgggcaacctgctgaacaaaaactggggcgtttactacaccaacgggatgcagagctacgaaaatttccgactctttacttacaccggacaaaatgcggccggtgccgcccaatacaccctcaatgccagcagcagcgacaatttcaagaaaaactcgaaatgggtaggccagaactccacagccagcacgtggggcattctcttcggcctgcgattgagcttctaa

SEQ ID NO: 1607 - DNA, 3570 bp, Alistipes indistinctus
atggcacagaaaaaatttattacttgtgacggtaactatgcagcggcacacatcgcgtatatgttcagcgaggtggctgctatttaccccatcacgccgtcgtcgacgatggccgaattggtggacgaatgggctgcacaaggccgtaagaacatcttcggcgaaacggtcaaagtggtcgagatgcagtccgaggcgggcgcagccggtgcagtgcacggttcgctgcagagcggcgcgctgacttcgacgttcaccgcttcgcaggggttgctgctgatgatccccaacatgtacaaaatcgccggtgaactgctcccgggcgtgttccatgtttcggcccgcgccctggctgcgcagagcctttcgatcttcggcgaccatcaggacgttatggcaacccgccagacgggctttgcgatgctggctaccagcagcgtgcaggaggtgatggacctggccggactggcccatatcctgtcgatcaaatcccgcgtgccgttcatgcatttcttcgacggtttccgtacgtcgcacgagatccagaagatcgagctgatcgacgacgaggcactcaaaggattgctcgaccaaaaggcactcgccgagttccgccagcgtgcgctgaatcccgagcaccccgttacgcgcggtaccgcccagaatcccgacatctatttccagtcgcgtgaggccgccaaccgtttctacgatgcgattcccgatatgaccgccgaggcgatggtccagatcagcaaaattaccggccgcgagtacaagccgttcgtttactatggcgatcccgatgccgagaatatcatcatcgcgatgggttcggtgaccgagacgatcaaggagacggtcgattacctgcgtgccaaaggcgagaaagtgggcgttatcaccgtacacctgtaccgtcccttctcggctaaatacctgctgaacgtgctgccgaaaagcgtgaaacgtatctgcgtgctcgaccgcacgaaggaaccgggcgcgaacggcgatccgctgtacctcgacgtgaaagatattttctacggtcagcccggcgccccgatgattatcggcggtcgctacggcctctcgtcgaaagacaccactccggcgcaaatgcttgccgtgttcaacaacttgaaagccaatgaaccgaaaaatcagttcacggtcggcatcgtcgatgatgtgactttcaagtcgctgcctgtgggcgaggagatcagtctggccaaaccgggtacgttcgaggcgctgttcttcggattgggtgctgacggtacggtgggtgcaaacaaaaactcgatcaaaattatcggcggttcgaccgataaatattgccaggcctacttctcttacgactcaaagaaatcgggcggttacacttcatcgcacctgcgcttcggcgacaaaccgatcacgtcgccttacctggtcactacccccgacttcgtagcctgccacgtaccttcgtacgtcgataaatacgatgtgctcaaaggactgaaaaaaggcggttcgttcctgctcaacagcatccacgatgccgagacgaccaaggagacgctgcccgaccacatgaagaaatacctggccgagaaccagatcaacttctacatcatcaacgcgacgaagatcgcgatggacctcggactgggcagccgcacgaacacgattatgcagagtgccttctttaagatcgcgaacgtgattccgttcgacaaagccgtcgaggagatgaagaaagcgatctacaagacttacggcaaaaaaggcgaggagatcgtaagcatgaactacgccgctgtcgataagggcggtgcagaagtgcacaaggtggaagttcctgcagaatgggccgacattacggtcaaggagaacggggccgctgccgacgatgttcccgaattcatttcgaaagtcgttcgtccgatcaacgcccttaagggcgacgatctgccggtgagcgcattcctcggccgcgaagacggtacgtgggatgccgggaccgctgcttacgagaagcgtggtatcgccgtgaacgttccgcagtggttgagcgagaactgtatccagtgtaatcagtgcgcctatgtctgcccgcacgctgtgatccgtccgttcctgctgaccgacgaagaggttgccgccgctcccgagggcatgacgaccctgcagggtgtcggtgcgacgaaggcttacaagttccggatccagatcagcccgctggactgcaccggctgcagcaactgcgccgatgtctgtccggctccgaccaaggctctggtgatgaagccgctcgaatcgcagctcgaccaggagaaatactgggattacctgaccaaacacgtgggttacaaggataccgtggtcgacaagaccaagactgtgaaaaacagccagttcgcacagccgctcttcgagttctcgggtgcttgtgccggttgcggcgagacgccttacatcaaactgatcacgcagatgttcggagaccggatgatggttgccaacgctacgggttgttcgtcgatctacggcggttcggcaccttcgaccccttacacgaccaacagcaagggtcagggtccggcatgggccaattcgctgtttgaggacaatgccgagttcggcctgggtatgcaccttggtgtggagaaactgcgcgagcgcgtggccctgaagatgcaggacgccatcgccaactgcagttgctgctcggctgagctgaaggctgcgatgcaggagtggattgacggcaaagacagcagcgcgctgagtgccgcagccagcgagaaactcattccgatgatggaggcctgcggctgcgatacctgcaaggagatcctcgagtggaaacagtatttcgtgaaaaaatcgcagtggatcatcggcggcgacggttggggttacgatatcggattcggcggcgtggaccatgtgctcgcttcgggtgccgacgtcaacatcctgatcctcgacaccgaggtttattcgaatacgggcggacagtcgtcgaaggccaccccggtgggcgccatcgcgaaattcgcctcttcgggcaagcgtatccgcaaaaaggatatgggagccattgcgatgacctacggttacatttatgtggcgcaggtttcgatcggagccaaccagaaccagtatttccaggcgatcaaggaggccgaggcttatcccggtccgtcgctgatcatcgcttacgcaccgtgtatcaaccacggcatcaagggcggtatgacccgcacgcagaccgtcggcaaagaagctgtagcctgcggttactggcagctgtggcgttacaacccgatgctcgaagagcagggcaagaatccgttctcgctcgactcgaaagagccggattggagtaaattccgcgagtttatcctcaaggaggtgcgctattcgtcgctgaccaaacttttcccggctgaggccgatgagttgtttgccgctgcggaagagaacgcccaatggcgctacaatacctacaagcgttatgctgcgatgaattttgcggatgaaaaaggggagccggtgcttccgaaacaatag

SEQ ID NO: 1608 - DNA, 3819 bp, Alistipes indistinctus
atgtcccaaaaaacagataataaacgtatcagcttctcttcggtcaaaaacaggatgccctatcccgatttgctggaggtgcagctcaaatcctttcaagacttttttcaactggacaccactgcggagaaccggaagaacgaaggcctctacaaggttttcatggagaacttcccgatcaccgatacccgcaacaacttcgtgctggaattcatcgactactacgtcgatccgccccgttactcgatcgacgagtgcctggaacgcggcctcacgtacagtgttccgttaaaagccaaactgaaattatactgtacagaccctgaacacgaagatttcgacacggtagtccaggatgtctatttcgggacgatcccctacatgactccccgcggcacgttcgttatcaacggcgccgagcgcgtcatcgtatcccagttgcaccgttcgcccggcgtcttcttcggacagagcacccatacgaacgggacgaagctttattccgcccgtatcatccccttcaagggttcctggatcgagttcgcgacagacatcaacaacgtgatgtacgcttacatcgaccgtaaaaagaaactgccggtcaccaccctgctccgcgccatcggcttcgagagcgaccgtcagattttagagatattcgacctggccgaagaggtcaaggtcaccaaggccaaccttaaaaaagtggtgggccagcgccttgctgcccgtgtgctgaagacatgggtggaagatttcgtcgacgaagataccggcgaggtggtttcgatcgaacgtaacgaaatcatcatcgaccgcgaaacggtactcgaagagcgccacatcgaggatatcgtcgaatcgggcgcaaagagcatcctgatccacaaagaggctccggggagtatcgacttctcgatcgtctacaatacgctgcagaaggacccgtgcaactcagaaaaagaggccgtggtgtacatctaccgccagttgcgcaactccgaaccgcccgatgaggcgaccgctcgcgacgtgatcgagaaactgtttttctccgacaagcggtacgacctgggcgacgtgggccgcttccggatcaacaagaaactgagtctcgacatctccccggaggtcagggtactgacccgcgaggatatgatcgcgatcatcaaatacctgatctcgctgatcaactcgaaaaccgacgtggacgacatcgaccacctgagcaaccgccgtgtccgcacggtgggcgaacagctggccaaccagttcagcgtgggtttcgtgcgcatggcgcgtacgatccgcgaacgcatgaacgtccgcgacaacgaagtgttcacccccgtagacctgatcaatgcgaagaccctttcgtcggtgatcaattcgttcttcggcacgaatcagctttcgcagttcatggaccaaaccaatccgctggccgaaatgacgcacaaacgccgtctgtcggccctcggtcccggtggtctgtcgcgcgaacgcgccggtttcgaggtgcgcgacgtacactatacgcattacggccgtctctgcccgatcgaaactccggagggaccgaacatcggtctgatttcgtcgctgtgcgtctatgcgaagatcagcgacatgggcttcatcgaaaccccttaccgcaaggtagaggacggcgtcgtggatctcaagaacagcgatgtcgtttacctgagcgccgaagaggaggagggtctggtcatcgcacaggcgaatgccccgctcgacgataaaggccatttcctgaacgcggataagatcaaggcgcgttacgaaggcgacttcccggtagtaaccgataaagaggtaaacctgatggacgtcgcgccgaaccagatcgcatcgatcgcggccagcctgatcccgttcctcgagcacgacgacgcgaaccgcgcgctgatgggttcgaacatgatgcgtcaggccgtaccgttggtaatgcccgaggctccgatcgtcggtaccggcctggaagacgacatgatcggggacagccgcattcagatcgttgccgaaggtaacggcgaggtcgttttctcagatgctacccagattcaggtcaaatacgaacgtaccgacgaagagaagctcgtcagcttcgatcccgaggtaacgacttataaccttccgcgttaccgcaaaaccaaccagaatacgtcgatcaccctcaaaccgatcgtccgcaagggtgagcaggtaaccaagggccagatcctgaccgaaggctattcgacacagaaaggcgagttggcactgggacgcaacctgaaagtggctttcatgccgtggaagggttacaatttcgaggatgccatcgtgatctccgaacggatgatgcgcgacgacatcttcacttcggtgcatgtcgacgagtacatcatggaggtgcgcgacacgaaacgcggcgtcgaggaactcacctcggatatcccgaacgtgagcgaagacgccaccaaggatctcgacgaaaacggcattatccgcatcggtgcgaacattaaaccgggcgatatcctgatcggtaagatcacgccgaaaggcgaaagcgatccgtctcccgaggagaaactgctccgtgcgatcttcggcgataaagcgggcgatgtgaaggatgcctcgctgaaagcacaaccttcgctcttcggcgttgtcgtggacaaaaaactgttcagccgggccaaccgtgacggcaaaaagagcaaagccgcagaaaaggcacaactcgaaaagctcgacatggcgttcaacgaacaggccgaagtcctgcgcagccgccttctcgaaaaactggccgtcctgctcaaagacaagacgaccgccggtatccgcgactacttcggcgtggagatcgttgccaaaggcacccgttttacgcagaaaatgctcggggagatcgacttcctgaacgtagcggcggacaaatggacgggcgacgcccatttggattcgctggtggaaaagacgatcaacaactatatcatcaaatacaaagaggctgatgccgtgctcaaacgcgacaagtacaacctcaccaacggtgacgaactgcccgccggcatcatccagcttgcgaaagtttacatcgcgaaaaagcgtaaactccgcgtgggcgataaaatggccggccgccacggtaacaaaggtatcgtggccaaggtggtgcgcgacgaagatatgccgttcctcgaagacggttcgatcgtcgacatcgtgctgaacccgttgggtgtgccttcgcgtatgaacctcggccagatttacgaaaccgtgctcggttgggccggccgtgaattgggactgaagttcgccacgccgattttcgacggggcatcgctcgaacagatcaacgagtacaccgcacaggcaggcgtaccgcgcagcggccgcacctacctcttcgacggcggtacgggcgaacgtttcgaccagccggcgacagtgggcgtgatctacatgctcaaactgggccacatggtcgatgacaagatgcacgcccgctcgatcggtccgtactcgctcattacgcagcagcccctcggcggtaaagcgcagttcggcggtcagcgtttcggtgagatggaggtgtgggcgctcgaggcattcggagccgccaacatcctgcaggagatcctgacgatcaagtccgacgacgtaatgggccgtgccaaagcttacgaagcgatcgtcaaaggcgacaacctgccgcaagccggtattcccgaatcgctcaacgtgctgctgcacgagctgcggggtctggccatcagcgtcaagctggactaa

SEQ ID NO: 1609 - DNA, 3708 bp, Alistipes indistinctus
atgagaaaaatatccgcacgactgctctcgttgtgcgcgctctggctcgccgcccagcagcccgccgccgcccagcatacccaacggttcaacggctggcccaccgccgccactgcacaggaattgcccgcagatttcgtcgcgcccccggccgggtacggcaacgtaccctttttctggctcaacggcgacacgctccggcgcgaccgcatgagcgacatcctcgatacgctcgccacatcggccacatcgggcttttcggtaagctatatccacaaaaacgccaacatcgactccgtcgaacacaaaagcggctacgggatgttcggacacaccgagccgggcgaaccgaaagtcttctcgccggcctggtgggagttctggaactggttttcaggcgcctgtgccgatcggggcatgggcctgggcttggacgactatacggtaggctggtacgggaacggctactatcccgatgaggtatacaaccagccaaagtacaaaaattaccagggcaaactcgacatcacggcccatccggtggccgccggagcgactctcaccctcacacttcccgaacatacggtcagcgtcgtcgccctgccggaacacaaccagaaagagaaaccgatcgatctcaccgccaccaccggtgccggaaaactgacctggacagctccctcctcggccaagtcctataccgtctatgtcacggccacgcagcccgactacctgctgcaccccgacaacgggaaagagctggtcgaggtctatttcgaccgtttcgaacagaacatgaaccaaaaggggcgcgacggcatgaactacttcttccaggacgagctcctctacccgctcacgatcctttcgtgggccgaagatatgcctgcccagttccgggaccggaaaggctacgacatccttccctacctggcagccctgaagtacgacatcggcgacatcacggccaagatccgtctcgattactgcgacgtggtgatgacactggccgaggagcgctatttcaagcccatcttcgactggaacgactcgcgcggactgatctacggctgcgacaatatggggcgaggtaaacagccgctccactacctcgactatttccgggcgaccagttggtttaccgcaccgggcaacgatgccccggcacgcggttccagtttcatccagaccaaggtttcgagttcgatcgcccacctctacgagcggccccgcacatggctcgaagcgttccacagcatgggctggggcagcaaaacggaatggctcaccgaacagatcgaccaccatttcctcgcaggcggcaacctcgtctgcatgcatgggctctactactcgacccacggcggctggtgggagtgggcccccccgtgcttccattaccacatgccttactggccgcacatgaaaaaatggctcgaatacaccgagcgggtcagctacctgatgagccagggccaccacgtctgcgacatcgcgatcctctaccccaccgagacattgcaggcgttctcaccggacaagccctacgacgatcaatacaatttctcgtacatcatggagctgagcaacgccggattggattacgacctgatcgacaatcgctcgttggtgaaggccgatatcaaagacaaagcgctgcacgtcagcggtgagagctacaagatactcctgatcaaagacattcgcgctttgcgctacgaagcgctgctcaagctgcgggacttttaccgcggcggcgggatcgtgctggccatcggcgatctgcccgaagcgagcgaccgggccggatcgaacgacccggaagtcaacaaaatcgtcaaagaaatattcgggatgaccgccgcacaaaccgaaacgatcgcggtcaaagcccagaaaaacccgaccggaggcgtaggtttttacctcaataccaccgaggacatggtgccgctgatccaccgcacgatcacgccggatttccgtgcagggacgaaaggcggcaaagtcctgcaccgccggacggacgaccgcgacgtttacatggtgatgaatgtcgaaccgggtaccgactgctttttccgggccaaagggaacgcccagctgtggaacgctttcgacgggacgatgcagccgcttccggtaaaacgcgtcaccggcgaaggaaccgtcatccggttggacacgccctacaaccgctcgtcgctcgtagtcttctcgcccggtgaaccagtgtccgataccgtttcacagactgagaaaccgcctcaggagattatcccggtagagggcgaatgggaagtggagatgttaccgacgctgaacaataagtggggcgatttccgcctgcctgcgaccgatgaaaagatcggtcccgaggctcgccgcttccgcttcataccgctgcgcgcattgggcaaaaccaagacgtggatgcaacccgcctacaacgactctacgtggtcggtgggcacttacggattcggagccccgatggaagtgctcgtcgacggctcgtcgcaaaaggccgacggactggctgcggcgatattcaacggtacgctcgccgactggaagccttacagcttttcgtggcagtacggggtcgagaacaaccccggttcgcagggctatcacggactgaaaggacgcgtagacaacaacttcctgatcctcgacaagggacggaacatgcttttccgtacgcagttctatgcgcccgaaacggatttttacgtcctcatcaccggcaacgtcattcccgagggtatttatatcgacggggaaaacatccgttcggaagatatcgtttcgcgcgaaggcccgaacggccagcgcgagacacgttacacggtcaacctgcgcaaaggctggcactcgctgctgctcgtctttacgaacacgaccgaccagccgctgcgccaagaaccgtatgacctgctcgaccggcgcacgcgcagtacggcggtgatcctgccgctcgctgacacggctgtaaaggaaaacacgccttacgacgacatcgttgcgatgaaatggtaccgatcgaaccggctcacgttcgatcccaacgccgggcggccgcaaaaaaccatctaccgcttcgaaaccgtgcccggcctctcgtccctgcggctcgacctggcaggacaccttgaaaaagcctgggtggacggtatggcgatcaatgccaagaccaatatccggacgaaaggcgacggacggtatgaaatcgtgttgccggtaaccttcccgcgcaccagcgaaatgacgctgcaaatcactcccgatccgggtgcgggcggtaccgccgtattccgtgaaccggtcaggttcatctgcggcaagggcgtgatgaatgcgggcgactggagcaagaacggtgcactgctctactactcgggtggcatgtactaccgaaaaaccgtcgaattgaacgagcagcagatcgcgcgcggtgtgacgctcgacctgggcaaagtgtcggcgagctgcgaaatcaaggtaaacggcaaagacgctggtatccacatctattcgcccttcagcgccgacatcaccccatatctgcaccccggcgaaaaccggatcgaagtgttggtctacagtacgctggccaaccactaccagaccagccccaccccctataaaggcgatccggaagcaggcctgatagggccggtacggctgatcgtcggcggaaaataa

SEQ ID NO: 1610 - DNA, 3693 bp, Alistipes indistinctus
atgatactctttttcaggaaagcaaacatcatttatgccgtcgatgcccgcaagtcgctcccggcagcagatatcgccaaactgacttggcttttcagcgaagcgaagcaactggacgccgaggtgctcaacggtatttttatcggaccgcgccgcgagatgatcaccccctggagtacgaatgccgtcgagatcacacagaacatgggactcgaggggattgcccgtatcgaggaattcgaggtggtcaagagcgaagacgcaccgtacgacccgatgttgcgccgtatgtatcgttctatcgatcaggatatcttcacgatccgcaagcagcccgatccggttatttacatcgatgacattgctgcatacaaccaacaggaagggttggcgctgagcgatgaggagatggcctacctgaacgaactttcgcggcggatcggccgcaagctgaccgacagcgaggtgttcggcttttcgcaggtcaattcggaacattgccggcacaagattttcaacggcctgttcatcgtcgacggcgaagagatgccttcgaccctcttcggcctgattaaaaagacgacaaagaccaacccgggccgtgtcgtatcggcttataaagataactgcgctttcctgcaaggtcccgtggtggagcagttcgcccccgcgtcgccggatacggcggattactatggcatcaaggatttcgagagcgtgatttcggtcaaagccgagacgcacaatttcccgaccaccgtcgagccgttcaacggcgcggcaaccggtacgggcggcgagatccgcgaccgcatcgccggcggtaagggcgcgttcccggtggccgggacggccgtttacatgactgcctatccgaggttggacggtgggcgcgagtgggagcagttcaccactccgcgcgaatggctgtaccagactccggaggatatcctgatcaaagcctcgaacggggcttcggatttcggtaacaagttcggccagccgcttatctgcggtagtgtgcagacgttcgagcatttcgaaaacgggaagaagttcggcttcgacaaggtgatcatgcaggctggcggtgtcggttatggccgtaagcaggacagtatcaaggacgaaccgcagccgggcgacaaagtggtgttgctgggcggtgacaactaccgcatcggcatgggcggcggtgccgtttcgtcggtggccacgggcgagtatgccggtgcgatcgaactgaatgccgtgcagcgttcgaaccccgaaatgcagaaacgagcctacaatgcgatccgggccgcttcggaggagactgaaaacccgattatttcgattcacgaccacggtgcgggcggtcacctgaactgtctcagcgagctggtcgaggcgaccggcgggcggatcgacatggagaacctgcctatcggcgatcctaccctcagcgcgaaggagatcgtcggcaacgagtcgcaggagcgcatgggattcgtcgtcaaagaggagaatatcgacaaattgcgtcgcattgccgagcgtgaacgttcgccgttctatgtgatcggcgaggcgacgggcgacatgcagtttacttttgtcaacaacaaaacgggcgagaagccgatcgacctgaaactggaggatatgttcggcaaggcgccgcgcacggtgctgaacgaccgtaccgtacgggagagctatgcagaaccgcagtacgatgccggaaaactggtacattacatcgaaaatgtgttgcagctcgaagcggtggccgccaaggactggctgaccaacaaggtcgaccgttcggtgacgggccgcgtggcgaagcagcaaacggctggcagcgtccaattgccgctgaatgactgtgccgtcgtggcgctcgattaccaggggcagcgcggtatcgctacggcgctcgggcatgctccggtcgccgcactggcagaccccggtaagggatcggtgctcgcgatcaccgaggcgctgacgaatatcgtcttcgctccgatcgacggcggactgccgtcggtatcgctcagcgccaactggatgtggccctgcaagaacgaaggcgaggatgcgcgtctctatgcggctgtgcaggcggcgagcgactatgcgctggctttggggatcaacattcccaccggcaaggattcgctctcgatgacgcagaaatacaaggacggcgaacaggtgtacgctccgggtacggtgatcattacctccgtgggcgaagtgtcggatgtgaagaaagtggtctctcccgcgctcaagcaccgccgcagccagatgatttacgtggatatgagccgcgacgggttccgtttgggcggcagcagtttcgcccaggtggtcggcagcgtgggcatggatgtcccgacggtcacttcggccgactactttacccgggcgttcggtgccgtacagcagttggtcgaagagggaaaagtgctctccgggcacgacgtgtcggcgggcggcctgattaccgcactgctggagatgaccttcgccgacaaccggagcggtatggacctgagccttgcggcgctggccgaaaaagacctgatcaaggtgcttttcagcgaaaaaccggccgtagtgctgcaggtggagaacggatcggaggtgtgcgaaaacctcaagttcgacgggatcgacgcctatgtgatcggcgatgtgaaccaggagcgccgcttcacggtgaccaatgccggggtcgagttctcgctgctgatcgatcagttgcgggatacgtggttcaagacctcttacctgctggatcgccgccagagcggagtgcagaaggcctcggagcgttttgcgaattacaaaaatcaggaactcagctataaattcccggagacgttcaccggcaaactgtcgcagtgggggctcgaggcgagccgccgtacgccgagcggcatcaaagccgcggtgatccgcgaacagggctcgaacagcgagcgcgagatggcgtggtgtatgcacctggccggaatggatgtcaaggatgtgcacatgacagacctgatcagcggccgcgagacgttggaggatgtcaatatgatcgtttttgtcggcggttttgccaactcggacgtactgaattcggctaagggctgggccggcgcattcctctataacgaacgggccaaggaggcgctcgaccgtttctatgcgcgagaagatacgctttcgctgggtgtttgcaacggttgccagctgatggcggaactggggctgatcacgcccgaccatgagcagaaaccccgcatgctgcacaacgattcgcacaaattcgaatcgtgcttcgtgaatgtcgaggtgcaaccgacgggttcggtgttgttcgattccatggccggtagccgcctgggtatctgggtggcgcacggcgagggtaaattccgcttgccgtacgaggaggagcgttaccgcattccgctgaaatacgcttacgaccagtatccgggcaatcccaacgggagcgactatgccgccgctgcgatcgtctcggccgacggacgccacctggcgatgatgccccatatcgaacgttcgctgcgtccgtggaactgggcctattatccagaagagcgggccgctgatcaggtgagcccgtggatcgaggcgttcgtcaatgcccgcaaatggattgagcagaggaggaacaaatag

SEQ ID NO: 1611 - DNA, 3624 bp, Alistipes indistinctus
atgagtcagtttgttcatcttcacgtacatacgcaatattcgatcctcgacggggcttcggcgatcaaacccttgatcaaacgggccaaggcgctgggtatgccttcgctcgcgattaccgaccacggcaatatgttcggggtaaaagagtttcacgatgcggcggtcaaagagggagtcaaaccgattctcggctgcgaggtctatgtggcgacgggaagccgttttgacaagaagcgcggacgtgaggaccgggggcatcacctgatcctgttggcgaaaaacctgaccggttatcacaaccttgcaaagatggtttcctatgcctttaccgaaggttattattaccatccgcgcgtggataaggagttgctgcgtacatatcacgaggggattatctgctgttcggcctgtttgggcggcgagttgccgcaggcgattatgcacggaggatttgacaaagccgaagcggtggttcgtgaattcaaggagattttcggcgacgactactacctggagatgcagttgcaccgcagcggcgatccccggcgggatgcggatgtgtacgaaaaccagaagagggtcaatgccgtgattctggagctggcggccaagcataacgttaaatatatcgcttcgaacgatgcccatttcatcatggccgacgatgcggaggcgcacgaccggctgatctgcctcaatacgggcaaggatctggacgatcccacccgcatgcggtatacgggacaggagtacctgaaaagcgagcaggagatggcggagttgttcggcgaccatcccgaagcgctgaccactacgctcgagattgcggacaaggtcgaagagtactcgctcgagcacaagccgctgatgccgaatttcccgattccggacgattttccgatcgacctgccgcagttgaaagagtcgttctcgaagaaaattaaggacgaagtgctgttggccgaggtgcagcgggcgacatcgctcgacgaactgatcggaggacaccccgaactggccgagtcactgatgatcgccaagcagttcctctacctgaagcacctcactttcgaaggggcccgccgccgttacggtgaactgaacgagcagatattgaagcgtctggattacgagctttcgactatagaatggatgggttttccgggttacttccttatcgtatgggactttatccgtgccgcgcgggaactgggggtatcggtgggaccgggccgtggttcggctgccggttcggtggtggcctattcgctgggtattaccaatatcgacccgatcaagtacgacctgctgttcgagcgtttcctgaatcccgaccgtatctccctgcccgatgtcgatgtcgatttcgatgaggacggccgtgccgacgtactgcactatgtggtcgaaaagtacggcagcaaacgggtggcgcagatcattactttcggcacgatggcgccgaaggctgcgatcaaggatgtcgcgcgtgtacagaaactgcccctttcggagagcaaccgcatttctaaactggttcccgaaaagccgggaacgaccttcgaaaaggcatttaaggaggccccggaactgttggccgagcgcgaatccgaaaacccgctgatccgggctacgatgaaatatgccgagcagttggaaggttctgtacgtcagaccggcgtgcacgcctgcggtgtcattatcggacaggacgatctggaaaaattcgcgccgatcgccatcgcgaaggatgccgaactgaacgtcgtgcaattcgagggcaagcaggtcgagagcgtgggccttattaaaatggacttcctgggactcaagacgctgtcgatcatcaaggatgccctcgagaacattgaagcgtcgaagggtgtcaaaatcgatatcgatgcgattccgctcgacgattccgccacgtacgaactttacagtcgcggcgagactaccggactgttccagttcgagtcaccgggcatgaaaaagcatttgcgcaacctgaaacccaaccgcttcgaggacctgattgcgatgaatgcgctctatcgtccggggccgatggagtatattccctcgttcatcgcgcgtaagcacggtcaggaaaaggtgacctatgatattcccgatatggaggagtacctgaaggacacttatggcattaccgtctatcaggagcaggtcatgctgctgtcgcagaagcttgcaggattcacgggcggccaggccgacacgctgcgcaaggcgatgggtaagaagaaaaaggatgtgctggacaagatgaagccccagttcattgagggagcgcagaaaaacggccacgatccgaaaatatgcgagaaaatatggagcgactgggaagcgttcgcttcgtatgccttcaacaaatcgcattcgacctgctacgcatatgtctcataccagaccgcatacctcaaagcgcactatccggccgaatttatggctgcgttgctgagccgcaacctatccgatatcaagaagatcagcttcttcatggatgagtgcaagcggatgggactgtcggtgctcgggcccgatgtgaattacagtaagagccgtttttcggtcgatgacgagggtaacgttcgcttcggcctggccgcgatcaaaggggtaggcgaggcggccgtgcaggatatcgtcgagtgccgccagcgcgacggtaaattcaaatcggtttatgattttatggagcgtgtgaacctgcaggcggtcaaccgaaaaacgctcgaaaaccttgccgtcggcggtgccttcgacagtatcagcgacctgccccgcagcgcttattttgcatcggacggccgcgaaggaacctttcttgaagcgttggtacgttacggcaaccgggtgcagagcgagaaagccaatgtgcagcagagccttttcggcggcgggaatgccgaggccgatatccaaaagcccgaaccgctgccgcacgaaccgtggaccaagctcgaaatgctgaacaaggagcgcgaggtgatcggcatctacctgtcgtcgcatccgctcgacgatttctcggtaatcatccgccattactgccattcgacattgggcgatctgcaggacctgccgtcgatgaaaaacaaggattttaccgttgcggggatggtcacttccgtcacgcacctgactactaaaaccgggaagccttacggccgttttacgatcgaggattacaacagttcgcacgaattcgtgctctttagcaaggattacgaaaatttccggcggtacctctacgaaggctactacctgctggtgagggggcgtgtgcaggagcgtacgtacaatcccaacgaactggaatgccgcatcaactcgatgatgatgctttccgaggcgcaggagacgctgatccgagaactgacgatcgcgctgccggttgccgagttgaccgaggatatcgtctcgcaactgaaagagacgatcaatgaaaaccggggcaatgtgacgctgcgggtcaaggtgctcgatccgcaggccgatgtggcagtgaatttgtactcgaaaacgcttaaagtgggtatgactcccggcatggtgcgcttcctcgacgacaatgcgttgcgctatacgcttatgtaa

SEQ ID NO: 1612 - DNA, 4602 bp, Alistipes indistinctus
atgggcaaagttataaaaatattgttatccttcctatcggcgaccctcctcgcgctgatcattttgcccatcgcctgctcgctgttgctgaaccttccttcggtgcaggattatgcgggccgcaagctgaccggatggctcagcgggaaattgcagaccgaagtgcatgtcgacaaactgcggctgcggcttttcaaccgtgtgacgctcgacgggctgtatgtcgaagattaccatcaggatacgatgttttatgcccggcgtatcgtggtgccgttgcagagcctcaacccctttacgggccgtgtcgcgctggggcgtgtcgagctcgagcagccgaagttctacctgatgcaggacagtacggggcgcacgaacctcaaacaaattctgctgaagctcaagcgcgagcgcaaaaaggagaaaaaaacgttccggctgacggctgcgggtgttgcgatcagcgacatggctttcaagcacctgaagctcgagcggcgtgaccgcgattacggggtgaattttaccgacctcgatgtacgccggttcaacctgcgcgtacacgacgtttcggttgtgaacgacagcgtgaacctggcgatcgaccacatttcgctcgaagagcgcagcgggttggtgattgatgccctgtcgacacgcaatttcaaaatttccggttccgggatgcgtttcgaacggttggccctgcgaactcccgactcgcgcgtgggcatgaaccacctctatttccggaccggtacgtggaaaggctacaacgatttcctggagaaggtggatatttcgtcggagatcgtcgattcgcgcgttagtttccgcacgatcgcttttttcgccccgacgctgcgcaactggcagaccgttttcgaacatgtgaacggtaccgtcgaggggcccgtggccgcgatgtcgggcaacctgacgcgcgtggattgccgcgatacgcgcgtgagcgtgcgcttcggcatgtacggcgttccggacattccccgcacgcgctttacgttcgacgtggcttcgctcgaaaccaacgaggcggacgtggcctttatcctcggcgatattgccgggcggacgctccagcctaccgatgcagagcggttgcgccggatgggccgcatctcgtttacgggacgtttcgacggcctgttccgcgattttgcggcatcggggcggctcggcatggatcagggaaatgtcaacctgaaattgaacttcaagtcgctgcaggcccgtactgccggattcagcggcgaggtgcgtaccgacgggttcgacctgggtagcctgctgcaagtgcccaagttgggccggttcacgctttcggccggcgtcaccggttcgtacgggggcggcatgctcaaactcaagacgaaagccgacctgccgcgcatctattataacggttacgattaccacgatatcgaactcaacggcgaattcgacaaccgcagtttcctcggcgcgattcaatccaaggacgaaaacctgtcgttcgatttcgacgggcagctggctttcaacgatacggtgcccgcctataatttcgcgttgcagctctatcgggccgacctgcacaggctgaacttcaacaagcgcgattcggtgtcggtcgtgcgcggcaacctggtggcggtgggctctggctcgacactcgacaacatgaacggggaggcgaccgtcagccacatggtctatgtcaaccatctcgatacggtccgtacgggcaacatccgtttcgtcgcgcagaacaatgccgaacgcaaacagttggggatgtactcttcgtttgccgacgtcgaattccgcggtcggctcggctacaaaaacctcttttcgtattttaccaatacgctggtcacctacctgccctcgctcgacgaaacttcgcgccgcaggcgtgccgagcgtcccgaaaaaccgcaggccgccacggtggataactactacctggtcaaagtcgacgtcaaagaggcgaacaacgtggccggtattttcctgcccgggctcgaactggccgaagggacgaagctttcgttcctgttcaatccgcagagcgatattttctcgctcacctgtacgtccgactacatcgagcgcggcaattttttcgtctcggacctcaatgtcagcagccggaaccagggcgactccatttcgctgtacctgcgctcggacgatattttcgtcggcggggtctatatgccggatttctcggtgcagggcggtgtgaaggagaaccaaatccgcctggcgacccgtttcaacaacaaagagaacggtgcctatgcactgatcagtaccgtatcgactctccaaagcgatccgctcagcggcattccgcagctcaggatacatttctatccttctacgttcggtacggataaacagatatgggcgctcggcgcaaaggagatactttacgattcgacccgtatggtggtcgacagtttcatgatggtcagcggcaagcagcggttggtgatcgacggcgtcgcgtcgcacagcatggccgacacgttgcacctgaggatggataacttcgacctgacgccgctttcgcagattaccgaccggcagggctaccgcatcagcgggtttaccagcggttcggccgatatggctgcagcgctgggccgcggcgtgctctatgcgaatatcgccttcgacgatatccgggtgaacgacattccgatgcgcaatacggttttccgcagcaaatgggatttcaatgcgcagcgcgcgctgttcgaactggcggaccggcagcagcagacgcccatcgtccagggctactaccagccttcggagcgttattaccgtgccgacgtacagctcgacagcatcgacctggcgctgttggacccggtgctcaagggggcgatccgcgacagccggggaacggccaatgcggcgctcaggctttcgaatcccgaggggcgcatgcggctcgacgggaggatcgtcgtcccgtcgttccatacgacggtggactatacgaatgtaccctatacgctcgactcgtcggtgatcgacgtccggtcgaacgtgatgacgatgcagcccaccacggtgcgcgacccgcagggacattcggccggattcgggatgagtttcgatttttcgaacctgcgcaacctcgcctacgacgtgcgcgtcaggcccgaaggagtgctcgtgctcaatacgacgctggccgagaatgacctcttttacggcaaggtctatgcgtcgggttcggccaccatcagcgggaataaaaacggcgtgaacatgaacatcgtcgcctcgacggccggcaattcgcagtttttcctgccgctgagcggtgtgtcgaatatctcggcagccgatttcatcgtcttcgaagaccccgcttcgaagcggcgcacggacagcctgcaccgcatgagccggcgtaagcagatcctgctgaaccgcaaggcccgacttcggaatacggccccctcgcgcatgaatatcaacatgcagctcacgttgcggcccgacctggagatgcaactggtgatcgaccccgctacgggcgatgtcctcaaagggcgcggcaacggaagcctgaacctttcgatcaatccgtcaaacgacctgttcacgatttacggcgattacgatattaccgaaggaagctacaaattcacgctgcgcaatatcgtcgcgcgcactttctctcttgaaccggggagcagtatccgctggacgggggacccgctcgacgcgacgctcgacattaccgccgcatacaaactcaaagcgtcgctttcggggctgatggcacccggcgacggagccgggcgcagtgcgagcacgtcggtggactgcctgatcaaactgaccgacaagctgaccgatccgacgatcaatttcgatattcagctgcccaacgccacgcccgagacgcaggcgctcgtgtcccagtcgatcaacacgcaggaggcgatggccacgcagttcctttggctgttggctacgaagagcttttacagcgaataccagagtttcggcacgagcctcgccacggccaccggggtcgatttcctcaccaaccaggtcagcagcctgatgtccaccgaacgtttcagtctcgtgccgaaatatacgcccaaaggggagctttcgtccgacgaggtgggcggttcggtctacggcgagttgatcaaggacaaactgatcctcgaggccgacgtgaactacgatatgcagaacaacaaggccagtacgcggcagaacagcatgtcgggcgatgcgacgctgagcctgattctcgatcgttcgggcaacctgcgcgtgcaggcttttacgcgcacgatcgaggattttcagccgaaccaggggacgcaggagagcggtatcgggattttctaccgtgagaacttcaacagtttcaaggatctggtgcagctattcaaggaccgtttcgcgaacatcgcgcgccgccgggccgaacgcaaggccgcgaaacggcagcgcaaggcagcagagcatgctgtgccggccgttgtgaaaacatccgaaggggagccggccggccgggaggagacgcccgtccgggccgaaggcgaataa

SEQ ID NO: 1613 - DNA, 3054 bp, Alistipes indistinctus
atgaaccagtttaagaagtataatctgatcgccggatgggctacgttcgcctttgcggccgtggtctacctgatgacgatcgaaccgaccgcaagcctttgggattgcagcgaattcatcgccacttcgtacaaactagaagtagggcaccctcccggagcccccctgttcatgatgatctcgcgcctgttcgcgatttttgcacccagcccggcgcatgtggccatgatgatcaactcgatgtccgcactcgccagcgccgcaacgatcctgtttctcttttggtcgatcacgcacctggcacgccgctcgtaccacaaaagcgaagaggaactaaccctgccgcaaatcacagctatcatgggagccggcctggtgggttcgatcgcttatacgtttaccgacactttctggttttccgcagtcgaaggcgaagtctatgccctctcgtcgatgtttacggcactcgtcttctgggcgatcctcaagtgggaaaatgtcgcggacgaaccgcatgcgaaccgctggctgatcctgatcgcttacctcacggggctcgcgatcggcgtacacctgctcaacctgctgatcatccctgcgatcgtctttatctactatttcaggaaatatccgcaaatcaccaaatggggaatcgtgaaagcgctggccgtatcgggagccattctgatcgcagcgctgtacatcattatccccggcaccattgaactcggagctttcgtcgaccgcattttcgtcaacggcttcggcctcccggtgaacagcgggattacattctatgcctttgcgctgctggcgatactgggctgggggatatggctcacccacaaaaaaggcaaggtcctggccaatacgattatcctctgcgttacggtaatcctgatcggatacggaagctatgcttcagtcattatacgctcctcggtgaacccgccgatgaacagcaacggtccgacgaatccttacggacttctcgggttgctgaaccgtgaccaatacggggcacgcccgttggtaaagggcaattattactcttcgcctgcgatcgcggttacagaaaaagatacctactacctcagcgacgacggcaaagaatacaaaaaagggtcgaccgtatcgggatatgaatacgcccccggattcgaattcttcttcccgcgcatgtactcgtccaaagagtcggatatcgcggcttataacaactgggtaaacgacggcaaggaaatcaaaggtcgaaaagtgcctttccgcgacgaaatggtcacggtacccacgttcgccgaaaacctgaagtttttcttcgcttaccagctcaacttcatgtattggcgctatttcctgtggaacttcgtcggacggcagagcgacatccagtcaacgggcgagattaccgacggcaactggctcagcgggatcaaagcgatcgatcagctgttcgtcggcccgcaggataacattccctcggaacaggcagccaacaaggggcgcaatacctattatttcttaccgttcctactgggtatcatcggactggtttaccagctgaaccgcgacggcaagaactttaccgtcgtgatgacgatgtttatcatgacaggcgtagcgattgtcgtctacctgaactcgccgcccgcagaaccccgtgaaagggattatgtatatgcgggatcgttctacgcatttgctatctggatcggtttcggtgtcttgtcggttttccaggcgaccaaacggtggttcaaaaaagagaatgtcgccacggcagtgatcgccacggcgatctgcgctacggtacccgtgattttaggcgccaaaaactgggacgaccatgaccgttcgggacgttacactgcgcgcgatttcggactcaattacctgaccggactgctgccgaatgccatcatcatgaacttcggcgataacgacaccttccctttgtggtatgcacaagaggtggaaggttaccgcaaggatgtccgtgtgatgaacatgagctacttgggcggcgaatggtacatcgaccagatgaagctcaaaagcaacgactcggaacctgtgccgttcacactaccgcggaacaagtacacctacaataacgaattcctgatcgtcaacgatctgttgaagaaaccggtgccgatcaaagaagcgattgatttcgtcaaaagcgaagacccgcgcacaaaaatgtcgatcggcggtaaaaacgccgatttcctgccggccaaacaactcatcgttccggtcaataaggagaatgtgttgaaaagcggaatcgtcaagccggaagatgccgacctgatcgaagacagcatcgtcgtcacgatcaaaaaaagcacgatcgaccggggtgaaatgatgctgctcgacctgttgtcgaatttcgactggaagcgcccgctttacttcaccactccgagcggcatcgacgaattggggcttagggactacctgcaattggacggtttctcgtaccgcttggttccgatcaaaaccgttccgcaatcgtcttgggaatcgggccgtatcgattccgaattcctgtacgatcaattgatgaacaaataccaatatgcgaatatcaaggatccgaaagtttatgcggattatttcgtacagaccaacttcggagccgtgcagtcgcgtaacctgttcgcacgtctggccaagcaactcgtagcggaaggagatacgaccaaagcgatcgaagtgctcgaccgcgcgatcgaagagatgccgttcaaccagattcgtcactcttacgtacagacgatcccgttgatcgaagcttactacatggccggggccgatgaaaaaggaaccgctgtgttggaagactatgccaaaatactagaagagtacatcgactactacttccggttcaaaggcaaacaggccggattggtacagacacaattgcggactaacatttcgctcttgtacgagctgtacactctggcccagaaatataaccagaccgaagaggctggtaaaatcgagaaatattttgtagacaaagggctgatggatgcttaa

SEQ ID NO: 1614 - DNA, 3246 bp, Alistipes indistinctus
atgatgaaacagctattgcgcacggcgttttgcctgctcttggggtccgcacttttcgcctgcggcccgaccaaagagccgctgacgcgccaaaccctcgaggcagggttcgtgacgccgcccgactcgatccagaccagcgtctattggtactggatgtcgaataacctcagcaaggaaggagtggtaaaggacttacaggcgatgaaaaaagcgggaatcaaccgtgcgttcatcggcaatatcaaggatggccgtattcccgacgggccggttaaagtcttttccgacgagtggtgggatatcctgcacacggcgttgaagaccgccggggaattgggtatcgatatcggtattttcaattctcccggctggagccagtcgggcggcccgtgggtcaaacccgaacaggcgatgcgttacctggcttcgtccgaaacccacgttacgggaccccaacggctggtagcgaagctgccccagccgaacgaactgtttcaggatgtcaaggtgatcgcctatccggcgcctaaagacgccggggtaaagatggccgcccgaatcgtgtcgcagccgcaggtggccgggataggaaacctgaccgatggcgatgcgactacctcggtcgtacttcctgcggccgggacgctgacgatcgacctgacccctccggaaccgtttaccgcccgcgccctgatcgtacgtccgacgattaagccccttgaagccgcctgctcgctgcaggtaaaagagggtgacggctatcgcacggtatccgatttcaagattgaccgccgttcttccgaatcgctgactgtcggtttcgaccgtgccgcgcctgtcgtgatttcgattccggctacgaccgcttccgatttccggctgattgtgcagaacaccggccaagagagcgcattgaacgaaatcgaactttcggctgctccgcgcgtggaacgttacagtgaaaaaacgctggccaaaatgtaccccgcgccgctgccctattggcaggagtaccagtgggcggcccagccggccgtggaagattcggcgctgctgatttctcccgcttcggtcgtggatatttcgcagtatctggcttcggacggtacgctgacctggaacgttcccgaaggagagtgggtgatcctgcgcaccggcatgacgcctaccggaacgacgaacagccctgcgccgcccgaagcgaccggctatgaaaccgacaagatgagcaggccgcatatcgaggcgcatttcgataattttatcggacagattctcgagcgtatccctgcgaaggaccgcaaggcattcaaggtggtggtcgaggatagttacgaaaccggcggccagaattttaccgatgatttcctcgaatcgttccggaagcggtacggctatgatccgctgccttacctgccggcttattacggttatgtggtggaatcgcccgaagcgtcggaccgtttcctgtgggatgtgcgccgtctggtggccgaccgggtcgcttacgactatgtggcgggcctgcgcgagaagagtcataagtatggtctgaccacctggctcgagaattacggccattggggatttcccggcgagtttttgcagtacggcggccagtccgatgaaatcggcggcgagttctgggccgagggcgatctggggaatatcgagaaccgtgcggcgatctcgtgcggacatatttacggaaaaaacaaaatttcggccgaatcgtttacttcgttccagcacgagttcgagcgccatccggcggtgtttaagtaccgcggagaccgttttgccgccgaagggatcaacaacaacctgctgcacgtttgcatttcgcagccttatgattcgctgccgggtatcaatgcatggttcgggatcgaatttaaccgagggaatacgtggttctcgcagatggacctcttcacgacctatctcaagcggtgcaattatatgctgcagcagggattgaacattgccgatgcggcctatttcatcggcgaagatacgccgaaaatggccggggtgctcgaccccatgattccggcaggttatcagtacgactttatcaatgccgaagtgatcgagcgcgatatgaaggtcgtggatggattgctgacattgccgcacggcacgcaataccggattctggtattgcccaagctcgaaacgatgcggcccgagctgttgaaaaagatcaaacaactggttgccgacggcggtgtagtactcggtcccccgccgacccactcgccgagtttgcagaaccagcctgctgccgatgccgccgtaacggagatggcggccgagctgtggggcgatgtggacggtgtgaaggttaaatcggccaaatacggcaaggggatgattctcaatggcctgacgatgcaggaagcgttcggactgattgagtgtgcaccggactgtcagttgcccgagggtgttccggtcctgtacggccaccgccaggcgggtgatatcgatatttatttcattacgaaccagagtgacaagctgttgcaggtggcacccgtgttccgtgtgggcggcaagcagccggagctgtggctgccgaccaccggtacgacgcgcaagcttcccgattttacgcagcaagagggaacgacgaccgttccgctgaacctcgacagttatgaaagcgtgttcgtcgtttttgccgaacctgtcaaaacgggtaaatcccctaaggtgggatccgtgacgaattatccgtccccggcgttgctgaccgagatcagcggcccgtggaacgtatcgttcgaccagaagatgcggggcccggtgaatccggtcgtgatgccgcgtttgcagccttggaacgaaatgcctaacgattcggttaagtattattcggggacggcggtatataccactgggttcgatctggtcaaacttccggcgaacgaacggatattgctcgatctgggtaaattgtccgcgatgggtaaggtctatgtcaacgggcaatatgccggaggcgtatggacgaccccgtacgagctcgatattacgcagtgggtgaaagaggggcgcaacgacctgcgtgtcgaggtggtcaacacgtgggtaaaccgcctgatcggcgatagccgcctgcctgcttcgcagcgccgtacctggactgtggtcaacccgtggcgtcccgattcgccgctgcaaacttccggtttgctcgggccggtgcgggtgacagccgtggcgtacgagcaataa

SEQ ID NO: 1615 - DNA, 3171 bp, Alistipes indistinctus
atgaaattagatagatttatcaaccgcccggtgctgtcgacggtgatttcgatcctcatcgtcatcctgggcttgctggggctgatgtcgctgccggtggagcagtatcccaatatcgcccccccgacgatccgggtgaataccacctataccggtgcgaacgcccagactgtgctgaacagcgtgatcgctccgctggaggagcagatcaacggtgtggagaacatggattacatgacctccaccgccaccaataccggtgatgcgacgatcaccgtctacttcaagcagggtgtcgaccccgacatggcggccgtcaacgtgcagaaccgtgtggccaaggcgcagggtttcctgcctgccgaggtaacgcaggtcggtgtcatcgccgagaagcgacagaccagtatgctgctgatcttctcgctttacagttccgacaaccggtacgaccagcagttcctcgaaaactatgcgaacatcaacgtcgtgcccgaggttaagcgtattcccggtgtgggcgatgcgatggtgatgggtgccgactactcgatgcgtatctggctcaagcccgatgtgatggccgagtacaaactgatgccgtccgacgtgtcggcggcgctggccgaacagaatatcgaggctgcgcccggccagttcggcgagctgggcgaccagtcgttccagtatgtgatgcgctataaggggcgcctgcagaccgagcaggagttcgaggatatcgtgatccgagccaatgccgacggcgaagtgttgcggctcaaggatatcgccaatattgagttgggccgtctgacttacggattcagtaataatgtgaatgggcatccgggtgtgtcggtgattatcttccagaccgccggttcgaatgctacggccattatccagaacgtcgagaaatacctcaagagcatcgaaaatacgcttcctcccggtgtcgaggaagaggtgctgatgagtgcgaacgatttcctcttcgcatcgatcgaagaggtgatcaaaacgctgctggaggccttcctgctcgtggtgatcgtcgtgtacgtcttcctgcaggatttccgctcgacattgatcccgatgattgccatcccggtggcgttgatcggtaccttctttatgctttacctgatcgggttcagtgtgaacctgctgaccctctgcgcgatggtgctggctattgcgattgtggtcgacgatgcgatcgtcgtcgtcgagggtgtccatgccaagttggaccaggggtataaatcggctaagaaagcctctatcgatgcgatgagcgagcttggcggcgcgatcgtttcgattacgctggtgatgatggccgtgttcattccggtgagcttcatgaccggtacgtcgggtactttctaccgccagttcggtttgacgatggctatcgctatcggtttgtcggctatcaatgcactgacgctgagccctgcgctttgcgcactgttcctcaaacctcacgatccggataaggagaaaaagagcactttcgtaagccgtttccatgccggattcaatacggcatacgctacgctgcttcagaaatataagaagagcgtgctcttcttcgtgcaccaccgttggatgactttcggcattatcggcgcgggtatcgtgctgctggtgttcctgatgaaaatcaccccgaccggtttggtgcctaacgaggataccggtaccgtcttcgcggtagtcgatacgcctccgggcacctcccaggagcgtaccgaagagttgctgatgaaggtcgatagcctgatctcggcgaatccggccgtcaaatcgcgttcgatgatcaccggctacagtttcattgccggacagggcaacacctacggaacgattatcgtcaaattgaaagactggggtgagcgcgacggcaaaaagggacaggacctgaattcggtgatcggctcgctttacgtacagtcgaaaatgggtgtttccgatgcgaacgtattgatctttgccccgccgatgattccgggatacagtgctaccaacggtttcgagctgaacctgcaggacaagaccggcggcgacctggataaatttttcggcatcgcccagcagttccttgcgaagctgaaccagcgtcccgagatcgcggctgcacgcacgtcgttcaacccgacgttcccgcagtacatgatcgatatcgatgcggccaagtgtaagaaggccggtatcagtccgcgcgatatcctgacggcgttgcagggttattacggcggcctgtacgcatcgaacttcaaccgtttcggtaagctgtaccgcgtgatgatccaggccgatccgaagtaccggatcagtcccgagacgctgaaccaggtgaaaatccggaatggcagcgagatggcgccgatcacgcagttcctgacgctgaaaaaagtgtacggaccggataacatcaaccgtttcaacatgtatacttcgatgagcgtcaacggttctccgaatgccgggtacagttccggagaggcgatccaggcgatcaaagaggtggcagccgagacgctgccgcagggttacggcttcgaattttcgggtatgacccgtgaggagtcgtcgaccggtaccagcaccacggcattgattttcgtgctttgtctggtgttcgtttacctgttgctgagtgcgcagtacgaaagttacatcctgccgctggccgtgctcttctcgattccgttcggtctggccggttcgtttatcttcgcgcagttcatgcatgtggataacaacatctacctgcagatcgcactgatcatgctgatcggcctgctggccaagaatgcgatcctgatcgtagagttcgcactcgaccggcgtagacagggcatgagtatcctctggtcggcgatcgccggttcggctgcgcgtctgcgcccgatcctgatgacttcgctcgcactggtgatcggcctgctgccgatgatgttcgcgtcgggtgtcggcgccaacggcaacagtacgatcggtacgggcgccattggcggtatgttgatcggtatgttgactcagatcttcatcgtgccggtgctcttcgtagctttccagtcgctgcaggagcggtttacgccgatggaggtagagccggagcccgaagagatcgaggctgagatcgaaaagctcgtttag

SEQ ID NO: 1616 - DNA, 3396 bp, Alistipes indistinctus
atgtgcaaactctcccgaaatttgcagcccgtgaaaaagatcgggctgttatgcgtggtgctcagttgggccgtctgcagcccggccgcaccgtcatccccatcgctacgaaacggctttacggatcctccgcaagcggggaaagcccaaacctggtggcattggacgagcctgttcgtcaccaaagagggtatccaagccgacctcgaagccatgaaacagatcggatacagcggagcacacatcttcgccacttcatccagtccgtgtcctcccggagattatcctgaaatcctgagtcccgaatggctcgacctcgtgcaatacgccggcaaggaagcctcacggctcgggctgacactgggtgtacacaactgtccgggctggtcactatcaggcggtccgtggatccggcccgaagagtcgatgcagatgatcgtctcatcggaaagccatgcctccggcggcaaacgccaaaaaatcgtattgcctcagcccgaaacccgacacggctattaccgcgacatcgccgtactggccttccccgatgtaaaccggcacgacatacctcaactcaaagccgatttcaaagaagacagcctcagcaacatcacagatggggactacacctctttcatccggctgccgatcgccaaagaggggtcgagcgccgtagtgacacttagctacgacacgccctattcgcctcaattcatcgaactgagtttcggcgaagtacatctcttcgtgaaaggaacgatcgaagcatcggccgacggcaaacattttcgcgaagtcgggaatttcgattaccgcatccgcaccgatatgcggctgcccaaatgcattccgctgaacgacggcgcacgcaacgcccgttttttccgggtgacgttcaactaccgtccttatcgctactggatgaaaccggccaacgtgcaactcaacgagatacggttgctggcctcgccgatggtcaacgacgtcgacacccgcaattcgacgatggaagacagctactcctacaaacctttcgatccggcttacacctcgccgggtatcgacccggtccgggtcatcgacctgactgcggacctcgcccccgacggaacgctcgactgtactttgccgcaaggcaaatggacgatcctgcgcatcgggcacaccaccacaggtaagacgaacggtccgtcgcactacaccggactggagtgtgacaaattgaaccgccgcggactcgatgcccactggcccggcatgatggcccgcatcgaggcgcaactgaaacctaccggagcactgaaatacgccattatcgacagttacgaggccggcggccaaaattggacggaaggtttcgacgaagaattcctcaaacggagaggatacgacctgaaaccttatcttccggccgtaatcggcttcgtcgtaggaacgccgcaacagagcgcccggttcctattcgactttcagcgtacgatttctgaattattcgctgaaaactattacgactatttcactgaattgtgtcatcgcaacggattgttgtccatcaccgaatcctatttcgggccgttcgattacctgcggtgcgcacgcaatgcggacatcccgaccggggagttttgggtgggcagcgggacatccatctcgagaatgcccggctcggccgcccatttccacggcaaagcacgcgtcggggccgaatcctttaccgcaggtccggtagaaggacgctggcagcaggatccggcacaactcaaaatttacggggaccgggcatggatccacggcgtcacccaactggtgatgcactcctacgtacaccaaccctacctgaatgtacgcccgggatggacgctcgcccaacacggatcgcacctctcccgtgcaaacacctggtggccttacggaaacggttgggtcgattacatcaaccggtcgcaattcctgcttcagcagggcacgccggtagcggacctgctggtgctctcgggcgaatcggccccgaataactaccccaccgacctgcaattgctgactgccggatacaactacgatttctgctgtgtcgacgatctccgggagctggtgcaggtcaaaaacggccggataacggcaccctcgggcgcaacctatgccgtcttatcgctgggtcccgaccgctacctgacactgcctactctcaacaaaatctaccaactgctccaagacggagcggccgtagccggactgcctccacagggatctccttctctgtcggacaacgatacggaatatgcggagatggtccggaaaatctggggagactccgatacaggcctgatccagagtgtcgggaaagggcggatcatccgttcgaacgatccggtaaccatcctgaaaacactgaatatccaacccgatacggaactgcccgaaaaagtttacggtatccaccgctgcgtaggggacaccgacatctatttcctttacaacgacagcacgcgcacgattcatttcaacggaaaattccgggtctcggaagacaaatcccccgaatactggaatgcacaggatggcacaacaataccggctgctgtctggcgcaaagaaacggcaggtaccgtggtgccgattaccctacaaccgtatgagtcactttttgtagtattcgttccgaataaaaaggttgcgccacacgtactggatatgaccattgccgcacctgcggatgaagaagcctcgacagtttccgcccgggtggaaaacgaccgggtacgactgtttttccgggaaccggcaaccgccacgcttaacttgacaaacggtaaaacacaaacagaaaccgtgcgggatgttccggcaccggtcgatctgagcgataattggcaagtaaacttccctgccgatctgggcgcgcccgattcgatacggctcaatacgctcgcatcgctgagtgaaagcccggaagagggagtgcgttatttttccggcacagcaacctattcgcgtacattcttgctgcccaaaggatggaacaaaccgcagcgccgcgtcgtcctcgatttggggacggtacgtaacctggccgaagtgaagatcaacggacacaaagcgggattgctgtgggcgtctccattccaattggaaataagcgactttctgcaaccgggcacaaaccgtatcgaaattgccgtcacaaacctgtgggtcaaccggctgatcggcgacacccgcaataccgccactattccagaaacggacggctggcccgattgggtattggccgacaagcccaactccggccagggcacctacactttttcgccctggaaaggttggaacaaagaggagccgttgcaaccttcggggctgatcgggccggtattgctgcgctgcatcgaaataaggtga

SEQ ID NO: 1617 - DNA, 2127 bp, Alistipes indistinctus
atgaaccgaaccgaaatcaacctttgcaaaggttttatctataccctgctggcaggcatgctggccaccgccggattgtggcgttgcgcgcggattacacagccgcagggcggcccgaaagactcactgccgccggttgtcatcacgatgacaccggcatacggcactgtcgatttcaaagagaagagggtctatatcgaattcaacgaatacgtacagctcaaggatcagcaaaaggagttttacacctctcctttcatgaaaaagacaccgctcgtctcgctcaggggacgcggcatccaggtcgacatcaaggataccttgctgccgaaccaaacctactcgctcaatttcggccgcagtgtggccgacaacaacgaaggcaacccctacacgggactgcgttatgtcttttcgaccggttccgaaatagattcgttgatgatgtcgggctattcggtggatgcctacacgagcgatacggtgggcaacgtattccttttgttttacgacccgaaagcggattcggtacccgaacgggactcgaccgtattccaatccaagccgctggccgtcggccgggcattccccaacggcatcttcctggtcgagaacctcaaaccgatggattaccgcgtctatgcgctcgaagacaacaacggcaaccgacaatacgaagcgggcgtcgaccggatcgcatttctcgacagcacctacaatccggccacgatgccggctttcgacatctggtacgattcgtcgcgcatgtatttgcaggcccagccgcaaatcctgatgcgcatgttcatggacgaaccttcgaaacgccaaacctattcgagttcggccaggccgatgaaaaacaagatacagttatacttcactgcaccacacccaaaaatcgaagagctttcgttcgacagcatcgacccgggagccatcgtaaccgaatacctcacgccgaaacacgacagcatggagctgtggttcgacctgtcgaaaatcgagaaaatgcccgatacgctcaaaggtaggatcatctaccacggacacgatacgctgaacaggctgaggctcgacacggtacagctaaagttgggctggaaagttccgccggtcaaagagaggaaaaagcccaaagagggggaacccgaggaaaagttaccgaatccattctcggtaagtgttacgccgtcgggtacggtcaatccggaaaagcacatcaaattcgctttttcgatgccgttggcaatggtggacagcagtgcgatcgtactggaacagatcctggacgacgaaccggtcaaaggagcgaaaccactgcctccttctttaaaaaggccttcccaaccggacggacaggatgggaagaatacacccgctaagccccgtaaaaccaaacggattccgctccatttcacacaggacacgctgaaaatccgcgaatggacgatgagcgcggcatggaaaccgggcgccagatattcgctgttgatccccgcagaaaccttcgtgaacgtcaacggggaaaaaaacgacacgatgcgaaccgaattcagtgtagccgaccctgaaaaattcgggactgttctgctcaatatccagggcaaaactcccgaaagcgaatacatcgtgcaactgctcgacaatacgggcaaagtgacgcaggagcgggcacacctcaccaccgacaaatatactttccggtacatcaatccgggaacggtacgcatcaaagtgatcgaagacctgaacggaaacggcaaatgggataccggctccctcaccgaacggcgccagcccgaacgggtcgaactcttcgtcggccccgacggcaaagaggagatcaatgccaaggaaaactgggaactggagttcgacgtcaacatggacgagttatttgcaccgatgacgatggaacgcatggatcagcgcatcggacggctcgaagcgattcgccgccaaaagatgatggaagagtgggccaaacgcaaccaggacaaacagcacaaccactcccacggcaacaccaacaccggaaatcagggctacgggaaccagggttacggcaatcaaggctacggtacccaggggtatgggaataccggctacaacagcacttattga

SEQ ID NO: 1618 - DNA, 3696 bp, Alistipes indistinctus
atggatacttcatcgatacctgaaatgaccgtttcgggtcccgccagcggcgggaacaggccggagagcctgagggggggggcttatccggatcaggaaaaaggaaaatcccgaaagccctggtggaggcgcctgatcaaggtgctgctgattgtcgccgtctcgctggccggactgttcgtcctgctgggtggggtggtctggctggttttgacgccgccgcgcctgacgcctttggtgaaccgtgtcgcgaccaaatacctcaatgcagaggtgcatttcgatactgtccggctgtcgctgttcgagaattttccgcacgtcagcctggagttgaaaaacggcgaggtgatctccggcgtttttgccgggattcccgactcgttgcgcggatacgtgccgcagcgggccgacagcctgttgcggttcaaagagtttgcggtgacgctgaacttgccgcgcctgctcgccgcgcagatcgccgtccgccagttgaagctggtcgatcccgatatttacgcttttgtgtctccggcgggcaatgccaactggaatatttatacgtctgccgatacgaccgccgatacgacggcgaccgatctttctacgattttcggtatccgggtgcgcgaattgctgctcgaaggcgggcgcatacggtacgaaagccgtcccgatcgggtggatgcggcgctcgattcgctgcatttgcggctacgggggcaccgcagccaacgttatgaaatcgatttcggaggcaaagcttcgatgcagcaggaggccgttcgttacgcccgctccctgccgctgtcgctttccgggagctttgcattcgatacgaaaaatccgggcggaattgcgcttgatcagctggctttcaaggtggacgatatcccggcagtgttcgacggcaacgtgacggtggcggccgacagtatcgtgtcggatatgacctgccgggtcaatccgttgcgattcaaacaggcgttcggcctgattccggtcgagttgatgcctgccgtacagcgtgtcgaaaccgacctgacggctgacctggagacgaagataacgggaacgtaccgtttcaacggcagtgtactgccgagtgtccggctcgattgcaaagtggacggcggttacctcggttatcgggggagtcgggcgcggatcgataatctgttgctcgatgcgtcgctgttttaccatccgtcccgttccgattccacaggtgtgatcctgcgcaagctctcggtcgatggaatcggaatgaaattccgggcggacggtacggcgtgggatgtgctgcgggacgcccgggtcaagggcaacatgcacggctcgatcaatctcggtacgcttaccgaactgtttccttccaagcagaaagggattgtggcgcatggtatcgtcggcatcgacgccgatctggcgtgccgtctcagtgaactcacgccgcgcaggatcgggcagacccgtgtccatgcggtggttacgctcaatgatatgctggtcgatatgccgcaggatacgcttcggctcgttgcaaacggaacccggatcagtcttggggcgaatccgaaccttccggaacaggatacactgatcgcagccggtacgcaggtggtctatcttgaggtacaggccgacacgatgcacgtcaacctgaaagaccagatggccgtcgctgtctccggggctgaacttaaaatgcgcaacgcagcttcggtattcagcggcgatacgaccgttgtgcatccgtttacgggttcggtacgcacgcgttatgtggaggttaatggccttgattcgacctgggtgaaggctggcaatgcatccattgcgttcagcatcctgccttcggcgtccgatccccaggtgccgatgatccgcacgcggatcgaatccagaggccttgctgcccgcagtctggagaatatctacgtactgcgcggcgcagatgtgaatctcgaggcaatattgttcaatacgcgtcgccggatggcgcagcagcgcgaccgtatgctcgattcgttgcagcgggtttatcctgcggtaccgcgcgattcgctgatggaccacaatcgtgcgctgcgcaggcaggcgcgtggtgcatcccgccgtgtccaggacgattttgcaggcgaagatatcgatatgcgggttgaccggtcgatcggtgaactgctgcgccgctggaatgcgaagggaagcattaccgctgccggaggcagggtgattaccccgtatttcccgttgaccaatacactggggaatgtggatgtcagctttacgaccgaccggatcgatttgcgcggaaccaccatccacagcggggtgtcggaactgaacctgaccggcaaggtgtccaatttgcgccgggcattgctgggacgcggcaagcttgtcgtggatatgaacatcgagtccgatacgctggatgtcaacgaactggtcaaggcggccaatgccggggcggcttatgcctcttcgagcgaagggtacaaagattccctgcggcaagccacttcccaggaacatctgcagcagatgatcgagcagaaaaccgaggccgataccgcatcgcagagtccgctgatcgtcatccccgccaacgtcgagatggatgtcgacttggatgtccgttacggagtgtatgcggacctgattcttaacaggctttcgggctgtctggtcgtgcgcgaccgttgcttgcagctgaacgacctgacggcagtgacggatgcgggcgaactgacgcttacggccctctatgcgacccggagccataccgatatcaccaccggctttgaccttgagatgaaaaaaatacaggtcgaccggctgattaaactgttaccttcggtcgatacgatgttgccgatgctgcgttcgttcgaaggagtggtcgattgccagctggctgccgccgctgcgctcgactcgtcgatgaacttcctgatgccgacggtcaatgcggcgtgccgcattcacggtgagaacatggtgctgctggacggcgagacgtttaccgagatctcgaagatgctccatttcaagaacaagaaacggaatatgatcgacaagatttcggtcgagatgctcgtgcgtgacaaccagattgaaattttcccgttcgtgatcgagatggatcgttaccgcgcggccgtcagcggcgtgcagaagctcgatatgagtttcgactaccatatttcggtgctcaaatcaccgatcccgttccggctcgggatcgatatttacggcaatccggataaatttaaattccgcatctgccgggcacgttacaagagcgtcgacgtgccgacctatgtcgaactgatcgattccacccgattgaatctgcggcggcgcataaccgatattttccatcggggcgtcgaggcggctaccctcagcgaactgagtgtcgcatcggcggtacatgtgccttcggaggcgaccctcaagagcgaggaactgaccgctgctgatacgcttttgttgcgccagcaggggatattgcccgatacaacggttcagaaagccgactcacttttaatgcctgctgccggagaaccgctggatggcgggtcacgggaaacggtcgtgccggaccggaaaggcaagtcatcccggcgaaagcaacggaaacagtcatcggaggcggtactccccgaggagcgaacggcgacgcggtag

SEQ ID NO: 1619 - DNA, 2226 bp, Alistipes indistinctus
atgaactctctgatctacctgttcaggttcatctaccgcatccgctggtggctgctgatcggtccggcgctggctgcactgttcgtcatctacaagacgcagaaaatgtcgcatacgtaccagacccgcacgaccatttacacgggcgcggtctccggttacagcattgacccggacgacagcggcaaacaggactgggcctcgaccaacaatacgatggacaacctggtcaacatcatcgtgtcgcaaagtacgctccgcaacgtctcgctgcgcctgttcgcacaagccatgatgtacggcagcccggataaaaacaccaattacatttcggcggccaactaccgcaccctgatgcggcatgtgcccaaagaggtggtcgcgctgatagacaagaactcggaagaaaacaccctcgccaacctcgaagattatgaaaaggccagccccgacaattacgtctacgggctgttccattacacgcaccgccattacagctaccaggcgctgagcaagatcgtggtcaagcgactgggcaacagcgacatgatccaggtatcctacgaatcggacgacccgggcatcgcctacaatacgctcgtcctgctcaacgaagagttcgtcaaacaatacaaggacctgcgtttcggcgagacgaacaacgtcatcaaatatttcgagcaggagctggaacgcacgcgcaaagtgctgaccgaagccgaagactcgctgcgcgactacaacgtcgagaagcgtgtcatcaactacgacgaacagaccaagcacgtcgccgtactgagccgcgacttcgaactgcgttacgaagacacccgcatcgaactggccaacacgcagcggctgatggaagtgatggacgaccggatcgacgagcacgtcaagcaattgcgcaacaacacgctattcgtggacaagctccggacgatctcgaacctgacggcgcgcatcactacgctcgaatcgttccaaaacgacacgctcgcccaggccctcgaccagccccttaccgcacgtccggccggatcgtcaacgacttcgatcagcagtttgaagcgacaactggccaaggcgcagggcgaactgacggaactgactcacgctttgggcacccaatactacaccaaggaggggctgtcgacctccacgctcgtcgaccaatggctcgacgtgctgatccgcaacgaaaaggcaaaggccgagatgaaagtgctccaggagtggaaggacaggctcgatgaccggtacgttttttacgcaccggtcggtacgacgatcaaacgcaaacaacgggagatcaatttcaccgaacaatcttacctgtcgatcctgcacggcctgaacatggcccggctcaagcaaaagagcctgcagatcacctcggcgaccctgaaggtgatcaacccgccctcgttcccgatcgcagcgatgcccaccaagcgcaaggtgatggtactggccgcattcttcggcacgatgatcttcatcctcggctacttcatcctgctcgaactgctcgaccggacgctgcgcgaccgggtacgcaccgaacggattaccggcggacgcgtgctgggcgccttccccgcacccggaaaattccggttccgaagctacacgaaagcatgcagacaggtggcctcgcaatatctgggcaatgcggtactcaactatttcaaacccgggaagcccaacgtcatcaacctgctaagcaccgacaccggcaccggcaaaagtttcctcggcgaacaactcaaaacctacttcgaagagatcgggctaaacgtccggctggtcacctatcatcaggatttcaccgtcgagcggaaaaactacctgctcgcgcagagccacaaagacttcattcctgtttgggaccggaagccggacggcgaacctgaaaccggccgcgaagacgtcgtcatcatcgagcatccgtcgctaagcacctgcacggtttccaaagcgctgctgcaggaggcgtcggtcaacatcgtcgtcgcccgggccaaccaggtgtggaaggataccgaccaaatccttttcgacaaggttcgggagcaggccggagagaccccggtcatgctctacctgaacatggcacgccgcgaggtggtcgaaagtttcaccggtatgctgccgccatataccccgctgcgcaaacggctcttccggttctaccagttcggactcacctccagcggaaaataa

SEQ ID NO: 1620 - DNA, 3153 bp, Alistipes indistinctus
atgggaaatatcttcattcggcgcccgatcttcgccatggtgatcgccatcatgatcgtagtattgggactcatcggcatacaggacactccgatcgaacaatatcccgacatcactccgcccatggtacaggtctcggccgattaccagggcgcggatgcgctgacggtcgagcagagcatcgccacaccgatcgaggagagtgtcaacggtgtgagtgacatgctctatatgcagtcgacaaattcgaacgacggcagtatgagcctgcaggtaaccttcggcgtaggttcgaaccccgacatgaacaccatatatacacaaaaccgtgtagcgtcggctaccccccagcttcctgcggcagtcatcacacagggggtaacgacgcagaagaccacgaccagttacatcatggtactgtcgcttttttccgccgacggccgctacgatgaaacgttcctgtctaactacgcgatgctcaacatcaaagaccgtatcgcccggattaacggcgtgggccaggtacaggtactcggcagcggcgcgtacgcgatgcgggtatggatcaaacccgacaagatggattatctgggcctgacggtcgccgatatcgccggagcgattacctcgcagagcgaagtcgttcccggcggccagctcggcgccgaaccgaccgcagaaaaaccggatttcacctatacggtccggatgccttcgccctacaatacggccgaacaattcggcaacgtaatcgtacgtgccaatccggacggctcgctggtgcggcttcacgacgtggcgaccatcgaattaggaacgcagagttattcggtcagctcgacctaccaagggcacgatgcggtcctgatgattatcaaccaatccccgggaagcaacgcggtacaggtgggcaaggaggtaaaagcgctgctcagcgaaatgtcgcaatcgtttccggaaggaatcacctacgacacgctggtcgactcgaccaaaaccatcacctcggggattcaagatatcgtcacgaccctgctgatcgcactgctgctggtcattgcggtcatctacctcttcctgcaggatttccgggcgactttcgttccattgatcgtgattcctgtggcattgatcggcgctttcatgcttttcccgctgttcggattttctgtcaatgtattctccctgctgggtcttgtgttggccatcggactggtcgtcgacgatgccatcgtcgtcgtggaagcggtacaggtcaacctggaacaaggcatgaaagccaaagaggcgacacaggcggcgatgaaaagcgtatcgtcgtcgatcgtcgcaatgactaccgtcctgatggccgtcttcctacccgtcgggctgatgccgggagccgccggaaaactgtaccagcaattcgcgatcacgattgccattacggtttgcatctccgggatcaacgcactgtcgttgacaccggccctctgttccctgttgctccgtccgaaacggcaagccgagcgaaaaggctttctcggctggttcaaccggacttttaaaaagagtgtcgacgattacctgaaaaccagcaacgtcattatccggcacagcgcccgtacgctggtcttgatcggcatcgtcgtcgcggtcgtcctgctgttcgtcaaaacagtgccgacaggatttctccccgatgaagaccagggttacctgatggccgatatccaactgccgaacgccgcttcgctgggacgcacgcaggaagtgatcgaccagcttcaggaggtgctcagcaaaaacgacaacatccagtcggtgacggcggcggccggtttcagcctcctgtccggaaccgaagcacccaacagcggattggttttcatcaggctcaaagattacaaacagcgtaaaatgacggctgacgaaatttcggacatgctgaacggggaactgtacgaagcgatcaattctgcggaagtgttcaccttcggacctccttcgattcccggattgggtccaggttccggctttacgatcatgatccaggataaaggcggcaacacgccccaatacctggcgcaatacaccgataaatttatcgaagaagcccggaaacgcccggaaattgcatccatcagcacgctttaccaggccgatattccgcaaaaggctatccggatcaacaacgaaaaagtgctcaaagccggcgtatcgctacaagacctgcacgagaagatatcggcctacctgggcggaagctatgtcaacaacttcaaccgcttcggacgcatgtaccaaacctatatacaggctgccagcgagtaccggctcacgcagtccgacctggatctgttctacatcacgaacaaccggggagagagcctgcccatcgcctcgttcattaccgtcaaagacactaccggcccccaatacaccaaccgcttcaacctgtaccgggccgcttcggtgaccgggcagcccgccaaaggctattcgaccggcgagacgatgcaggccctcgaagaggtagccgcccgggtacttccctccgacatggggtacgcatggagcaacatgtcctaccaggacgcgcacaccaccggcgaagccacggttttcctctacgccataattttcatcttcctgattctggccgcgctttacgaaagctggtcgctgccgctaagcattattctcggcattccgttcgcggttttcggcgccatgttgttcatcttcctcggccatttgctgaatccgaagtacatcaacgacatcttcctgcaggtatcgctgatcatgctgatcgggttggccgccaagaatgcgatcctgatcgtcgaatatgccaaagcaaaattcgacgagggtctttcgctcagggatgcggcgatcgaaggcgcccgtttgcgggtgcgccccgtcatcatgacggcattcgccttcctgatgggcgtaattccgctgatcttcgctacgggcagcaatgccgtcgcacgcaacgtcatgggtctcggactcttcggcggtatgctgatcgccacgctgatcggcatattcgcttacccggccctgttcgtatggatcggcaagatgggcaaatacgaacagaagcgaacggccaaacaacaagaaatgacaaacagcgaacaccatgaataa

SEQ ID NO: 1621 - DNA, 3210 bp, Alistipes indistinctus
gtgaagaaacaactctctaaggtgctcgtgttgggttcgggcgcactcaaaatcggacaggccggcgaattcgactactccggctctcaggctctaaaagcgatgaaagaggaggggatttccaccgtcctgatcaaccccaatgtggcaaccatccaaacctctgaaggtatcgccgaccgggtttacttcctgccgctgaacgcttattttatcgaggaagtgatcaaaaaagagcgtcccgacggcattttgctcgcttttggaggccaaaccgcattgaactgcggcaccgagttgtatcagaacggtatcctgaaaaaatacggtgtcgaggtactgggtacttccgtagaagcaatcatgtacaccgaagaccgcgacctgttcgtcaagaagctgaacgaaatcgagatcaaaacgccgcgcagcgtcgcagtcaacacgatggacgaggcgatccaggccgccgagaagatcggcttcccggtcatggtacgctcggcctacgtactgggcggtatgggcagcggtttctgctacgacatggatgaactcaaagcccgggctgaaaattctttctcgtacgccccgcagattctggtcgaggaatcgctcaaaggatggaaagagatcgaattcgaagtaatccgcgataaaaacgaccactgcttcacggtggccagcatggaaaacgtcgatccgttgggcatccataccggtgagagtattgtcgtggcgccgacctgctcgctcgacgagaaagaattgagtttcctgcaagaactttcgaaaaagacgatccgccatctgggcatcgtcggtgaatgcaatatccagtacgcattcaattcggacaccgacgattaccgcgtaatcgaggtaaatgcacgcctgagccgttcctcggcactggcatccaaagcgaccggctacccgctggctttcgtggccgcaaaactggccttgggctacacgctcaacgaaatcggagagatgaacaccccgaactcggcctatgtagcgccgcaactcgattacatgatttgcaaaatcccgcgctgggacctaagcaagttcgcaggcgtatcgcgccagatcggatcgagcatgaaatcggtcggcgaaatcatgtcgatcggcaaaagtttcgaggagatcatccagaaaggtctgcgtatggtcgggcagggaatgcacggtttcgtctgcaacagcgacatcacctttgagaacctcgacgacgaactggccaatccgaccgatatgcgcatgttcgccattgcagctgcttttgagaaaggttacagcgtacaaaaactccacgagttgaccaaaatcgatccgtggttcctctccaaactcgaaaacatctaccaatactcgctcgtgctgaaaaaatacggtacgatcgccgaaattcccgccgacgtgatgcgcgaggcaaagcgactcggattctcggatttccagatcgcacgtttggtcgaagcgcccaatggcaacctcgaaaaagagatgatcgccgtacgcaaccaccgcaaacgcctcggtgtcctgccgtcggtcaagcgcatcaacactgtcgcttcggagcatcccgaactgaccaactacctttatttgacttacgacggttccgaacacgatatctcttactaccacaataaaaaatcggtcgtggtactcggttcgggcgcttaccgcatcggcagctccgtcgagttcgactggtgctcggtcaacgccgtgcaaaccgcacgcaagctcggttacacgtcgatcatgatcaactacaacccggagacggtctcgaccgactacgacatgtgcgaccggctctatttcgacgaactgtccgaagaacgcgtactcgacgtaatcgacctcgaacagcctaacggcgtgatggtttcggtcggcggccagataccgaacaacctggccatgaaactccagcgccagaatgtacccatcctcgggacgtcggccgtttcgatcgaccgtgcagagaaccggcacaaattctcgtcgatgctcgacaacctcggcatcgaccagccgcagtggaaagagctttcgtcgatggacgacgtgaacgaattcgtcgaccgcgtaggcttcccggtactgatccgtccgtcctacgtgctttcgggagccgccatgcgcgtctgccacaccaaacaggagatggaacatttcctcggcatcgccgcgaaggtgtcgaaagagtatccggtcgtgatctccaaattcctcgaaaatgcaaaagagatcgagttcgacgcggtagcgcacgccggtgagatcatcgattacgcgatctcggaacacgtcgaattcgccggcgtgcactccggtgacgcgacactggtattcccggcccagaagatttacttcgaaaccggacgccgcatcaaaaagatcagttgccaaatcgccaaagagctgaacatcagcggaccgctcaacattcaattcctggccaagaacaacgacatcaaagtgatcgagtgcaacctgcgtgcttcgcgcagcttcccgttcgtatcgaagatcctcaagcgcaacttcatcgaaacggcaacgaaaatcatgctagacgctccttacgcaaaaccggacaaattcgacgtcgattacatcggcgtcaaggctgcgcaattctcgttcgcacgcctgctgaaagcggatccgattctcggcgtcgacatggcttcgaccggcgaggtaggatgcctcggagacgacttcaacgaagcgctgctgaactcgatgatcgcagtgggatacaacatcccgaaaaagaacgtgatgatctcttcgggatcggccaaatcgaaagtcgatatgctggaagcctgcggcgaactggacaaaaaaggctatacgatctacgctaccgccggaaccgccgagttccttaaagaaaacggcgtaaacgccattgctgtcagtcgtcccgacgaacacaagacggataacgtactgagtctgatcgcggacaaaacattcgacctggtggtgaatatcccgcgcgaccataccacccgtgagattaccaacggcttcaagatccgccgcgcggcaatcgaccacaacattccgctgattaccaacgcacgcctggcggcttcgttcatccatgctttctgcaacatgaagatgaccgatatcgcgatcaaagcgtgggacgagtataaataa

SEQ ID NO: 1622 - DNA, 2976 bp, Alistipes indistinctus
atgatccacgtcaagggagcccgtgtacacaacctcaaaaatatcgaggtcaaaattccgcataacgaactggtggtgattaccggcctttccggttcgggtaaatcgacgctcgccttcgacaccatcttcgcggaggggcagcggcgttatgtcgaaagcctgtcggcctatgcccggcagttcctcggcaagatcaacaagcccgaggtcgatttcatcaccggcatagccccggccattgcgatcgaacagaaggtcaatacgcgtaatccgcgttcgacggtcggcacctcgaccgaaatctacgactacctgaaactgcttttcgcccggatcggacacacttattcgcctgtttcagggcgtgaagtcacatcgcatacggtagccgacgtggtgaactacatcgttgcgctccttccccatacgcgcatcctcgtgaccgctccgctgatcctcggcgaaggacagggactgatcgaaaagcttaccctgctttcgggagatggttttcaacgtgtatatatcgccggagaagtgcttttcatcgaagatgtagtgcaacaagccgaacgctacaacgaagcccgggatatccgcatcgtgatcgaccgtgcgaaggtcagcgccgaagaggagctcctcagccgcctcggcgattcggtctccaccgcattcaacacggcaggcggcatgtgcgatatcgtcatacaaaatccggaaggcgaccgtgtcgaacacttttcatcacgcttcgagctcgacggcatccgcttcgagcatccttcggaacatatgttcagtttcaacaatccgatgggggcctgcccgcgatgcgagggttacggcaaagtgaccggcatcgacgaagacctcgtggtaccggataaagccaaaagcatttatgatggcgccattgcctgctggcgcggcgaaacgatgaaatggtggaaagaacagttgatcgagcacgcgcccaaattcaactttccgatccaccggccctattacgaactgaccaaacaggaaaagcacctgctgtggaaaggcaacgaatattttcacggactcgaccgttttttcaagttcctcgaaagcgaacgctacaaaatccagtacagggtcatgctatcgcgttacacgggcaaaacgatctgtcccgactgcgaagggggacgcctgcgtaaggaagcgctgtacgtccgggtcggggataaaaacatcaccgaattggtcacgatgccggtcgatgagctgcaagatttcttcaccgcactgccgctcgacgaccgggaacgacacatggccgagcgtatcctcaccgagatcacttcgcgactcacatacctgaacgaagtagggttgggttacctgacgctcgaccggctctcatcgacgctatcgggcggtgaaagccagcgtataaacctggccacttcactgggcagcagccttgtgggatcgctctacatcctcgacgagccgagtatcggactgcatccgcgcgacacgtaccggctgatcggcgttctgaaaaaactgcgcgacctgggtaacacggtgatcgtagtcgaacatgaagaagagattatccgtgcagcagatacgattatcgatatcggcccgttggccggctaccagggcggggaagtggtattccagggctctgtagatgaactaatccattcggacaagagccttacggccaaatacctgaccggccgggagactatcgacgaaccgaagcattaccgcaaatggaacagctatatcgaagtgcagggagcgcgggaaaacaacctcaaggggattgacgtgaagttcccgctcggtgtgataacctgcgtcaccggagtgagcggcagtggcaaatcgtcgctggtcaagggtatcctctatccggccgtgcggcgcgaactgtacgaaacgggactgaaaccgggcagtttttccgggctgtcgggcgacgtcacccgccttaaatcaatcgaaatcatagaccagaatccgatcggcaaatcgtcacgctcgaatccggtcacttacatcaaagcgtacgacgaaatccgcaaacttttcgccgaccagccttatgcgaaacacaacaacatgaatccgtcgcatttttcgttcaacatcgcgggcgggcgctgcgaggagtgtcagggcgaaggggtgatcaaggtcagcatgcagtttatggccgacgtcgagttggtgtgcgaatcctgtggcggcaaacggttcaaagacgacgtactcgaagtgaagtaccacgaccgttcgatttacgacattctggagatgaccgtcgacgatgcgatcgaatttttcggcaaataccaggacaaagacccggtcaacaaaaagatcatcgaaaaactgagcactttgcaggatgtgggtctcggttatattaaactggggcaatcctcttcgacgctctctggcggcgagagccagcgcgtgaaactcgcatcgttcctcaccaaagagaacgcacagggaccgatcatgttcatcttcgacgagccgaccaccggcctgcatttccacgatatccgcaaactgctcaaatcgttcaacgcgttgatgtctaaaggacatacgatcgtaattgtcgagcacaacatggatgtcatcaagtcggccgactgggtgatcgacctgggaccggaagccggggaccggggcggatacctggttttcgaaggtacgcctgcgcagctcaaagattgcaaagagagttataccggcaaatttctggctctcaacaccgaccggaaaaccgggtcggcagtcgcatccaagatgtcgacagcatccgggccgacaacagaaatacctgctgacaatagggctaatacgacggaaaatacgggaaggacacgatccaagaggaataaaccgcaaacagccgaaacaaagtacccctctcagaaaaccgtcaaaacaaccaaatccgaagtataa

SEQ ID NO: 1623 - DNA, 2856 bp, Alistipes indistinctus
atgaaaccggaaaaaaacgatatacactcccttcctactgaaaatcggatcgaagtttacggagcacgcgagcacaacctcaaagatgtgaatgtcgtcatcccgcgcgacaccctgaccgttatcaccggcctgtccggttcgggcaaatcgtcgctcgccttcgacacgatctatgccgagggtcagcgccgttacctggagacgctttccacctatgcgcgccagttcgtcggcacgatggaacgtcccgatgtggataaaatcacgggcctcagtccggtaatttcgatcgagcaaaagacgaccaacaagaatccccgttcgacggtcggcaccgtgaccgagatcaacgattttctccgcctgcttttcgcgcgggcgtcggacgcctattcgcccgtcacgggcgaactgatggtacaccataccgatgcgcagatcgtcgacctgatcctgcgcgattttgccgggcgcaagatcgcgctgctggcgccgctgatccgcgggcgtaaaggacactaccgcgaactgttcgagaggtttattaaaaaaggctacctctatgcccgtgtggacggtgagattcgtgaggtgcatgccgggatgaagctcgaccgttataaaattcaccatatcgagctgatcgtcgaccggctcgtggtgaaagaggatgtccgcgaacggttgctcaaaagcctgcaggagacgatgcggcagggcaaagggacgatgatggtttacgattacgattcgaacaacgtccgcttttacagccgccacctgatgtgtccgaccagcggtatcgcattcaacgaaccggcgccgcactccttttcgttcaactccccgcagggggcctgcccgcattgcaacggactgggcgaggaagcggtcttcgatctggaaaggatcatccccgacaacgataaatcgatccgcgaaggcgcgatcgaaccgttgggtaaataccgcaataacctccttttcgcgctgatcgaggcattggggcgtaaatacgatttcacgatcgacgatcccgtcggatcgttgggcgaggaggcgttgaacgctgtcctgtacggcgatgccgaaccgctccggatcgatacgcatgacctgggcggtgcgggtaactacatgattgcctgggagggtgtggccgactatatcgagaagcaacaggaggacagttccagcagcaaaggcaacaaatggaaagagcagttcgtcgtgcggcgggtttgttcggtctgcggcggttcccggctcaaacgggaggcgctccagttcaagatcgacggtaagaatatcgccgaactgtcggtgctcagcatcgaggatttcgcacaatggatggagggacttgaagaacgcctgtcgtcccggcaacggcagatcgcgcgcgacctgctcaaggagattcgcgaacggttgcgcttcctgctcgatgtaggcctgggctatctgtcgctgagccgcagttcgcgttcgctctcgggcggcgagagccagcgtatccggttggctacgcagatcggatcaaagttggtcaatgtgctctatattctcgacgagccgagtatcggcctgcatcaacgtgataatatcaaactgatcaacagtcttaaggccttacgcgatgcggggaactcggtcattgtggttgagcacgacgaggagatgatccgcaatgcggactggatcattgatgtcggtccgaaagccggtattcgcggcggagagatcgtcgctgcgggtacgctcgacggggtgatgcattccggcagtatcacggccgattacctgagcggccgtcgtaagatcgaactgccggccgtgcggcgaaccggcaacgggaagatgttgacggttcgcggtgcgcgcggcaacaacctgaagaacattacggtcgatttcccgctcggggtgatgatctgtgtgacgggtgtaagcggtagcggcaagtctacgcttgtcaatgcgacgttgcgcgcggcgcttaaccgttacctgtaccattcctatgatcagccgctcgaacacgatgcgatcgaaggaatcgcaaatatcgacaagctggtggtggtcgaccagtcgccgatcggccgtacgccgcgcagcaatccggcgacctattccaacgtgttcagcgatatccggaaactgttcgaagcgacgcccgacgcacaggttcgcggtttcaaagcaggacgtttctcgttcaacgtcaagggcgggcggtgtgaagcgtgccggggagcgggggttcagacgatcgaaatgaatttcctgcccgatgtctatgtaaagtgcaaggtgtgtaacgggcagcgttacaaccgtgaaacgctcgaagtcaagtacaaaggtaagagtattaacgacgtgctgaacatgacgatcaaccaggcggttgaatttttcgaggcgatcccgtcgatccatatgaaactcaaagccattcaggatgtcggcctcggttacctgacactcggacaaccctgtacgaccctttcgggcggggagagccaacgtatcaagttgtcggccgaacttgccaaacgcgatacgggcaatacgctttatattttggatgagccgaccacgggactccatttcgaagatgtccgggtattgctcgacgtgttgaacaaattggtggacaaaggcaattcggtgatcgtaatcgaacacaacctcgatgtgatcaaagtggccgattacctgatcgacatcggtcaggaagggggaagcgggggaggccggttgatcgccgccggtacgcccgaggaggtcgctaaagtcaaaagaagttacacgggtcagttcctcaagccgttattgagccaatag

SEQ ID NO: 1624 - DNA, 3588 bp, Alistipes indistinctus
gtgattcgatacactgctttcactcgaacacgcccggctattgttgccggaattgggtttactcttgatattctgcccggaaatacctatttttgcccgttaccgccggggcgcattcccggcaaacgcaacgagaatccgaaaatagttatgggccgttcgaaattcaacgagtacaaggggctggacctgccccggatcacacaggaggttttgaaacagtgggacgctgaggatacgttccgcaaaagcatatccacgcgcgagggacaccccacgttcgtgttttacgaggggccgccctcggccaacggccgtccgggcatccaccacgtgatggcccgcacgatcaaggatattatctgccgttacaagacgcagcgcggtttccttgtgcaccgcaaggctggctgggatacccacggcctgcccgtggaactgggcgtcgagaagaaactcggaatcaccaaagaggatatcgggacgaaaatctcgatcgaagagtacaacgatacctgccgccgcgaggtgatgacctataccgaccagtgggagagcctcacgcgcgagatggggtactgggtcaacatgcaggatccctatatcacctacgacaacaaatacatcgagacgctgtggtacctgctgagcgagctttataaaaaaggactgctctacaaaggctatacgatccagccctattcgcctgcggccgggacgggcctcagcaaccacgagttgaaccagccggggtgttaccgcgatgtgaaggataccacttgcaccgcacagttcaaagtgattcgcaacgataagagcgaaaagctgttcgacggggtggagggcgacctctatttcatggcctggacgaccacaccttggacgttgccgtcgaataccgcgctggctgtcggtcccggtatccattacgtacgggtgcggacctacaatccgtatacgggggagcccgttacagtggtgctggcccgtgacctgtttcacaactattttccgaaaaagaacgaggaactcgatctggacggctacaacggcgacgggaagaacattccgtaccgggtgacgggcgaattcctcggcaaagagctgcccgggatcgagtacgagccgctgattccgtggatcaaaccgatgggcgatgcgttccgggtgatctccggtgactatgtgaccaccgaggacggtaccgggatcgtgcatatcgcgccgacgttcggtgccgacgacgaccgggtggccaagcagcagaatatcgcgccgctggtggtggtggacaaagcgggcaaacgccagccgatggtcgatcgcacgggcaagttcttcctgatggcggatatggacccggcgttcgtcgcatcgaatgtcgatgcggaggcgtaccgcgagtacgaaggccgctttgtcaagaacgcctacgatccgaagctgaccgatgccgacgagacgctcgacgtctcgatctgcatgatgctgaaagcggaaggcaaggtgttcaaaatagagaagcatacccacaactatccgcattgctggcgtaccgacaagccggtgctctactatccgctcgactcgtggttcatcaagacgacagccgtgaaagagcgcctgatcgcactcaacgaaacgatcaactggaaaccggcttcgaccggtagcggccgtttcggcaaatggctcgaaaaccttgtggactggaacctgtcccgttcgcgctactggggtaccccgctgccgatctgggcgaccgaagaccatagcgaactgaaatgcatcggttctgttgccgaactgaaggcggagatcgacaagtcggtcgctgctggctttatggccgaaaatccgttcacggcctttaccgaaggagatttttcgaaggagaattacaataagttcgacctgcaccgtccctatgtggacaacatcgtgctcgtctcgtcgaaaggcgaacgcatggtgcgcgagagcgacctgatcgacgtctggttcgactcgggggcgatgccttatgcccaggtgcactatccgttcgaactcagcggggagaagttccggaaggtttatccggcggatttcatcgccgagggcgtcgaccagacgcgcggttggttcttcacgctgcatgcgctggcgacgatgctcttcgacagcgtggcgttcaagaatatcatttcgaacggtttggtgctcgacaagaacggcaataagatgagcaagcgtttgggcaatgcggtcgacccgttcgaggtgcttgaaaaatacggtaccgatgcggtgcgctggtacatgatctcgaactcgcagccgtgggacaacctcaagttcgacgtggacggcgtggacgaagtgcggcgcaagttcttcggaacgctgtacaacacctacagcttcttcgcgctgtacgccaatgtcgacggctttacgggccgcgaggcggaaattcccgtggcggaacgcccggagatcgaccgttggatcatctcgctgctcaatacgctggtcaaagaggtaaccgagtcgctcgaaaattacgatccgaccccggccgcccgtgcgatccaggatttcgtgaatgaaaacctgtcgaactggtatgtgcgcctgaaccgcaaacgcttttggggcggcggcatgactcccgacaaactggcggcctaccaaaccctgtacacctgtctggagaccgtttcgcagttggccgcaccgttcgcaccgttcattaccgacaggatcttcaccgacctgaatgcggtgagcggacgccacggcgacacctctgtgcacctggccgattttccggctttccgggccgaattggtggacgctcgtttggaacagatgatggctttggcacaaaaagtgtcgtcgatggtgctggccttgagacgtaaggtcaatatcaaggtgcgccagccgttgacgaagatcgtgatcccggtgcttgccccggctattaaagccgaaatcgaagcggttcggggattgatcctcggcgaggtaaacgtcaaggagctggaatttatcgaggataccaccggcgtaattaccaagcggatcaagccgaacttcaagacgctcgggccgcgctacggcaagcagatgaagcagatatcggcactggtggccgctttttcgcagggggacatcgcgcagatcgagcgggaggaccgctggacggccgaaatcgacggcgtgcggatcgaagctactgcagccgatttcgatatcgtgtcggaagacatgccggggtggctggtcgctacggagggcaagctgaccgtcgcgctcgacattaccgtgacggaggagctgcgtcgcgaaggtatcgcccgggagctggtcaaccggatccagaatctccgtaaggagagcggtttcgaagtgaccgaccgtatccgcgtggtgatcgagcggcatgaagcgctgacaggagccgtcgagtcgttcggcgattacatcgctgcacagacgctggccctgagcgtcgcactggcggattccctcgatgaggcgggaagcgtcccggtagagctggatgaactgaccgtgagaatgaaagtggagcgcgtctga

SEQ ID NO: 1625 - DNA, 2703 bp, Alistipes indistinctus
atgaagatcaaaccatttttcattttcgtactgggcctttgcctcgctccggcaatggctgtcccggttatcggcgccccccctcaggatcaggagttgcgtgtcgacccgatggccgagctgcaccgggacgcaaaatttatcgactcgaccgaattgacgctggtaaccccggtacagttggaaaaactgctcaaggagaagcccgccgcaggttatttctgctttgccgagctgcgtgacaaggagatccgccaatacgattcgctaccggtaatctgggccgagcgccccgtttcacaacgcaacgtactggtagcttcggcacaaccgggcgaatactatccgtggcagctgggcgtctatgcgccttacaagaagctcgacaacatacggttggttttcggcgacctgaccaatgcggcaggcgataagatcagtgcggcggcgatgcaatgcttcaacatgggcggcatcaatcaacacgggaaaccgttcacgaacacgatcaacgtccccaaaggccttatccaggtactctggagcgggatcgacattccgaaaaccgcatcgggaacctaccgcggcaaggcggtgctggaagtggacggcgccgaaccgacgatgatcgacatcacgctcaacgtaggaggaccggtgctcgagaacggcggccgcgacgaaagctggcgcaaaagccgtatgacctggctcaactcgacgatcggtttcgccgaaacaccgacggcaccctatactccgcttaaacgcgacggagagacaatcagctatctcggcggtaccgtaaagctctcggccgatggactccccgccagcatcgtgacgaattacgaccaggcgaaccaactcgaccgcagcatctcgaacgaagtgctcgccaagccggttgctttcgtggtcgaaacttcgaagggaaccgagaaactgaaaccgtcaaaaatcgagttcctcaaacagaccccggccacactggagtggaaagttctgctcaaaggttcggacgtagaagcggaatgccttgcaaaaatgctgttcgacggaacgatcaactaccagttgaaagtgaccgcactgcgcgatgtccaggtcaaagatatccgtacggtattcgattatacgcactacgcatcgaaatacatcatgggcctcggtgtgaaaggcggtgcacgccccgattcgacgatcgactggaaatgggatacgatcaaacagcaggaccgcatctggctgggtaatgtcaacgcgggtatgcaggtcgttttcaaggacagcaactacaaacgcccgctcgtgaatatctattacgagttcggacgcatccggtacccgcattcgtggggtaacgacaataagggaggaatcaatatcaccgaacaggcaaatgccacacaggtgaacgcatacagcggagagagaacgctcaaaacgggcgaaaagctcgatttcgatttcgacctgctcgtaacgccggtcaaaccgatcgacctgaaagctcatttcgccgaccgtccctaccacctgaacgccgacacgagcggcggattcattccccgggcgctgaaagccggagcgaaatggatcaacgtacaccacaaagcggacatctatccctacatcaactatccgatggtagacgaggtcgtgcccgatatgaaagccttcatcgcgaaagcgcatgcgaacgacctgaaagtacgcctctattacacctgccgtgagctgacggtcaaaacccccgaattctggatgctccgcagccttggccacgagatcatcaaagacgggcccggtaacgatacccgaacgatcgtctatccgaacggtccgagaccatggctcgtccacaacatgcgcaagaactatattccggcctggtatgcgggcttcgaacagggcaaatacaagggtcagctcgatgtcgcggtcatcaccgatcccgagtcgcgctggaacaactattacctcgaaggactgaactggatgatcaaaaacatgggcatcgacggtgtctacatcgacgacagttcgttcgacggggagacgatgcgccgggcacgccgtattttcgacgcggacggcaaacgccgcctggtagaccagcacacatggaaccacatgaacccttacggcggctatgcgaactccatcaacctctcgttggaccgcctgccctacgtcgaccggctctggatcggcgaactgttccgcgactacaacaagcgtgatttctggcttgtcgagatgtccgggattccgttcgggctgatgagcgagatgctcgacgcgcacaacgttttccgcggcatggtgttcggcatgctgccgcgcctgccctggagcggcaatccggttccgatgtggcgcgcgctcgacgctttcgggatcgaccaggcgaagatgtacggctactgggacgaccgtaatccggtccgcagcgacaacgaactgatcccggtaacgacctacctgcggcccggccactcggccatgctgtcgatggccaattgggacaacgacaatgcgcaaaagtgccgcatccgcatcgatgagaagaaactcgggttccgtccgacgcaggtctacctgccggagatcgacgagttgcaaccggccggagagatcgacctgaacggggagatcgagattccggcgaccaaagggcatattgtcatcctgaaatag

SEQ ID NO: 1626 - DNA, 1365 bp, Alistipes sp.
atgagcaaagataacaagattaccagaagagagtttctctcttactcggcattggcaggtgttgccggcgctatgggactctccccgttcctgacctcgtgcaagggaggagataaagcagtagcttacacgccactgaaggctcccggagaatactacgtaccggaactgcccgacaaagcagtcgatggcaaagagctgaaagccggtgtgatcggttgcggcggtcgtggttcgggtgctgccgaaaactttttgaatgccgcaaacggcgttacgattgccgcattaggcgatgtcttcgacgaccgtctgcaaggccttaaaaactcgttgaaagagaagtatcagatcgatgttccggccgacaaatgcttcaccggattcgacgcataccagaaggtgatcgactcgggcgtggatgttgtgattatcgctactccacccttcttccgccccgaacacttcaaatatgccgttgaaaaaggggtacactgcttcctcgagaaaccgatctgcgttgatcccgaaggataccgcaccattatggccgcagcaaaacaggctcaggccaagggactgagtgtcgtaacgggaactcaacgtcaccaccaacggtgctacgttgaatcctacaaaaaggtacaggaaggtctgatcggcgagatcaccggtggaaacgtctattggaatcagccgatgctgtggtaccgcaaccgcgaaaacggatggtcggacatggagtggatgatccgcgactgggtgaactggaaatggctctcgggcgaccacatcgttgaacagcacgtacacaatatcgacgtattcacttggttctcgggatacaaacccgtgcgtgccaccggtttcggaagccgccaacgccgtgtgacgggagaccaatacgacaatttcagtgtcgatttcgaattcgataacggagtccacatgcacagcatgtgccgccagatcgacggttgtgactcaaatgtcagcgaattcattcagggaaccaaaggatcatggaacagcgtcgatttcgcaatccgtgacctgcaaggcaacatcgtatggcaatacgatgcgaagagcgaagagggacgccaaaacgatccatacaccctcgaacatgtgaactggatctcctgcatccgcaacaacacgccgatcatgcaggcagaagagaccgctgtttcgaacatgatggccatcatgggacgtgaatcggcctatacgggcaaatccgtaacgtgggacgagatgacggcatcgccgttgaactacactcctgccaagatggaactcggtccgatggacatgaagctctacaccgttgccgttccgggaacgggtcctgagaaatag

SEQ ID NO: 1627 - DNA, 2244 bp, Alistipes sp.
atgtcattttcgttcaaaaatgtatgggaatatgggcggatccgtcctttcctgaccaaaaccagagtcgcttgcagcatcatgctggccacgacggctctccttttcgcttgtagcgaagatccggaaaccaatcccgatgagggtgaacccgatccgccagatagcgaacaaaccgattcaacctcaacttcaaaaccgatcgaaatcgaatacatggagttcaatacagcttcggccgttgatctcaatgtttctcaacaggaagatggttcttacagaatcacaactaccggaacagacccctacatcagcacaaaaccgttaaagaccaagaatccatcggattctgtagttcttacgttcgagtacaaaaccaactcttcgatcgaatctttccaaatctttttcgctacacccgtgtcggaagaacgctcgatcaaaatcgccaaacttgaatctgctcgagcccaatggaaaacattctctattaatttaaaaactcaaattgatcaattttcatggggtaaagtggatgactacttgcggttagactttggccaaaaatcaggtgtaacgatccagatccaaaagatgtacctcagggcaatgaacgatgaagaaaaagaggagcaagagagtgagcaggataaggcccaatatgaagccgaactcaatacaaaccttcagaaatatcttcaagccagctatcgctctgaaattacaagtgtagaggttaaaccgttcctgatcgacatcaaaggaaattgtgccggagatggagaattttacctgtgtgaggttccaccctaccttgacgtaacacaaatcaaagagttcgaatacaaaactccaattaccagctcatccttctcgttgagcctgaaccggacggcagaacgcgatggaatcgaatatgaccgagccctctccaaatgggtgatcgttaaaaccgaagacgggaaagaaacaatcgattctcatgcccattatgccgatgatattcaagcatcgcaatcaatgtctcccatgcagcttacgacgaaaaaagggttgggaggattccatcttaatgccgttgaaagcgacctcgacgatctgggtataggtagcgtgacggtcaatgtgcctattacggcctacatgtttacctcggatagaggcaactgcatttctcatacctacggaggcataacttactatttcgaccggggcggtatcgaaaatttggacgctaccttccgcgccacgaccaaacggaatatcgtcgtttcggctatccttttgatccaaccagcggccagttgccccgatcccgaaatcggcagattgctccaacaccccgactacacctcgcaaggtatctataccatgcccaacatgaccaatcccgagagcgttaattgctatgccgcagcactcgacttccttgccagcagatactgccgtaccgacaatcaatacggaaggatcaattattggatcatgcacaacgaagtcgatatgggactcgattggaccaatatgggtgcaaaatccatttggctctatacagacacttatatgaaatcaatgagaatgtgctacaatattgcacggcaatatgatccaaatgccgaagtccttggatcatttactcaccattgggcacaatcttcaggagccaatcatccttcgaaagatatgcttgaaatgatcgtaaaatacagtaaactcgaaggcgattttaaatggggtgtggcccaccacccttatccagatgatttgagtgaaccgaaaacatggttggataaaaatgcaacattctcaatgagttctcccaaagtcactttcaaaaatcttgaagtgatcaataaatggattttggagagcgaaaacctctatatgggaaccacaaaacggacactatggctctcggaaaacggaaccaactctccgacatacagcgaagaagacctcaacgaacaagcagccggatttgcctacgcatggaaaaagatcaaagcgctcgacggtatagacggtatccaatggcacaactggattgacaaccgaagcgaatacggcctgagaattggattacgtcgatatcccgatgacgaagaagatccactgggcaagaaacatgtatggtatgcttaccaagcagccggaacagatcaggaagatacggtattcgaaccatatcttgccatcatcggtatcagcgattgggatatcgtccaagatttcatcagcgaatag

SEQ ID NO: 1628 - DNA, 1167 bp, Alistipes sp.
atgaaaaaattctggctatttgttctggtccttttgaccgccgttacgctcagagctcaaactccgttccaaatcacctttggaccctatcttcagaatgtaaccgaagagggtgttaccgtaatatggggcacttcgggcgatgccctctcttgggtcgaggtcgctcccgacggcaacgatcacttctatgccgaagagcgcccgcaattctttcaaacaaaactcggacgacgcacggtcgggaaactccataccgtgcggatcagagacctgcaacccggtaccttctaccgctatcgggtttgttcgaaagaggtgctcgagatgaaccccgcaaaggtggtttacgggacgacgatctgcaccgatatattccgccacctgccgttccggttcaaaacccgtagcgcggatcaggattcgctcgctctggttatcgtcaacgacatccacgagaacagcgaaatgctgggaaacctgcttgctgatgtcaaaaagggaggatacgacttcgtctttttcaacggcgacatggtcaacaacatgagcagcgaacaacagctgatcaacggattcctcgggaagtcgaccgaattgttcgcttcggagatcccgttttactttgcccggggcaatcatgaaacgcgaggcaacttctccgatcactatttggactacttcccgacctcaacgaacgagccatattacgctttccggcagggaccggtattttttatcgtactggacggcggggaggacaaaccggacagcgacatcgaatactacggattggccgatttcgaccgctaccgggccgatcaggtggcttggctgaaagaggtggtcgcaacagaagcgttccgttcggcgccgttcaaagtggtcatcacgcatgttcccccgatcaacacgacatggcacggaccgctggaggtcaaaaaacactttctccctgtattgaacgaggcaggagtcgatctgatgatttgcggacacctgcatgcctatcactacattccggccggagagtccgattgcagtttcccggttctgatcaactcgaacgacgcttcggtttcaatccatgccacaagcaagtcgctcaactttaaggtgcagaatgcacagaaagagcttgtcaaggaggccaccctcaccaaataa

SEQ ID NO: 1629 - DNA, 1242 bp, Alistipes sp.
atgaaaaacaaatttttactaccttttattcttatgcttggcagcgtttttttcgccgctgccgaatctccgatggttccggagccctatgacgcagacaagtacatcgaaagcgatgtcgttccgctggccggacggaaagggttttcgttcgagaccaaaaacggcgaattcatgctcaagccttacgtgctgttgcagactgccggaaaattcaactattatgacgacgaacagttggggcttgacgaccaggacaatgtcgctaacagcggattcgaaattccatacgccatcttagggttctcggggcgggctttcaacaagctgaccttcaacctgacgatcaatgccgccaaaacgggagcctcgctgctgcaacaggcttgggtagacgtcaacctgaaagaccagctccgcttccgggtcggaaaattcaaaacgccgttcaatcaggcctatctggtcactttgggcgaaactctctttcctacccttcccacatcgctcaccacatcgctctacatggaccggagtatcaactcgacgccgcccacttttgctacgggattcgatctgggcgtcatgatgcacggtctgctcggcggcaaatgggaatacaacatcggcattttcaacgggaccggcatcgacgtcaatctggcgcaaaagaccctcagcgacgatctgggcatcccctctctgctctacgccggacgtatcgcctacatgccgaacggaccgattccgggacatcagggacgtatcgacgacctgcatagcgagaaactgatgttcgccctttcggcctcctacaatgtagaggccaactggcagacgaccaacgattttcgactcggattcgagttcacctacctcaaaaacagactctacctctcagctgaagcctactttctcaactccgattttgtcgaacgccaacgctccggtgcctattacaattacatcggcggatacgtccaagccggttatttcgtatcgaaaaagctccaacccgccgtacgctgggatttcctcgaccgaaactcactgggcatggacggattcctgaacatgccggccgtaggtctcaactactacatcatgggatacaaccttaagttacaggccatgtaccaatttcttggccgatggggtcacgcgacacaggacgatcgtgaactcgacgatttgggattggcccaacacggagccgttgtcatgatgcaattttcattttaa

SEQ ID NO: 1630 - DNA, 882 bp, Alistipes sp.
atggaaaacagcagcgatattctgaaacaggtgcgtcggatcgaaatcaagacgcgcggtctgagcaacgatgtctttgccggaaagtaccatagtgcgttcaagggacggggtatggcgttcagtgaagtgcgtgagtaccggatcggcgacgatgtgcgcgatatcgactggaacgttaccgcccgaagccgtaagccccatatcaagatttttgaagaggaacgggagttgaccatgatgctgttggtcgatgtgagcgggtcgagaatgttcggaacaacgtcgaagctcaagaaaaacatgattaccgagatcgcggcggtgttggctttttcggcagcccagaacaacgataaggtggggtgtatctttttcagcgatcgggtcgagaaatttatccctccgaaaaagggcaaggctcacgtgctgatgatcatcaaggagttgatcagctttaagcccgaaagcaacgggacgaatctctccgaagggttacgctatctgaccaatatcctcaaaaagcggtcgacagcttttatcctttccgactttatggacacggaggagggtaaaacacgtttcgaggatgcgatgaaaattgcttcgggaaaacacgatctggttgggattcggatctacgaccgacgggaggaggctttgcccgatgtgggagcgatccgcatgaaggatgccgaaaccggagaggaggtgtgggtcgatacggcttcccgggccgtacgcaatgcctatgcgcgtcattgggaacagaccaatgcgttgattgatacgtcgttgaaacggtgtcgtgtggacagtgtgatgattgctaccggagaggactatgtcgcttcgttgatcaaactctttaaacggcgttag

SEQ ID NO: 1631 - DNA, 1929 bp, Alistipes sp.
atgggaaagattattggtattgacttgggaacaacgaactcgtgtgtggccgttatggaaggtaacgagccggtcgttatccctaacagcgaaggtcgtagaacgactccttcgattgtagcattcgtagacaacaacgaacggaaagtgggtgatcctgcaaaacgtcaggcgatcaccaacccgaaaagaaccatcacctcgatcaaacgtttcatgggtgaaacctacgatcaggtgggtcaggatatcaaacgggctgcctatagcgtcgtacggggcgataacaataccccgagaatcgatatcgacggtcgtttgtatacgccgcaggagatctcggcaatcattctgcagaaaatgaagaaaacggctgaagattacctcggtaccgaagtgtcggaagcggtgatcaccgtgccggcttacttctccgattcacaacgtcaggccaccaaagaggccggtgaaatcgctggcttgaaagtccgccgtatcatcaacgaaccgacggccgctgctttggcttacggtttggataaggcaaacaaggatatgaagatcgccgtgtatgacttgggtggtggtacgttcgatatctccatcttggagttgggcgacggtgtcttcgaggtaaaatcgaccaacggtgatacccacctcggtggtgatgacttcgaccatgtgatcatcgactggatggccgatgagttccagaaagagcacaatgtcgatctgagaaaagacccgatggcactgcaacggttgaaagaggccgccgaaaaggccaaaatcgaactttcgagctcgacctctacagagatcaacctgccctacatcatgccggtggatggtattccacaacacttggtcatgacgctgacgcgggccaaattcgaacagttggccgacagcttgatccgggctacgattgagccttgtaagaaggccgttgccgatgcaggtttgacgaccagtcagatcgatgaggtgattttggtcggtggttctacccgtatcccggctatccagaaagtcgttgaagagttcttcggtaagaccccttcgaaaggagtgaaccccgatgaggtggttgctatcggtgccgcaattcaaggtggtgtgttgaccggtgaggtgaaagacgtcttgttgttggatgttaccccgctgtcgttgggtatcgaaacgctcggtggcgtattcacccggttgatcgatgctaacacgacgatcccgaccagaaagagcgaggtcttctcgactgcggctgataaccaaccctccgtggagattcacgtactgcaaggtgaacgtcagatggcacgtgacaacaaaacgatcggtcggttccatttggacggtatacctgccgctccgagaggtgtgccacagatcgaggttacgttcgatatcgacgcaaacggtatcttgaatgtatcggctaaggataaaggtaccgggaaagagcagaagatccgtatcgaggcctcttctggattgaccgaacaggagatccaacggatgcgtgacgaggcaaaagccaacgaagcgaaagataaggaggagcgtgaacgggtcgacaaggtcaacgctgccgacagcatgatattctcgaccgagaaacagctcaaggagtatggagacaagattcctgccgacaagaagagtgccatcgaggcggctctcggtaagctgaaagatgctcacaaagcgcaagacattgcgggtattgatgcagcaactgctgaattgaactcggcatggcaggcagcttcgcaggacatctacagcgcacaacagagtgcaggatcggctcaggctaatccgggtgctggtgccggtgcaacctcgggtagtgcaaatgccggtgcaggacagaacggttcggataatgtgaccgacgtagactttgaggaagtcaaataa

SEQ ID NO: 1632 - DNA, 1188 bp, Alistipes sp.
atgggaaaaactctttttgataaagtttgggatgcgcatgtcgttcgtcaactggacggcggccgcagcgtattatatatcgaccggcactacatccacgaggtgacctcgccggttgcttttctgggcctgaaaaacagagggatcaaggtagcacgcccgcaacagacaacgggaacacccgaccataacgtgccgacacaggatcaggacaagcccgtaaccgaagaacagagccgcaaacagctcgaatcgttcagcaaaaactgcgaggaaaacggaatcgaatacttcaaactgggaagtccgaaccacggcgttgtgcacatcgtaggtcccgaacagggcattacgcaaccgggcatgacgatcgtctgcggcgacagccacacctcgacccacggagccttcggtgccgtagctttcggtatcggaacctccgaagtggagatggtattcgcctcacagtgtattctccagcccaagcccaaaaccatgcggatcaccgtaaacggcaaacgggggaagggcgtaacggccaaggatattatcttgtatattatctcaaaaatatcggcttcgggcggaaccggacacttcatcgagtttgccggagaggccatccgcgacctgtcgatggaggagcgtatgacggtctgcaacatgagtatcgagtgtggggcccgcggcggtatcatcgcccccgaccaaactacgttcgactacatcaaaggccgtaaccgtgctccgaaaggcaccgacttcgacaaagctgtcgaaaaatggaaaactctcgcttctgatcccgatgcaaagttcgacaaggaatatacgttcgatgcggccgacattgaaccgatgatcacctatggaaccaatccgggtatgggtatcggcatcacgcaaacgatcccctcggatgaagggctcagcggtagcgacaaggtcagctttgccaaagcactcgcctacatggatttcaaaagcggtgagaagatgcttggcaaacgggtcgactatgtatttctgggaagttgcaccaacggacggatcgaagatttccgccagtttgcccaagcggtaaagggacgcaaaaaagcgcctcacgtaacggcttggttagttcccggctccaaaatggtggaggctcaggccaaagctgaaggcctcgacgtcattctcaaagag

SEQ ID NO: 1633 - DNA, 2868 bp, Alistipes sp.
atgaagaacacatttgtactgaagtcttttttgatagcctgtctgtgggtgctcgggagtttttccgtattcggacagagcaaaatcgatgtcaagggaaaggtgatcgatcagtcgaccggtgatccgatcatcggagccgtggtggaatacgtggccagtgagggaggtcagaaacgttatgtatcttccgataagacgggagccttcacgttgccgtcgctctctgccgggacctatgatcttcgcattacctatctcggcatgaaaccctatacggcgagtgtcgagatttcgaagaagaattcggatttggggaccatcgccatggagatcgacgtgaaggagatcagcgaggtggttgtcgagggaataaccatgcggacgacgcaaaaaggcgatacgttagtctataatgcaggagctttcaaggtggctcaggacgcgacgaccgaacagttgctctcgaaaatgccgggtataaaggtcgatggaggtgccgtagaggcccaaggcgaggaggtgaagaagctgttgatagacggaaaggagttcttcggcgatgatgtgacgacggcgatccgtaacctgcctgctgaagtgatcgataagatcgaggttctggataagcagagtgatcaggccgagttcagtggagtcgatgatggcgagagctacaaggcaatcaatgtggtgacacacggagggattgaccatgctcagtttggccgtttttatgccggttacggattcaatgacctgtataacgtcagtgcgagtttgaacctctttaaggagaatcgtcgtttgaccctgttgggaatggcaaacaacgttaaccagcagaatttcggtatcgatgacctgatgggggtgattggctccggcggacgacgtagaggtggtgccggaggaatgatggtcggtaatcagagcggggtttcgacggtgcaatcctttggtgtcaactatgccaatcaatggcttgatgagaagatccgcgttgaggccagctatctgttcaactcctcacagaatattaccgaatcattgaccgaaagggagtatttctcgcaacagttctacgatgatcgggcacgggatgattcaaagaactttaaccacagaatcaacggacgggtcgaatataaaatcgacagcaacaatacgatcatgttccgcccgacgcttcgttttcagacaaacaatgcgttcagttccgatacgtcatcgacctcaatgacgagcggagtggaaaatgctttgctgaatgtgttcaggagtacgaatgatgcggacgccttcggatacaatctttcgggaagtttgatctatatgcacaaattcgggggccgcgacggtcgggtcttgatgatgtctgtcgatggaggtctgtcgaagaacgatcaggacaatacgcagtactccctgacccggtatttgaatcccgattcgacctcactgttgaatcagtatattatgaaccactcgagcggctacaacgtgagcggtagaatctcctattcggaaccgatttcggatcgtgtacagttgctggccaattaccagatttcgtacaactactccgatcgcgacaaacgctcatacgaactgccgggcgatctctttctggatagtttgtccaatacctacaacagcggttatctgatccatcgagtgggtcccggattgaggtatcacaccgaaaagaccatgttcgttaccaatatcaattaccaacgttcgaccttgacgggcgatcaggtcttccctacttcggccaaggatcagatggatgcctcgttcaacaacgtggtctacatggcgatgcttcagatgcggttcaatccgagcaatatgttgcggatccggatgaattcgagaacgagcaatccatcggtcacccagttgcagaatgttctggatgtttccaatccgttgttcatatcgcagggtaaccctcacttgcagccggtttactcgaacaacatgaatatccattaccgacgtgtcaatgtgcagaaagggcggacgttcatggtgatgttgaacggctcgacccagagcaactatatagccaactccgtggaacgggcatcggccaacggttacgaggtgaaagatgatgccgggaatacgattgtcacgttggatcagggtgcgcaatactcacgtccggtcaatctggatggatattggaacgtatcgggaggggtcagttacggtttgccggtaaaatggctgatgagtaacatgaatttcgatgcacgggtctcttataacgcgacaccgacgatctataatctggtgcgcagtacgaccacgacgacctcctataccgggggaatttcgatcggaagcaacatcgacaaactcgacttttcgttctcctataacgccgggtacaacatagcccattcgacctcaaacaacgagtatttcaacggagtgggaaccggccgtatcgtttgggagacgtggaaagggattacgcttcgggccaacggtagttatatgaaatatcgcggtgtgaccgacaagtttaccgaggagtattttctgctcaatgccagcatcggaaagaaacttttcaagaatcagcggggtgagatcaacgttcaggtcaacgacattctgaatcagaataaaagcttctcgcggattgtcagcgaaaactatattcagaacgtgacatccaatgtcttgggccgctacgtttgtatcagctttgtgtacaatctgaaaaacttcaagggtaaggatggcaaaacctacagtcagccgccggcagggagtgatttccggtcgagaccacctcacgggggaggtcctgccggcccacctccgggaggcccaagacccttctaa

SEQ ID NO: 1634 - DNA, 1872 bp, Alistipes sp.
atgagattcgaatacaatatcatcgtcatcggaggaggccatgcaggatgtgaggcggcagcagcggcagccaatatgggatgccagaccctgctgatcacaatggacatgaccaaatttgcgcagatgtcctgcaatccagccgttggaggtgtggccaaaggacagatcgtgcgcgagatcgatgcgatgggcggatatatgggaatcgtcaccgaccggacaacgctgcaattccgcatgctgaaccgatcgaaaggtccggccatgtggagtccccgagcgcagtgcgataaggccaaattttcggccgaatggcgccgtatgctcgaaaatacacccaacctctatctttggcaggatgccgtggtcgacctgagcgtcgaggagggaaaaatccggagcgttacaacccgtatgggtgttgttttcgaagcgaaggccgtcatcctgactgccggaaccttcttagagggtctgatgcacatcggacgcacacacgcatccggaggacgtgcaggagacgcagcatcgcacggattaagcgctcgtctggccgaattgggattcgaagtcggacgcatgaagaccggaacacccgcacgtctcgatgctcgtacgatcgatttttcacaactcgaggaacaacccggagacgaacacccgtgtaaattttcattttcacctgatacagaagtagttaaacatcagaaaaggtgttatttggtctacacctcaaaagaggttcacgacattctccgcagcggttttgccgattccccccttttcaatggtaccattaagggtataggtccccgctactgccccagcatcgaggacaaacttcggacctttgctggcaaggagagtcatcagctctttctggaacccgaaggtgccgatacgaacgaatactatctgaacgggttctcctcctcgctgccttgggacatacaggtggccgcacttcaaaagatcaagggcttcgaaaatgtgcaaatttatcgtccgggctacgccatcgaatacgactattttccgccgactcagctctatcacaccttggagaccaagctgatcgagggactctactttgcagggcaggttaacggcaccacaggatacgaagaagctggttcacagggacttatggcaggaatcaacgccgttctgaaaatacgcggcgaagaaccgttagttttacgtcgtgatgaatcctatatcggtgtactgattgacgatctggtaactaaaggagtcgacgaaccctaccggatgtttaccagccgggcagaatatcggattttgctccggcaggataatgccgatctgcgcttgacccctatcggatacaaagtcggcttggcagacgaaagaaggtatgcgcgaaccatgcgaaagaaggagcttgtcgagtcgcttattgcctttgttcggcaatacagcgtttcgccacaggagatagccgattatctgaaatctgtagaatcaacaccgctcacacagggtaaaaagttatacgatgttatactgagaaacaaagtaacgattgagggattgattgacaacatttcggcgctgagggacttcattgagcgtcaggagtgcacgcatgaggtgattgaggaggctgagatacagataaaataccacggatacattgagcgagagcgacacattgccgacaagatgacacggttggagaacatacggatcaggccggacttcaattacaatgagttgaagtcgttatcgattgagtcgcggcagaagttgacacgcatcaggccatcgacgattggtcaagcctcacggataccgggggtgagtccgtcggacatcaacgtgttgttggtatattttggccggtag

SEQ ID NO: 1635 - DNA, 2172 bp, Alistipes sp.
atgaaaacaggacacaaactctgtattgctgcgctgcttttgacctgttcgacagggttcgtacagtgggacaaagggttgcgcgaacgattcaagacgccgggtctcgagtatcgaatgaatgtcaaccggcacagcatgccccacgacgaacgggctcaggactccatgatccagtgggtaatctccaacggctacggcggtatggccaccaatgtcaatccgaacgactacctcaaaagcgaggaggagttcaaggtgttcaaccgcttcgtccacgccgcaaagaaacgggggctcgacctgtggctctacgacgagaagctctacccttcggggatggccgacacctatgttctggacgaacatcccgaatgggaagccgaaggtctgctctttaaggacacgactgtcgtcggaggacaaaacattcagctgaatccgctgccgggctcacgggtgttgacccaagccgtacccgtaaaggaaggtgctctatgttacgatgaagcgatggaccttacgccccacctcaccggtgacaccctccgatggagcgtcccggaaggccaatgggtgatcgcacaggtctcccgatcgacgctttacaccggctttcaggccggaacggagcgcggcggtgtcgtaccccgctaccccagcctgctgatgcccgaggtaaccaaacgtttcatcgaactgacccataaacaatatgcggcccacttcaacgaaaagctcgggacgctctttacttcgacctttaccgacgaaccctcttcgatggccctccccttcccgaatctcggatatggagtctacccatggaaagaggtggtctccgaactgttcgaagagcgctatggggtcgcactgaacgatgtactgctcccgatgatgctggacgaaggagccgaagggcaacaactccgctatcaatacttcaagatcatcgccgactgcatgagtctgaactacttcaaacaggtcagagagtattgcgcctctcaaaaactcctttcaggcggacacctgctggtcgaggagtcgatgatggcacacgtaccgctctatggagacatcatggcctgctatcgggagatggatattcccggtattgacgtactgacgggcatgccgagttttaccagacgctatttgtactcgtcgcgtttggcctcatcagccgccgaactcaacggacatacgagggtgatgaccgaatcgtgccccatctcggactataacttctacaacgggaaggaagccccctcggttgagatcaaaggaaccctgaaccgacagatggtcggaggcgttaccgactttaacaactatctggagttgcaacacgaggattcaaccggccgtaaagccttcaacgactacattgcacgggttgccatgatgatctccgacggggtcagggcctcccgcatcgccgtctactatccgatcgaaacgttatggaccaaataccgtccattggccaccggtctgcaaagctgggacaacgtagccggaggcgatccgaaagcccagcaactttccgctctgttcgaccgggtgagcgactgtctttacgacaacggatgggaattctcctacatcgataccaagggactcgagcaggccaaactcgacaaaacctctctggcccacaacaacctgaaatgggatgttctgattcttccgggtgtcgagacattgtcgcaacaagccatggagcggctcgtggagttcgcacaagccggaggaaacatcatcatgctcgaggctctgccgaaaaacacaccggacgaatttccctccccgttctgcgaatccaaagtcaagggaatgctcgaaaacaagacggtctatccggcagtctacttcgaggagacgttcgatgccaagattcttaacctgctgttggaaggacttttggaccgagacatcattctgaacgactacacaggaattctgcatagccaccggagggtcggttcgaaggagatctacttcatcgtcaacgacacgaatgcaccgaaaagcgtcaaagcagaatttccgtttgccaaaacattagagtgctggaatcctcaaaccggagacattcaaaacattcaacccgaaaccacgctcacctttggcccatacgaaggactgatcatccgacaagtaaaataa

SEQ ID NO: 1636 - DNA, 651 bp, Alistipes sp.
atggagcgcaaaaatcgcaagatttactatacgatgggtgaagtttcggagatgttcgatgtccgaccttcgctgattcggttttgggaacagaagttcgacattctcaagcccgacaagaatcggaaagggaaccgactattcaccccgaaggatgtcgaaaacctgaagctgatctaccatttagtcaaggagaacggaatgaccctcgccggtgcggccaaacggctccgtgaaaacaaaaagggagaggaacgcgatttggaggtgatcgaaaagttacagggcatccgttcgctgctgctcgaggtccgagaggagctcaaaacaaagggagaagaggctgtatttgtcgatgaacctctttcggaagaggaggaggagcgtatcccctccattgaagaagccgaaacaccgacttccaatccacaagagaggtttcaacccgtgccgcacgacgacgaagtgattccgatcggtccggccgttccgcgatttctgcaacgcgagatcccgatcccgccccaacccacgatcgtacgtcccctctacgaagagcttccagacaacgagacctctgatcaagacgagtccaaagaggatgaacccactcctccacgccctacgattatcgagcaatctctcttttaa

SEQ ID NO: 1637 - DNA, 2280 bp, Alistipes sp.
atggggaataacgcaaaaagcaagaaggaagaggcgcttctctaccattcggaggggcggcccggaaaaatagaggtcgttccgaccaaaccgtacagtacgcagaaggatctgtcgttggcctattctcccggagtggccgaaccgtgtttggctattaaggagaatccggacgatgcgtataagtatacggcaaagggaaacttggtggccgtgatctcgaatggtacggcggtgctcggactcggggatatcggagcgatggccggtaaaccggtgatggaagggaaaggcctgctttttaaaacgtttgccgatatcgatgtgttcgatatagaggtcaatacgaaggatacggagcagtttatcgagacggtaaaaaatatatcggtaacgttcggcggaatcaatctcgaggatattaaggccccggagtgttttgttatcgaagatcgactgaaggaggagctttcgattccggtcatgcacgacgatcagcacggcacggcgatcatctcttcggcagcgttgctgaacgcgctggagattgcagggaagaagatcgatgaggttaaggtggtcgtgaatggggccggagctgctgccgtctcttgtgcaaggctgtacatgtcgttgggggtcaaacccgagaacgtggtgatgtgcgatagtaaaggagtgatctctgtacgccgtaaagatttgaatccgatcaagagtaagtttgctacgactcgggaggtcaatacgttggctgaggcattggtcggtgcggatgtctttctcggactttcggtggccaatgtgctgagtcaggagatggtacgcagtatggcagacaatccgatcgtgtttgcattggccaaccctaatccggagatctcctataccgatgcgatggctgcccgtaaggatattatctttgcaacgggacgttccgattatccgaatcaggtgaacaacgtgttgggatttccatacattttccggggagcgcttgatgtgcgggcgactacgatcaacgaagagatgaagattgcggccgtgaaagcccttgccgcattgaccaaagagccggtgcccgatattgtggcagcagcctataatgataataatatctctttcggccgggactatctgatcccgaaggcgctggatccgaggttgatctcgaccatttcggtggcggtggccaaggcggctatcgattcgggtgtcgcgcgcaagacgattaccgactggaaggcatacgccgaagagctggatggacgtatgggtcgtgacgataagctgatgcgggcgatccgttcgaaggtcaagacggccgaaccacgccggattgtattcagcgaaggtgaccggttgaccacgatcaaagcggcgatccatttgatcaacgataatctggctattcccattttggtgggcgatgcaaagaagattgcctctattttggaggagaaccatctgaatctcgatatgaaatatgtggtcgatttcagaagcgatgccgaagagggacgtcgtcgggattacgccatgcagctctataataaggtgagccgtaagggtgtacggatgaatgaagcggtcgaatacatgatgcatcgggattggttctcgttgatgatggtggccgcaggagatgccgatacgtcgattctcggatatgcacaccactatatcgagtcgctgaaacccgttcgacagatctttacgacgaacagcaataccactttggcagcgatgcagatcgtgacgaccaaaaagggaccgatgttttttgccgatatggcagtcaatccgagtccgtcggtcgaagatctggtcaatattgccctgatgacggcgcggaccgtacggagtttcggtatcgaaccggtgatcggcatgttgtcgcattcgaacttcggtacaagtaccgagccgttggcgacgaaagtggccaaagccgtggagattctgcacttccagtaccccgaattactcgtggacggtgagatgaaggccgatattgcgctgaacaaaaaggcccggaacgaattctatccgttcaacaaactgggcgatcgagacatcaatgtactgatcttcccgaacctgtcgtcagccaacatctcatataagatgatggagattctgggtggggccgagatcaacggtccgattttgatggggttgaaccatccgtacgtacatttgattccggaggttgcctcgtcgcgttcgattcgcaatctgagtgtgattgctgcggccgtaacgatcccgaccaaataa

SEQ ID NO: 1638 - DNA, 1269 bp, Alistipes sp.
atgatgcaaagtatcgttgtcgttgtcatagtcgtagtggtcgcactgaccctatcggcctttttttcgggtatggagatcgcttttctgtcagccaacaagctgaagctcgaaatcgaacgcaaaaaaaatccgctgttcggattcattgccgggatcttttcgaaatatccgggacagtatatcacgaccattctggtcggcaacaacatcgctctggtcgtctactcgttacagatgagcgtactgatccagtttctgttgagcaagtgcggactctccgtcagcgacggtacctcctacctgatcgaaaccctgatctctaccgtcatcatcatcttcacggccgagtttctccccaaagccatcgtccgcttggatccaaacttctactaccgcaatttcgccgttccggtctactttttctacctgctgttctacccgatcgctcgtctgacgaccctcatctcgttgggcgttttccgactgttgggatttccggtaagaaaaaaacgcaacgtcggttcgttcgaccggaccgatctggccctgctgatcgacaaagcctccgaaaaccgggagcaacaaaacgaaaaggacattcgtctgttccagaacgcattggacttctccgaacggttcgttcgcgattgcatgaccccccgtgtcgacatcgaagccatcgaccggaactgttcggtcgaggaggcacgccaacgcttcgtcgacacacaattctcgaggcttctggtctatgacggcaacatcgatcacgtcatcggcttcatccacaacaaaagtctgctgcaatatccccaaaccatcctcgacgtgctgaaaaaggtcgaatatgtccccgaaagcatgccgacccgcaggttgctctccatctttatcaaaaaacaccactcggtggccgtcgtcatcgacgagttcggcggaacggccggaatggttaccatagaggatattctggaggagatcttcggagagatcgaagacgaacacgactctcaagagctggtcgaaaagaagatcaacgaccgcgaattcctcttctcgggacgtctcgaaattgaggcaatcaacgaaaaatacggcatcggtctccccgaaagcgacgattacgatacactggccggatatgtcatatcggtctatcaagggattccggaagcgggagaaaccatcatgaccgaccgcatgcgcatccgtattctgcgcaccgatgcttcaaaaattgaattggtccgcataactttgatttaa

SEQ ID NO: 1639 - DNA, 1194 bp, Alistipes sp.
atggtcagtataggaacggtgttttctccgatcgggaaaaaagcgctgttgtgcggatcgggagaactgggcaaagaggtggcaattgaattgcaacggtacggaatcgaggttgtggccttggatcgttatccgaatgcccctgccatgcaggtagcgcatcgatcgtatgtggtttcgatgctcgatggggcgaagctgcgggagattatcgaacgggagcatcccgattatattattcccgaaatcgaggctatcgcgaccgatgtgttggtggatctcgaaaaagaggggtaccacgtggtacctacggctcgagcagcacagctgaccatgaaccgggagggtatccgtcggctggctgccgaaacgctcgggttacctacttccccatactgttttgctgcgacgcgggaggagttcgaacaagcggttcggaagatcggatttccgtgtgtgacgaagccgatcatgagttcgtcgggacatggacagagcgttttgcgttcaccggaggatgtcgatcgggcatggcacctgacgcaagagggaggccgggccggagccggtaaggtgattgtcgaggggtttgtgaagttcgactatgaaattacgctgctgaccgtgcgtcattgtggcggaacgtcatttttggagccgatcggacactatcagcaggatggtgattaccgggagtcgtggcaaccgcaaccgatgcaaccctcggtccgcaaacaggcggaggagatcgcccggaaaattaccgatgcactcgggggatacggaatcttcggtgtagaacttttcgtacagggcgatcgggttctgttcagcgaggtgtcgccacggcctcatgataccggtatggtgacgatgatttcgcaggatttatcggagtttgccctgcacgtacgggctattttgggactgccgataccgaacatcgcttttcacggaccgtcggcttcgcgtgccgttgtggtcgagggggatacgaaccgggtcgaactggccaatctcgaggaggtgcttgccgaacccgatacacagatccgtatcttcggaaagtcggaggtcgaagggcatcgtcgtatggcggttttgttggcccgaggtgccagcatcgaggaagcgcgtaaaaagacggcccgtgcctatgtcaagttgaaaattaatctcttcgagcgagaatag

SEQ ID NO: 1640 - DNA, 1068 bp, Alistipes sp.
atgaaaatagcttggaaagagtatcagaaagatatagcggatgataactacttctatgcacggagttgcatccggcagaatttttttccgggatcggaggctgcgtttctgaatatcctgcgacaggatctggggcgcgacgtatatgaagatccgcgtcatacctcttgtacgggaatcggctaccacagcgacatcgttccgttagagacgatcatgaccgtcgtggcccgtcagttttcgctgatgacggaggcggggtatgagaatttcgtcccttcgtgcatcacctcgtttgggatctattcagaggcgctcgagctgtggcacgactttccggaacttgaggagaaggcgcatgaatacctctataaggcgaccggacgtgacttcaaaaagccgaaaaatctggcccacacgtccgacgtgatttttcaccatcgggaagagattgccgccaaggcgaagcggaaattggtgaatgtcgctacgggacgtccgttgcgcggggtcgagcacatcggttgtcactacgccaagatatttccgaaggcgggagtcggtggttcggagttcccctacgtgctggccggcatgatcgaggcgtggggtggcgaggtggtcgattatcccgaacgtcgccactgttgtggattcggcttccggaactatctggttatggccaatcggggctattcgatcgccaactcgaaacagaagttcgagtcgatggctccttataaacccgattttatcgtggcgaattgtccggggtgcgccatgtttctcgataaatggcagtatgcgatctcggagatggaggggacgttttacggtcccgaccggcagggaattcccgtgctgacgtacgaagagctggccggattggtgctcggatacgatccgtgggatttgggcatgcagatgcatcaggtggccgtagaacccctgctggataaactgggcgtagagtacgatccgtcggcgaagtatttgggcaaagacggcaagtttatcggaaagcccgaagagtgtgctatcggaagttacacaaaaaatatactgtaa

SEQ ID NO: 1641 - DNA, 4527 bp, Alistipes sp.
atgaaaaaaagaaacaacggattgggtttgccccgacagcagggtctttacgatccgaacaatgaacatgatgcctgtggtgttggtttggttgtaaacatcaagggaaagaagagccacgacattgtggaaaatggtcttcaggtgctcgagcacatgatgcaccgaggagcagaaggtgcggataataaaaccggagatggagccggtatcatggttcagattccgcacgaatttattcttttacagggtattccggttccggaaaagggacattacggtacgggactggtctttttgccgcgcgatttggcagatcagacaaccgcactgggaatcattaaacggaatgtacagacggccggattgaacttgatgtatgtccgcgatgtgccggtcaataatgaggtgatcggagaagcggcacgaaatacagagcctgtgatcaaacagcttttcataactggagatccgggcaatatgactttagagcagaagctctatgtcgtacggaaaaagatcgaaaaagaggttgcccagagcgatatgtccgacaaggattcgttctatgtggtcagcctctcttgtcgtacattggtatataagggaatgctctcctccgtacagctgaggtattatttccctgatctgatcaacccctattttacgagcggactggcattggttcactctcgtttctcgaccaataccttcccgacatggagtttggcacagcctttccggatgttgggccataatggcgagatcaatacgatccgaggtaaccggagctggatggagagccgcgaaagtgtgcttcatcccgatgagttgggcccgatcgaggagttgagaccgatcgtacagccgggaatgagcgacagtgcctcgctcgataatgtgctggagtttttcgtacgcagcggtatgagtcttccacacgctttggccatgttggtgccggaaagctacaacgacaaaaacccgatctcttcggagctgaaatcgttttacgagtaccacagtatctttatggagccgtgggacggtcccgcaacgttgctcttttccgatggacgttatgcgggcggtatgctcgaccggaacggtttgcgtccagcccgttactttattacgaccgacgatatgatggtcgttgcttcagaaaccggaacccttgcagtagagtcttccgaaatccgtgagaaaggacggttgcgtcccggaaagattttgatgatcgataccgaaaagggtgagattcaatacgatcccgagatcaaggagcgtctggcttcggagcatccctataaagagtggttgagcaagaatcgggttattttgaatcagattacctccggccgtcatgtaaaacattcggtagacgagtacgacagaatgctccgtgcgttcgggtacaataaggaggacatagagaaaattatcaagccgatgggagagaacggagccgagccactcggttcgatgggaaacgatacgccgttggctgtcctgtcgaaaaagccccagcggttgttcaactatttccgtcaacagtttgctcaggtgaccaacccgccgatcgacccgatccgcgaggagttggtgatgtcgatcgcaagttatatcggtgcggtagacggaaacattttgcacccgtcggccgaacactgtaaagtagtgaaactgcccagtccgattctgaccaatacggagttggatattctgaataacctgcaatacaagggatttcggacaaggaccctgccgatgttgtttgaagctaagggaggagcgcgcggattggcgaaagcggtggatcgcttgtgtgaaacggcagaaaaggcggtcgatgacgggatcaattatgttattttgagcgatcggggggttgatgcggaacatgcaccgattccctctctgcttgcgctgtcggctgtacaccactacctgaccggtaagcggaaacgtgcccagattgccctgatcgtggagacggctgaggcccgcgaggtgatgcacatggccctgctgatcggattcggtgcgagtgccgtcaatccgtatatggcttttgccgtactgaatcgtctggtggagaagggggatatacagctcgattacgaaaccgccgaaaagcattacatcaaggctctgaacaagggtctgttgaagatcatctccaagatgggtatttcgacgatccgaagctaccgtggtgcgaagatcttcgaggcggtgggtctttcgaatgccctgctcgaccgttatttccacggcatgacttcgaaaatcgagggcgccgatctggatgatattgcggctgatacgctgaaggcccatgcacacggtttcggtgaagattttgatgatacggagttgctcgaaaacttcggtaattattcctatcgtaaggatggcgagcagcacgcatggaatccggaaaccatatcgaccttgcaactggctacccgtttgggcagttacaagaagttcaaggagtacacccgtttggtgaacgagaagtcgtctccgatgttcctgcgtgatctgatggagttgaaaaagaatccgatcgatatctcgaaagtagagccggcttcggagattatgaagcgtttcgtaacgggagccatgtcgttcggttcacttagccgcgaggcccacgaagcgttggccatggcgatgaataagatcggaggcaaaagtaacacgggagagggtggcgaagacccggaacgttatcatccgcatgctgatggcacctcggcccgaagtgcgatcaaacaggtggcttctgcccggttcggggtgaatgccgaatatttggtcaatgccgatgagattcagattaaggtggcacagggagccaagcccggtgagggcggacagctgcccggatacaaggtggatgagatgattgccaagacgcgtcattcgattcccggtatttcgctgatctctccgccacctcatcacgatatctattcgatcgaggatttggctcagttgatcttcgatcttaagaatgtcaatccgaaagcccggatcagcgtgaagttggtttcggagagcggtatcggtacgattgctgccggtgtggccaaggccaaggccgacatgatcctgatcagtggtggtgaaggtggtacgggcgcaagcccggtcagctcggtgaaacatgccggactgccgaccgagattggtctttccgatgtacagcagacgttggtgatcaatggattgcggggtaaggtgacccttcagaccgacggtcagctgaaaacaggacgtgatatcgttatcgcagccatgctcggagccgaagagttcggatttgcgaccagtgcgttgattgttctgggctgcgtgatgatgcgtaagtgccacatgaatacctgtccggtcggagtggcgacgcaggacgaacgtctgcgtgaacacttccgtggccgctacgaatatctggtgaacttcttcaacttccttgctgaggatgtacgcgagaatctggcagaactcggattcacccgtctggatgacatcatcggacggaccgacctgatccaacagcgtaagttcgctcccggaacgaagatttcgaaggtcgatctttcgcggatcctttatcgtccggccaatgtcgatacggaggatgtacggcgtacgaccgcacaggatcacaagatcgaaaaggtcaaggaccgttcgattatcggtatggctacgccggcaatcgagtcgaagatgccggttcatctgaacttcccgatctgcaatacggaccgttctgtgggagcgatgctgtcgggacggattactgcaaaatacggaaacgaagcacttccggaagatacggtcagcgtaaccttcaagggttcggccggccagagcttcggagcattcctctgtcacggagtcacattccgattggaaggcgatgccaacgactatttgggcaagggcctttccggtggtaagatcattgtgacgccgcctaaaaattcgatcttcctgccgcaggacaacatcattgcgggcaacacgctgttgtacggcgcaaccgaaggagaggtctatatcaacggtcaagtcggcgaacgcttctgcgtgcgaaacagcggtgcaacggcggttgtcgaaggggtcggtgaccactgctgtgaatatatgaccggcggacgtacggtcgtattgggtacgaccggccggaactttgcagccggtatgagcggtggtgtcgcttatgtgtggaacaagttgggcaatttcgatttcttctgtaacatggagatggtcgagctctctttggtcgaggagtcgatcgacgcgaaagagctgcacgccctgatcagtgcccactattaccatacgggcagtccgttggccaagaccatgatcgacaattggggcgaatacgtcggacagttcattaaggtgatgccgatcgagtacaagaaggtgctgcacgcacaacgaatggctgcactcgaacagaaaatcgcccaagtggaacgtgattattaa

SEQ ID NO: 1642 - DNA, 1101 bp, Alistipes sp.
atgttattgaatacctatacagacagtctggatttcaatgcgctgacccaatggatcgatcaagcactgagcagtgtgatgccggcgtggggcgttgtcctgaccgaatgcatcttgatcggtttgtgcctgttgttggggtatgcactgattgcgctggcactgatctatgtcgaacgtaaggtctgcgcctttttccagtgtcgtctcggtcccaaccgtgtcggaccctacggtacggtacagagtattgccgatatggtcaagatgttgatcaaggagttgattacgatcgatcgggtcgatcgcttcctgttcaatctcgccccctatatcgtgattatctcgtcggtgctggcgttcggatgtctaccctttgccaaaggactcgaggtgctcgatttcaatgtgggaatcttcttcctgatggccgtttcgtcgatcggcgttgtcggaatcttgctggccggctggtcgagtaacaacaagtattcgttgatcggagccatgcgaagcggtgcccagatgatcagttatgaactttcggtgggattgtcgctcatgacgatggtcgtattggctggaacgatgcagctctccgaaatcgtcgaacgtcaggccgattgctggttcctcttctcggggcacattcctgccgtgatcgccttccttgtctatttggttgcgggtacggcggagaccaaccggggaccgttcgaccttcccgaggccgactcggagttgacggccggttatcacaccgagtattcgggtatgcacttcggatttttctacttggcggagtatctgaatctgtttatcgttgccggaatcgctgcgacgatgttcctcggaggttggatgccgttgcatatcgccggttgggacggattcaatgccgtgatggactacattccatcgttggtgtggttcctgattaaggtcgcagtgatcatcttcatcatcatgtggttcaagtggaccttcccccgtctgagaatcgaccagctgttgaaactcgaatggaaatatttgttgccgatcaacttgctgaatctgttgttgatggtgatcatcgtcgtaaccggattgcatttttaa

SEQ ID NO: 1643 - DNA, 2157 bp, Alistipes sp.
atgagaacctatgcaactaacgagatcaaaaacgttgtgctgctcggggcgtccggctccgggaagaccacactggccgaagcgatggctttcgatggaaaggtgatcgaccggagaggcactatcgaatcagaaaataccctgtcggattataccgaagtggagcatctttacaaacgttcgatctacacgacgattctgtttgccgaatacaacggcagaaaactgaatatcttcgacacgcccggatcggacgatttttgtggcggtctgttttcggccttcaaagtggccgacgtgggagtcatgctgctcaatgcgcaaaacggtttcgaggtgggaaccgaaattcaggcccgctatgcccgcaaacatgagaagccgatcatcgccgtgatcaatcagctcgatagcgaaaaggcttcgtgggagaatacgctcgagtctctgcgggcggcctcgcaggtgaaacccgtgatcgtgcagtatccggtgaatcccggtccggacttcgatgcattcatcgacgtgttgctgatgaagatgtataaattcaaaggagatacgggtattcgtgaagagttggagatccccgaatcggagatggagcgggcccgagagttgaaccaaatcctgacggaagctgcagctgaaaatgacgaatcgttgatggagctctatttcgacaagggggttttgacgcaggacgaaatgcgtaaagggttgaagttcggattggcaaaacgcgatctgattccggtgttctgtgcctccggaaagcgggatatcggtgccaaacgactgatggagtttattatcaatgtggcccccggtccgctggaggctcccgcctttaagacggtcgatggaaaggaggtgcttgctgacagttcggctcctacttcgttgttcgtattccgcagcagcgtagaacctcatcttggcgagatgacctatttccgcgttgtgtcgggtaaggtgaccgaaggaatggagctgatcaatacgaagaccggaaacaaagagaaaatttcgcagctgtttgccgttgcaggtaagggacgcgtcaaggtgaccgagatggaggccggcgatatcggatgtacagtcaagctcaagggtacgaagaccaaccagacattggctgctccgggattcgacgtcgagtatgagccgatccgcttccccgatcctcgctatcgtgcggcagttcggtcgctcaagacgggggaggatgaaaaactcggtgagttgctcaatcgggcgcacttcgaggatccgacgattctggtcgaatattcgaaagagttgaaacagaccattctgcagggtcagggcgaacaccatctgaatattctcaagtggcagctcgccaaccagaacaagatcgatgtggagtacttcgcaccgaagattccctatcgggagaccattaccaaagtggctgcggccgattatcgtcacaagaaacagtcgggtggagccggacaattcggagaggtctggctggtgattgagccctatacggagggtatgcccgagcccagcaagtataagatagacggtcgcgatttgatggtcaacatcaaaagcaaagaggaggtcgatcttccgtggggcggcaagctcgtattttacagcgcgattgtcggaggtgcgatcgatgcacgtttcctcccggcgattatgaagggtatcatggagaagatggaggagggtccgttgaccggatcctatgcccgggatattcgcgtggttgtctacgacggcaagatgcatccggtggattccaacgaactctcctttaagctggccggtcgtaatgctttcaaggaggccttccgtaaggctggaccgaagatcatggagccgatttacagcgttgaggtgctggttccgtcggacaagatgggcgatgtgatgagcgatctgcagaatcgccgggcgatgatcgagggtatgagcagcgagaaaggtttcgaaaggctcgttgcacgggtacccttggccgagatgtatcgttattcaacgacgctcagttcgttgacgaacggtcgggctacctactcgatgcaattcgcatcctacgagcaggtgccttcggatgttcaggagaagctcttgaaggcatatgcagatacggataaagacgaatag

SEQ ID NO: 1644 - DNA, 813 bp, Alistipes sp.
atgagagtcattatcgaaccgaacggcgaacaggtctctgcatgggccgccgcctacatcgtaaaacggatcaacgaacacaacagccgcgagactcgcccgttcgtattgggtctgcctacgggttccactccgctgggcacctacaaggcactgatcgaatataacaaagccgggaaagtatcgttcgccaatgtcgtcacgttcaacatggacgagtatgtcggcatcccgaaagatcacccggaaagctatcattcgttcatgtggaacaacctgttcagccacatcgacatcaaacccgaaaatgtccacattctgaacggaaatgctccggatctgtgcaaggagtgtgcagattacgaagctaagatcgcagcggtcggaggcatcgacctgttcatgggaggaatcggccccgacggacacttggcgttcaacgagcccttctcgtccctcaactcgaagacccgggttaaatccctgacgaaagatacgatcatcgccaactcacgcttcttcgggggcgatgtaaatctggttccgaaaacggccttgacggtgggagtcggtacggttatggccgcccgcgaagtgatgatcctcacgatgggacacaacaaggcccgcgcactggctgccggtgtcgaaggcgcctacaaccatcagtggacaatcagtgccctgcagatccacccgaaaggaatcatcgtctgcgacgaagatgccaccgatgaactgaaggtaggaacctacaaatactttaaagatatcgaatcggagaatctcgatccggcatcgctgctgaaatag

SEQ ID NO: 1645 - DNA, 2037 bp, Alistipes sp.
atggattttaaattggtatcggaatatagcccgacgggagatcaaccggaggcgatcgagcagttggtgtcggcactgaagagcggttgccggcacaatacgttgctcggggtcacgggttcgggcaagacctttacgatggccaacgtcattgcggcattgaacaagccgacgcttgtgatgagccacaacaagacgttggctgcccagttgtacggcgagttcaaaaacttctttccggagaatgccgttgaatattttgtctcttattatgactattatcagcccgaagcctacattccgacgaccgatacctatatcgaaaaagacctttcgatcaatgaagggatcgagaagatgcggctcagtgcaacatcggctctgctgagcgggcgcaacgacatcgtggtagtgtcgagcgtttcgtgtatctacggcatcggcaacccggaggatttccatgcaacttcagtcgagctgaaggtgggcgatatcatcagccgcaacaagttgctgtatgcgctggtcgatgcactttacacacggagtgaggccgatttccgtccggctacgtttcgcgtacagggcgatacggtcgatatatttgccgcttacggggagaagtgttaccgggtcgtcttcttcgacaacgagatcgagatgatctatacgatcgatccggtgacgggacagcgactcgagactcaggaacgggtggtcatctatccggccaatctgtttgtgactacgcgggagcgggtcgagcaggccattcggatgattcaactcgatctgggcaaacagtgcgaatacttcgaatcgatcggaaaaccggccgaagcccgaagactcaaacaacgggtcgagtatgatctcgaaatgatcaaggagttggggtattgtcccgggattgagaactattcgcgctacttcgacggacgttcgcccggaagtcgcccattctgtctgatcgattattttccgaaggactatctgctgatcatcgacgagagccacgtgaccgtaccgcagattcgcggcatgtatggcggagatcactcccgaaagaccaatttggttgagtatgggtatcgtcttcccgcagcgctcgataaccgtccgttgaagttcggggagttcgaagcgctcgaaaatcaggtgatttatgtcagtgcgactccggccgattatgagctgatcaagtccgaaggctcggtggtcgagcagtttatccgtccgacggggttggtcgatccgccgatcgaagtgcgtcctacgctgcatcagatcgatgatctggtcgaggagatcgagattcgggcgaaaaaggacgagcgggtattggtaacgacccttactaaacggatggccgaagagctctataaatatttcgaccggatggggatccgttgccggtatatccactcggatgtcgacaccttggaacgggtgcagattctggacgatctgcgggccggattgttcgatgtgttgatcggggtaaacctgttgcgtgaggggctcgatttaccggaggtttcgttggtggcgattatggatgccgacaaggagggctttttgcggagtgcccgttcgctgacccagacggccggtcgggctgcccggaatgtcgaaggacgcgtcattatgtatgccgaccggattaccgactcgatgcgcgcgacgattcaggataccaaccgacgtcgcgagaagcagatccggtacaacaatcttcacgggattgtgcctcatcaggcggtcaagagcggtcggacgattctttcgggcgaaccgctgcagtcgaaatccgaaccgggaggggtaacctatgatttgagcggagacagaaaatttgcggttgccgccgatccggtcgcggcctatatgaccgagcacgatatagagtcggcgatccgtatggcccgggaggcgatggagcaggcggctcgagagctcgacttcacgacggctgcggcttatcgggacaagatgtatgccctgcaggagcagcagaaaaacagaaagacaaagtaa

SEQ ID NO: 1646 - DNA, 2370 bp, Alistipes sp.
atgatcaagttatttgtggatgatcgtcttgtcgatatggatcaacaaacctctgtttccatttcgctcggtatcgcttctgtaaccaaaatagaatccggacgtaccggatactccaaaacgatacaactccccatgactgcccgaaaccgggcaattttcggtgacgcggctgaactgcatgcggctgaggcattcaatcagagtgcccattcggcaagaattgaggtcgatgggtataccgtaatcgagggtacgcccatgatgacaaagtgcgctgcgtcttcgtacggcggtggttggtacaaaatgaatatcatcggtgcgggtaaagagtgggtaaaaagtgcggctgagaagatgttcaatgaaattcccattgtgttcgaaaaaacgatttcggctgacaccgtggcacaaagctgggtgtgggaagatcccgtacgcttctttccggtgcaaagagaccgttatgaaacggtgtcgaacacgcttgacggtggtgtccggttactctcgttcagcgactatcacccctttatcaatgtgaaggcattggtcgatgcgattgtggcggatgccggatatacgatcaattcccaatttatggatagtgatttctttaagtcgctgtacatgagcggaaaataccccgaaaaggaggtgcagtcgtttgccgaggagatggggttcgtggccggacggttccaaaacgcctccgctaccgcagatcgattcggaagagtatatgcagatccgtttacaaccttgtcgtccatcggaaatcttgtcgattccgctgatcccgatcaatcgtcagagaacggtgtcatcagtggtgtgtacaatcatggagagtgtttcaaaaccgatgagtccggacgtataggctattatccgctcgaaaaaattaccgtggggttcgaatatgagctgcggtaccgttccgatttccgaatcgctaaccgaaatgaactgaaatgcttcgatcgagtctatcttgacgacgatattgaacggaagttctcggtgaaaaatcagtatgaagatcggagagagtcgttccatgatatgtggagctaccttctggttgtgttcgatcacgcagaaggtgcttcgtatatgttctcctatgaaaaagaggacggaacgattgtaaataaagtgaatttctcctcaagatgcgtctcgataggaatggaggagggtataaccgtgcgtaatcccaaactgtggattctcgatggctcgagttatcgtgcttatgacgccgattgggccctgtatgacggttatgtctcggaaaccggacaaatcgagatagccttgaccgtacgcagtgcggcaagtgaagtctccgcctcgaacccgaaattctttcatcgaattcacttcggtggcgctgacgaagggatgacgttaaccctctataatacgaccagacttaagtctgtatttatgccgcatccatgtgaaggacagacaatccagtttgctgacgtggctgctcatcgcgtccggcaaatcgaattgatgaatgcgctcaaacagatgttcaacctctatttctataccgatacattgtcaaaaacaatttatgtcgagccgcgcgaagcattctattcggatggggcggtcgtggattggagcgatcggttggacctcgataaacccgtggaaatcgaagaactcggctctgacctgtcgcaatattttactctgagatatctggagggtgatggatatgcggcccgttgggatcaagcccagcaaactgtctttggccgttggagtaccgaaatttttaaccgtttcgccgaagagggtgaacaaatctatcagaatccgctctttgtccctacgttgaatgtgtccggcgcttatgctgatgtgccgcaggcttccctgatacaggtcggtgacagaacttcggatggaaccgacgactacgaaaatctgaatttccctgcaaagatcgttcggttctgtggaatgcagaccctcgagagcggacgttggggatggccttcgtatggcgatcagtatccgaaaatcgcatttcatgaccccgagggagaggtgcctttctccctttgtttcgaggaccgcgacaactgttccggattacatgcctattatgacaagaccatcgacctctacaacaacagtcgtagagtaactctctatctaagacttagacccgaagatatcgaaccattctcttctccaaacggattgcaacgtgacttcagggcgctttttaaattgaaaatcggtggcgaaattttgtggtgcaggctcgaagagatctgcgattataaccctttcgcaaacacctcgacgaaatgtacattccttaaaaatgtttaa

SEQ ID NO: 1647 - DNA, 1182 bp, Alistipes sp.
atgttcgacggagaggatggcagccatatttgcgaccagtgtatcgaacggggacatgccattctggaagaggcgatggagcagactcgccgtcaggccccgagcttcaagatggaggagctgctgaaaccgacccagatcaaatcgtttctggacgaatatgttatcggacaggatcgggccaaacggagtatggcggtggccgtgtacaatcattataagagattgctgcatgaatcggaaggcgatcgtcagatcgagatagacaagtcgaacatcatgcttgtggggcctacgggaaccgggaagacgctgatggcccgaacgattgccaaactgctgaaggtgccgtttacgattgtcgatgcgacggtactgaccgaagccggatatgttggagaggatgtcgaaagcattctgacgcggctgcttcaggtggccgattacgacgtggctcaggcggaacggggtatcgtcttcatcgacgagatcgacaagattgcccgcaaaggcgataacccttccattacgcgggatgtttcgggagagggtgtgcagcaggctctgctgaagatattggagggaacggtggtgaatgttccgcctcagggaggacgcaagcatccggaccagaaattcattcaggtgaatacgtccaatattctgtttatatgcggaggagctttcgacggcatcgaaaagaagattgcacagcggctcaatacgcaggttgtaggatatggtcagttgcgcaaagagcggatcgataaggagaacatcatgcaatacatcatgccgcaggatctgaaggccttcggattgattcccgagttgatcggccgggttccggttttgacctatctggaaccgcttgaccgtgcagcgctgcgttcgatactgaccgagccgaagaatgcgatcatccggcagtatgtccgtctgttcgaaatggatggcatcaagctgacgttcgacgatgcggcgttggactacattgtcgataaggcgatcgagtatcgtttgggagcccgtggattgcggtcgatttgcgagacgatcatgatggacagcatgtatgaacttcccggacagagcgatcgcaaaacgttgcggatcaccgaggcttatgtgaagagtcggctcgacaacgagaaaaacaaacagttgcaggcagccggatag

SEQ ID NO: 1648 - DNA, 1341 bp, Alistipes sp.
atgaaaatcgtaatcgccggggccggagaggtggggagccatctggccaagatgttgagcagtgagtatcatgaaataacggtggtcgacagcgatccgaaacggcttgaatcgattgccggtatggccgatgtgatcgtgatcgagggggattgtacgacctttgccgtgctgaagaaggcttctgtgcggaaagcggatctctatatcgccgtactgcccgatgagacgtcgaatatcgtttcggccatgttggccaaacagctcggcgcccgtaagtcgattgcccgtatcgacaacaacgagtatctggagcccaacaacaaggaggcctttatcaatatggggatcgattacctgttctatcccgagaaagcggccgcacaggaggtgatcaacctgttggggcataccagtacgaccgaatatgtcgacttttcggggggaaagctctcgttggtcgtattcaagatcgatgcgtcgtcgccgttggtcgataagtcgttgatcgaggcctcggccgatcaggagaatctgccctatcggacggttgccatatcgcgcaacggagagacgatcattccacgtggaaacgatcggtttaaggagggagataacatctatgtgattgccaatcagtatgccgaaaaggaggtggtggccttctccggcaagaccgatatcgacatcaagaacatgatgattctgggcggaagccggatcggtgtacaggtggctacggccttgcaggatgaggtgaacatcaaactgatcgactatacgcccgagaaggcctataaactggccgagcagttggacaaaaccttgatcattaatgaagacggacggaatacggatgcgatggtcgaagaggggctgagcaaaatggatgctttccttgcggtgacgggtcgggccgaaacgaatattctggcagcgatgttggcaaagcgcctcggggtgaaaaaggtgattgccgaggtggagaacctcaactacatcaatctggccgagagtatggggattgatacgatcatcaacaagaagctgatcatggcgagcagtattttccgctttacgatgagcaccgacgtacaggcgatcaagtgtctgaccggatgcgatgcggaggttctggagtttatcgtaaagccgaactcaccggcgacgaagagcatgatccgggatctgaaatttccgcacgatgcgatcattgggggagtcgtacgaggtgacaagacgtttattgcggtcggcaatatggagatcaatgcctacgaccgtgttgtggtcttcgcgctgccctctgcgattgcgaagatcggaaaattctttaattga

SEQ ID NO: 1649 - DNA, 1368 bp, Alistipes sp.
atggaattcgatgcgaagagtttgaagtcgatgcgcccgttgacgggagagggtcgaaaactgtatatcgagacgtatggctgtcagatgaacgtcaacgacagcgaggtggtgctatccatcatgcaggatgcgggataccgctacacggaacatttggacgaggcggatgtgattctgatcaatacctgttccgtacgggacaatgccgagcagcggattttcggccgtctgcgggagttcaagccctataaacaaaagaaggagctgctgatcggtgtgatcgggtgtatggccgaacggcttcgcgagcggctgatcgagcaggaacatttggttgacattgtggcgggtcccgatgcctatcgcgatctgccccgattggtgcggcaagccggcaccggagccaaagccgtaaacgtactgctctctcaggaggagacctatgccgatatttcgcccgtgcggctcgataaaaacggcgtgagtgcattcatctcgatcatgcgcggttgcaacaacatgtgttcctactgtgtagtgccatacacgcgcggagcagagcgtagccggaatccgcagaccattctgcgggaggcacgcgagctgtttgaggccggataccgcgaagttaccctgctcggccagaatgttaactcctaccggtggaacgaatccggaacgacgaccgattttgcggctttgctgggtgcggtagccgagatcgatctgcttttgcgggttcgtttttcgacgtcacatccaaaagacctcagcgacgaggtgcttcatacgatggcgtcgcatccgaatctgtgtcgggcgattcacctgcctgcccaatcgggaagtacgcggatgctggagatcatgaaccggaaatatacccgcgagtggtacctcgatcggattgcagccatccggagaatcctgcccgactgtgcaatttcgaccgatttgatcgccggtttctgcactgagaccgaagaggatcaccgcgaaaccctgtcgttgatggaggaggtcggatatgagtttgcgttcatgttcaagtattccgaacgtccgggaacaaaggctgcccgtcacatgaaagatgatgttcccgaagcggtgaagacggcccgtttgacccagatcatcgatttgcagaaccagctctcgctgcggagcaacaagcgggatgtggggcaagttttcgaggtgctgatcgagggaacctccaaaagaagtgcggatcagcttttcgggcgtacgtcgcagaacaaggtggtggtattcgatcggaaggagcaccgtatcggggagtatgcaatggtacggattaccggatgtacgtcggccacgctgttcggagaggcgatttaa

SEQ ID NO: 1650 - DNA, 1278 bp, Alistipes sp.
atggggttacccgcatcattacctgcacaagagcctctctccctgtctcaggccgaatgccgcgaacgggctctggcccacagcgaagagttgcagcaggccgaaaacgcactccaacaagcgggtcttgaccgcaaaatcgccaattcggcctcccttcccaacttcgaaggttctgccctcggcgcctatatgctccccgacatcgacatgatgggcagcgagcttcgcatgcggggaacctacatggccggtatctcactgactcagcccatctatacgggagggaaaatctcctccgggcggcgtctggcaaaaatcggtgaagccgttgcctccgaacaacggcggatgacccgcatggaggtgattgccgaggccgacaatgcctattggagctacatcgccgttgagcggaaggtcaaaatgacggagcagtataaaaccctcatggacaccctgtttcaccaaaccgaaacggccctgaaggccggtatggcaacggacaacgacctgcttcgcatcgaagcccgccgcagcgaaatcctgtaccagcttcaacgggcccgtaacggagccgacctgtgtcggttatcgctatgccgcattatcggggtagattccaatacggaattcattccgaccgataccctgataaccgttacgactccgagtcagctgagtgccgacattgactctcgtccggagctgcgcctgctcgaaaaacagatcgaagccaacgagcaacagatccgtatgacccgagccgacatgctgcccaccgttgggttcagtgccggatacacctattacggcaacatcaaactgaaaggtacggccgacatcgggaacggaaccctgatcccctttacccaacaatttcgtgatggtatcggaatcgcgatgttggccgtcaagatccctatttttcactggaacgaagggcgcaacaaagtacgaaaagcccagttcgacctcgacaacgcccgtctcgagatgcaaaaaaactcccgtctgctcgacctcgaagtgcagcaggccattcgtaacgtagaggacggattccggctgatcgaagcagccgatctcgctttccgccaagccgaagagaaccttcgcgtcatgcagaaccgttatgcggcatcgatggctccacttaccgatctgctcgacgcccagtcgcagtggcaacaggcatcaagcaacctgattgaagcacaaactcaatacaagatttacgaaaccgactatttacgtgcgacaggaaaattagaatag

SEQ ID NO: 1651 - DNA, 2115 bp, Unknown
  Description of Unknown: Clostridiales sequence
gacgcaaaagaactcaggctaaattccgggctcgaacaggaaccggaggtgctttttgatgacaatgctgcgaaagatgaagctgacagatttcagtctgacacttcgcctaaattggctataaaatatccccggacttttgttttgccaaaacccgttgtcgatgagccgcttgttattactccatccgcggacgctgattcgcctcaggtgacgccgccggcagagaattcggcgacagaagttcccgcgacccctcaagaaacaaaatcggaagtttcgcccacaatagctgatgttgcggacaatgtaaaagatgcggttgatgaagttcttgatgatatagataaaataatcaaaaaagccggctcaaacaagctacatacagagtttgggatggataaagacggaaatattgtttttcaggaggctaacacaaaggctgtatatgatgaaatcttcagccgtgttaaaaaagaaatccagaagcttgaaaaatatggaaatatgaatcttctcaatgcactgggcggcgatgatgtgcttgaaaaacttgtacagtctgcatggatgacaacttataattcttataattcatcacaatcaaataatacagaggattttgttaaatctgtgctcaataatttaaatagtatgcttacaatgctggaaaaaagtcctgaaatgcttgaagtatttactcagcgcggctcttatgcagacagttcgctgacaaacgggcttaaacattacaacacaaatacaacctatggcggcgatgaaaagataaattattccggtacaattgctcaatatgctgacgggactgtccatattgacaatacaatcgatgataatgattatcaacagacaatggaaccgctgcttgaaaggattatcgcaaaataccccgaccttgaccctgaatatttgactgaaatcttccgaacagcacaaaaagatgcgattgaagctttccagaaaaacgaagctgactgcccttacggcacgggtaacaacagcggacgtgtagaggattattcaaagaactggggcggcaaggataaccgcaaaaaagatggttctgttgcgcatatggaccaaatagtccagatgaccttgtatagctttgataaactcttgtatcagggaataatcaaagacggctctgctgcgttaaagaaagttgaaaacgcacctgaaactcctccggtcagtgatgtagtagccgaatcgggtgaaaaagaagtaaatcaggagcttattgacgcggcagattatgcctcggacgctctggacgaagtaattgacgatattgataagattgttgataaagcagcctcaagcaagattcatacggaattcggtatggataaaaacggaaatattgtcttccaggaatcttcaactaaagccgtttatgacgaaatcctgaatcgttttacaaaagaaatcggcaaacttgaaaaatacggcggaaaaaacatactctccgcgctgggcggtgaagcagccctcaacaaacttgtacaggcggcctggatagaagcttacggcgcctttaattcatcacaatccaataatacagaagccttcgtaacaaaagtcctcgataatcttgaatcaatactcaaaaatttgcagtcaaatccggacttgatggaaacttattctcagcatacttcctacgctgataccgctctaactgatgagctgccgtacagcagcaccaagaaagtcaattacggcggaaaagttgtgcaatattccgatggtacagttcatattgataatacagccggagatgtggcttatcagggagcaagggagcctcttttgcagcggcttatagaaaaatatccgaatattgacaaatcccaaataacaagtctattccgtgccgcgcaaaaagccgctcttgccgcaatgcagggtaatacaaacgattgtccgtatggtacggctaataacaatggccgcgtcgaagacaacaccaaagactggagcggcaaagataaccgtaaaaaagacggttctgttgctgatatgagccaaattctccagatgacattatacaattttgataaacttttctatgcctacctcaatacatag

SEQ ID NO: 1652 - DNA, 1686 bp, Unknown
  Description of Unknown: Clostridiales sequence
gtgattagcattgattcgcttctggcagaggcatttgtggaggaaaacagggctttttttgagggggcaaaagtacaaaaaatccagcagccgaccagaaaagagctgattttgcatttgcgctcgaattttgaatcaaaaaaattctacataaacatccacccccggtttcaccacgcagccttgatgaacaaggaaaacgaggcaaaaagaaacctgaaaatccccgcccagcctccgatgttttgcatgcttttgagaaaacacatggaaggcgcaaaaattgtgcgtataaacaagcccgaaaacgaacgaataatcgaacttttctttgaaaactacgacgaaatcggagcaaaggtcgaagaatgcctcagtatcgagcttatgggcaaacacagcaatattgtgctttacaacacagataacaacataattctcggctgcgcgcacaatatcggctcagaaaaaagcaaagaaagggaacttgcgggcggtttgccctacatttacccgcccaaacaggacaaacgcgagcttttgagaacgcgctcggattcttttaaaaagattttcaaaaaaagcccgaatccgcttaaaaaagttttagcggagaactttttcgggctgacgcaaattctggcaggacaaattgccgaaaaaatcgggataaacggggattctgcagcagattcgttaaaagaagaagaaatgttgaagctttttgccgcattgcacgaattttttgaaaatccgccggaaaattacttcataagcagggattttgaatatttttcgccctttgaatcgcccgaagcaagaaaatacaccgaaataaacgccttgattgacgattattttgcttatcatcaggaaaaattcaacctcaaaaacctgaaagcaacactttgcgcagctgttcaaaaggagctcaaaaggctgaaaaacagtttcaaaaatctccaaaaagaggctgcaaacaaagaaaaagccgaaaaatacaggctcaaagccgaccttattatggcgaacctttacaatctgaaaaaaggggagaaaattgttgttttgagcgattttgagggggaaaatcaggtcgaaatcgagcttgatgagaatatttcaccggttgaaaacgcaaacaggtactatgcgcgatacaacaaggcaaaaaaggcctatcagatagctgaggagcttgcgcaaaaggctcagggcgaaatcgaatattttgaagagctgatgttttcaattgagcttgcgcagagcatggcagagcttgaagaaattgaagaggaaataattccggcgaaaaaagatgaaaaatccaagaaaaaagaaaaacaaactaccgttcaaaagcttgatatcaatggatttaacgtttatgtaggaaaaaacaacaaacagaacgattttattttttcaaaaatttcttcaccggaagatttgtggtttcacgcgctcaacgtgcccggtgcgcatattttgataaaagttcaggacaaagaaccgccggataaggtgcttttgagggcagcagaaattgcaaaagaattttcaagcgcaaaaaattcgggaaaagtgccggtaatttacacaaaacgaaaatatcttaaaaaaccgcccgcgcaaaagggcgggatggtcacataccgcaacgaaactgaaatagtcgttgaataa

SEQ ID NO: 1653 - DNA, 1452 bp, Unknown
  Description of Unknown: Clostridiales sequence
atgagaaaattccgcagaattttaaatatatttttaataattgccgcagttttcgggggcatttaccttgttttgtgcttcgggctgccgtttttgcttaattcaaaagattattcgggcataatttcggacgctgtcaaaagccagacaaatcttgaccttgttatccgcgattacaggattaaagtatccccaaagctcaatttgaccgttgatgcggggaatgttcagcttttttacccgaataaaaaccagattcttgatataaaaaatgtaaacctcgattttgcaacgattgcgctgcttcacagggaattaaagctcgaaaaggtttctgcggacagcgttcaaatttccacaaaattgctaaaaaacggcaaattcacgcttcaggagtatcttgagaaaaactacaaagaggcggaatcttctcaactcaaaatctccgatgaaatcccgtcaataaacgtgaattcgctgctaatcaagattaaggacgaaaaaacagcccaaaaattcaagctggaagcgcaaaatttaaaaatttcaaacaaactcctgacgaacaaccgaaaactgagcacatcaggcgcattcttctgcggaaccgggaaaattgcggattttaacctgaaactggcgttttctgacaaattaatcaaaaactttcagcctgagccggttcaaatcccgttttccgacttcaacaggtataaaatgaacgcgaaaattaacgcagatttgaccctttcagaaaatgcaaagctgagcggcaaaattaacattgacaatttcacaatgaaatccgcaaacgggctcatgctgccgccgtcctactttcattttaaatttgaaaaagacaaaggagaaatggattcggaattttttgctgcaagagatgaaaaagccctgctgaacgcaaaatttgcactttccggcgcaaaaaaaatatatttaaaatgctcgacaaaaaagatttctttaaaaaacctgaaaccggttctgatttcgcttgcggaaatgctcaatataaaaaataacctgtcggaatttgacgcggacggctatattacctctgattttacagtggaaacggactttaaggcaatgaattcttccggcaggctcggcgtttttaaagcttcactaaaacacaaatccatccctttaaaaatcacagaaatcaacgctgacgttgatttttcagataacgaagtaaaaatcaacaaatctgcactgctcgtgaacaaccagccggtggaattaagcgggaaaattgacaaaaatgcctggggaaacctgactttgagcgcaaatgacctcagccttgcaaatttaatgaatgctttttcatttttgaagccatcggacaaaattgccgtaaaatcaggcactttgtcctttaacgccgtgctaaaaggcaaattagagaacgcttcacctaaaattaat

SEQ ID NO: 1654 - DNA, 726 bp, Unknown
  Description of Unknown: Clostridiales sequence
atgagtggtaatttaaagtacaaaagagttttattaaaaatcagcggcgaggctttgcttggcgaccagcaattcgggattgaccaaaagcctgttgagatgattgcgaacgaaataaaaattgcgcatgacatgggggctgaaattgcagttgttgtgggcggcggaaacattttccgcgggatgaaaaacagcgcaaagctcggaatggatcaggcgagcggcgattatgtcggaatgctcgctactgttatgaacgcaattgcgctccagagtgcgttaaggaaattgaatgtttcctgcagggttcaatcggcgatagatatggataaaattgccgaaccttacataagattcaaggcaattcgccatcttgagaaaaatcgtgtggttatttttgccgctggaacgggaaatccgttctttacaacagatacagccgctgcattaagagcttctgagattgacgctcaggttatgctgatggctaagaacggggtggacggtgtttactctgatgatccgcgtgttaataaaaatgcgaaaaaatatgacaaaataacttatgatgatataatagttaaaggcttaaaagttatggatactgcatcatgtgctctttgtaaacaaaatcatataccgattatcgtatttgattttgcggcaaaaggaagtattgcaaggcttttgagcggtgaattgttaggtacttttgtaggagaataa

SEQ ID NO: 1655 - DNA, 681 bp, Unknown
  Description of Unknown: Clostridiales sequence
aggtattataatcaatacacaggagcacgaagcatgaaaataaacactatcacgaatcaattttacattaataacaacaaaataaatttcagtgcaaaaaacaacaaaaaaaacagtccgcagccacaaatgccggaaacagcagcacaaacaagccggcttgtacccgcaatgatggctctggcggcgttgacaacattaaattcctgcactgaatccgacattcgttacgcagatttgagaaattttaaaaacgaatgccttgaagagtttctaaatgacgaagatagcttttcgagaattgatgaaaaaacatttgtcctgagctcaacaaaagacagcatttcaaaagaaactccggattataaatacagccatacaagatacaaagaaaacaatcataccagcgttttcggcgaaatcacaagaaaacgcgacaacaaaacactaaaattcataaacgtatacgacaaagataaccagctgacctcaacaacgctcaaagacccgaaaacaggcgacaaattttacataagctatgaagatggattcttcaaacaaatccacgataaagacggaaaacccgtaaaaggtgaaaaacgggcgtttatcctgagcgttcttgtgctggctgctacttgcggcgcaggaatcaaattccgcggtaaaggtcaggattga

SEQ ID NO: 1656 - DNA, 1581 bp, Unknown
  Description of Unknown: Clostridiales sequence
aacccgcaaaggtgcacgctgtgcggaaaatgcgttgcggcatgtacttttaacgcaatcaaagtaaacgtcgaaagacgccggaaagtctattcagaggggccgctgcccgacccgcacgtaaaatgggttacagaacccgtcataaaacaggtcgtaacctgcaacaaaaactgcgtgggctgcggaatgtgcgcaaaagtatgcccgaacgaggcgataaaaccggttttcaacgaaaacaaccgctacgatgttatgttcagagcagaaaacgccgaatcccccaaaagaggcggcagaagcaacctccacaccgagggaagaacgctcgacaaaatcaaaatcggcagaatctctcaaatgaccgacccgtcattggacgcaatgcgccatactttcgatattctggcgcctttcgggcgcgtaatgcctcctgaatcactgccttttattgttgaggacggcgatttgaagatgaaccgttcaatgcccactactaactggatttatccgataattataggcgatatgtccgtgggagcgctttctacgaggatgtgggaggctgttgcgattgctacggcttatttgaacgaagttgtcggtttgcccgtgagaatgtgctcgggcgagggcggaatgccgcaaaaacttttaaaatcgcgttatttgaagtacatgattctccagattgcgtcagggcacttcggatggaacagaattatcaacgcaatgcccgaaatgacagaagaccccgcgggaattctcataaaaatcggtcagggcgcaaaaccgggcgatggcgggcttttgcttgcgaaaaaagttgcccgtcatattcaggaaatcaggggcgtgccgaaatccgacctgctttcgcctccgaatcatcaggggctttattcaattgaagaaagcgttcagaagatgtttttgtcaatgaatgcggcgtttaaattccgcgttcccgttgcaataaaagtcgctgcatcgaccacgagcgtaagcgtttacaacaatttgctgcgcgacccgtacaatattgtcggcggattcttccttgatggaattgcaggcggaacgggcgctgcacacgagatttcgcttgaccacacaggtcatccgattgtgtcgaggctccgtgattgctatctggcggccgttcatcagggaaaacaggggcaaatcccgctctgggcagccggcgggctcggtatgagaggcactcttgcggctgacgcgtttaaaatgatgtgtttgggcgcaaatggcgttttcacagggaaattgatactccaaatcgcgggctgcgtaggtaacgatttcggaaaatgcaacgcctgcaacacaggattatgccccgtaggaatcacaacccagaacaaaacccttatggacaggctcgatgtggataaagtcgccgaaaacattgtaaactacttcctcgcaacgaacactgaactgaaaaagctcctcgcgcccatcggaaacagcactttgccggtcggacgctctgacgctttgattacagttgataaaaacgttgctacaaggctgaatatccagcatgtctgctaa

SEQ ID NO: 1657 - DNA, 1107 bp, Unknown
  Description of Unknown: Clostridiales sequence
aaaatgggtgtaaataccaattacgaagtaaaaattaatgaagttaaatatccgcaaacattaaacgctcgcacagaaacacctgtagcgcctattaatcttaacggcaacggcaatctcggacaggtcggagacggctttgtaagaagcaaggattctactcttgatgaagcagaaaagttaatcgattcaaataacttagaccagctaaaaagcgcagagcaacgggtttcggctttgtccgttgaagatacagacccggtaaaagacgctcaagcagcagaagacgcagcagcagcaaacgtaactgacagacaatccgctgctgacgcagcagacgcaaacaaagacgctgcagaaactgaaaatgacgcagcaaaagaaaatgaagaaacagcaacacaaaataaagcagcagccgcacaagcacagtcagccgcaacagaaaatcacacacaggcacaagccaacacacaacaggcaactgccgacgtaacaaaagcagaagcaaaccaggctcaagccgaagcagcagcaaaagcagacccgaccaacgcagctgcacagacaagagctgcacaagcaaaaacaaaaacaacagaagctaaacaaaaagaaactgtagcaaaaaaagaagaagcaacagcaaaagaaaataaagacaacgcagataaacaagccgacaaagcagaaaaagaagaaaagaaagccaaaacaatagccaaaaaggcggcctccggtttgtctaaggcaacacaaacggcttctcaactcggcagcctgctcactatggcaaaaagcgccctcggcacagcacaaaacaacacagcagattacacaacaacaaccggtgaaactaaagcgcaggttcaacaacgtttggcagcaactataaaaagccttgaaaacggaggaagcggcaatccctattcttcttattcgacaacctcgggattcactctttccaacgcaacttcttcagcagcaggctcagcttataatgcagtatcatctgcaagcacaaatgttgcagctaactccgcaaatttcgcttcagccgccggaagcaatgcagcaacaccgaacatattccttaaaaaagcatag

SEQ ID NO: 1658 - DNA, 621 bp, Unknown
  Description of Unknown: Clostridiales sequence
gcagaaaacgaagatatttttgagggatttgattttcagaacattgatttttcacagcgctcggaaaggcgcaggggcgaccgtcgcaggggctacaggcgcgtcgatgacagaaacctcatctcccgcgcgcaggaagaagcaatcctaattaaagaagaatccacaaaagaaggctacgaagaaggtcttgcacgcgcgcagcatgaaattaaccagctcgctgaagcattaacagaattttttgactacaaagtgcatgtttatgacaaagtttccaatgatatccttgatatttcgctggaagtggcaaaaaaaatcataaaacgcgaagttgccgcggacaaaacaatccttgatgatatcatttacgacgctctggagaatattgctaaagacgaaaacaaaattatactaaaagtagcaccggttgatgtggaatacgtcaaagaactggttcccgagctgctttcgacaggagcagtcgaagcaaaaatatatgtaaccgccgaaaaaacggtcgatgaaggcggagtgataatagaaacctcaaacgggctgattgacgcaaacataacgacccagctcaacgttttaaaggaggcttttaaacagatttaa

SEQ ID NO: 1659 - DNA, 870 bp, Unknown
  Description of Unknown: Clostridiales sequence
atgaagaaaaaaatagcaatacttttacttattcttgcaataatcggggcaggtgtttattttttaacccgccaaaagcccaaccctgacgaattgacgctttacggaaatattgaaatacgtcaggtggatttgagttttcaggtttccggacaaatagctaaaatgcttaaagaagagggcgacagcgttaaaaaaggcgaactggtagctgttctcgatgataaagattacaaatcaaatctccagaaggcttctgcggaagtttcgcgcacattagcgcttagtaaagatgcagcttcaaaatatgaaagacaggctccgctatgcgctgacaacactgtatcaaaacaggaatgcgatactcttttaaatacaaaagataaagccaaagcagattacgaagcagcagttgcgcaaaaaacttatgcaaaaaatcaactggattacacaaaaatctatgcacctgaagaaggcacagttacggtaagagtgcaggaaccgggtgcaactgtaaacaaaagccagaccgtttatacaatttccaaaacaaaacctgtctggatacgtgcatacgtaaatgaaaccgatttgggcaatataaaatacggaatgaaagcgaaagttttaacagacagcattaatccgcagaccggaaaacaaagagaatacgatggctatgtaggctatatttcgcctgttgcagagtttacgccgaaaactgtacaatctacggatttaagaacaagccttgtttaccgaattcgtgtttatgttgacgacattgacgaatacctcagacagggcatgcccacaacaataaaaattaaccttcttgagagcaagccaaatgcaaacagtagaaattaa

SEQ ID NO: 1660 - DNA, 1029 bp, Unknown
  Description of Unknown: Clostridiales sequence
atggggctggctaatgtttgcgaggtgaaaggcgctgaaccggttgaaacgccctgcgctaaatacggaattatgcatgaaatctcaaaaggcaaggatacaaccaccggccactgggaaatggcgggacttgtgctggatgtgccgtttcgggtttatccggagggctttcccggggaaattattgacgaatttgtccaaaaaaccggctgcaaagaaatcctcggcaactatcccgcttccggaacaaaaattattgaagatttgaacgaagaacaccataaaaccggatttccaatcgtttataccagcgctgacagcgtttttcaaattgcagtggacgttgatgttgttcctttagaaaaactttatgaatattgcaaaattgcccgcgaaatcctgcatggcgagcacaatgtttcaagagttatcgcccgcccttatcatattgtggacggaaaaccggtcagaatttcaaaggatagacgggattattccgttgttccgcccaaaccgaccgttttaaatgaaatactcgaaaaaggcggacgcgttttggggattggcaaaattgaggatatttttgttaaatcaggggtttcgcatgcaatccacacgggctcaaacaccgaagggctaaaactaacgcttgctgcggttaaaaatgagctggaaatgagctctttgcagatttccgaagcggaaaagaaccccaaatttgagctgatttttacaaacctcgttgatacagatatgctttacggccatagaaatgattttaagggctacggggcggctattgaggaaattgacgcgtttttgccgcagattatgtattcaatgaccgaagatgacattctcatcgttactgctgaccacgggtgcgaccctacggtcgcaggaaccgaccataccagagaacaggtgccggttcttgtctacggcaaggcgcttgagcctgaaaatctcggaattaagccgtcatttgcttatgttgccgatactgtcagggattggctgttttcataa

SEQ ID NO: 1661 - DNA, 642 bp, Unknown
  Description of Unknown: Clostridiales sequence
atgttcacgggtattattgaagaaaaagcaaccatcacttcactcgaaaagcagcaaaacggtgcgattttaaccgtttcgtgctcaaaagctgcacttgatacaaaaattggcgatagtatcgctgttaacggcgcctgtttgactgttgttgaaatagaaaacgacggattcaaggcatttgcctcttatgaaacacttaaactcaccactatcggccttttaaaagcaggggacagcgtaaacctggaaagagcgctcagactttctgacagattgggcggacatattgtttcggggcatgttgatggggttggagcctttatttcttcaacaaaaatcggcaaagcctttaaaatgatttttgaaatccccgaagatttgatgaacgaggttgtaaaaaaaggttcaattgcaatcgacggcgtaagccttacagttgccgaagtttccggcaataaaatcgcggctgcggtcattccccatacttataaaaacacccttttgggtgatttacgaccaaattcagcggttaatatagaaactgatgtcataggcaaatatgtgggcaaaatgctcgctgccggaagaaaagaatcaaaaataacagccgattttctggaaaggaacggttttatataa

SEQ ID NO: 1662 - DNA, 1410 bp, Unknown
  Description of Unknown: Clostridiales sequence
atgcaatcaaacattaatagcacatattttccgggtcaaaacccaaattttgcggcttatccgaacaatccgcaaatcaacgcaggtgctaaaaaaatcgaagacaatacattactcaaacaagcccagaaaacgcaggacaatccggctgttttaatcggcggggccttaggtttcggaattccgcttttgtgggcgtcatctgttttgaataaacagctccgcggcaactatgacgacacttttttcggaaaaatcgaacaattcggcgacagattgggcaacaaacccgctcttaaaagcacaggcacaaaacttgccgcatttaatgaatggttcaaaaacaatgttgtaaataaatccgaaattttaagaagtatctggacaaaaccgagtgtcggtggctcaatggctcagggacaggcaaccggtacgatggggcaccttgcaacaagcgcaagagagctcatggaagcatatgacaaggctcatggcactacagtttttaaagatattcttgaaaaaacagcaaaagattcgcacaaatatacaaaagaaatctttgaagcgttaaaagcgcaccctgaaacgcatgcagagtttttcaacacctcaaaagcctgggttccaatgccgaaattcctgcaaaaaggcggaactctcggcgaaatctacaacaaaatgcgtctaacccaaaattataaaaacataaccaattcattaggcaaaaaactctctggcggcacattccgtgcgctcgaagctctttcaaacggcatggcaggcggcaaattggcagttgctttgcaggcatttttccttgctcagtccttaaaagaggggctggacgcaccaaaaggcgacagatttaaaacctttgcagagtcaatggccagctttatggcaatgatgctcacaatgggcctccaattgcgcgtattcaacaaagcagcgggcctgaaaaacataggaatgagccccgaaaactacaaaaaataccatgaaactatcgaaaagctcaacgcagccggaaaagcaggcgatgaagcagcatataaaacactcaaagccgaactcaaaaacatcaagagcggaaaagtcaaattctggcaaaaaccgttcaaatgggttggaaatctcctgagctggggccgaataaaagaaacagtgcgccccctcaagtcaaccaacccgctcaaaaacgcaataaaaatgacaggttacggcgcaaaaatcggcgcaggctatgtaggcagatttgcattcatcgcaactgttgttatgtcgctgttcacggacactgcggtaaaaatttctcacaaaatctttggcagacctcaaaaatcaatcctcgacaaagaagaagaaccaaaaaccgatgaacaggctaatgcgcagcagcttgaggag

SEQ ID NO: 1663 - DNA, 672 bp, Unknown
  Description of Unknown: Clostridiales sequence
ttgagattattcaacgagcataatttagagggcacattgatttgtgttgaggggattgacggttcgggaaaatccacccagctggcgattcttcgcgactggctgcaatcaaaagggcttgatgtgatttttacggagtggaattcctcggaactcatctctcaaaccacaaaaaaggccaaaaaaaagaatcttttaagcccgaggacgttcagtcttctgcatgcggttgattttgcggacagactggagcagattatcattcctgcgttgaaagcggggttcattgtgcttgctgacagatacgtttacacggcctttgcaagggatgttgccagaggcgtggacaaaaactgggtgcgaaatatgtacggttttgctgtaaagccggatttgacgctttattacagcataaacgccgaaacttcgctcgaaagaatctgtgcaaaccggacaccgagcttttatgaggcgggaatggatttgaaattgagcaacaacccttacaaaagctatgttattttccagaatatggtaaatgccgaatatctgcaaatggtcgaggaattcgggcttgtaaaaatagatgcgcagcagtcaattcatgcaaaacaggttaaaatgcgtgaactcgtaagagattgcctcgcaaaaaaaggaataaatatataa

SEQ ID NO: 1664 - DNA, 1032 bp, Unknown
  Description of Unknown: Clostridiales sequence
atggattttaaaaatagctttactgcaaaaaacataagtttttcacttttaattctttttattgttttttgtattgtaaaaatgcccgatatagcgcttttgctctttgtcggttacgtaatctcctgcgcaatcaaccctgttgtaaacaaactctcggaaaaaatgtcgagaacactcgcaacctccattatgctcactgtagttatcgcagcgacgctgggtttgttcattccgataatcgttatggcggtcaaagaaattaaagaattcataacacagctgcccgggcaaattgataacatccagatgtaccttgattctgtgaaaataggcaaacaaagcctttcccagctttttaacctcgatgccggacttgcaaattccggacaaatcgcccaggaaatcattgataaatcaataaatttcactgtcggtgcgctgggagtcataactattctcgtcacagtggcgattatcgtatttttctttacaaacgacagggaaagaatcaaaaattccactctgcgcctgctaccggcctcgcttagagaggatgcatccagaattattgacgatcttgagcaaaaagtcggcggatatgtgaccgcgcaattcctttccatcacgcaggtcggagtttgtgtggctgtggggcttgcgattttacacgtaaattatgcagttttcctcggatttatttctgcggttatggatctggtgcctgtggtggggccggtgatttcaggtgtggtaattttgctcgttgcaatctctcacgggcctgtgattgctgctcttgctatcggtgttttgcttcttgcacaattcattgaaaataactgggcaaaaccttattttttctcaaaatacatggatttgcacccgctaatagttatattttcatttgttcttgccgcaaaattaatcggtgtaataggtgtggtctttgctcccgcgattgcagcagtaattgttacgctttttgacgagatttatgtaaaaatcatgaacgaggacggcaaaaattga

SEQ ID NO: 1665 - DNA, 471 bp, Unknown
  Description of Unknown: Clostridiales sequence
atgaaaaagtttttgattacattttgcacattattaataggattgggcgcaaatgctgccgttactgcagatcaggcgcttacgttttttgcaaaatacattgattcagccaataattataaagaagatgtagtaaatttttacacacctgacgcaaaaattataagagtcgttatgaaacccgacggctcaaccgtgactttaaccacaaacatgaaagaatatgcaaaccagatgagaatcggtgcaaatcttgctaaaatgcgcggatataaaaacttttatacagaaagaaaagttacaaaatccggaaatgactacaaaatcacctgcctgcgccagccgtctaccagcgattacaaaattccggcatattttatcatcggcgaggattccaaaggcaatcttaaaatcaaagaagaatcaatgcattctaaaaaccagcttttgttaaaaggcaagaaaaaataa

SEQ ID NO: 1666 - DNA, 426 bp, Unknown
  Description of Unknown: Clostridiales sequence
atggaagtggacaagtttacaaaaacatatcatcaaaaggaaaacgacgaagtcgcaatggacgactttaaagtcgatttttctgctgcgcagtccattttctcaagaaatcccctgaattcggctgatgacccggaaaaagaagaaaatccgcagggattttttgaatttatgtttgaaaaatttgaggaatacctcgacaaaaacaagaaaaattcaccgcttgcgcgcaagctcaaaatgctcatccactttttccagataaaagacactctgagcaggctcaacaaaataaacagctcggttgacgagctcgtaaacctgaaagtgcccttcggtgagcagcaaaaacgctatgaaatcctttctaaccggctaattcgcgcaaattatcttcattcccagattaaaaaggagctgtcataa

SEQ ID NO: 1667 - DNA, 360 bp, Unknown
  Description of Unknown: Clostridiales sequence
atgagcacctctctcaaaaatgcccaacttgttaaaaaaatccccggcgtatcagaaacttacatgaaaaaattgaaacgttccgaggtcttgattaaaaagaaccctcaaggagaatcagtttccgagctcacaaaatacaatgacggcagatacagatttgtagagttcaaagacggaaaaccggcgttcagcattgaaaatgaccccgaaatcggagcaagacactattataaagtcggcgcaaagggcgtaaaaacaaaagaaaaaaccttgtacaacggattgaaaggcattttcaactggtacatggacttttacaacgaagcaggacaaagaattaaacagattataagataa

SEQ ID NO: 1668 - DNA, 270 bp, Unknown
  Description of Unknown: Clostridiales sequence
atgaccacgcttaaagaattagttggaaaaaggataaagatagtcagaaaaaggtgcaatctgactcaggaaaagcttgcagagcttattgatattggcacgcgtcagatttcgaggctggaatgcggaggaaatttcccatctcaccagacttttgaaaaactttcgagggttttgggcgttgaaacaatggagtttttcaattttgaagatatggacattgctgaaacacagattgaaaagcctgcaatgtcgaaaataagcggttaa

SEQ ID NO: 1669 - DNA, 357 bp, Unknown
  Description of Unknown: Clostridiales sequence
atgagagtaaaacgcggtaacgtcttaagaaaaagacataaaaaaatcttaaaattagctaaaggcttcatcggagccagaagcagaatcttcaaagttgctaacacagcagttatgaagaaactcaaataccagtacagagacagacgcaatctgaaaagaaatatgcgccgcctctggattgtcagaatcaatgcagcagttagagcacacggcttgagctattcaaaattcatgaacgcattgaaaaaatccgaaatcgcagtgaacagaaaaatgctcgcagaaatggccgtaaacgagcccgaagcattctctgtaatcgtagaaacagcaaaatcaaaagtttctgcataa

SEQ ID NO: 1670 - DNA, 1503 bp, Unknown
  Description of Unknown: Clostridiales sequence
atggaaaaagaagaaaagttttattatgaaacaataaaaacgccttttaaaaggatttttttgctgcttgttgtgttgttctgggtaattccgactgttgttatgatgacattccggctggaaatggctgcccaaatcacgattgcaatctcttcacttatgttattttgcgggttttgcggaggtttttatgcaaagcaaaaaatggaatacggcgcaataacaatctctgaagactacaaaacgctcactttgtttagaaacaatctacctgtcaaagttatttataataactgcattgccagagtcgatttaaacatcacaaatatgtcaatacattgtattgacggtgaagtcgtgaaattaaaattggacgcggatgatgagattgatttgtatgttcaaattttcaaaaaagtttccgatgttgacccgtcaaggcaagcaataaaaaaagaacgaccttattttattgatactgcgtggctgcaaatattagggcttgctgttgtgatggcaattctcgtattttcgttccaaaactgctactgcgacaaaacctccggagtttgcgcaaccggtgcatattcaatcttcgccggaggtaagcacaatgaagtttttgaaattaaaaacataaaaaaggtttacaaagacttttttagaccgttcagaaacattggcttttacaaaatctacgtccaatgcgaatacaacaggattgatacgggttacagctacgtgcttcctttctctgcggacaatttcacaacaagatttcaaaactttttagacagcaatgaaaatacgttttcttattactacatttcgcctttatttgtattattcttgctgggagcattgttttcttttgcaaaaagtagcaaagtggacttaaaaaacacaaaaaatttgattcttctgctcggcgcggcaggactggtattttcagctgtttacagcgtatttgataaccaacaggtattaagggaagaagctgtaaaactatccaatccgcatttagcattaaatacaccccctaagcaagaacaaaaagggcttaatgattttatttctcttgaaataaaccagccgaccgaatatgattacctttcgcgagaagaaatcttcaatttaagaaaaaaatatgtaaacaactccctttttgcctcaaaattctatcgcccgtcaaatgaagtcttcggtgctatagaaggaaacaagccatggtacggggaaaacatagcctgcccgtttagtgcaaaagatataacggcaggttacagcgcaagaagtatttatgtgaacaatccggctattcttgtgggcgcaattcagactctgggttacaaatacccgcaggacacgcctttttgcaagaataaacttttaaatttcatgccgcaaaaaatcctttacagcaaaaagaacaatcttcttattgtccgctacaatgcagacaattcactgataaataacattcaggagccccaatacggtatg

SEQ ID NO: 1671 - DNA, 333 bp, Unknown
  Description of Unknown: Clostridiales sequence
atgaagcctcaatataaaagatggtatgatcatgaccccgttttaatggaggttctcgagcttttacgcaattatcaggacgagttgaaagcgcaggctgaaatttttctgcaaaaaattgaagaaaaggtttcaaaagaaacaattgacaaattttatgagatggtaagacccataaacggcaaccgctggtacgataaagacccagttatatcaaaaacggttgaacttttgagggttgttccgccggaaatccaaaaatccgcggctgaaaactttataaaaacccttgaagatgcaggaattagccaccaaaaagctgcgaatgattag

SEQ ID NO: 1672 - DNA, 840 bp, Unknown
  Description of Unknown: Clostridiales sequence
atgaaactaactgttgattttaataaaaaaccatccttcaagagcctgccgctgcatccaaaagatttggcatacaaaaaattactacagcaaggattaaaagacacatttgcaataaattgtaaaattgaggacttgagccccgttacaggaccggtcgaattaaaaaatattattgacaacctaaaaccctttcagtacgaagtaggcgaaaacttcagggcaaattttcatcttcatacacaagcatctgacggagaacttacggccaaagagtttttggaacagtgtttaaaatgggcaaacgaaatattcaaatccggcaaaaccaaagacggactgcccgcgttttctgcggcaataaccgaccacgataacgttcaaagtgtgaaaaaggctattgctctaatctcacgagaacctgacaaatacaaaaacttcaagttcgtttcaggctgcgaatttttactgcacggatacgatgtaccttatagcggctttgaagccgtggggctgggatttaacccttttgataaaaatctggcacctttgatgaaaggcttttgtgcaaacaatcacgtttctgatataaaaaaaatcacagacgccggaggtatcttgtcctgggctcatcccctgataactcccgataaactcaataatcacttttttgaattcttaaaaaaacacggaattaatggcgttgaggggaattatcaatattgcaaatgggataatgaatatattatgtcaataaagccaagacttgacggttttatcaaaaaatttcaaatgtttgtgacgggaggcactgatagccacagaaaaacaatattctaa

SEQ ID NO: 1673 - DNA, 1197 bp, Unknown
  Description of Unknown: Clostridiales sequence
atgacagaaaaaatagtttatttagacaataatgcaacaacaaagattgacccgattgcgcttgaagccatgcttccttatttttgcgaattttacggaaatccctcaagcacgcacgaatttggcggaaaagtttcttatgcaatcaaagaagccagagaatctgtgcgcgacctgctgggtgcaaaggatgaaaaggaaattattttcaccggttcgggctcggaaagcgcaaacatggcgataagaggggttcttgaggcgaacaagaacaaaaaacacatcatcacgaccaaagttgagcacccatgcgttctcaatgtttacaaatactttgaaaaacagggttatgaggttacttatctgaacgttgacagcgaggggaaccttgaccttaacgaattgagcgaggcagtcaacgaagaaaccgcgctggtcagcatgatgatggcaaacaacgaaaccggcgtgattttcccttatgaaaaagcggcttcaattgtaaaaagcaaaaatcctaaaacaaaagtgttcatagatgccgttcagggtgcagggaaaatcccgattgacgtcaaaaatacgcaggttgaccttatgggcattgcggggcacaaaatccatgcgccaaaaggcgtaggagcgctatacatcaaaaccggtacgcttttgccggcattgattatcggcggccatcaggaacgcggaaaaagagccggcacagaaaacgttacgagcattatcgggctgggcgttgcagcaaaactcgccaaagaagcgctacacgacgaagcaacaagggttgcggccctgcgtgacaagctggaaaaaggaattctttccacaatttacaatgcacgcgtaaacggctccacggcaaacagagttcccaacaccacgaacatcggttttcaatatattgagggcgaattgattcttcttcacctcaatgacctcggaatttgcgcaagttcgggaagtgcctgcacctccggaagtttggagcccagccatgtactaaaatcaatgggcgtgccgttcacagcgcttcatggcagcatacgtttcagtctcagcaggttcacaacggaagaagaaattgattacacgctgaaagtgcttcccgacgtgattttcaagctgaacaaaatctcgccttatcaaaaagagctggctgccttgaaagaaaaacggtaa

SEQ ID NO: 1674 - DNA, 1635 bp, Unknown
  Description of Unknown: Clostridiales sequence
atgcctgtttctatggcttatgacgtgagaatcgcgcaggtagatgaagctttttcgcctgcgtcaaatgaacaggcgcttgaagaacaggctgaagagcttcctgctgctcaaaaaaaggaaaagaagcaattcaaattatttaataaaaagaaaaaaacggaaaatacagaacaaaaaaccaaagaacgcagctttaaaaacgcaacaaaatatgcggaagaatcttacaaaaaccgcaaagaagaagaaaaagccggtaaaaaagctgccagaaagcagcccaaaaagaaaaaatccgcaaaaaaagacgcacaggaaatcgaagtaaatctaaacagcgaaaattccggcaataatgcggaaattcaaacaacacagcaggtaatgaccggctctattacggcaaataaaatcatttccgttgatgattgcgtaaaattggcgcttgaaaacaacccttctatcgtttcacagatgatgaacagggatatttacaaaaataaaattgcgcaggcgtgggcaaattacttccctacaattaatcttggcgtcagtgcttcaaaaaatgatatgctgatgacgaacttcaagttccccatgcaaaaatataccctttggaacgcgcccagcgcaggcgtgaacctgcttttgtttgactttggcaaaacttctgcttctgcgggtgttgcaaagaaaacttttgaagcgtcggaagaaaatcttcaggctaatatcaatgaaattatctacaacgttaaaaatgcctactattcgcttctgtacgcgcttcagcaggtggaagttcaggaagaagccgttgcgcagtatgaaattcacctgaaacaggccgaggcttattacaatatcggctcaaaagccaaaattgacgtcactacggcccagtacaacctcaataacgcaaaactggatttgattcaggcgaaaaatactgttgatatggcttatgcaaatttaaataacgcaatggggcttcctgaatttgccgattatgaaataaaagaaaagcttacctcaagaaaatacgatattatttttgacgatataatcaaaacggcttatgaacagcgtcctcaacttcttgcggcaaagaagaaaatggaggggtcaaaaattttgattaaagcgtcgaaatacgcgtttttgcctgacgttacaggatttggcagctacacaaggggcggaaaaactcccggaaccgattatggctaccagataggcgcccaggttgcatatcagaaccttaatttactcttgctgaaacagcaggtggatgaggcaaaacttacctacttaaaggacaaagcggactatgaggttcagcgtcagagcgtctatcttgaagtaaaacaggcatatattcagtttaaaaatgcgcaggagtcgattcctgttgcgctttcttcaatgaatgaggcaaaagaccgctatgaccttgctgctggcagatataaggtcggattgggcgatgcggttgagttgaaagacgcgcaaactacctatttgaatgcgcaactgggctattacaacacgctcacgcagtacaatacctcggctgccaacctcgaaagggttgtgggcgcgccgattatccctgttgagaacaatctttaa

SEQ ID NO: 1675 - DNA, 843 bp, Unknown
  Description of Unknown: Clostridiales sequence
atggcggaaattattgacggaaaagcgctgcgcaacaggattctcgagggtttaaaagctgaggttaaaaaccttgataaaaagccgtttttagcggtaataatcgtcggaaatgaccctgcaagcaaaatttacgtttccaacaagaaaaaaaccgctctggagctgggttttcagtccgttgtaattgaaatgcccgaaaatacgccggaaaaagtacttttagaaaaaatcgaagaattgaacaagaacaaagaggtcaatgcgattcttgttcaactgccgctgccggcgcatatcagcaccgaaagggtgattgaaacggtgagcccccaaaaggatgttgattgttttcatccgttcaatacgggcaaaatcgcccagaatgcgcgtccgtttgtttatccgtgcacgccgaaagggattatcaggcttttagaggaatacaaaatccccgttgcaggcaaaaatgcggtggtaatcgggcgctcaaacattgtcgggcggccagttgcggctatgcttacgaatctcgacgccacagtaacaatctgccacagcaaaacgcaaaatctttccgaaatcacgaaaaatgccgatattttaatcagcgcagccggctcaagagggctggtcactgctgatatggtcaaagacggtgctgcggtgtttgatgtgggcatgaacagagatggaaacggcaagctcgcaggggatgtggattttgaggcggtgaaagaaaaagcctctttcatcacgccggttccgggcggtgtcgggccgatgacgatttgcacgcttatgacgaacacgtttgagcttttcaggcggcaaaataagtag

SEQ ID NO: 1676 - DNA, 819 bp, Unknown
  Description of Unknown: Clostridiales sequence
gtgaaaaaacaatcatccggagctgtcaaatggcttctgatcgcagtgagtgtcctgtttctcgccgtgatgctggtattgccgctggtttacgtcttggtaaccgcattccggcagggcattcagccattcttggcggcggttacggataaatatgcactgaaatccgttcagcttaccattgaagcgacgctgttcgcagtcgtgctcaacacgattttcggactgttcgcggcgtggagcattacgaagtttcagtttcgcggaaagaaagttatttctacgctgattgatcttccgctcaccgtgtctccgattattgccggtttgattttcgtgctgacctatggcagacagagtgatttgtatccgcttctcaagagcttggacatcagaattatttatgcggttccgggcattatcatggcaacggtattcgtcacgtttccgtttatctcacgcgagattattccggtgctgactgcggcgggaacagaggaagaagaagccgctgcgctgatgggcgcaaagggctggacgattttcagcaaagtgacgttcccacatatgcggtgggcgctgctgtatggcatcgtcttgtgcacggctcgtgcaatgggcgagtttggcgccgtatccgttctttccggacatctgagaggcaagaccaacacgatgccgctgtacattgagctgttgtatcagggctatgatttcaccggtgcatttgcgatgtcggcaattttggttgtcatggcaattattatcttggttctgcgcagcgtgctggagtaccgaggaaagaagaacgaggagtaa

SEQ ID NO: 1677 - DNA, 2229 bp, Unknown
  Description of Unknown: Clostridiales sequence
atgaagcgtccggtgatttggttttccgcggcatttgccgccggtgtggctctggctttgcgttcattttcactgccgtgggtattggcactgacattgctcgcagggtgttttctgtttggatggaaatggtctgctttccgtccggcttgcgtgttgtttgcaggcgtcttgtctgggctctgctatacacaggcatatcatgcagtgattcaagcgccctgcgctgcacttgacggcaccagcaagtccatgattgttgaagtgacagacttcccaaaacagtatgataccggtcagcgcgtggaaattcgtgtcatcggctcccgtatcggatgcccgctcaattttcggacgctggcatatctgcccaagacggagcaggacatcaagcccggagatgaactgactgctacgtttgatttttatattcccaatcaaacgcagggatttgaccgcgcttcgtattatcgctcacaaggctatgcgattttggcacacgtcaacgaagaatttggcatggttgtgacagcaccgagccatcgacctctgcgctattatcccaaggcatttgcgcaaacattacgcactgtttacatgcagcacggaaccgagcggcaggctgccttttggcgcgccctgacaaccggagatcgcactgcactgaccacgacagataccgatcacctgcggcgtgcgggtttatcgcatgtcattgcactgtctggtctgcatgtaggatttttgatttcgatgctgctgttgctgcttggaagaaaaatcggcacgtatcttggcattcctgtgctgcttgcattttatctcatggtcggctggtcaccgtcagtcgttcgtgcctgtgtgatgtatgggctgattttattggcgtttgccctgcgaaaagaatatgacagtgtcaatgcgctatttttcgcgctcttgcttattttgctggttctgccggatgcgctgttatccgtcagcctgcagctgtcgtttacctcgacactgggaattttgtgctttgcttggaaataccagcatatcttttcggttcccaaacgaatgccacgcagattgaaaaaagtatatcgcggcgtaatgggaagtcttggctgttcggtttcctccgccgcattgacgacgccatttttgctgtatcattttggatatttgtctgtcttttcgattttttccaatttattggcactttgggctatttctttgctgtttccgctgctttttctcggtggtgtccttggcatcatttccgcgccattggcgagcatcgtcctgaaaccggcggcatggctgacagattatgtatatcaaattggagatttctttgcagcaatcccgttcggtgtgctatactgtgagaataccgtagattttcttttgtccgttctcgtcagtatcctgatgattttgatgctgtggctggggaataaacgcgtgctcgcaatatgcacgccgatgataacagccgtattgattggcgtcagcctgtcccgcagcaatgcggcgtgggacgattggacggttactgttttatccgagggaaacgggcaagctattttggtgtcctgcggcgatgaactggcgctaattgactgcagtgcaaccggataccatgacgccgtggaggacatcaaacaatacatggattggaacaatcagcaaaatattgatttgttcatactgacttctatagacaaatccgccgctcgaaacgccagtgagcttttgcagaaagttccggtggatatggtgattttgccggaggaaaaccgcgaaaagaatgcagtgtatccaaaatttatgaaaatattgcgcgagcaaaacatcccgtatgataaaaccgcgccgcagaacgaattacaggtgggagatccggtactgggattgtctgttttggggcgcaccgagcgcaaattggttgtgcgtatgcaatcggaacagcacaacatagtaacggttcgcgcgctgacacagaaaatgctgctggagctgacggaacagtatccgctggcctgtgataccttgctggtagctggcagttttacgaaagatgcggataagatgcacgaaattttgcggcgcatttgtcctaatcagcttgtgatagaaaacggctggaacagcaaagagagctatgacgggattccggcgagcaatccctatgtttccggaacaattatttggaaaaccgtgcgagaagaggagtga

SEQ ID NO: 1678 - DNA, 813 bp, Unknown
  Description of Unknown: Clostridiales sequence
ttgaagcagaagaaatcctttcactggacacgcgttgttctcgccgctgtcatcgtgttcttctacattccgattgcatacaccattttgttttcatttaacgcatcgcgttcgctgacgaccttttccggtttttcgctgcgctggtacgaaaaaatgttttcttcgtccgtgacgatgggagccatcggcacgacgttcgccattgccatcttggcaaccgttatctccacctgcatcggcacgattactgttatcggtctgtcccgctgcagcaagccgctgcgcagggcggttcgcacggcaaatgacctgccgattatgaatccggacattgtcactgcgattggcttgctcatgttctttgccacgctggaagtgagcaagggctttttgacgctgctgctggcgcacatcgcgttttgcacgccgtatgtcatgttgtccatcacgccgcgtctgcgcacgctggacccgaatttggcggacgcagcactggatttgggtgcaaacccttggcaggcgctgtggcatgcgattattccgcagctgtctccgggcattttcgccggtgcgctgattgccttcacgatgtcgtttgacgatttcgtcatttcttactttgtcaccggcaacggcgtacaaaacatctctattttggtttacacgatgtccaagcgcgtcaatccgtccatcaacgcgatttccacgctggttatcgtcatcatcacggttgtgctgctgctcgtcaatctgattccgcgcattgcagagcgcacgcggaaaaagcataaggaggaacctgcatcatga

SEQ ID NO: 1679 - DNA, 1284 bp, Unknown
  Description of Unknown: Clostridiales sequence
atgaaaacgaaaaaaatcgtgatgagcctgatttcgggcacactgacggctgtgatggcatgcggcggcgcattcgctgcgagcgttcgcacaaccaccgatgtaaatatgagagcaaaaccggataacgcttctgccgttctgtgcgttctgccgaagaatgcagaggcggaaaagctgggaatggaaggcaactggtatcatctgtcctataaagacaaggatggctatgtatataagaagtatatcaaggacaccgaagcagcaccggcgacagagaccaagaccgtttacaccacggcagatctcaacgttcgtgcaacaccggataaagccggcaagaagctgggcgttctcaagaagggaactgcggttgagaccaccggtctgaaaaacggctggtataccatcaagtacaacggcaagaccggttacatctccgcaaagtatacgaccgagaccaagccggaagcaaagccgaccaccaagactgtttacaccacgggcgatctacatgttcgcgcaaagccgaccaagaacagcgaaaagctgggcgttctcaaaaagggaaccgcggttgagaccaccggtctgaaaaatggttggtataccatcaagtacaacggcaagaccggttacatctccgcgaagtatacgaccgagaccaagccggaaaccaccaagaccgtttacaccacgggcgatctgtatgttcgcgcaaagccgaccaagaacagcgagaagctcggcgttctcaaaaagggaaccgcggttgagaccaccggcacgaagaatggctggtacaagattacctataaaggcaagaccggttatatttccggaaaatatgtaaccaccaccaagccgagaaccgcagagacgacgattgtttacaccactgcgaacctgaatgtacgcgacaaggcaacgacggaaggcaagaagctgggcgttctcaagaagggaaccgcagtcgagaccctcggtctgaaaaatggctggtataccatcaagtacaacggcaagaccggttatatctccgcgaagtacaccacggaagtcaagccgggaactgagaagccgacaacaccggcaaccaagaccgtatataccacttccgacttgaatgttcgcgcagaaccgaacaaaaacgcaaagaagctgggtgttctgaaaaagggcacagaagtaaaaaccatcacgctgaagaacggctggtacagcatcgcgtataacggcaagaccggttatatctctgcgaagtacaccaccgacaagcgttga

SEQ ID NO: 1680 - DNA, 1491 bp, Unknown
  Description of Unknown: Clostridiales sequence
atgattcgttatatcttgggtcatgtgctcaagattgaagccattcttctgctgcttccctgtttgactgcggtttattatcaggaaatacaaggtgtgtattatctgctcaccgcagccatttgtattgtgctcggctttttgatgacgctgcgcaaaccgaaaaacaacgtcttttatctcaaagagggctgtgttgccacagcgctgagctggatgtttctcagtgtgtttggctgtctgccgtttgtattcagcagagaaattccttcatttaccaacgcgctgtttgagacaatctccggctttacaacaaccggcgccagcattttagaggatgtagaagccctgtcgcactgtgcgctgctgtggcgcagcttcacgcactggattggcggcatgggtgtgctggttttcctgcttgcgattgttccgatgagcggcggttccaacatcaatttgatgcgcgcggaaagccccggaccgtctgtcggcaagttggtgccaaaaatggtatcctccgcccgtatcttatacggcatttacttcggactcacgctgcttgaagctgtcttgctggttctcggcggcatgccgctgtttgacagcgtggcaaccagcttcggcacggccggcaccggcggtttcggcatcaaagcggacagctttgccggttatgccgtccacctgcaatggattgtcaccatcttcatgattttattcggcgtcaatttcaatgcgtattattttattttgttccaccaattccgcaaggcatttggcatggaagaagtgcgcgcctatttcatcgtcattctcgcttctgttgcgtttatcacgtgcaacatccgcagcatgtgcaccggcgtctttgacgcattgacacaggcagcctttcaggtcggttcgattatcacgacaaccggcttcgccacggcgaatttcgacttgtggccaaaggcaagtcaggcaattcttgtcatgctgatgttctgcggtgcctgcgcaggcagtaccggcggcggcatcaaggtttctcgtcttctcatcgcgggcaaaaccgttgtcaaagagctgcgctcgtatatccatccgaaaatcatcaccaaggtcaagatggacggcaagccgatcgagcatgaagttgtccgcgcgaccaacgtgtacgtcatgacgtttgttgttatctttacggcttcggtattcgccctttcctttgaagggcatgatttggtcaccaacttcacggcggttgccgcaaccatcaacaacatcggtcccggtctttctttggtaggacctgcggcaaacttcaatttcttcagcccgatttccaaatacgtgctgatgttcgacatgcttgcgggcagactggagctgttcccgctgctcattctgttccacccgacgatctggcgcgagctgttcgcccacaaagcgcaggagcgcagagccgcccgcgaacgcagaaaagagcgaaagcaaagatga

SEQ ID NO: 1681 - DNA, 1119 bp, Unknown
  Description of Unknown: Clostridiales sequence
atggatcggacattttcaagagatgataccaaattgatgaaaggcgctgcaatcgttttgatgctgatgcatcatctgtggggctttcccggacgcattgcaggcggtgagctgtggcatgtgctgagcatctgcggcgaaagctctctcacctacttcggttctttcggaaaaatatgcgtttcctttttcttttttctcggcggctacggcgtatatctcagcactcattccaagcgatatgatttaatcgccaagctcaaggggctgtatctttcatattggaaggtctttgtgatttttattccccttgcgtttttcttctgtgcgcatcagccgacgtactgcgatgaggcggaaatctgcacacgatacgccgaattttccagacaggaatgcttcaacaattttatcggtttttcaacttcctacaacagtgagtggtggtttttgaacagttatatctgtgcattgattttgtatccggtcattgaccgcattgtccgccggtattctacgctgttcaacatctgggcggttatcattggcaccattctcatcaccaatgtgttccccgccatcggcaagttggaggtgctcggcacactcaacgacaactatctgtatcatgcctttttcctgctgtctgcaccgtataccgcttgtttttggatgggcgccgtctttgcaaaaggaaatctgttgatacaattgcaggacgctttgcgccgaaacaatctgctccatccggttcttgatgtttttttcatcggcgtcatcattcagctgcgctctcgtctgaccgaacagacgccggatatgatttatgtgccgtttctcattctattctttttggatttgctgcgctatatgcggccgcttcgctggctgctcctgcgcatcggcaaggaaagcaccagcatgtggctcattcatccgtttttttgctactacttctatcccgttgtaaaaatagtcgttgcgccgcgctggggcattttgtgtctgcttgttttacttgcgctgtcctatatcgccgcgcggctcgtccggctgttctggcagggcatcggcagcatgatgcagcgcatacaaaagacatttcttaaactttcttaa

SEQ ID NO: 1682 - DNA, 1383 bp, Unknown
  Description of Unknown: Clostridiales sequence
atggcattgcctgccgcatttgaacagcgcatgcagcgattgctcggagaggagtatccggcatttcgtgatgccttggcgcgcccgcaggcgcgcggtctgcgcgtcagcccgctcaagattgcgccggaacagtttgccgcgcaagcaccgtttgcgctgacgccggttccgtgggcaccggagggctttttctatcccgatacacagcggccgggacggcatccgtattatgaagcgggcgtatattacattcaagaaccgtccgcaatggcagttggtgcgctcgcggatgccaagccgggagaacgcgtgctggatttgtgtgccgcgccgggcggcaaaaccacccatttggcggggcgcatgcacggcgagggcttgctcgtggccaatgaaattcacgcgggccgcgcggcaattttggcgcagagcatcgagcgcatgggcgtgcaaaactgcatcgtgtgcaatgagacgccggaaagactggcacagagatttccggaattttttgactgcattgttgtcgatgcgccgtgctccggtgagggcatgttccggaaagacgacaatccggcgcagagcgaatggacgccggagcttccggcattttgtgctgcgcggcaggcggaaattttagaccgcgccgcggacatgctggcgggcggaggcagattgatttattccacctgcacatttgcaccggaggaggacgaaggcacactgtcccgctttttggagcggcatccggaattttccgtgcagcaggtgccgacgccggaaaaactcagtccggcacatccggaatgggcggaaaacggaaatccggatacacgccatgcgtttcgcctgtggccgcataagctggatggggaggggcatttcgccgccgtcctgcacaaaaacacgggcggcagatgcgatgcacccgtattacaagaaacatacagcaaaaaagaacgggagcagcttcagacagccgagcagatgattgccgatttggtaaaacagctgccggagggcaggctggtactgcgcaaggataagctgtggctgctgccggaagcgtgccagttggatgtaaccggtctgaaaatcaagcgcatgggcatcgaaatcggcacgctcaaaaagaaccgtctggaaccggcacatgccttggcacatgcgctcgcgccggagcattttttacaggtgtgcaatctgagcgcggcggacggctctgcggaggcatatttgcgcggcgaaaccttcccgtatgacggacagaagggctggacggcggttgccgcggacggctttgtcatgggctggggcaaatgtgccggcggtaccatgaaaaatcattacccaaagggactgcgttgggtcggaaagtaa

SEQ ID NO: 1683 - DNA, 900 bp, Unknown
  Description of Unknown: Clostridiales sequence
atggcaaatccggttcttgtcgttatggctgccggcatgggctcccgctacggcggtctaaagcaaatcgatccggtcggcccgaacggacagatcatcatgcactattccatctacgatgcgtggaaggctggcttccgccgcgtggtatttattataaaagaggaactgctcgacgcattccgcgagcgcatcggcaacgccgccgaaaagctcatgcaggtagattatgtattccagtctccggacaagctgccggagggctgcaccatgccggaaggccgcaccaagccgctcggcaccggccacgccatttactgcgtgcgcggtgttgtcagcgagccgtttgccgtcatcaatgccgatgatttctacggcgcacaggcattccagtgcttatatgactatctgaaggacgcacaggacgatgacaagtatcggtactgcatggtcggctaccgcgtagaaaacacgctgacggaaaacggcacggtatcgcgcggcatctgcgaggcagatgaaaacggctatctggcagacatcgtagagcgcaccgccatttcccgcgatgcaaacggcgtgatttcggatccggaggccggcgaaatcgcagagggcacgctggtgtccatgaacatgtggggctttacgccgtccttcctcgatgagctggaaaccggtctgcgcaccttcatgacggacgagctgccgaaaaatccggcaaagggcgagtactatctgccgttcgccgtcgatcatctgattcagaacggacaggccaccgcaaaggttctgcaaacctctgcacagtggtacggcgttacatacaaagaggacaagcctgtcgttgtggacgccctgcgccgcatgacagaagccggtttgtatccggcagaataa

SEQ ID NO: 1684 - DNA, 1662 bp, Unknown
  Description of Unknown: Clostridiales sequence
gtggattttcacttgccaaagaaaaagatattttccgcggtgctgtgcggcgctctgatgctttctgcgagcgtgccggcgttcgcgtttagtgatagctcgattgcatccagcgtatttgaggaaacccagatgactgttgaacaggcagccgctgcaggcaacggtgcggatctgtcgcagagtccgtatgtgctcaagcgcttgggtctggttgcaggcaatgacaagggagatttgatgctggataaagttggcacacgtgcagaggcactgacgctgtttatcagcatgcagggtgagcaggacgaagcgcgcgctgtcgattactcgtatccgtttacggatattccggattggtttcattggtgcgcgggctacggtgtattccgcagctataccagcggcatcagtgcgacaaagtttggttcctttgatacggtgacgccggaacagtacatgacatttacgctcaaggcactggattacaagtgcggcgaggattttacatgggaccgctctttggacaaggcgatagaaattggtctgtgcacccgcgcacaggcaaatgcttggaaaaacggacagttccgccgacaggagattatggaaatctcatatttggcgctccacaccaaggtcaagggcggcaatagcacgctgaccgacaagctgattgcaaagggcaagattacgacagagcaggcgcgtcaggagtctttgacgtttggcaccgcctatcaggcacagcaggaacagaacaatgcgtctccgattacctgcaccaatgtgccggacggcagctatgagctgcacagtgcggcaaacaacagcgtcatgacagcatccgccaacaagcaggcgatgatttctctggcagcggataaagacggcgcagatcagcagttcacctttgtgaagaacagcgacggcagcttccgcatcgccagcacggcaaacaaagacctcgttatggacaccaacccgacgagcggtgcagcggctctgctgtggacacagaacggcacgatttgtcaggattttgtggcagtcggagaggcaaacgacgcatattctttccgcttggcgaacaatccctcgatgacgctgaccgcatccggctccggcgtgtcgctgcaggcatataccggcagtgcatcccagcagtggaagctgtccaacaattcggaggacaccgcatcggcttccgcaaagctggcttctattatgacggtacatccgaacggaaagaacttgggcagcagctactcctttgcgggcgcaagccagtgcatgggattcggcagagaagttttctaccgcatgtatgatcagcaggcacgctggaattatgacggcagcccgaagtccgcgagcgatggcaagatgtattctatcaaggcgtcttccacttcatattctgcaagcagcatcaagggcgtgatcagcaaggcaaagccgggtgacgtgcttcagatgaacaaaccgaagatgcacacgatgattttcgtatccagcgatgcagacggctttaccgtatatgatgcaaactggacggcggcaaacaccgtcagcgtgcgttacgtcaagtacggcgcatgggcgagccgcaacagctccggcatcacgctgctgcatgcgaccaattatccgaaaaactaa

SEQ ID NO: 1685 - DNA, 1485 bp, Unknown
  Description of Unknown: Clostridiales sequence
atgatggcaggaggagacaagatgataaaacgcatcgcaggcatggtggcggtatcggtcgtgctgagcggcgccattgcgctgtacgcgccggcgctcaccacgcggcagacacaatcggacgaaaatgccgagccgcagatgactttgcagcctgctgcacaacaggttgcctataccattcctgagcggatttcggcagacttggcgggtggtgcgcaggacgtcctgcagcctgatgcggcgtataaaaaaatctttccctatgcggcaagcatcgtcggctggaaggatgacggcacgccggtgtatcgatatgccatagcagatgcagacggagaacagctgacgcaggcagtgtacacgcaggcgcagcgcgcgctgtgcggcagcaaacaggtatggctgctcacatctgttgccgcggacggcagcacgcagatgacctgtgcggcagacgatggcagttgggtcatcgggccgattacaggcacgattgcggtaaaagacagctgtattttgcggcaattatccggcgaaagcgtcacgacggtgtacaatggggacggcaaaagtctgggcagcgtgatgggttccatgcaatcctgcgcagacggcgttctggtcagtgaacaggagctggacggcaaaaaaacgtggtatttttatgatgcgtcgacgatggcggcgctgacgcagattgatgccgtgcaggtcggtacgttttccggcggcagtgcaaccgtgcaggtctcggaaggtcagtggggagccgtaaacaagaagggcgtcattaccctgttcaaccgcgtcgcctgggcggatgaaatgcgcggcggctatgcgctggcgaaagacacaaacggcaaattcggcgtcgtcgatgcggcgggaaaagtcgttttggattttacatacagcaacggcaagcactgcagtgacagcgaggcactgtatcagctgtggacggcgcaggacagctgcgaagtggtcagcgtgggctggaaaaataaaaaattagttttgccgagcgatgtcaagggacaagagctgacaccgcttccggataattatttcgcgtataccaacgcggcgggacattccgtgatttttgatgatctcaaaagtatcgaattagaaggtgaagcggtgttttatcagcaaaatggcaagctgattggcgcgatgagcgaaggctaccagatttttgatttggatgaggaaacgctcagcggactgcggacgtatgcatacatggcatgcgacacggaagccgtggagaaagacggttacttcacgattgtcaatccggtgaccggattgcagggaatcggcaatacaaaggccaagacagtactgcgcgcgggctatgacagcattgaaagtgtcggtggcggatattttaccgccgtacaaaacggctggacaggaattatagactcgcacggaacatggatgctgcggacacagctgaccggcgtgtaa

SEQ ID NO: 1686 - DNA, 1038 bp, Unknown
  Description of Unknown: Clostridiales sequence
atgaaactgaagcgaacaatggcgattttgatggcaggtgtgacatgtgccggcgcgctggcaggctgcggcggttccggttcgaaggataccggttcggctgcttccaacagcggcggtctgacggaactgacattcgttatggcgtcccgcgatgaatttatgtcgtcgattgaagaagcaatggtagcggaagcagaaccgctcggctataagattgtatcgcaggacgcgcagaacgactcgtccaagcagatccagtacatcgaaaccgcagtaaatggcggcgcggaagcggttatctgtttgccggttgacgcagacggcacgcagtctttgattgatgcagtgggcgaaaagaaccttgtgtttgtaaaccgtccgcctacgaattattccgaattggcagcggacaatgtaacctatgttggttccaatgaggacacctccggttactatcagggcgaatatctggcaaactacttcaagcagaagggccagaaggaagtgaagtacctgatgattcagggcacactgggtcaggtttctaccaccaagcgttcggaaggcgttatcaaggcgctcaaggacaatggcatcaatccggtagaggcttccgctccggttgttgcggactatgaccgtccgactgcacaggaaatgattcagccgctgctgacttccggcaaggaatttgattgcatcattgcgaacaatgacgctatggcactgggtgcaatagaagcgtgcaaggatgctggtgtggaaatcaacttcccgatcgttggtatcgactgcacggctgacggcgcaaaggctgttcaggacggagatatggctatgaccgtattccagaatccggtaggacagggcaagggcgcggtcattgctgcggacaacatgattaacggcaagaagctgggcactggtatggaagaactcggtgcactggatacttccggcaaggattacagcgattcgattttctggattccgtttgagccggtaaccaaggacaacgtagctgattacatgtaa

SEQ ID NO: 1687 - DNA, 1212 bp, Unknown
  Description of Unknown: Clostridiales sequence
atgttgaaagctgcaattttgggttttggaaccgtcggttccggcacccttgaagttcttgagcgcaatgcggacaccattgcccgcaatgcaggagaggcaatcgaagtaaaatatattctggatctgcgcgattttccgaacgaaccgcatcaggagcgatttgtcaaggattttgccgtcattgaaaatgatccggaggtcagcatcgtcatcgagaccatgggcggcaagggcgcagcctatacctttaccaagcgcagcttggaagcaggaaaaaatgtcgtcacgtccaataaggaattggtggcaacacacggcgcagagctgctggaggttgcggcacagaaaaacgtcaattatctgtttgaggcatccgttggcggcggcattccgattatccgcccgatgcagcgctgcctgaccgcaaaccatctgacgcagattaccggcattctcaacggcacgaccaactatatcctgaaccgcatgattgacggcggcttggactttgcgaccgcgctcaaggaagcacaggagctcggctatgcagaggcaaatccggcagctgacgtagagggcattgatgcctgccgcaaggtttgtattttggcggacatcgcatacggagacaacgtggcgccggaaaaggttgagaccgaaggcattacggcgattacgctgcaggatgttgcatatgcagagcaggctgacagtgttgtcaagctgctgggcagaaccgttttgcaggaggacggcacgttctatgcgtttgtggctccgcattttgtcaagaagagcagcccgcttgcctgcgtgaccggcgtgtttaacggcattctcgtgaccggcgatatgctcggcgatgcgatgttttacggtcagggcgccggcaagctcgcaaccgcttccgctgttgctgccgacgtcatcgactgcgcagtacacaaaaacaagcgccgcaacattggctggggtgacggcagcaaaaatctggttcgttcgcttgacacgttcgcttcaaactggtatattcgcgtacagggagcagatgccgcagacaagctggcacaggcgttcccgaacagcaaggtgctggagccggtacaggcagaagaagctgctgtcctgactgatgttctgacgactgctgaaatgaatgaaaagaaagcacagctcggcaatgttctgggctgcatgaggctgctgtga

SEQ ID NO: 1688 - DNA, 936 bp, Unknown
  Description of Unknown: Clostridiales sequence
atgaacaatcttttaaagctgctcgactgctccaaggatgatatcatcaacattctggacttggcagatcagctcaagtacgaaaagaaacacaacattccgcatcgccatctggaaggcaagagcctcggcatgattttccagaagttctcgacgcgcacacgtgtttcgtttgaaaccggcatgtatcagctgggcggtcaggcgctgtttctgaccaaccacgacttgcagatcggccgcggcgagctggtcaaggacaccgcgcgcgtgctgtctcggtatctggacggcattgtcatccgcacctacgatcaggaagaggcggaaatcttggcggactgcggcagcattccggtcatcaatggcctgacgaattttgcacatccgtgtcaggtgctcgccgatctcatgaccgtgcgcgagcattttgcgcagctggaaggtttgaagatgggctttgtcggtgacggattcaacatgtgcaattctctgattgtcggctgtctgaaggtcggcatgaaggtgtcggtggcaacgccggagggctatgagccggacgccaaggtgctggcattcgcagaggagatgaaaaagcaaggcgcatcgtttgaactgagccatgacattcatcaggccgcagacaacgcagatgtcttgtttacggatgcatggattggcatgggacaggaagccgaagcagaaaagcgccgcgtggcgtttgcaggtttcacggtggatcacgacctgctgtcctgctgcaaggaaggcgtcatggtacagcactgtctgccggcacatcgcggtgaagaaatcacggatgaagtgctggaagagcatgcagatgagattttcgaagagtccgagaacagactgcacgcgcagaaggctgttatggtcatgctgatgagcgaaaaatcggattttcatatttga

SEQ ID NO: 1689 - DNA, 993 bp, Unknown
  Description of Unknown: Clostridiales sequence
atgactaagacaaagaaaaaatccaatggcaattcgttccttggcacactggcggcgctgattattctgtgtgtggtattaaccattgtcagtgataagtttttgacgtataataacttaatgtcagttttaaagcagacgacgtttaccgcgctgctgtccaccggtatgctgctgtgcttgattaccgcaggtattgatttgtcggttggcgccaacgcaacgttctgtgcttgtatctgcggcatgctcgtcaagggcggcatgaccaactcgctcgtcctcatcgtcattgcgattgtagccggcacactgatcggtctgattaacggcttgctgctgacacgtctgcacctgccgcatccgttcgtatccaccttgggcatgaagaactttctgtggggcgcatcgcttctggttgtatcctcgcagatggtatccggttttccggacggtgtcatggcactgggctctgcgacaattggcggtttcccagtcagctttatcattgttgtagttatttacatcatcatgcacatcctgctgacccgcacttctctgggccgctccatctactgtgcaggcggcaacatggaagcaacccgtttgtccggcatcaatgcaccgaacgtgctgaccttctgctatgcgctgtccggctttatggcagctctggcaggcatcgtatccataggccgttccggtatctgcaacggtgccaatgccattcagccgtatgataccgatgcaatcgcagcgtgtgttatcggcggcgcatcgttcatgggcggcaagggcacgatgatcggcaccatgatcggcgcgctgattatcgcaaccctgcgcaacggcttcaccctgctgtctatcgattccgcagtacagaacatggtgctcggtctcgttatcatcggtgcagttctccttgatgtcacccgtgagtctatggctgttaaggctcgccgcaaggaagctgctgcaaaggcaaagtaa

SEQ ID NO: 1690 - DNA, 792 bp, Unknown
  Description of Unknown: Clostridiales sequence
atgaaatacacagcaaaagccccatttgacaagggctataataagatggtttccgcagtagacaatccggaaatgatgggcatggagttcggcgttgtcaagatgacagcaggcgacatcatgaattttgactatgcacaggaagttgtttacgatctgatgagcggcacagtcaccttcgcttgggaaggcaagaccgagaccgtaacccgtaaggactgcttccatgagggcgcaattctgctgcacgttccgcagaacaccgctgtcaccatcacttgcggcgcagacgcagaaatcgcagtggcacgcaccgaaaacaagcgcagctttgcttcccgcctcatgcgtccggaggactgcctgagcgcaaacgaggagcgcggcgcaggtcagatgaacgagtgctccacccgtctggttcgtactttctttgatcgctccaactgcccggagaccaatttcttcatcggcgaagtagtgcacttcccaggcaagtggtcttcttacccaccgcatcagcatgtagagccggagctgtattactacaagttcctgccggaaaacggctatggtctggctgagtacggcgatgacgcatttaaggtaaagaacaatgatctgaccggtatgccggagaatgttacccattctcagtgcgcagcaccgggctatgcagagtactatctgtggtgcatccgtctgcaggacgacaagaacattgtgaccacggttgtgccggaatacgagtgggtaaccgcagccgacgcaaagtatttcccagagatttaa

SEQ ID NO: 1691 - DNA, 894 bp, Unknown
  Description of Unknown: Clostridiales sequence
atggtagcaatcattttgattttgattgtgttggttgtattgatttccaatatcaaaatcgttccgcaggcaaaagcgtatacgattgaacgattgggagcgtatcgcggcacgtggcagacgggtctgcattttaaaatcccgctgattgagcgcgtcgcacgccgtgtaacgctcaaagagcaggtggttgattttgaaccgcagccggttatcaccaaggataacgttaccatgcagattgacacggttgtatattttcagatcacagatccgaagctgtttacttatggcgtagaaagtccgatggcggcaattgaaaacctgacggcaacaacgctgcgaaacatcatcggcgacttggagctggatgaaacactgacatcccgcgatgtcatcaacaccaaaatgcgcacgattttggacgaagcaaccgatgcgtggggcattaaggtcaaccgtgtggagctgaaaaacatcatcccgccaaaggcgattcaggaatccatggagaagcagatgaaggcagagcgcgaacgccgcgaggccattctggttgcagaaggtcagaagcagtctgcgattctggttgcacagggtgaaaaggaatctatggttctgcgtgcagatgcaaagcgggaagcacagattaaggaagcacagggtcaggcagaagccctgatgaccgtacagaaggcactggcggactctctggtactgctcaatgaagcagcaccgaatgacaaggttcttcgcctgaaggcgctggaagcatttaccaaggcggcagacggcaaggcaacaaagattatcattccgtcggaaattcagggaatggcaggtttggcaacctctctgcaggaggtatggcagacgccaagcccgaaggaatag

SEQ ID NO: 1692 - DNA, 1284 bp, Unknown
  Description of Unknown: Clostridiales sequence
atggtaacgagactagagcgccgcgtgtgtccgcatgcggtgtccggcaagatgttctggctgtgcgccatcacgtatattatcgctttattcggaagaatgagttattccgcggtgatggttgcactgattgcaaacggcagtatggatgaggcacaggcgggactcatcggcacggcgttgtttatcgtgtacggcgtgtcgcagattttcagcggcttaattggtgaccgcatcagcccgaaaaagatgatttttgtgggcttgattggatccggtattttgaatctcatcatgggtttgaccggacaatatgcggtcatgctggtggtctgggcgctcaacggattgtttcagtcaaccatgtggtctcccattgcacgtatttttgccgagcagatgccgccggatgagcgcaaaaaatgctgcaataacatcgcggtgacctatccgctggcgacaattctcgcctatgtgctggcaacggtattgctgacggcttggaactggcgcggcgtatttttgctggcgggcggcatgattattattacgggcatcaactggatgattcgcatgagctggtttgaaaaacagatagaaaccagtgatgaaatcgaagtgattgagctgcagccgaagcagacacagaaaaaagaaaacatgctgcgtttgctgctgctctccggcattgtgctggcgacgattccggctatgacgcacggtatgctgcgcgatggcatccagacttggctgccgaccttgatgacgcagaatttccactttggcacgtcagcgtctgttgcgctggatattatcattccggtgtttaatatgctgggtgtgttctttaccaaggcgctgccgaaaaaatggacggaaaacgaactcaaagcgtctgcggcattttttgccgtgacgattatcgcgttgattgtgctggatttggtttgcaatgtcagcgccgtgctgtcgctgattctgctgactgtagcaagtacctgtatgacaggcgcaaatatcatgttaatcaatttaattccggtgcattttggcgtagtcggacgcgcttcatctgtgacgggtattttgaattgttcggcatatgttggttcggcgatttccagttttggtgtcggcgcagtcgcacaaaattttggctgggggtcagccattgcggtttggatcggcttttcgctgcttgcgctgctggcatcgctgggcggatgcaggcgctggggcgtgtatgaacatcgcttagacaaccgcgagcgcgcaaaatcataa

SEQ ID NO: 1693 - DNA, 909 bp, Unknown
  Description of Unknown: Clostridiales sequence
atgaaaaagcgacacaattttttatgggttatcacagcgatggtactggtcgcctttgcattcagcaaggaatttttacctgccacccatcccgataataccctctccaacacactcgcaggcacatctgccgccgatgcaaccgacctgcattttatcaatgtcgggcagggcgatgcggaactcatcgtctgcggagaggatgccgtcctcattgacggcggcaaggcatccgcaggaagcactgtggtcgattatctgtctcggcagggcattgccgagctggatgccgtcatcgccacccatccgcacgaagatcatatcggcggcctcatcaatgtgctggatgcatttcaggtcgatgccttctacatgtcagatgaagccatggacacggacatttacgaaaatttgcttgatgccattgacgacgagggcattcagccgcagttccccgacatcggcgatgtcattccgattggtgacagcggtgccaagctgactgttctcgccccgggaccggacagcgcagacacatacagcaaaaacgacccgaatacctggtctctggtctgtcggctggacgcgaacggatgcagcgccctctttaccggcgataccaccgccgctgttgagaaaaccatgctgcgtaccgagccccatctgctgaactgcgatgtcttaaaggtcgcacatcacggctcgcgcaccgcatcttccaaggattttatacaggctgtctctccgtcctacgccgtgatttcttatgcgcagggcaattcatacggcctgccaaacaacgaagtatttgaatatttgaaaccgctcggcacaaaaatctatgagaccgccaaggacggcacggtggttctccagctgaaaaacggacaggtgagtgttgcatcatga

SEQ ID NO: 1694 - DNA, 1461 bp, Unknown
  Description of Unknown: Clostridiales sequence
atgcgaaaaaataccaaacggctgcttttgggtctggtcgccgtcgccattctcggcggtgtttacgccggactcatgcacatgccggacgaacaggacacctccagcgagagcaaaacgctggtgtctgcggacgcagatgcattgtccagcattcatgtcgcgctgagcggcggcgatgattacacgctgaccagtacaacaaaaaacaaaaagaccacctataccatgtccggcacgcaggacaccagcgcatacagcgacagtctgatgcaaaacctcttttccaccgccagctccatctccggcaccgtggttgaggaatcctgctcggatttatcaaaatacggtctggcgggcagcgattccatcagtaccgtagcgattaccgatacagacggcaaaaccaccaccctgcggtttggtgtatccagtgatgtcgtgagcggcacctattgcaatctagacggcaaaaacgatgtctatctagtggacagcgacacagcatccgctctgttggagcaggaatcctattaccgcaacctgaccgtgctcggcagctattacagcttatcttccgagctgcaaagtctgaccgtcgatgcgcttgcagacggaacggttctgaccgtgcaggcgcgggacacctccgacatggatgagacaaccgccaaagcctattctgattttgtctttaccgcaccggaatcctgcgatgcagacgattctgagctgaaaaacggcttgttgtccgacttacagacgctgctcaccgcacagtcgattgccgcagacaatccatcggatttgagtccatacggcttggacaatccaaccgcccgcgtacacatcaaaaccaacagcatggatgccacggttctcatcggcagcgtcacagacgacaacagcggccgctatgtcatgaaagaaggcggttccacggtctttgtgtccgatgcttccggctgcggctttctcagtgacgattggagcgattggcgctctgccaatttgatgccgttctcgctgaacgaagtgtctcaaattaccgtcacacaaaacggcaccacacacgcggttgccgtgacacaggaatcttccgatgaagacgatgaagacgccgagagcgaggacagctccaacacagacagcagtgatacggattcctccgatgtctctcaaaccgccgcactggacggagagaccatgagcacggaagccttgcagcagctgtataccgcattggattccatcaattacacgcgcattgtcgacgccccaactgcacagcaggcgcaagcaacggtcacgctgacgatgacagacggcacgacccgttcgctatcgttcgccaagggcggttctcgggaatatctggtcagcgtaaacggcggcgcctacgcctacggcgtgcagcaggatgaactgaccagcatcactgacgcactgacaacgaagtaa

SEQ ID NO: 1695 - DNA, 909 bp, Unknown
  Description of Unknown: Clostridiales sequence
atgcgatgcccctattgcggtgtcaattatacagacggagagcgccagtgcccgatctgcggcaaacgtgccccgctcaatgccccaaagaaaaagaaaacgattgatttcggcatttctcgcgaatccgaggaagcgaactatacagccaaatccactgaacgaaagcaaacctatcgagattcgtccaatgcgtttcaggacatccccaaacgcgagcagaaagagaaaccggatgcagagtccgcttggcagcgtgccgcccgcggcgaacactctcacggcaatccgctcgaacccaagaagaaaaacggttgcggcataggctgcctgcttgttgtgattgtttttattgtcatcagcatactcggttcgctttctttcgattttgcatccaacacacaggaggagctggaaaatgtgattgattctgtacttgaggaaaccgacggttcgcacacggatgacacgtatcaggcgatagacatgccgtccatcctgaacggcatctggaaaaacagcgatgcttcactttcgctcaccattgacaacggtgtggttgcatggaaaaatgcagacggcagctttacaacggattccccgacactgtatcagctccatttgacggaagataatattttggattatctttcggaggatttgcaggaaaagtacccgctcagtcaatatacctattacgatttgacctgttggggaactgacgattccgacgatgacgatgagcattatatcgaaatgattctgtttgtgcctcaagatgccgcacagctgtattcgttcgactactacgactgcgatacatacaagaccgacacgatgaccaaaggcggcgttcgctccaagcaggtcggcgatccgtccgctgttccggcagagcaatccacataa

SEQ ID NO: 1696 - DNA, 2163 bp, Unknown
  Description of Unknown: Clostridiales sequence
aagaagcaggaaggcaagaagccggcgcagcacactgccgctgcagaggaaaagaagttcaacaacgacaagaagaagaaccatcgtcaggcaaagccgcatgagcagcgccagattctgcgtccgcagggctccggcgaggcggcaacgtctaccgttacgaccgaggagcacaagcagccgaagggcaagcagattcaccgcgtcgatacccgcggcgcaggcaatgtcaatctggatcgttacgacgaccgcattgacgcgctggttccgcagaaggctgaccgcatgaagtcgggcaagcagaaaatcacccgcaaggcggatgcacgcagaccgttctccaacaagcgccgtcaggaggagcaggagaagatgaagcgcctgcagcgtcagcaggagctcaagaagattcagctcaaggttatgattccggatgaaatcaatgtcggcgagctggcttcccgcctgaagcgcaccgcagcagacgtcatcaaggagctgctcaagctgggcgttatggcaaatatttctcagaccatcgactttgatacggcggcaatcgttgcagaggaaatgggcgcaaaggttgagaaggaagtacacgttaccatcgaagaaaagctgtttgatgagagcgaggacaaggaagaaaatctggagccgagaagcccggttatcgttgtcatgggtcacgttgaccatggtaagacgtccctgctcgaccgcatccgcaagaccgatgttgcagcaggcgaggccggcggcatcacccagcacatcggcgcataccgcgtcaaggtaaacggccgtccgattaccttcctggataccccgggtcatgcggcatttacttccatgcgtgcgcgcggcgcaaagattacggatattgccattctggttgtcgcagcagatgacggcatcatgccgcagaccatcgaggcaatcaaccacgcaaaggcagcagagattccgattatcgtcgctgtcaataagattgataaggaaaacgcagatccggatcgcgtgctgcagcagctgaccgagcacggtctggtaccggaagaatggggcggcgaaaccatcgtctgcaagatttccgcaaagcagggcatcggcatcgaaaacctgcttgaaatggttctgctgaccgcagatatgcaggagctgaaggcaaacccgaaccgtcaggcaaagggcgctgtcatcgaggcaaagctggatcgcggccgcggtccggttgctaccgtcctcgtacagaacggtaccctgcactccggtgacaccgtcattgcgggcaaagcagtcggccgtgttcgtgtcatgaccgacgagcgcggacgcaagctggaaaatgccggtccgtctgttccggttgagattatcggtctgggcgaagtgccggatgccggtgacatcttctacgctgttgacaacgagcgtatggctcgtgagttggttgagcagcgcaaggagaaggagaaggaagaacgcaacaaggccatgcagaaggttacgctggagaatctgtttgacaccatccagcagggcaacatgaaggagctcaacatcatcatcaaggctgacgtgatgggctctgtcgaggcggttcgcagctccctgctcaagctgagcaacgaggaagtgcgcgtcaatgtcattcatggtgctgttggtgccatcaatgaatccgacgtaatgctggcagcggcatccaatgccattattgtcggctttaacgtgcgtccggagcgtgtagcagcggattccgcacacgatcaggatgtagaaatccgtctgtaccgcgtcatttacgactgcatcgaggagatggagcaggcaatgaagggcatgctcgatccgaagttcaaggaagttgttgtcggccacgccgagattcgtcagacctttaaggtctccggtatcggcacgattgccggtgcatacgtacaggacggcaagattgtccgttcttgcgaggttcgcattgtgcgtgacggcatcgtcattcatgagggccacctgaactccctgaagcgcttcaaggacgatgcaaaggaagttaccgcaggctatgagtgcggcatgggcattgagaactacaacgatctgaaggaaggcgacatcatcgagtccttcgttatggagcagatcaagccgtaa

SEQ ID NO: 1697 - DNA, 1167 bp, Unknown
  Description of Unknown: Clostridiales sequence
atggcatttcgtaaggtaacagacagcattctgtatgtcggtgtcaacgaccacgaggtagatctgttcgagggacagtatgtggtaccgaatggcatggcgtacaattcctatgtgattctggacgacaagattgccgtcatggacacggtagacatccatttcgcacaggagtggctgaacaatatcgcagaggcgctggacggcaagaagccgacctatctcgtagtacagcacatggagccggatcattctgcaagcatcgcagaatttttgaaggtgtatccggatgcaattgtcgtaggcaatgcaaagacctttgttatgatgcagcagttctttggggcagacgttgcgccgaaccgcgaggttgttgccaataagggaaccttggagctgggcagccatacgctgacgtttgttttcgctccgatggtacattggccggaagttatggtcacatatgatgctgccgataaggttctgttctccgcagacggcttcggcaagtttggcgcactggacgtagaggaagattgggactgtgaggcacgccgctattacatcggcatcgtcggtaagtacggtgcgcaggtgcaggctctgctcaaggtggcagcaacgctggatattcagattatctgcccgctgcacggtccggtgctgactgagaatctgggtcactacattgaaaagtatgacatctggtcctcctacaaggtagaatccgagggcgtgatgatcgcctatgcatcggtttacggcaacaccaagaaggcggcagaaaagctggcagagacactgaaggcaaagggctgcccgaaggttgttctgagagatctggcacgcagcgatatgtcggaaaacattgaggatgcgttccgttacggcaagctggtgctggcttccattacatacaacggagatgtattcccgttcatgcatgccttcctgcatggcctgaccgagagaagctatcagaaccgcacccttggcgtgattgaaaacggcacttgggcgccgacagcaggccgcattatcaagtctgcgtttgaaaagagcaagaacatcacgtggctggacacgacggttaccatcaagtctgcaatgaatgcagcaaatgacgcacagatcgaggcaatggccgacgaactgatgaagggataa

SEQ ID NO: 1698 - DNA, 1878 bp, Unknown
  Description of Unknown: Clostridiales sequence
ttgtgtgcgataaaaacattttgtaattttggtaaattatccttcaaatttcctgtgaaatgctgtataatttttctagagatatcttctgtttcaacagaagaaaaattctatgaaaaaaataaaataggaaatatgaggtgttttgaaatgggctatatggaagaatatcgcaagtggatggaatctccggctttgaccgcagaggaacatgcggaattggcagctctggagggcaatgagaaggaaattcaggagcgattttttgcaccgctctccttcggcacagcgggtctgcgcggcacgatgggcattggtctgtataaaatgaatcgttttactgtcggtgcagcaacgcagggtctggcaaatttgattaagcagtatggcccgcgtgctatgcagcgcggtgtagcaattgcctgcgacagccgtctgcattcggatgagtactctcatctggcagccagcattctggcagcgaacggcatcaatgtcattgagtatgaatccctgcgtccggttccggtgctttcgtttgcggttcgtacatatggcacccttgcaggcgttatggtcactgcatcccacaacccgaaggagtacaacggctacaaggtttactgggaggacggcgcacagctgccgccgaaggaagctgacgttgtggcaaaggaaatggacgcgctggacatgtttactgatgtcaagaccatggatcatcaggaagccattgacaagggtttgattaagattatcggaccggaatccgatgagatttacctgcgtcagattcagaagatgagcatcaatccggactgcatcgcacaggttgccgatgacttcaagattatttacacgccgttccacggtgcgggctacaagctggttccggaaatcctcaagcgcatcggctacaagcacgtgatttgtgtgccggagcagatggtcattgacggcaacttcccgaccgtaaagtctccgaatccggagaacaaggaaggctttaatctggctatcgagatggcaaagcagcagggtgttgacctgattatcggcacggatccggactccgaccgctgcggcaccgtgctcaagagcagcaccggtgactatgtcacgctgagcggcaaccagatgggcgtgctgctgattgactacatcatcacggcaaagaagctgaccaacaccatgccgccgcatccggcagtgctcaagtctgttgtttctaccgaaatggcacgcaaggttgccaacgacaacggcgttgcttgctttgatacgtttaccggcttcaagttcctggcggagaagatcaaggaattcgaagcaaccggttcgcatcagtacctgttcgcctttgaggagtcttatggctacctgtgcggcgaccatgcccgcgacaaggacgctgtcattgcatccatgctgattgcagagatggctgcttattaccgcaccaagggcatgaccctgtacgatgcaatgcaggacatgtacaagcgttacggctactatgcagaagaaactctgtccatcgtgatgccgggcgtatccggtctgacccgcatggcagagctgatgaaggagctgcgtgagaccccgctcaaggaagttggcggaaccgcagtaaaggacgttcgcgacttgcagtccggcatccagaccgagctggcaactggcgcacagaccgaagtagagctgaagggtcagaacgttctgtattacgatctggaggacggcacgagcttcatcatccgtccgtctggcaccgagccgaaggtcaaggtttacatcatggcaaacggcaaggaaaaggcagaagtagacgcaaagattgaaaagtacgcggctgctgcaaaggaaatcgtgaagtaa

SEQ ID NO: 1699 - DNA, 795 bp, Unknown
  Description of Unknown: Clostridiales sequence
atggcgagtacaaacgatatcatcagcggcattgcgcgcacacaggaagaacgaattttgctcacgcagatcgcgcagaaggcggagacctgccgtgaaaagtgctatctgacgcacacaaaatttttggatatgcacgaggcggcgctggcagatcggctgctgcgcggtctgggagaacgcggtattttctggggcggatatgagcaggcggaacgccgcatggtcttttttctgccggaatggatggatgccgtgcccacagagggagaggactgcccgattgttgtcattcgctgtttgcgcagcaaaaatgacgcgctgacgcatcgggattatctcggttcgctgatgggcttgggactgcgccgcgacggcatcggagatattttggtcagcgaacacggcgcagatattctcgtgctcaaagacattgcgccgtatctgctcatgcattacagccaagcgggacgcaagcatttgcagacggaagaaattccgctcacgcaattgattgttcccgaagaaaaagtgaccatgctgcgcgatacggtcgcatctatgcggctggatgccgtgacggcatcgctgttccgcatgtcgcgcgccaaggcggcggacgccatccgtgcaggaaaagtgtttgtcaatcagcaggaatgtatccatacagacaaagaaattgcggtgcatgaccgcattacgctgcgcggcaccggacgcggagagattgcggaaattttaggcgagagcaaaaaggggcgtgtcgtgctgtcgctcaagcgatttggatga

SEQ ID NO: 1700 - DNA, 831 bp, Unknown
  Description of Unknown: Clostridiales sequence
atggacattgtcaagaccattccgattctctttgttgtatatctggtcatcagctggatggaaaatcatatggatgcggtaacccgcgtggtcacgagcacagagccggcagggccggtcatcggcgcattgattggcgcgattccgcagtgcggcttttcaatgggctgctcggtgctgtattgccgcggatttctggcgcctgccacgctgattgccgtgtatttgtccacatccgatgaggcaattccggttttattcgcgggcggctgcagctggaaagaaattgtgctgctcattgccgtaaaaatcgtcattgcgattgtcgccggttatctgttttatctgttctggttccgcaagcactggaacattgacgactggccggaggacgatgagctggacatgaacgaggtcaatgcgagctgttcctgctgcggcggccaatcgctgtggcgctcggcgctcattcgcacggcaaacaccacagtttttctcgtcatcacgatgttgattctcaacacgattatttatctgctcggtgcagattcgctggcggcgattttgctgcaaggctctcgcctgcagccggtgctgtgtgcgctgatcggattgattccgggctgtgccgtgtcggtgttgctcgtgcagctgtttaccgcaggtaccatcagctttggcagtgtgattgccggactttccgccggtgcgggctttggttttattttgctgctgcgcgaagcgccgtgcaaaaaatccgcttggcagattatcggctgcacgtatgcggcagccgttgcggcgggactgctgatagattgtattatataa

SEQ ID NO: 1701 - DNA, 2571 bp, Fusobacterium sp.
atgaacaaaaagcagttatttattgcggctgtagctgcagtattatccgtttccggggtaaatgccagcgttattacaggcgttgaaggtaacggaggtattttcaatattaatcccgaacatgtaaacggtgatgtaggctacagacaatatgaccagtttgaactttctaaaggcgatattgcgaacttaatttataaatatggtcaaagagatcttgaaacttttattaaccttgttgacggacaagtgaaaatcgacggtatattaaatactatgcgtgacggtaacttttataacggacacgctatattcatttctcctaacggaatggtcgtgggcgcaagcggcgtacttaacgtaggttcattatcagttgttactcctacagatgataaatataatactttaaaaggcgattatgcagccagaaactatactaatattaatcaaatttctaagctgaaacaggacagcaacgctgatatcacaattgcaggtaaagtatttgcaagaaacggtgttgaccttcgcggtgcaaatattaatgtttcaggcgacatcttaaacggagtaaaagctgcagatgctctaacatctgaagctcaagccaataacttgtttaactctcttgtaaatactgacggtattgtacagggaaatgcttttgaatcaaacggaagcagcattgttattaaatcaggcggtaaaactgacgggtctaagcttgcagatgcaggaattaatatttccggcaaagttataaaccactcaggcggtgaaacggctttgactaaccatggaggaaaaggattaaccgtaacagggaacatacaggctaataacaaattaaatttatataataccaacggaaatttaaatattgcaggaaaagtttcaaacactaacgctgcattatcaatttccaacaaaggcggagatcttgacatcggaaataaagcaaacatctcgacagataacgcccttgaaatcgtaaataacggaacaggacaccttgcaattgccggtaaagctgtttcaaccggtaaaactgatattgttaatgaaggtaaaggcggcatgaatatttcgggaactgtcggcaacacgtcaactccttccgtcagaatagttaaccgtaacggagaacttgtaattgcttctacagcaaatgtttcagctaacgatacattaagagtggaaaattcaggttcaggaatgtccgcaaacggaactttaacagcaaataaaaaagtttcaattgaaaataaagcaggcaacttaaacattaacggcaaagttgcagttacaaaaggtgatattacaattttaaacaacggagataaattaactcttgcttctgacagtaatatcgcaggaaacggaaatgtttcaattaaaaataacggttctaacggtatgacactcgaaggaacaatcacaaatacaggtgaaacagccattaataatactaaaggacaattactggctaacggaacaattacaaacgaaggtaatatcggcattattaaccaaggtacagggcttgtaatttctaaaaatgctaaaattaccaacaaaggtacaaccaaaattgtcaacacaggtgaaaacggaatgtctgtcgtcggttctgtagacaataccggaaatttatatttctacaatgataacggccaattatcatttacaacggattccggcaacactaccgcagcaaaagttgcaaaccgtaacggaaatatttatattgcatcaagaaaagatgcaacaggtatttcttcaagctcttcaagcagtataacaaatgaaaacggtaatattattataagaaataaaggagaacaaacctccgaaaactctagaggtttagatcttcaaggaacaatttcaaataaaggcggagatgttgctatcaataacgataaaaatgatatgtacatttcaggaaacataaatgttgaaaacggaaacctcggaattataaataatgcaggagcaggcaaagctgattttgcaagcagtggcaaaattaatataacaggcggcaacgctaatattaaaaatgaaggcagcggtgatatgaccgttaacagtgaaatcactcacaacggaagattaaatattcttgggaactcaggttatttaactctcggcggcattattcacaacaacagtaacgggaatcttgatgacaacaacggtttctatgcagcatcaagagcaaacggtacaggtataaatgtaacaagcggtttcaaaggggacggcagcggtcaatacttaatcaaaaatatttccggtgataatggattgagataccagggtaatattaatacaagtgcccaagctgaattatataaccagaaaggcgatatgaccgtaggcggttcacttacaggcaaaccggctgtaatcttaaataccggagataaattgacagtaaacggaactgtatcaagcgaaacagatgcgaaagttgttaataaaggatctgcagcagctgatgtttcaaaagcaactgttaatactccgaatgaaaaatggttctatgaaaaactaaaaaaatag

SEQ ID NO: 1702 - DNA, 870 bp, Fusobacterium sp.
atgttaaatgaaaatttaaaaacaatccgtttaatttatcctcaatggcagggcggtgtagtatcacactggatgcctgatattccggaagaagattcctcacgcggatattatctgggagcacagcttttaaatatgcttgctcctcaaagttcgcaggaagtttttgaagttcctgtttctcttgatataagccacagaaccgttgagaaaggtatcacggacagaaatgctattcttcaacagacaaaggcggcacttgatattttaaaagaaaataatcccgataaaatagttactttaggcggagagtgctctgtaagtgttgtgccgtttacttatttagctgaaaaatataaagatgatgttgcaattatatggatagatgctcaccccgatataaatctgccttatgatgagtatacaggatatcatgcaatggctttaacagcatcaattggtatgggtgatgaggaattaatcgaaatgcttcctgcaaaagtcgatgcatcaaaagttttattgctcggacttcgttcatgggataaaggcatgaaagaacgtcaaaaagaacttggtattaaaggattatctcctgaagaaagccgtagttccatcgttttagactggttgaaagatacaggtgtatcaaaagtcttaattcattttgatttggatgtaattgacccgaatgatatgattgcaggcgtaggagttgagcctgacggaatgaaaacggaagatgcagtttctgtaataaacagcattgcagataactttgatttggccggcttaacggttgccgaaccaatgccgagaatagcaattaagctgcgcaatatgctttacagccttccgctgctcaaataa

SEQ ID NO: 1703 - DNA, 1110 bp, Fusobacterium sp.
atgaaaaatatattatttgtatttggcacacgccctgaggttattaaactcgctcccgtaattttggagctgaaaaaacatcctgataaatataacgttattatttgcaataccgagcagcaaaaagaactttcaaatcaaacacttgcttatttcggtttggaagctgatttaaatttggattgtatgaagcctaaccaatcgctttctgaagttcaaacacgtattcttaatgctcttgataaagtatttaacgaaaatactattgatgcaacaatagtgcaaggtgatactatgacggtactttgcggagcactggcaagtttttacagaaaaattccggtataccacgttgaagcaggtcttcgctcctatgatatttatgagccgtttcctgaagaagttatgcgccagatgacttctcgtgttgcagcacttaattttgctccgacagaaaaaaacagacaggctctattaaaagaaaatatatctgacgataaaatttttgtagtaggaaatactgtgattgatgccttattttgtttatctgataaaactttggacagtgcaagattatattttgacaacgcaggcataaaagttaatgataaattagtcttaataacagctcacagacgtgaaaatcatggtgaaaggattgacagaattctggatgcaatcgaacatctggtaaaagaatataaagaccatacctttgtcattcctgttcatccaaaccctaatgttaaagataaaatacactcaagacttagaacctatgcaaatgtaaaattgttaaaacctttagattatccatatttggtgtatttaatgaaaaatgccaaattaattttgacagattccggaggtattcaggaagaagccccgtcattcggctgcccgacacttgtaatgcgctatgaaaccgaacgtcaggaaggtattgatgcaggagtttcaattctggtcggtgcggattatgacaaaattatctcacacagtaaagaggtgctttctaaaactcgtgaagaaacaagattaaaggctcaaaatccatatggtgacggaacatcatctaaaaaaatagaagagataatcagtaagtattaa

SEQ ID NO: 1704 - DNA, 1203 bp, Fusobacterium sp.
atgaataacagttttaaatatacgtgtttatttggcggcggcgcaattcgcggagtttcatacatcggagcaataaaagcgcttgaggaactcggtataaatccttcgacgcttgcgggttcatcagtcggttcaatcattgcagctatgctcgctgttggttacactgccgaagaacttaaagaaattttccttaaagttaattttgatttatttaaagatatatctatagggcttggacctatatttgcactgagtaagggagaagtttttcttgaatgggtaagggaattaatcgaatctaaattttacggcgataagtataaaaaaggtgctaacagagcagtaacatttaaagatatagaaaaaaatcttgtacttattacaaccaacctttctaattttgaatgtaaggaattttcaagatttgaaacacctgattatgaaattgcctcagccgtcagaatatcatgctgtatgccgggacttatgaaacccattgaatataataaaacactgcttgttgacggagatttacagaaaagctggcctatgtggaagctgtccaaaaatctcctgcttaatgacgaaagaattttagaattcaggcttgaaggttactatgacacaaacgatatatccggaattgattatgcaaacgcagtctacagctgcatgaccgcaatgtcaacatcatttataacaaatatatatgctgataaagataaatttgattatatagttcttaatacgggcgatatcgtagttgtagattttaatattgccgaaaataaaagacttgaacttatacaatcaggctacaaacaaaccatgtgttactttaacagcatgcttccaaaaaagaaagctaaaataaaaaataattatgaaataatactttcacatatggttaaaattcaaaagtacattaacgcaaagaaagttataaaagctaaaattcagcttggagaactttttacggatctttgtgatttgaacggaataatagatttatcggactataacgatataaaaacatttaaaaatatgtttttaaaaagtataatttacccgcctttgttcggcaaaataacattagagaatgaaaatttaataaaggctgaattaacccgtataaacaataatttgagttctaaagtcgatgagctcgaaaaatatcttgaattatttccgctaaaataa

SEQ ID NO: 1705 - DNA, 1215 bp, Fusobacterium sp.
atggaaactaaaattactgaacttaaaaataaaatagaatttgcttataaaagaaacccgaatacaccgagagttgcattttatcttaacttctcgattaataactatcctaaaaatccggggatgtattctttactggtacgcttgtttatgcagggtaccaaaaaccgtacggctcaacaactgtcagaagaattggataagtatgctatcgaatttactgcagaattaaaacttgattatataaaatttaagtttgtatgtttgaacgaagattttgaaaaagctcttgaaatatttacagatatagtaaaaaatactacttttgaagaatttgaaaaagaacgtacaaagcttcagggagaaattattgctgaactcgactccccgcgtgcaaaaattatagacagctactataaaaatatttatgaagggcacagttatggatatacaaatacagtaattctagaaaatttgaataatattaaaaaacaagaagttattgacggttacaaaaatattcttgaaaatagtaaaaaagtttgcgcttttgtgggagatttagattttgataaagtcaataaccttctggaagaaaatcttggcgacattgcaccgtcaactcaaaatttaccttgtttagcccatcctcttcttacggaaacaaaaaatgtggaaattattcaacctgatttaaatcaggcgcatattttgaaaggctggctggtcgcttctgcagacagtgaggattatgcttctattgcactgttaaatattattctaggtgcaagcggtttatcttccagattgtttttggaacttcgcgacaaaaaagggcttgcatatgttgtaagaagtgcttatgatgttgcaagactttctgcaaacttttctatttacatagctacagagccgaacaatattgaaacttctttgaagggatttgatgaagaaatcaaaaagattaaaacaatacctgtcagtgaagaagaacttgaaaacgcaaaaaataacatattcggtaaatgggcatttatcggagaaacaaattcgcagcaggcaaattggcttgctcattacggagttatggggttcggttttgatttccatgaaaaagccgttgaaaagattaaaaaggttacaccgcaggatattattgcctgtgccaataagtactttaacgatacttatgtactgtctgtcttaaagccgtaa

SEQ ID NO: 1706 - DNA, 1089 bp, Fusobacterium sp.
ttgtttataaaatcttcttttgtaaatttttccatatttgtaataaaattattatacaataaattaaaagtatttaacaggagagatatggcaaaagaagataaaagtgtttggttaatattttttgaaggtataaaaatttattgtttaaatattcataaatttttgttatatatggcttttcctgttctggggcagttaatcggactttttttaattttcggtctgacttattggtacactcaaaatttacaggaattaactgcgaaatttccgctgttaaatgatttgtccgtaatgcttttatgcataattctctcgattattccgggacttttgatatggggaaaagctttctgggattatcttgtttcatacggtgcgttgaattctatgaccgatggttatttaaatacgggaagggtttatgattttaaggctcataactctgttgtcacacaaaaaacattttctttcatagcattatggcttttattcagtgtgtttactttaattgctgtaattccgattttttggattataggtttcgtatttttcatttattttatattgatttttcaggtgtttgcttttgaaaacggtttgtcgccggtaggatattttagaagaagtctccagcttattaaaggtaaattctcaagaacatttttgttgatgatgctgcttgttgtctttacatattattttttgacagcagggcttggtgtaatttttgatgcgctgaatattacaaaaccccttgcaaaggtttttgaagtctgggcatacggtctgccgcttgaacctcttgagccgtttcatgttacaccggctcttatcgggtcggaacttgttaaacaaattgtattttttattgtaataggttttactttgccaataagaagtatttgctggacattgtggtataacaatctcgcttctgaaactgatgttttacctgtaaagccgaaaaagaagtctaaaaaaagctcttcccaaaaagtatcagctaaaacatttaaaatagaaaaaagagggattgatcctgaaattatcagacgggcaagattggaagacgatgagtactaa

(The sequence listing continues in the following parts.)

The invention claimed is:

1. A method of treating a cancer amenable to Nivolumab or Pembrolizumab anti-PD1 antibody therapy in a patient, comprising administering to the gut of the patient a bacterial composition comprising bacteria selected from the group consisting of *Enterococcus hirae, Akkermansia muciniphila* and mixtures thereof, in combination with Nivolumab or Pembrolizumab anti-PD1 therapy.

2. The method of claim 1 wherein the bacterial composition comprises the bacterial species *Enterococcus hirae* and *Akkermansia muciniphila*.

3. The method of claim 1 wherein the bacterial composition comprises the bacterial species *Enterococcus hirae*.

4. The method of claim 1 wherein the bacterial composition comprises the bacterial species *Akkermansia muciniphila*.

* * * * *

UNITED STATES PATENT AND TRADEMARK OFFICE
CERTIFICATE OF CORRECTION

PATENT NO. : 11,684,640 B2
APPLICATION NO. : 16/472778
DATED : June 27, 2023
INVENTOR(S) : Laurence Zitvogel It is certified that error appears in the above-identified patent and that said Letters Patent is hereby corrected as shown below:

On the Title Page

Item (54) and in the Specification, Column 1, Line 6:
Insert --TREATMENT-- after "AB-BASED"

Item (73):
Delete "Insitut national de recherche pour l'agriculture, l'alimentation et l'environnement (INRAE)" and replace with "Institut national de recherche pour l'agriculture, l'alimentation et l'environnement (INRAE)"

Signed and Sealed this
Twenty-first Day of November, 2023

Katherine Kelly Vidal
*Director of the United States Patent and Trademark Office*